United States Patent 11,981,905 (POLYNUCLEOTIDE SEQUENCES AND PROTEINS ENCODED THEREBY USEFUL FOR MODIFYING PLANT CHARACTERISTICS) - sequence listing, part 8

SEQ ID NO: 20342 - DNA, 1479 bp, Panicum virgatum
  misc_feature: Ceres CLONE 1811194
gcttctccgtctgccctcaattcgatcctcttcctcgcggtcgcggctcgcggctccctctcctcctcaagaccccaacccgtcgctgaggcgggtgcggccaccgatcgacgcgtcctccctgcttcctggttcccacccgttcactgtccccgccgctcgtcacggatccatcagggatttggatcgatttggtaaggaaacctagctttgcttagatttagttggcaggatttttttcttgctgcgagaagtcgaatccacatcgttctcgatgggacgaatactccaacagtccagcttatcgcagatttggttcctgtgtgtagattgacaattgtttttgagaagcccgatctagggttttgatttgtgaaccgacgcagccccggcactgttgctctttgctgctgtctgctgtgcagctgtcgagttcttcatcttgctgttgggagctaccatggttagcatatgcagcagttgtagacttgtagccccccttttagccgattgaatcaacccatagaatcatacaaggattatcttcgatgtgatttgcactcaaggctgtttagttgattgctggaattgtgacacgggacatgtttaggctgattgctggaatatgaacaaagcagtagttaattaagaatatgaatggattttgcttttcttggtagttttaacagtgttttgggtcttccttttgatcagagattaataataatctaaaatggtgtgcagcttaggttaaaatcaagtaatattttgttgggcggaaaatacaaggcctacaccagaaggaatacccttgtgcagcagacgaagagctgtctctctgtgtagttttgtttggtttatttctttgcagttgcagggggagaatctaaacattatattggagggacaaattcgtcttgttgctttttagtttatctgttgggcattaacctagttgaacggtgtgcagatttatataggttaaaaagtgatcagtttaccaggagcaagagttagccctgatgagtactgaagtagatcacagttattttggtctttctattcactttctcctgatatttaactttttgagtaagtttgcagattaggtcttaaaaagggattgggattaggatttcttggaagggcctgagctgtataattttccagtcatacagtgggctgcacagggttaatttacaggaatattacttgttggtgatcctaaaagaagcatatgttgtgagccctggtttgttttagctgcatgtgtacctttttgtctacttagtcttgcacactgacgacctttattgaggtattcctttatccccatggtttctagataaccaaaacatgaatgtataggcactctagttcatcttatattgaagatgggtaatgatatgttttttgcttatgcttgcaagcactctgtcagccgcagaggtgaatcatggcggagcactttggctccat

SEQ ID NO: 20343 - DNA, 1228 bp, Panicum virgatum
  misc_feature: Ceres CLONE 1811197
  misc_feature: Encodes the peptide sequence at SEQ ID NO. 20344
agttggtggggaagacgatagatagggcagtatggcggcgaccttctgcgccggccccgccgcgtcagccgcggcaaaccctagctccgccggccgccgcctccagaacccagctccggcctccgtgctgcaagctcgctggagacccggccggggggctcccgcttttctgtccctccggcgccccaatgccgagctgcggccgctccgcgtcgccgctggcgctggcgttgacccgaagattgtcaatggggaagatttccctcctatgaaagacctaatccaactgtacaagaccgcttttctagatggaaatgatgaggttcttggcgaagttgagaaggcaatcactgccgtgaaaaaagagaagagtaaggtagcttctcaatttgaaagtgttacagccgaaataacttctgggaaggaaaagttcattcgcttaaatgccgatctggagaatttccggaagcagactgaaaaggagcgagcaaagtttacatcaaatatacaggtagaagttgttcagagtcttttgcctctggttgatagttttgagaagacaaatttagagaacaccccagagactgaaaaggagcaaaagatcagcacaagctatcaaggcatatacaagcagttagttgagacgctaagatttttgggtgtaggagttgttgaaacagttggcaagccatttgatccttcggtacatgaggccatcgcacgagaagaatcctcacaattcaaggcaggggttgtctcgcatgaagtctgcagagggttcctcttgaaggagaggctgctaaggcctgctactgtgaaggtttctactggctctggcaaacaaagcgcaagctcagtggaggcggccaaagatgccactgtgtgaactggttgaaagatcagctgcaactgatagccaaagcaccatttagtgagcaaccgttttctgttcataacataatggtggcatttgatctcaaatgaggttcacctatgtatacacttctggtgttgcgagttatcaccagcttgaagttttgctgttaccgtgtaatgagttatcaccagcttgaagttttgctgttactgtgtaatctgctggaattttgttcaccgaaacagtgaagtattggacatacataatcagatgtactgactgctcgatttctccagttatgagtgataaaccactcgtacaatggattcaatctaccttcttgccattggc

SEQ ID NO: 20344 - protein, 284 aa, Panicum virgatum
  misc_feature: Ceres CLONE 1811197
  misc_feature (107)..(266): Pfam Name: GrpE Pfam Description: GrpE
MAATFCAGPAASAAANPSSAGRRLQNPAPASVLQARWRPGRGAPAFLSLRRPNAELRPLRVAAGAGVDPKIVNGEDFPPMKDLIQLYKTAFLDGNDEVLGEVEKAITAVKKEKSKVASQFESVTAEITSGKEKFIRLNADLENFRKQTEKERAKFTSNIQVEVVQSLLPLVDSFEKTNLENTPETEKEQKISTSYQGIYKQLVETLRFLGVGVVETVGKPFDPSVHEAIAREESSQFKAGVVSHEVCRGFLLKERLLRPATVKVSTGSGKQSASSVEAAKDATV

SEQ ID NO: 20345 - DNA, 1133 bp, Panicum virgatum
  misc_feature: Ceres CLONE 1811210
  misc_feature: Encodes the peptide sequence at SEQ ID NO. 20346
agcagcatccggtcctccatttcttggcttccagaagcatcaggcaagcatctagtagcagctcagcatcgtccatggggtcccgctacgaggtggaggtgacggtgggttccgccaccaacctcaagaacgtcaactggcgcaacggcgacctccatccctacgccgtgctctgggtcgacgacggccccaagtgctccacccgcgtcgacctcgacaacggcgaggaccccgtctgggacgagaagctcctgctccccgtccctccgtccgtggcccacctcgaggacgccgtcctctgcgtcgacgtcgtccacgccgacgccgccgagggcgtcaagccgctcgtcggctccgcgcgcctcccgctccgcgacgtcctcgacgacgccggcatcgggggcaaggtctcgcgcagcctcaggctcaagcgcccctcgggcaggccgcagggccgcctggaggtccgcgtctccgttcgcgaggccgcgccgcgatactacggctacgagtcgtcgtacccggcgccggcctacggcgccggagtaggatcgcgcgacccgtactacgcggcccctccgggtcccggctacggcggccagcagccgtacgccgcgccgccggcgggctacccggcctacggcggttacggagccgcccccgccgccgccgctcctccagcgccaccggtggcttacggggcgggtagtggtgatccttctgctgccgcggcgtacggttctgctgcccccgcggcgaccaagagcaagatggggatggggacggggcttgcggtgggcgcggcggcggggctgctgggcgggctggcgctggcggaaggggcaagctacctggaggacaaggtcgaggaccacgtggcggagaaggtggaggaggacctgtacgacgacgccgacgacggtggctacgacgacgactactaatccccgatctcctctactgtgagatcgagagtgagataacaagtgccctgtgcacttacgttgtgtcattgtgtgcgagagagatcgagtcagacaaactccatgttttattttactttcttttccttttcgtttggttgcccttgtacttgttcgatcaattcatataatccaagctttgctttgatt

SEQ ID NO: 20346 - protein, 289 aa, Panicum virgatum
  misc_feature: Ceres CLONE 1811210
  misc_feature (7)..(96): Pfam Name: C2 Pfam Description: C2 domain
MGSRYEVEVTVGSATNLKNVNWRNGDLHPYAVLWVDDGPKCSTRVDLDNGEDPVWDEKLLLPVPPSVAHLEDAVLCVDVVHADAAEGVKPLVGSARLPLRDVLDDAGIGGKVSRSLRLKRPSGRPQGRLEVRVSVREAAPRYYGYESSYPAPAYGAGVGSRDPYYAAPPGPGYGGQQPYAAPPAGYPAYGGYGAAPAAAAPPAPPVAYGAGSGDPSAAAAYGSAAPAATKSKMGMGTGLAVGAAAGLLGGLALAEGASYLEDKVEDHVAEKVEEDLYDDADDGGYDDDY

SEQ ID NO: 20347 - DNA, 1524 bp, Panicum virgatum
  misc_feature: Ceres CLONE 1811219
  misc_feature: Encodes the peptide sequence at SEQ ID NO. 20348
ggcaaccaaacagcttgctgagctgagagctcctattttctcagtccccatcttctcccccaaatccgataacagaaaagggggctctccgccgccgccgccgatggcaaccctcctccggcgatccgccactcccgtgcgccagctcctactcccgcgccacctcgccgccgctggctccgcccccgcctcgtcccgcgccttctcccgctactaccctcgcgacgacaacgccaggtacgatccgccgggcacgccggtgaactggggcgtggccatagtcccagagaagaaggcgtttgtggtcgaaagattcggcaagtacatcaggacccttggctccgggattcacctgctgatccctgcggttgaccgcatcgcctacgtgcactcgctcaaggaggaggccatccccatccccaaccagtcggccatcaccaaggacaacgtcctcatacagatcgatggcgtgatctacatcaagatcgtcgacccctaccttgcttcctatggcgcggaaaatccaatttttgcagttatacaacttgcgcaaacaacaatgaggagtgagcttgggaaaattacattggacaaaacttttgaggagagagatgcattaaatgaaaatattgtgagggctatcaatgaggcagcaacagattggggcctgaagtgtctccgttatgaaatcagggacatatctcctccacacggtgttaaggtggccatggagatgcaagttgaagcagaaagaagaaagcgtgcccaaattcttgaagcagaagggaaaaaacatgcccaaatccttgaatcagaaggtgaggccggagcggttcttgccttatcagaagcttcagctcgtggaattagactagtttcagaggctatgacaactaaaggaagtactaaggctgcgaacctgagagttgcagagcaatatgtcagagccttctcacaagtggctaaaaagggcaccactgttctgcttccaagtgatggtggcaatccgtcatcttttgtggcccaggctatcaagatcttccagcaactccaggctaacaacccccaggtagacgagctggaggaatcagaagaagagactggtcctgctgaaacaagcgagatgccaccactcatccctgatgcagatcctgggacgaacttctcactccaacgccgcaagaactagatttgagttgcactcggagtgcctgaaggaagtccccttttttttctcttattgttctgcaaacatgggggtatcactgataacaccagtagcactagttttctgagtctgagaaatttactatgcaacggagaagttaggatgcctaggcaattggtttctaggagataaatggaagcaagtttggtgacaggagaggaagattttgattccagtgaaagttaaactttggctcgttcttaatttgatgggaatttgtaaaaatgcaaggttggcctatcgttggtgaaacaaagtacacgtgatggcaatgttttcgttgatgccttctgttg

SEQ ID NO: 20348 - protein, 361 aa, Panicum virgatum
  misc_feature: Ceres CLONE 1811219
  misc_feature (58)..(230): Pfam Name: Band_7 Pfam Description: SPFH domain / Band 7 family
MATLLRRSATPVRQLLLPRHLAAAGSAPASSRAFSRYYPRDDNARYDPPGTPVNWGVAIVPEKKAFVVERFGKYIRTLGSGIHLLIPAVDRIAYVHSLKEEAIPIPNQSAITKDNVLIQIDGVIYIKIVDPYLASYGAENPIFAVIQLAQTTMRSELGKITLDKTFEERDALNENIVRAINEAATDWGLKCLRYEIRDISPPHGVKVAMEMQVEAERRKRAQILEAEGKKHAQILESEGEAGAVLALSEASARGIRLVSEAMTTKGSTKAANLRVAEQYVRAFSQVAKKGTTVLLPSDGGNPSSFVAQAIKIFQQLQANNPQVDELEESEEETGPAETSEMPPLIPDADPGTNFSLQRRKN

SEQ ID NO: 20349 - DNA, 670 bp, Panicum virgatum
  misc_feature: Ceres CLONE 1811221
  misc_feature: Encodes the peptide sequence at SEQ ID NO. 20350
tttatgccgccgtgtaaatacccaccacaagcagctagcttcgcaggtcgtcttccacatccttctcattcatctctccccactcctagcttctgcagctctcaagctgtggctgctagctagggtttacaccggtcgggatccgggagctggcggtcgggggagggcagtccagttcggcggcggcgagatctgcttgctggtggtcgccggcacagaggaaattcagttgatttagagggattattatattgcaggccatttcttgagatcctggagattattccggtgtctggcgccgcgcgcgacgatgatgacgacgagcgccgccgcgcaaagatgatacgcggcagcaacctgcagcaggcggcggacgaggagctagcccggaagaacgccgccgtggcgacgtcgcggcaatggtcggcgcagacggagtcgcgcatcgtgcgcgtctcccgggtcttcggcgggaaggaccgccacagcaaggtgaagaccgtcaaggggctgcgcgaccggcgggtgcgcctctccgtgccgacggcgatccagctctacgacttgcaggaccgcctcggccttaaccagcccagcaaggtcgtcgactggctcctcaacgccgcgcgccacgaggtcgacaagctgccgccgctccagttcccgccgc

SEQ ID NO: 20350 - protein, 110 aa, Panicum virgatum
  misc_feature: Ceres CLONE 1811221
  misc_feature (29)..(110): Pfam Name: TCP Pfam Description: TCP family transcription factor
  misc_feature: The sequence is a functional homolog of SEQ ID NO 1202 in the 10/666,642 US patent application
  misc_feature: The sequence is a functional homolog of SEQ ID NO 1406 in the 10/666,642 US patent application
  misc_feature: The sequence is a functional homolog of SEQ ID NO 2378 in the 10/374,780 US patent application
  misc_feature: The sequence is a functional homolog of SEQ ID NO 538 in the 10/225,066 US patent application
  misc_feature: The sequence is a functional homolog of SEQ ID NO 184 in the 10/225,066 US patent application
  misc_feature: The sequence is a functional homolog of SEQ ID NO 2816 in the 10/374,780 US patent application
  misc_feature: The sequence is a functional homolog of SEQ ID NO 484 in the 10/666,642 US patent application
  misc_feature: Useful for making plants with altered lignin content
  misc_feature: The sequence is a functional homolog of SEQ ID NO 222 in the 10/225,068 US patent application
  misc_feature: The sequence is a functional homolog of SEQ ID NO 2376 in the 10/374,780 US patent application
  misc_feature: The sequence is a functional homolog of SEQ ID NO 402 in the 10/412,699 US patent application
  misc_feature: The sequence is a functional homolog of SEQ ID NO 953 in the 11/479,226 US patent application
MIRGSNLQQAADEELARKNAAVATSRQWSAQTESRIVRVSRVFGGKDRHSKVKTVKGLRDRRVRLSVPTAIQLYDLQDRLGLNQPSKVVDWLLNAARHEVDKLPPLQFPP

SEQ ID NO: 20351 - DNA, 1263 bp, Panicum virgatum
  misc_feature: Ceres CLONE 1811224
  misc_feature: Encodes the peptide sequence at SEQ ID NO. 20352
aggctccgccgtctcctccgccgtctctcttccctttccccgttcagttcagcttcggttgcctcgccgttcgggttattccgcgcctcgcttcgcccccctccgccgcaaacctcgtctcgaattcgatcgcggtgggagcgatcggggcgccaggatgaccgtgatcgacatcctcacgcgggtcgacgcgatctgccagaagtacgacaagtacgatgtcgacaagctcaacggcgccaacgtcgccggcgacgaccccttcgcccgcctctacgcctccgtagacgccgacgtcaaccaatgcgtcgagaaagcggaggcggcgaagcaagagaagaaccgggccgcggttgtggcgctcaacgctgagatccggcgcaccaaggccaagctcctcgaggaggacctgccaaagctgcagcgcctcgccgtgaagaaggtgaaagggctcacaaaggaagagatcgcgacccgtagtgatctggttgccgcattaccggatagaatacaagcaattccagatggtagttctagtaccacaaagaaaaatggaacctggggagcctcaggatctcacactggaggagccataaagttcgacactactgctgatgggaactttgacgatgagtactttaaggggacagaagaatcgaaccagttccgccgggaatatgagatgcgcagaatggaacaggataaaggtttggatgttattggtgaagggctggaaactctgaaaaacatggcatctgacatgaatgaggaattggacagacaagttcctttgatggatgaaatggatgacaaggtggatagagccaatgcagatttgaagaataccaatgttagactgaaggagactgttcttcagctgagatcgagtcgcaacttttgcattgatatcatccttctctgtgtcattcttggtattgcggcctacctttacaacgtgctaaaaaagtgagacaggatccagttgtggcccctgtgttattacggctcaacctatcagttcttggagtgatgagtaatgacgtgtgctcgagcgatttgtgttgtcatatctctgtattatttgtggtgtcccgcttgaaccttaactagggtttgttgaagtagcactgcgtgtgcgtaaactggagtctgcagatatatcttctgtacatttgggagtaaatttcctagtgaggagtacacggcgtcattctgtgtggaccatgcaaacgtgctcatgtatattccatcaggtcttccatc

SEQ ID NO: 20352 - protein, 270 aa, Panicum virgatum
  misc_feature: Ceres CLONE 1811224
  misc_feature (180)..(242): Pfam Name: SNARE Pfam Description: SNARE domain
MTVIDILTRVDAICQKYDKYDVDKLNGANVAGDDPFARLYASVDADVNQCVEKAEAAKQEKNRAAVVALNAEIRRTKAKLLEEDLPKLQRLAVKKVKGLTKEEIATRSDLVAALPDRIQAIPDGSSSTTKKNGTWGASGSHTGGAIKFDTTADGNFDDEYFKGTEESNQFRREYEMRRMEQDKGLDVIGEGLETLKNMASDMNEELDRQVPLMDEMDDKVDRANADLKNTNVRLKETVLQLRSSRNFCIDIILLCVILGIAAYLYNVLKK

SEQ ID NO: 20353 - DNA, 1261 bp, Panicum virgatum
  misc_feature: Ceres CLONE 1811225
  misc_feature: Encodes the peptide sequence at SEQ ID NO. 20354
atctagtccgttttgccttttttttttccccacgcgttgaggtctatttgggctgctggtggtgcggcacccggtcaagtcctctctttgctgacctcggacggagcaggggggaggaaggaagcgagcaagcgaggaggagagcatcgatcggtgaggggagagaggcatggcggggagggcgcggtacgacaaccccttcgaggagggcggcgccgacgaggtcaaccctttcgcggaccaggctaaaagaggagcatcaaacgctcagtccagctattccggtggcgcgttctacacaacgcaatcacgccctgctcctccgagcacacgccgttcgcctcttcctccggaacctgccgacttctacaatgactttgctaccccggtggacatccccatggacacaaacagggacatcaagacaagggagaaggaccttctggccaaggaggctgagttgaacaggcgtgagaaggaactcaaaaggagagaggaggctgccgcacgagctggcattgtattggaagagaaaaactggccaccatttttccccatcattcatcatgatattgggaacgagatacctatccatttgcaaagaacacagtacgttgcatttgcatcactattaggattggtcttgtgtctgttttggaacatcatctgtgttagcgctgcctgggcaaaagggtcaggtcctaagatatggtttcttgcaatcatatacttcattcttggatgccccggtgcctacttcctatggtaccggccactttaccgtgccatgaggaacgagagtgctctgaaatttgggtggtttttcctattctacttggttcatatcgccttctgcgtgtatgcagctgtttccccttcaattctctttgtgggaaaatcattgactgggatttttccagcaatcgacttgataggcaatagcgtcattgttgggatcttctacttcgttggctttggattgttctgcctcgagtctttgctaagcatgtgggtcattcagcgtgtctaccggtacttccggggcagcgggaaagaagcggagatgaagcgggaggcagcacgtggtgcggcgagggcagcattttgatgatccgtatatataagtatatatatatatatacaacacgtataatgttcatagtgtgaagtgtttgtagatcaaaaagacgtgcggagtagggttagtgtgatgtaaatctacagaatttaatttccttattttccactgagtttggagccc

SEQ ID NO: 20354 - protein, 312 aa, Panicum virgatum
  misc_feature: Ceres CLONE 1811225
  misc_feature (120)..(294): Pfam Name: SCAMP Pfam Description: SCAMP family
  misc_feature: Useful for biocontainment applications
MAGRARYDNPFEEGGADEVNPFADQAKRGASNAQSSYSGGAFYTTQSRPAPPSTRRSPLPPEPADFYNDFATPVDIPMDTNRDIKTREKDLLAKEAELNRREKELKRREEAAARAGIVLEEKNWPPFFPIIHHDIGNEIPIHLQRTQYVAFASLLGLVLCLFWNIICVSAAWAKGSGPKIWFLAIIYFILGCPGAYFLWYRPLYRAMRNESALKFGWFFLFYLVHIAFCVYAAVSPSILFVGKSLTGIFPAIDLIGNSVIVGIFYFVGFGLFCLESLLSMWVIQRVYRYFRGSGKEAEMKREAARGAARAAF

SEQ ID NO: 20355 - DNA, 1320 bp, Panicum virgatum
  misc_feature: Ceres CLONE 1811230
  misc_feature: Encodes the peptide sequence at SEQ ID NO. 20356
acccctctctcctcgctccgctccgcagctcgcgatcggattcgctccctcctcgccgcgccacaccacacccgtcggcgctggggatctctagggtttagcccagtcgcccggctcgaccccgcgccgtcctcgccgtcgccaccatgccgctcaggttggagatcaaggtgcgccggcccgacctcactggatctcggtctccgcgtcgtcggtgtattgttcgtgcgggttcgtgccgctttgattttgcgctgatttcggtttcgttttgttttctgttggtgatcagcggaagttcgcgcaacggtcagagagggtcaagtcggtggatcttcaccccacggagccatggattctgtcgagcctctactcggggagtgtctgcatctgggattaccgggcacaggctatggtgaaatcatttgaagtttcagaactgccagtgcggtcggcaaaatttgtatcaagaaaacaatgggttgtagctggtgcagatgacatgttcattcgtgtctacaactacaataccatggacaaagttaaagttttcgaggcccatactgattacatcagatgtgttgctgtccatccaactctaccatatgtgctgtcatcatctgacgacatgttgataaaactgtgggactgggataaagggtggatgtgcactcaaatctttgagggacattcacactatgtgatgcaggttactttcaatccaaaggataccaacaccttcgcaagtgcatctcttgaccgcactacaaagatatggagtttgggttctccagatccaaactttacactagatggacatcaaaagggtgttaattgtgttgactacttcactggtggtgacaggccctatttgattactggttctgatgactccactgcaaaggtctgggattaccaaacaaagagctgtgttcagacactcgaagggcatacacataacatctctgctgtctgtttccatcctgagcttcctataatcatcactggatcggaagatggcacagttcgtatatggcattcgacaacttataggttgcttatttgcgtgagcttgagatgtgttagttattcctagttacaatacttgggccatttatcacttctctatcctatcatgttggctttctcgtaaacctgaattctaggcaacaatattatttatccttgtaaaaacggcgcctttaattttcaatataagggcctatgagcatgcaactagtgtttgagtagttgtttgtactctcctagttcaaacccatgttaacttactataatcccatggtgtgtaaacttgaaccc

SEQ ID NO: 20356 - protein, 227 aa, Panicum virgatum
  misc_feature: Ceres CLONE 1811230
  misc_feature (171)..(209): Pfam Name: WD40 Pfam Description: WD domain, G-beta repeat
  misc_feature (41)..(79): Pfam Name: WD40 Pfam Description: WD domain, G-beta repeat
  misc_feature (84)..(123): Pfam Name: WD40 Pfam Description: WD domain, G-beta repeat
  misc_feature (127)..(167): Pfam Name: WD40 Pfam Description: WD domain, G-beta repeat
  misc_feature: SWISSPROT Homolog: EC 2.7.11.7 [Myosin heavy-chain] kinase
MVKSFEVSELPVRSAKFVSRKQWVVAGADDMFIRVYNYNTMDKVKVFEAHTDYIRCVAVHPTLPYVLSSSDDMLIKLWDWDKGWMCTQIFEGHSHYVMQVTFNPKDTNTFASASLDRTTKIWSLGSPDPNFTLDGHQKGVNCVDYFTGGDRPYLITGSDDSTAKVWDYQTKSCVQTLEGHTHNISAVCFHPELPIIITGSEDGTVRIWHSTTYRLLICVSLRCVSYS

SEQ ID NO: 20357 - DNA, 624 bp, Panicum virgatum
  misc_feature: Ceres CLONE 1811233
  misc_feature: Encodes the peptide sequence at SEQ ID NO. 20358
atctgtcggcttctcacagcaagatcgatcgacgactcgacgtcggacgagtagaacaggccgccgggatcgagggagagagatggcggagcatcgctcgcggtggcggacctccggcgctcgtcgcccgctcctctcctgcgcgctcatggctctcgttggtttcgtggcggcagggccgttcgtgctcgccaagggtatcgtcttccacgtggccaaccggtgcccggtgctcgccggcggcggcttcctggtgccgccgggcaagtcgaggcgcgtcgtcgcgccgtccacctggaacggccgcttctgggcccgcaccggctgcaacttcaccgcgaacggcggcgtgggcggcgcgtgcctgaccggcgactgcgagggccggctggcctgcaacgggtccgtgggcgcgccgcccgcgacgctcgcgtggaggaacaaagccctgttttgtagtggtggttcctacgacgtgagcctggtggacgggtacaacctccccgtgtccgtgtccgccgtgcccggcacgggcgccgccgaccccagcaggtgcgccagggacgtgaacgcggcgtgcccgccggagctgcacgtcaccgctggcggcaaggcggcggcggt

SEQ ID NO: 20358 - protein, 180 aa, Panicum virgatum
  misc_feature: Ceres CLONE 1811233
  misc_feature (46)..(176): Pfam Name: Thaumatin Pfam Description: Thaumatin family
MAEHRSRWRTSGARRPLLSCALMALVGFVAAGPFVLAKGIVFHVANRCPVLAGGGFLVPPGKSRRVVAPSTWNGRFWARTGCNFTANGGVGGACLTGDCEGRLACNGSVGAPPATLAWRNKALFCSGGSYDVSLVDGYNLPVSVSAVPGTGAADPSRCARDVNAACPPELHVTAGGKAAA

SEQ ID NO: 20359 - DNA, 2072 bp, Panicum virgatum
  misc_feature: Ceres CLONE 1811234
  misc_feature: Encodes the peptide sequence at SEQ ID NO. 20360
gagcttccccttccagcaccggctccccccttcgctcgcgcggttccatcttcccctcgcgcgcagttcccacgactcgacggttcctcaccgcgcgcccctcctgcttggcgtccccgcctcgccccgacgccgccctcgccctccacgtctcgctcgccgacgccgccgggccgccatcccgctttcgcgccggcctcgcctccccttctcactcgccggcgccgccgccgcgccctgtccgctctgtctcccggtcgcgccccctcccccgcgcccgtccccctcggtctcccggcgcagaccacgcgaggcgcggtgcgagaaggccgtcgtccccttctcactcgggccgtccccttctcactcgccggcgctgccgccgcgcccatcccgctcaccgggaaaggaagacctaagggcgggtggcgccgccctctccctccccgtcgcgccccctcccccgcgcccgtcccctcggtctcccgtcgcagatctccggcgcactcgacgacctcgccgcgcgaccgtcctcccggcgcggatccaccacgcgcggggtgcgcggtcgtcgtccctgaagcccggccgccttccgtcgcgcccgcctctcccccgcctcgcgcgtgtgccggcacacgtcaagatcgaccagcagctggggcgacaacacctcggagggcatcatatctgtgcccaacgatcacgggttcagaaatcggagcttgtgcagtggcctgtcgctctactgttcacctctgcaccaggtttcaagtactttgatctttatccggcttctttgttcggatcagtcagtagccaacatgttgtcaagagaatttatcttctactacctaaaaagaacgaagttggggtatgtccgctcgctcgtgtgtccgttgtcgtggtgtgtccgcccgtcgcccgcaccggctcccccttcgctcgagatcttattgcagttttcaaatgggagaaaagtgttttcttgaaagccatcatctgctgcagctacaaaaaagcttggtggagcacactcatgcaggagacactatgggttggggatggcctaaataacctcgctgatgatgtcttgaagtccaccacgacgccagcgcaaagatgcggagagctggacacagcggtgattggccgtggcgacaacatcaaggagcatgcatgtaacatgactcctcaatcctcatgccaagcgaataatttagcagctcaacaagaggtttggaaatggcgaacaagtttgtagttcttcttggtgttgtcctggcctttctcctcgtctgccaggatttggcatgtgctagagggctcactgaaaccaatgagtctgaaggaaaagatgtgaagcctgctggaggagtgcctggactcaaggatgaaaagtggggaggtggttacaatggaggatatggcaatggcggcggttatggtggtgggtacggtggtggctatgggcctagatatggtggaggataccaccatggccacggaggaggctatgggcccggatatggtggaggatatggatctagacatggtggtggctatggtggccctggatacggtggcgggtatggtggccctggatacagtggcgggtatggtcagcctgggtatggcggaggatatggcggtggctatggtggtggctatggaggaggatatggtagtggcagcgggtatggtggaggtgggggctatggaggcggatatggaggaggtggacaccatggtggatggaattaagtggtagagctatgcatgtttctctatgtcaaataattaagaaacacatcgtgatgataggtttgaatgttgcatggcactttggtgatacaaatcatgtctacgtatggkataaaacatggtgatggatgtactgttgtgtacattagatggatttaatcctgtcttgcatgaagtgtggtaataagaactaggctgctagccatgtatggcagtgtgcactagctggcttttagaaccggtacctcctcatgtatggacctatgtatacatataaataaatgactatcctttaaagttgtgtatcg

SEQ ID NO: 20360 - protein, 172 aa, Panicum virgatum
  misc_feature: Ceres CLONE 1811234
  misc_feature (1)..(166): Pfam Name: GRP Pfam Description: Glycine rich protein family
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: Useful for making plants with altered lignin content
  misc_feature: Useful for making plants with altered alkaloid content
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
  misc_feature: Useful for making plants with altered terpenoid content
MANKFVVLLGVVLAFLLVCQDLACARGLTETNESEGKDVKPAGGVPGLKDEKWGGGYNGGYGNGGGYGGGYGGGYGPRYGGGYHHGHGGGYGPGYGGGYGSRHGGGYGGPGYGGGYGGPGYSGGYGQPGYGGGYGGGYGGGYGGGYGSGSGYGGGGGYGGGYGGGGHHGGWN

SEQ ID NO: 20361 - DNA, 819 bp, Panicum virgatum
  misc_feature: Ceres CLONE 1811240
  misc_feature: Encodes the peptide sequence at SEQ ID NO. 20362
acgggtggccctcctgcatgctgtcctgatggccccgtcttctctgacgctcctcctcctctccctcctgaccctgacgacgtcgtcctccgccaccaccgccggagacgacggcgacggcctcacgcacatccacctctacgtgcacgagacgtacaccggcccgaacaccacggcggccgccgtgctgcagtccccgctcggcgccaactcgtcgttcgggagcatcggggtggtggacgacgagctgcgcgccgggccggaccgcgcgtccccgctcctcggccggtaccaggccgtcttcttcggcacgagcttgcaggcgggcgcggggtacctgtcctccgtcacgctcgtgttcaccgccggcgagtacgccgggagcacgctctcggtgcagggccccgtgctcgggttcgcgggcaccatcgagcgcgccgtcgtcggcggcaccggcaggtttaggctcgcccgcgggtacatgctcttcaagatggtcagcaagcccacgccggagacggacgtcaacaaggtccacctcttcgtgctcatgcaccatggcaagtactagccttgctgctgctctttctgtctcgatgtctgccactccaacaagtactgtttcttgatctgttcttgtcgaactactgtactgtgcgtatgtgcaggatcacatttcatctgtaataaaggtttaatttagatgctcatagggatagaatttatactcgtgcattcataggggtgagtgtacgtgcgttatgagtgtctgagtttattatattgtgtaatattttttttaaaatatgtaatttcttc

SEQ ID NO: 20362 - protein, 180 aa, Panicum virgatum
  misc_feature: Ceres CLONE 1811240
  misc_feature (10)..(175): Pfam Name: Dirigent Pfam Description: Dirigent-like protein
MAPSSLTLLLLSLLTLTTSSSATTAGDDGDGLTHIHLYVHETYTGPNTTAAAVLQSPLGANSSFGSIGVVDDELRAGPDRASPLLGRYQAVFFGTSLQAGAGYLSSVTLVFTAGEYAGSTLSVQGPVLGFAGTIERAVVGGTGRFRLARGYMLFKMVSKPTPETDVNKVHLFVLMHHGKY

SEQ ID NO: 20363 - DNA, 1356 bp, Panicum virgatum
  misc_feature: Ceres CLONE 1811242
  misc_feature: Encodes the peptide sequence at SEQ ID NO. 20364
atcctccccaactccgtcccgccgcccacctcccaccggaaccgccgccgcgcccatccgcgccccggctacgcgaccggaacgaaccgacccgatcggacgggcgggggaggcggcggcgcctcccgacctcgctcccacctcgcctccccgaccggaccgccggcccgtcggaagatgcagggcggcgtctccggattccagaacgcgccggtgacgcgggcggtcgtcctcaccagcggcctcctctccgtcgtcttcagcgcgcagcgccgcgcccgcgccctcggcatctcataccaggaaattataacgaatttccgtttatggaagatattcccatctgtatttgctttccagtcaacaccagagttaatgtttggactgtaccttctctattacttccgtgtgtttgagaggcagattggatctaacaaatactcggttttttgcttgttcactatcacagtgtcatcacttcttgagatcctatcattggtcatcctgaaagatacaaactacatcagcacacttgcatctggaccttatggtcttatatttgcctcatttgttccattctttcttgacattccgatcacatcacgataccgtatctttggcctaaatttcagcgacaaatcattcatttacctagctggtcttcagcttcttttatcttcctggaagcgctcccttattcctggtatatttggtctggttgctggttctctctatcgtctaaatgtgtttggcatccggaaaatgaagatcccacaggttatttcatcattttttgcaagatactttgccccttcaccaggaagtacacctcgtccttccaggactgtcgttggaaacacaccgtcacaaacaggccgtgctgttcagaatcagtcatcaactggatttgcacctatggtggaacctccagagtcctctgttgctatgctggtctcaatgggctttgatggcaatgacgctagacaggcactcatgagagctagaaatgacatcaatatggcaacgaacatcctactggaagcacagtctcgttgaactgacctactgcaacttcggtggccaaccattgggtggaactggttgtgttccaagatgagcagacaatttgacacgttggactcagattctaccatgaatttggagttgtttgatgcctccttcgaggtttacaatctaggaaatcagcacagaaaacatttgcatcagttagcttgatcgtgtcaatacttagattgctccaaccgtacaggcagaatgtactattccaatttcagtttgtaagatagatgatgtatacattcctagtgtaaaattcatcagaggtttacaactttc

SEQ ID NO: 20364 - protein, 292 aa, Panicum virgatum
  misc_feature: Ceres CLONE 1811242
  misc_feature (250)..(286): Pfam Name: UBA Pfam Description: UBA/TS-N domain
MQGGVSGFQNAPVTRAVVLTSGLLSVVFSAQRRARALGISYQEIITNFRLWKIFPSVFAFQSTPELMFGLYLLYYFRVFERQIGSNKYSVFCLFTITVSSLLEILSLVILKDTNYISTLASGPYGLIFASFVPFFLDIPITSRYRIFGLNFSDKSFIYLAGLQLLLSSWKRSLIPGIFGLVAGSLYRLNVFGIRKMKIPQVISSFFARYFAPSPGSTPRPSRTVVGNTPSQTGRAVQNQSSTGFAPMVEPPESSVAMLVSMGFDGNDARQALMRARNDINMATNILLEAQSR

SEQ ID NO: 20365 - DNA, 1532 bp, Panicum virgatum
  misc_feature: Ceres CLONE 1811256
  misc_feature: Encodes the peptide sequence at SEQ ID NO. 20366
gacctcactctctgcctctcgctcgaacgcccgccgtgcttgcttgacctcactctctgcctctcgatcgaacgcccgccgccgacggcgttctcctgccatgcccggtgcctccaccgccccacatcatcacaccaaatcagctcatcagccccacaagaactgttcgtaggtcacggaatccattactacccatactcctccagctctctgaacaaaaaaaaagatcatcttgtttatatataccatggtctaatcggccatggatgtcaccggagacgccggcggaggtcgccgccccgacttccccttgcagctgctggagaagaaggaggagcaggcttgctccacgtccccagcggctggtgtgggcgccggcgccgcgggtaatggtcggtcggcggggccgggagagttgcaggtgaggaaggcgccgccgccgaagcggacctccaccaaggaccggcacacgaaggtggacgggcgcgggcggcgcatccggatgccggcgatttgcgctgcgcgggtgttccagctgacgagggagctggggcacaagacggacggcgagaccatcgagtggctgctgcagcaggcggagccggcggtgatcgcggccacgggcaccggcaccatccccgccaacttcacctctctcaacatctccctccgctcctcgggctcatccttctccatcccggcacatctccgcgccgccggcctgcccggcccacgcttcggcggcgcgcggggcgacccgtgggaccgcgtcgtgggcctcgggttcggtggcgccgagggtccgccgtccgctacctcctcggcgtcgtccccgctgctgagcttccactccggcagcgtcggtctcgacgtgtcgccgtcgtcgacatctgccgcagccagctccgacctgtcgaggaagcgccagtgggagcaagaaatgcagcaccagcagcaacaccaacagcagcagcagcaataccagcagcagatggccgggtacacgcagagccaaatgccgggcaccgtgtggatggtgccgagcagcaacgcgcaggccgccgcagcggcggcgggcggaggcggaggcggcagcgagtcgatctggacgttcccgcaagcagcacgcggcggcggcggcggcggcgcggcgaccttgtaccgcggcgtgccgagcgggctacatttcatgaacttccccgcgcccatgtcgctgctccccggcgggcagcagcttgggctcggccaagcggcaggcggcggcggcggcggaggggagggccacatggggatcctcgccgcgctcaacgcgtaccgcgcgcaggccgcctcggacgctgcggcggcggcgcagaacggcgcggaaggcggctccagcagccagcaccaacaaccccagcacggcggcggcgagcggcaggagagcatgagccccagcgacgactcgtaggtctccgcgggggcgtgcgctgctggtcctccaaggcgtcgtcgtcgtctctcctgtttttagtctgttctccttgacttcc

SEQ ID NO: 20366 - protein, 395 aa, Panicum virgatum
  misc_feature: Ceres CLONE 1811256
  misc_feature (51)..(236): Pfam Name: TCP Pfam Description: TCP family transcription factor
  misc_feature: The sequence is a functional homolog of SEQ ID NO 166 in the 10/225,068 US patent application
  misc_feature: The sequence is a functional homolog of SEQ ID NO 220 in the 10/374,780 US patent application
  misc_feature: The sequence is a functional homolog of SEQ ID NO 1392 in the 10/374,780 US patent application
MDVTGDAGGGRRPDFPLQLLEKKEEQACSTSPAAGVGAGAAGNGRSAGPGELQVRKAPPPKRTSTKDRHTKVDGRGRRIRMPAICAARVFQLTRELGHKTDGETIEWLLQQAEPAVIAATGTGTIPANFTSLNISLRSSGSSFSIPAHLRAAGLPGPRFGGARGDPWDRVVGLGFGGAEGPPSATSSASSPLLSFHSGSVGLDVSPSSTSAAASSDLSRKRQWEQEMQHQQQHQQQQQQYQQQMAGYTQSQMPGTVWMVPSSNAQAAAAAAGGGGGGSESIWTFPQAARGGGGGGAATLYRGVPSGLHFMNFPAPMSLLPGGQQLGLGQAAGGGGGGGEGHMGILAALNAYRAQAASDAAAAAQNGAEGGSSSQHQQPQHGGGERQESMSPSDDS

SEQ ID NO: 20367 - DNA, 1368 bp, Panicum virgatum
  misc_feature: Ceres CLONE 1811261
  misc_feature: Encodes the peptide sequence at SEQ ID NO. 20368
atcccacgccaatatttcaacccgcgctcagaactcaatccaccacaaagtcacaatgctcgcggtcaccagataacccacgcacgggaatttgagggcgtccgacgcgatgttgcccgtgcgcgcaacgtcgcagccacggggacgccgccggtcacacttcatgacccatccaccgggacgccgaccgatctgagtcctgaaccaaaccgcggcgcccgacgggccccaacttcccgagccgccaccggctgcctccgcgcccgcgcgcggcgcgccaggtggcaccgcgtccgcgcggcgcggggtcctctgctccacgcccccaaggccccaacgaactgcgcgagcgaagcctccgctgatagtgatcggctgattccgcggcgggcggcttgtgcaggtgcggtcccgcggagcgcggagccctaggccaggcacgcgcgaggcagcccgcgggggaccatggagcgcaagcagccgccaccggcgacgcggcggaagggcgcggcgccgagccggaagtggctggtggtgccggcggcgggggagccccgcgaggcggagctggggaagcaccggataatggagatgacgggggtgcccacgcgcgacctccgcgtgctcgacccggacctcgcctccccctccaccatcctggtccgcgagcgcgccgtcgtcgtcaacctcgagcacgtcaaggccatcgtcacggccaccgaggcgctcgtcctggactccagcaacccgctcctgggacccttccacaaggacctccacgcccgcgtcgcgtctccggacgtctccagcacgggttcagcgacagatcgtagcaacgagccggagcagggcgagggtaacgggccaacagtggctctctgtggggcggggagtaacaagaccctgcccttcgagctcaaggtgctcgaggtctgcctcgagcacacatgcaaatgcttggaatctgagacgttggctcttgagaaggaagcgtacccggccttggatgagctgacttccaaggttagcaggctaaacttggagcacgtcaggcacatcaagaaccggctggtcgcgctgtcagggcgcgtgcagaaggtcagggatgaactcgagcacttgctggacgatgacatggatatgtctgaaatgtatctgacaagaaaacttgcgttccaaggattcaccgagacgttgagcagggtggattcaaataaggatgcatccactgatcacgacgagaaggaggaagaagatcgtgacgacgagacagacactggccgcgaaagttctgcctatgttaagcctgatattgaagagttggaaatgcttgttgaagcctactttgtgcagattgatggcacgctg

SEQ ID NO: 20368 - protein, 300 aa, Panicum virgatum
  misc_feature: Ceres CLONE 1811261
  misc_feature (16)..(295): Pfam Name: CorA Pfam Description: CorA-like Mg2+ transporter protein
MERKQPPPATRRKGAAPSRKWLVVPAAGEPREAELGKHRIMEMTGVPTRDLRVLDPDLASPSTILVRERAVVVNLEHVKAIVTATEALVLDSSNPLLGPFHKDLHARVASPDVSSTGSATDRSNEPEQGEGNGPTVALCGAGSNKTLPFELKVLEVCLEHTCKCLESETLALEKEAYPALDELTSKVSRLNLEHVRHIKNRLVALSGRVQKVRDELEHLLDDDMDMSEMYLTRKLAFQGFTETLSRVDSNKDASTDHDEKEEEDRDDETDTGRESSAYVKPDIEELEMLVEAYFVQIDGT

SEQ ID NO: 20369 - DNA, 1432 bp, Panicum virgatum
  misc_feature: Ceres CLONE 1811266
  misc_feature: Encodes the peptide sequence at SEQ ID NO. 20370
acgccaaaaccccgatcacatcctcctccatccatcatcctttttctccgaactttctcgaagcgaagcgagctcgtccttcggcgcgatggcggtggatctgaccccgaggcagccgaagaagacatacggcagtgagggcggcgcctactacgagtggagccccgccgacctgcccatgctcggcgtcgcctccatcggcgcggccaagctctcgctcgccactggcggcctctcgctccccagctactccgactccaccaaggtcgcctacgtgcttcaaggcacgggtacctgcggcattgtcctgcccgaggccaccaaggagaaggtcgtcggcgtgaaggagggcgacgccctggcgctccccttcggcgtggtgacctggtggcacaacgcccccgacgccacgacggagctcatcgtcctcttcctcggcgacacctccaagggccacaaggccggccagttcaccaacttccagctgacgggcgccaacggcatcttcaccggcttctccaccgagttcgtgggccgcgcctgggacctcacccaggatgacgccgccaagctcgtgtccagccagcccgcatcgggcatcgtcaagctcggcgccgggcagaaactccccgccccatctgcggaggaccgcaagggcatggccctcaactgcctggaggcgccgctggacgtggacatcaagaacggcgggcgcgtggtggtgctcaacacccagaacctgccgctggtgaaggaggtcgggctcggcgccgacctggtccgcatcgacgcccactccatgtgctccccggggttctcgtgcgactcggcgtaccaggtgacgtacatcgtccgcggcagcgggcgcgtgcaggtcgtgggcaccgacggcaagcgcgtgctggagacccacgtcgagggcggctacctcttcatcgtgccccgcttcttcgtcgtctctaagatcgctgacgcctctggcttggagtggttctccatcatcaccacccccaaccccatcttcagccacctggcggggaggacgtcggtgtggaaggcgatctcgccggaggtgctggaggcctcgttcaacacgacgccggagatggagaagctgttccggtccaagaggctggactccgagatcttcttcgcccccaactgaggagcccccgccaccattgccgcccgatccaccagcagtctcgatgtcgtcgtcggtcgtcgttagcttagctcgataagaataataatagagagctgcggtagggtctgtcggtggcggcttccttcgtgagtcagtgtcagtcagtcggcagtcttagggtctcaagtgggagagagctttgagcgctctgcgtcatggtctggtcgtgcgtgtccggttggtgaaacttgcgagatgaatacaaatctcatgcttctttcgttt

SEQ ID NO: 20370 - protein, 358 aa, Panicum virgatum
  misc_feature: Ceres CLONE 1811266
  misc_feature (193)..(342): Pfam Name: Cupin_1 Pfam Description: Cupin
  misc_feature (5)..(160): Pfam Name: Cupin_1 Pfam Description: Cupin
MAVDLTPRQPKKTYGSEGGAYYEWSPADLPMLGVASIGAAKLSLATGGLSLPSYSDSTKVAYVLQGTGTCGIVLPEATKEKVVGVKEGDALALPFGVVTWWHNAPDATTELIVLFLGDTSKGHKAGQFTNFQLTGANGIFTGFSTEFVGRAWDLTQDDAAKLVSSQPASGIVKLGAGQKLPAPSAEDRKGMALNCLEAPLDVDIKNGGRVVVLNTQNLPLVKEVGLGADLVRIDAHSMCSPGFSCDSAYQVTYIVRGSGRVQVVGTDGKRVLETHVEGGYLFIVPRFFVVSKIADASGLEWFSIITTPNPIFSHLAGRTSVWKAISPEVLEASFNTTPEMEKLFRSKRLDSEIFFAPN

SEQ ID NO: 20371 - DNA, 1709 bp, Panicum virgatum
  misc_feature: Ceres CLONE 1811282
  misc_feature: Encodes the peptide sequence at SEQ ID NO. 20372
atgccacacctcgttttcgacgaaccctcaagaacgtgagatcagagaggagacgagtgaggagagaaggattcgaagggggaggaggaggcggcgcacggcggttgctggattgctcctcgaggacgacggccatggcgtccaagaggcaggtgggggtggggcggggagcccctgttcccgctcaggaacagaagatcgatgcggccaggctcgtcaggaggtcagtggcgacggttccccaacaagctgtggcaagaaaccgtagggtgcttgccgacgtcggcaactttatcaatggccaacctgctcttgcaaaccaccagaagcaagtccttgtaccagttaagaactgtaggaaagcaatccctcaggtagcagcaagaagccggggagtgcttgctgatatgggcaatcatatcaacggatgtcgggctcctgcaaatcgtcagaagtcactggttgctgcatctgacaggaatggaaaagcagttaagctgaaggagcagaggaaactgaagcccgaagtcattgtgataagttcagactccgagagggagaagaaaaccgaagtctcaggaggccagcgaattgcaaggagggtaccaacccttactggtatcctgacaacttgcagcagggtttctgatagggtaatttccagctcgaagaatgcacagacatttgacattgatgcccctgatgctaccaatgagcttgctgtggttgaatatgttgaggacatctacagattctacaagagtactgaggggacttgcctgcccctcagcacctacatgagctcgcaggacgagatcaatgaaagaatgagagctatccttgttgattggatcattgaagtacaacacaggcttaaactaatgccagagacactttacctgactgtgtacgtcatcgatcagtacttatccatggagaatgtaccaagaaaggagctacagcttgtcggcataagtgccatgctgatagcgtgcaagtatgaggaaatatgggctccaatggttaaggatttattgtgcctatgcgacaatgccttcagcagagagcaggttctgaccaaggagaaggcaatcctgaacaagctccactggaacttgacagttccaacaatgtacatgttcattgtccggtatctgaaagctgctaggggtgacaaaaagcttgaaaacatggcattcttctactccgagcttgcattggttcagtacacgatgctgatttaccctccatctgtgaccgcagctgctgttgtctatgctgctagaaatactcttgaaatgaagccactgtggactgatattctggagtatcacactggcttaactgagccacaattactagactgcgcgaggcgcctgatgtgcttccacgccctagcgccggagagcaagcagaaggcggtctacacgaagtactccaaccccaagcgcggcgccgtctcgctctactcgcctgccaagaagctactgtcagtctgagccgaggctccctgctgcggcggctgctagtactggagatgctagtactgctgttgcatatcatcattctgatgataccattttgtttcagtcctattttctgctctttgctttgatcagtatacttgaaagttcaaaatcatcagcaaatgttaaaccattatcgaatggttcggttaattgttatgtgtggtttgttgtttatgcttt

SEQ ID NO: 20372 - protein, 454 aa, Panicum virgatum
  misc_feature: Ceres CLONE 1811282
  misc_feature (203)..(329): Pfam Name: Cyclin_N Pfam Description: Cyclin, N-terminal domain
  misc_feature (331)..(451): Pfam Name: Cyclin_C Pfam Description: Cyclin, C-terminal domain
MASKRQVGVGRGAPVPAQEQKIDAARLVRRSVATVPQQAVARNRRVLADVGNFINGQPALANHQKQVLVPVKNCRKAIPQVAARSRGVLADMGNHINGCRAPANRQKSLVAASDRNGKAVKLKEQRKLKPEVIVISSDSEREKKTEVSGGQRIARRVPTLTGILTTCSRVSDRVISSSKNAQTFDIDAPDATNELAVVEYVEDIYRFYKSTEGTCLPLSTYMSSQDEINERMRAILVDWIIEVQHRLKLMPETLYLTVYVIDQYLSMENVPRKELQLVGISAMLIACKYEEIWAPMVKDLLCLCDNAFSREQVLTKEKAILNKLHWNLTVPTMYMFIVRYLKAARGDKKLENMAFFYSELALVQYTMLIYPPSVTAAAVVYAARNTLEMKPLWTDILEYHTGLTEPQLLDCARRLMCFHALAPESKQKAVYTKYSNPKRGAVSLYSPAKKLLSV

SEQ ID NO: 20373 - DNA, 1000 bp, Panicum virgatum
  misc_feature: Ceres CLONE 1811288
  misc_feature: Encodes the peptide sequence at SEQ ID NO. 20374
aattctccactagctacctatctctctgtagattggctagatgtaagctacgatttcagtctggactctggactggatcgtcgtcgaggctgactcctgaaccaaccgatcgaccgaccgacagaccctgtacgcgcacggcggccgcaagttctggatccacggcacgggcgcgctgggctgcctgccgcagaagctggcgatcccgcgggccgacgacgccggcctggacgcccacggctgcctcacggcctacaacgccgcggcgcggcggttcaacgcgctgctggcgggcgcctgcgcggagctccggcgccggatggtggacaccgcgctcgtcttcgtcgacgtgtacgccgccaagtacgacctggtggccggccacgccgcgcacggcatcgcccggcccctcatggcgtgctgcggccacggcggcccgccctacaactaccaccacttcaaggcctgcatgtcggcggagatgcagctctgcgacgtcggcgcgcgcttcgccagctgggacggcgtccacttcaccgaggccgccaacgccatcgtcgccgccaaggtgctctccggcgacctctccacgcccaggggggtcaccatcgccagcctcgtcaacgccacgctcgtcgtggccaacaacaacgatggctaggctctcgctcgtgcggtttcttgctgcccatgggggaagtgatgatggtagaaaggaatctagccaagatatgatgattgcagcgagttcgtggagatcgatccgagctggttcgccgctcgtcaggatcgagctggttcaacaaaggagcgagcaattatgtgacaccattgattattgactagaattttgcaaatgaaagggtggcccaacctagtggttttgtggggattattggcctccagtttgagacttaatttgtactacatcaaacatgataacatacacatgcatgtgtgtaagatccacggttatttttttactaattttcttttacct

SEQ ID NO: 20374 - protein, 113 aa, Panicum virgatum
  misc_feature: Ceres CLONE 1811288
  misc_feature: SWISSPROT Homolog: EC 3.2.1.51 Alpha-L-fucosidase
MVDTALVFVDVYAAKYDLVAGHAAHGIARPLMACCGHGGPPYNYHHFKACMSAEMQLCDVGARFASWDGVHFTEAANAIVAAKVLSGDLSTPRGVTIASLVNATLVVANNNDG

SEQ ID NO: 20375 - DNA, 1156 bp, Panicum virgatum
  misc_feature: Ceres CLONE 1811296
  misc_feature: Encodes the peptide sequence at SEQ ID NO. 20376
cccgaccagaacccccaccggccaccgcatccccgcacccgcacccccgagcgctgtcgagttggccgccggcgagatggcgacgccgacgccactctccgtggaggacgtgctgcgcgtcaacggcagccgccgcttcgccgccgcgatggcggccgcctcccccttcgcctccctcgccgacgcccttctcgccgcccgccgcatctggctcaacgaggtcgacgtcaacggatggctcgaggccttcgcggcgcacccggcaatcggaaccacctccccctccgtctccaagtggagcaaggaggagcaatcagcagcgctctccacagccacggattcgactgctcaggagctggcagagtggaatgccaggtacagggagaagtttggcttcgtgttcatgatttgtgcatctgggaggtctgcacctgaggtcttgtctgagcttaagaggcgctacacaaataggccaattgttgaacttgagaatgcagcacaggaagaacttaagataactgaattacgtcttgcgaagcttttctcatcagagcctactgttccctctcatccaactgaacacccgaccatccaatcagataaagcagcaggtagctccaaccgaagtcggccacccattacaacccatgtgctggatgtcgcccgtggatcccctgcatctggaattgaagttcatctggagatgtggaaagatatttcagctcccccatcattcaacaagaaagatttcaatggatgggcaactcttggcacttcagttacaaacaatgatggccgcagcggtcagctgacggacattgttgacaacatcgctcctggtttctaccgcatgagcttcaacactagcaagtatgcgcctgcagggttcttcccttatgtcagcatcatatttgagatcaaggagaatcagacggcagagcatttccatgttcctctcttgcattcccccttctcgttcaccacttaccgtggtagctaagttgctatgtacgtgtaattacctcatgttgttggtatgtttaagaacagctgtgtaaacttgacacttccgctgttatgacttgtgaataatcttgttccaaaagccagcctttaaacttttaataaaatattgttgctgttgcttcctgtgatc

SEQ ID NO: 20376 - protein, 307 aa, Panicum virgatum
  misc_feature: Ceres CLONE 1811296
  misc_feature (186)..(306): Pfam Name: Transthyretin Pfam Description: Transthyretin precursor (formerly prealbumin)
  misc_feature: SWISSPROT Homolog: EC 3.5.2.17 Hydroxyisourate hydrolase
MATPTPLSVEDVLRVNGSRRFAAAMAAASPFASLADALLAARRIWLNEVDVNGWLEAFAAHPAIGTTSPSVSKWSKEEQSAALSTATDSTAQELAEWNARYREKFGFVFMICASGRSAPEVLSELKRRYTNRPIVELENAAQEELKITELRLAKLFSSEPTVPSHPTEHPTIQSDKAAGSSNRSRPPITTHVLDVARGSPASGIEVHLEMWKDISAPPSFNKKDFNGWATLGTSVTNNDGRSGQLTDIVDNIAPGFYRMSFNTSKYAPAGFFPYVSIIFEIKENQTAEHFHVPLLHSPFSFTTYRGS

SEQ ID NO: 20377 - DNA, 727 bp, Panicum virgatum
  misc_feature: Ceres CLONE 1811303
  misc_feature: Encodes the peptide sequence at SEQ ID NO. 20378
cctatccaagcaagaaagaaacccccgaaaacctcccctgccatggcgaccgccgcccaggccgccgccgccttcctctcgttcctttcttcctcccccagccaccacagcgccccgtcctcggtctccctcggggcaacccctgtcctatcagtctccctccgggtcgctgccgcgggtggcccacggctgtctcccccactccggggccgtcgcatcagcgccgtcatcgcccagctccccaccgcgcatcccgaggtagccactggggacaagaagatcagatggtcttcaagggcggtgcgatcatttgcgatggcggagctggaggcacggaagatgaggtatcctacaacaggcactgaggggctcctcatgggcattcttgttgaaggaactagcggcgccgcaaaacttttgcgtgctaatggaatcacgcttctcaaagtgcgtgaggaggcagcaaatgtgcttgggaaatcagaaatgttttattttagtcctatgcatccaccattgacagaagctgcacaacgagctcttgattgggctgtcaatgagaaactaaagtcaggcgaggatggagaagtaactgccaatcatttgctgctggggatatggtcagataaggagtcagctggtcataaaatcctggcttcacttgggtttgatgatgagaaagccagattacttgccaaaacggccggtgaagagggctgcacgagtc

SEQ ID NO: 20378 - protein, 228 aa, Panicum virgatum
  misc_feature: Ceres CLONE 1811303
  misc_feature (93)..(145): Pfam Name: Clp_N Pfam Description: Clp amino terminal domain
MATAAQAAAAFLSFLSSSPSHHSAPSSVSLGATPVLSVSLRVAAAGGPRLSPPLRGRRISAVIAQLPTAHPEVATGDKKIRWSSRAVRSFAMAELEARKMRYPTTGTEGLLMGILVEGTSGAAKLLRANGITLLKVREEAANVLGKSEMFYFSPMHPPLTEAAQRALDWAVNEKLKSGEDGEVTANHLLLGIWSDKESAGHKILASLGFDDEKARLLAKTAGEEGCTS

SEQ ID NO: 20379 - DNA, 1393 bp, Panicum virgatum
  misc_feature: Ceres CLONE 1811319
  misc_feature: Encodes the peptide sequence at SEQ ID NO. 20380
agaccaaacgccaccgcgccccacctccgtccccgtcctcccccgactagagagccagcgcagaaaccgccgcgtcacacaccctccgcccgctccgcgcacaagcgtttcgttggagaacctgaccgcgccggggggccatgcatagccccagcgcgggcgccggggacatcgtggagatgtcctcggccgccgcctcgccgccggcgcacgaggggcgggaccgcgagagggtgatcccgcacagcggcccgctgagcaagaagtcggggccgcggaagagcgcgcgcttcgccgagtccgtatcggcgccgctcaccgctcccccgccgcgggcctcctcctccccctccgccgacgacgacgactacgtcgagatcaccctcgacgtgcgcgacgactcggtggcggtgcacagcgtcaagcccgcccaccaccacggcggcgccggcgccggcgcggaagaccccgacgtgacgctgctggcgcggacgctcgagagccggcggtcggcgtcctcggccatccgcagcgcctcgtcgcggatcaagcaggtgtcgcaggagctccgccgcctcgcgtccctcaaccgccgcggcggcggcggcgcggcggggcgcggcggcctcgaccgctccaagtccgccgcggcgcacgcgctcaaggggctcaagttcatcagccgggccgacggcgccaagggctgggacgccgtcgaggagcgcttcgacaagctcgaccgggatgggaagctccagaacggcctcctcccccgctccatgttcggccaggtcatcgggatgcgggagcccgagttcgccggcgagctgttcgacgccctcgcgcgccgccgcaacatctccggcgagtccatcagcaaggccgagctgctcgagttctgggaccagatctccgacaccagcttcgacggccgcctccagaccttcttcgacatggtggacaaggacgcggacggcaggatcaccgaggaggaggtcaaggagatcatcacgctgagcgcgtcggcgaacaagctgtccaagatccaggaccagtcggaggagtacgcccggctgatcatggaggagctggacccgggcaacctgggctacatcgacctctacaacctggagatgctgctgctgcaggcgcccagccagtcggtgcgcatcggcaccaccaacagccgcaacctgagccagatgctgagccagagcctccgccccacgccggagcccaacccggtgcgccgctggagccgccgcgccggctacttcctcgaggacaactggcgccgcgtctgggtgctcctcctctggctcgccgtctgcgccgccctcttctcctgggagttcgtccagtaccgccgccgctacgtctttcacgtcatggg

SEQ ID NO: 20380 - protein, 417 aa, Panicum virgatum
  misc_feature: Ceres CLONE 1811319
  misc_feature (162)..(264): Pfam Name: NADPH_Ox Pfam Description: Respiratory burst NADPH oxidase
  misc_feature (265)..(293): Pfam Name: efhand Pfam Description: EF hand
MHSPSAGAGDIVEMSSAAASPPAHEGRDRERVIPHSGPLSKKSGPRKSARFAESVSAPLTAPPPRASSSPSADDDDYVEITLDVRDDSVAVHSVKPAHHHGGAGAGAEDPDVTLLARTLESRRSASSAIRSASSRIKQVSQELRRLASLNRRGGGGAAGRGGLDRSKSAAAHALKGLKFISRADGAKGWDAVEERFDKLDRDGKLQNGLLPRSMFGQVIGMREPEFAGELFDALARRRNISGESISKAELLEFWDQISDTSFDGRLQTFFDMVDKDADGRITEEEVKEIITLSASANKLSKIQDQSEEYARLIMEELDPGNLGYIDLYNLEMLLLQAPSQSVRIGTTNSRNLSQMLSQSLRPTPEPNPVRRWSRRAGYFLEDNWRRVWVLLLWLAVCAALFSWEFVQYRRRYVFHVM

SEQ ID NO: 20381 - DNA, 758 bp, Panicum virgatum
  misc_feature: Ceres CLONE 1811319-R
  misc_feature: Encodes the peptide sequence at SEQ ID NO. 20382
acggcgcgccggcgcaggactacaagcagtacgacgtggtgctgctggtggggctgggcatcggcgccacgcccatgatctccatcatcaaggacatcatcaacaacatgaagatgctcgacggcgacctggaggccggctccggcgccggcggcgacgggtccgtgtcggcggcctccttccgcacgcggcgggcctacttctactgggtgacccgggagcagggctccttcgagtggttccgcggcgtcatggacgaggtggccgagaccgacaagaagggcgtcatcgagctccacaactactgcaccagcgtctacgaggagggcgacgcccgctccgccctcatcgccatgctccagcagctcaaccacgccaagcacggcgtcgacgtcgtctccggcacccgcgtccggacccacttcgcccgccccaactggcgcaacgtctacaagcgcatcgccctcaaccaccgcgaccagcgcgtcggagtgttctactgcggtgccccgatgctgaccaaggagctgcgtgacctcgcgcaggatttctcgaggaaaaccaacacaaagttcgatttccacaaggagaacttctaattcatttagcctcgacaagtttagcgtatatatggatgtagagagaggaagtagaacaaagtaggtattgcttgattgtgaccggccagttgggtcaaaatcccatcagttttttgtttactttagaagaactaataatacaaatgcctttgtaagatg

SEQ ID NO: 20382 - protein, 198 aa, Panicum virgatum
  misc_feature: Ceres CLONE 1811319-R
  misc_feature (10)..(181): Pfam Name: NAD_binding_6 Pfam Description: Ferric reductase NAD binding domain
  misc_feature: SWISSPROT Homolog: EC 1.6.3.1 NAD(P)H oxidase
GAPAQDYKQYDVVLLVGLGIGATPMISIIKDIINNMKMLDGDLEAGSGAGGDGSVSAASFRTRRAYFYWVTREQGSFEWFRGVMDEVAETDKKGVIELHNYCTSVYEEGDARSALIAMLQQLNHAKHGVDVVSGTRVRTHFARPNWRNVYKRIALNHRDQRVGVFYCGAPMLTKELRDLAQDFSRKTNTKFDFHKENF

SEQ ID NO: 20383 - DNA, 714 bp, Panicum virgatum
  misc_feature: Ceres CLONE 1811334
  misc_feature: Encodes the peptide sequence at SEQ ID NO. 20384
acccgcgaatccaacacgagaacgcatcgcgtcgcccccctcgcatcacatgcgcgcataggacccggctgcaggtcgcactcaccaccatgccgcccccgctgctcgcctgtctcctcctcgtcctcctcgtctcgccggccgcggcgcggccgtggtccgtggcggccgaggcgccgaagcccgcggcgaggcctcgcgtgttcccgctgcgggcgcggcaggtgccggcggaggcgctgccgcggccgccgagcaagctgcggttccaccacaacgtcagcctcaccgtgtcgctcgccgtcggcacgccgccgcagaacgtcaccatggtgctcgacaccggcagcgagctgtcgtggctgctctgcgcgccaggccgccgggcgaacgcgagcgcccccaggggcgcatcgttccgtccgggggcctcgcgctccttcgccgccgtgccctgcggcgccgcgcagtgcagctcccgggacctgccggagccgccgtcctgcgacggggcctcgcgccagtgccgcgtgtcgctgtcctacgcggacgggtccacctccgacggcgccctcgccaccgacgtcttcgccgtcggcgacgcgccgccgctgcggtccgcgttcggctgcatgtcctccgcgtacgactcgtccccagacggcgtcgccacggccgggctgctgggcatgaaccggggcacgctctcccttc

SEQ ID NO: 20384 - protein, 208 aa, Panicum virgatum
  misc_feature: Ceres CLONE 1811334
  misc_feature (68)..(208): SWISSPROT Homolog: EC 3.4.23.12 Nepenthesin
  misc_feature (67)..(93): SWISSPROT Homolog: EC 3.4.23.41 Yapsin 1
MPPPLLACLLLVLLVSPAAARPWSVAAEAPKPAARPRVFPLRARQVPAEALPRPPSKLRFHHNVSLTVSLAVGTPPQNVTMVLDTGSELSWLLCAPGRRANASAPRGASFRPGASRSFAAVPCGAAQCSSRDLPEPPSCDGASRQCRVSLSYADGSTSDGALATDVFAVGDAPPLRSAFGCMSSAYDSSPDGVATAGLLGMNRGTLSL

SEQ ID NO: 20385 - DNA, 1120 bp, Panicum virgatum
  misc_feature: Ceres CLONE 1811346
  misc_feature: Encodes the peptide sequence at SEQ ID NO. 20386
aacgcaaaccctagcctatagcacaaacccctgccgccggcgagggacacgcctcgagcctcgagcgcggcgggcgaggaggagagagctaaagagagatggggcggccgtacgcggtgaaggggcgcaagaagaagcgcaggctcgacgaggcggcggcctcggacgccgccccgcccgccgaagaggcggaggagctgccgccgccggagagcggcgaggaaaaggagggggaggatggggcggcggaggggcaggaggaggagcacgcgacggtggaggggctcccggtcgtgcccaggccggtggacgggaagcggcggcccggcgccatcttcgtgctcgagagggcctgcctcgaggtcggcaaagtcggcaagactatgcaaatcctgaactcagatgatcacgctaattatttgaggaagcagaatcgcaatcctgctgactataggcctgatatcattcatcaggctctacttgcgatatttgacagccctttaactaaagctggaaggctacaagctgtttatgtgaggactgaaaagggagtattgtttgaaatcaaaccttatgtccgcatgccacgaacatttaaacgtttttgtggtttgatgtcacaattgttgcaaaagctgagcattacagcagttgggaaacgcgagaagctccttaatgttgttaaaaatcctgttacccgctatctgcctgttggtgcacgaaaagttgggctttcatttagtgctgagaagtcagtcaacttgtttgactatgttgctaaatccagtgatgatgaacccttagtgtttgtggttggtgccatggcccatggaaagatcgacaaggaatacacagatgactacatccaaatttgcaactaccctctcagtgctgcctgctgtttaaatcggatatgcagcgccctggagcagaagtggaacatccaatgaacggaaattttgaaacaaacatctgtgtactcggtagctagtagtatcgtctttttttctccatcttacatgtactgcctctgcctttttgatccgtaccttgagctccagcattttaaacatatgaccgttaaatgcttcaaattcaatgtttccttatgttgcatttt

SEQ ID NO: 20386 - protein, 283 aa, Panicum virgatum
  misc_feature: Ceres CLONE 1811346
  misc_feature (112)..(278): Pfam Name: Nep1 Pfam Description: Nep1 ribosome biogenesis protein
MGRPYAVKGRKKKRRLDEAAASDAAPPAEEAEELPPPESGEEKEGEDGAAEGQEEEHATVEGLPVVPRPVDGKRRPGAIFVLERACLEVGKVGKTMQILNSDDHANYLRKQNRNPADYRPDIIHQALLAIFDSPLTKAGRLQAVYVRTEKGVLFEIKPYVRMPRTFKRFCGLMSQLLQKLSITAVGKREKLLNVVKNPVTRYLPVGARKVGLSFSAEKSVNLFDYVAKSSDDEPLVFVVGAMAHGKIDKEYTDDYIQICNYPLSAACCLNRICSALEQKWNIQ

SEQ ID NO: 20387 - DNA, 1563 bp, Panicum virgatum
  misc_feature: Ceres CLONE 1811373
  misc_feature: Encodes the peptide sequence at SEQ ID NO. 20388
atcgttggctccgtctagggttttagcccctgccgccgcaacccaacctcccgtcccctgcctctgcccctgccgccgcaacccaacctcccgtcccctgcctctgcccctgccgccgcaacctcctcctccccctatcgaatcccgtgcccccgcgacccgccgggcgacgagcgcctgcgccggcggccgagatggaccggtaccagagggtggagcggccgcggaccgagtcggcggccatcgaggagaacgagatccgcatcaccgcgcagggcctcatccgcaactatgtctcctacgccacctccctcctccaggagcggagaattaaagagattgttttgaaggccatgggacaggcaatcagtaagtctgttgctgttgcagagattatcaagaaaagaattcctggtttacatcaggataccaatatcagttctgtcagcatcactgatgtttgggaacctatagaagaaggccttgtcccgcttgagatgactcggcatgtctcgatgatttcaattactttgtctcctggagagttggatcagagtactcctgggtaccaagcacctgcttacgttgaacagcccaggcaaccgcagcgcctccagcaggcaccactgccgcagcgccaacctcgccgagcacaaggccagttccagcagcctgagtacgaagactcctatgctcggggtcgaggtagaggaagaggccgtggacgtggaaggggttggggtagaggaggctatggtgcttatggtggatatggaaacaaccaaggtgggtacaatgagggtggcggttattatgataatcaaggtgggtatggcggctatgataatcaaggtgggtatggaggctatgataatcaaggtgggtatggtggtggatatggctacaaccaaggcagatatggaaactaccaagaaaatggtgggtatagccgaggacgaggtggtggcatgcgcggaagaggcaactggggctaccgtggaggctatgatggaggcaggggcggtggctatgaaggaggcaggggtggaggctatgagcaaggcaggggcggtggctacgagggtggcaggggtggaggctatgagcaaggcaggggcggtggctacgagggtggcaggggtgggggctatgaaggaggcaggggtgggggtggaaggggctatggtggtcgtggaaggggaagaatgggtggccgtgggcgagggaactgagcgcaggcgcaaaatccatgggcttctggtgtttcttcaatgcatgctttataatcaagggaaaagataagttatctgagaatttgtgttggaagccgtcagttatgtgaggtctgttgttttccctgagcgcgaggtttggttgtgagcataatgcatttgcaagtttaatcatgttgtcatctttcaatatttctgctgccgaggttgcttgttttcccaatggtctttaaatgctgagcatgctgcctaatgttcatgcccgcagtatcaacagatggaaactcttcccctgtgttaaattgttcattctatttgtgcaattttgctt

SEQ ID NO: 20388 - protein, 345 aa, Panicum virgatum
  misc_feature: Ceres CLONE 1811373
  misc_feature (18)..(88): Pfam Name: Alba Pfam Description: Alba
  misc_feature: SWISSPROT Homolog: EC 3.1.26.5 Ribonuclease P
  misc_feature: Useful for making plants with modulated nitrogen use efficiency
  misc_feature: Useful for making plants with altered alkaloid content
  misc_feature: Useful for making plants with altered lignin content
  misc_feature: Useful for making plants with altered terpenoid content
  misc_feature: Useful for making plants with modulated phosphate use efficiency
MDRYQRVERPRTESAAIEENEIRITAQGLIRNYVSYATSLLQERRIKEIVLKAMGQAISKSVAVAEIIKKRIPGLHQDTNISSVSITDVWEPIEEGLVPLEMTRHVSMISITLSPGELDQSTPGYQAPAYVEQPRQPQRLQQAPLPQRQPRRAQGQFQQPEYEDSYARGRGRGRGRGRGRGWGRGGYGAYGGYGNNQGGYNEGGGYYDNQGGYGGYDNQGGYGGYDNQGGYGGGYGYNQGRYGNYQENGGYSRGRGGGMRGRGNWGYRGGYDGGRGGGYEGGRGGGYEQGRGGGYEGGRGGGYEQGRGGGYEGGRGGGYEGGRGGGGRGYGGRGRGRMGGRGRGN

SEQ ID NO: 20389 - DNA, 693 bp, Panicum virgatum
  misc_feature: Ceres CLONE 1811387
  misc_feature: Encodes the peptide sequence at SEQ ID NO. 20390
aaccgcaggcattcctctcgtctcgtcccccaccagagccagagcatgcgcgtagccgcgacgcgactcgccgccgcccccgctcccgctcccgctccgcgccccctcctcgtcctgctgctggtcctcctcgtctccgcgcccctcgcgaccagagcagcggccatggccggccacgtcctcggcggcgtgaaggagaaccccgccgccgccaacagcgccgagtccgacgggctcggccgcttcgccgtcgaggagcacaacaaacgccagaacgcgctgctggagttcgtgcgcgtggtggaggccaaggagcaggtggtggccggcacgctgcaccacctcacgctcgaggccattgaggccgggaggaagaaggtctacgaggccaaggtctgggtcaagccgtggctcgacttcaaggagctccaggagttcgtccacaagggggacgctaccaccttcaccagcgccgacctcggcgccaagaaaggtggacatgagcctgattggcgtgaggtgcctgtggaggatcctgctgtcaaagatgctgcacaccatgctgtgaaatcaatccaagagaggtctaactccctgtttccctatgaacttcttgagatcgttcgtgccaaggcacaggttgtggaaggcttcacgaaatttgacattctgatgacgctgaagagaggcagc

SEQ ID NO: 20390 - protein, 215 aa, Panicum virgatum
  misc_feature: Ceres CLONE 1811387
  misc_feature (47)..(135): Pfam Name: Cystatin Pfam Description: Cystatin domain
MRVAATRLAAAPAPAPAPRPLLVLLLVLLVSAPLATRAAAMAGHVLGGVKENPAAANSAESDGLGRFAVEEHNKRQNALLEFVRVVEAKEQVVAGTLHHLTLEAIEAGRKKVYEAKVWVKPWLDFKELQEFVHKGDATTFTSADLGAKKGGHEPDWREVPVEDPAVKDAAHHAVKSIQERSNSLFPYELLEIVRAKAQVVEGFTKFDILMTLKRG

SEQ ID NO: 20391 - DNA, 657 bp, Panicum virgatum
  misc_feature: Ceres CLONE 1811389
  misc_feature: Encodes the peptide sequence at SEQ ID NO. 20392
attcccccacagcacacacagcagctaatccagactcacactactgcagcatttgctttgcttagcacgaccgccgatcgataattaataataatacaacgataatggcggttctgatgatgaagaacaagaagcagatgcaggcggtggtggccttggccgttgtggtggcggcggcggcgctggtggcgtcggcgtcggcggccatcacctgcgggcaggtgggttcggcgctggcgccgtgcatcccgtacgcgacggggaaggcgagcgcgctgccgtcgtcgtgctgcggcggcgtgcgcagcctcaacagcgcggcgcgcacgagctcggaccggcaggcggcgtgccggtgcctcaagagcctggccagcaccgtcaagtcggtgaacatgggcaccgtcgccaccatccccggcaagtgcggcgtctccgtgccattccctatcagcatgtccactgactgcaacaagtacgtactagctagcttctctatcatcgtcttatatatatatatatatatatatatatatatatatatatatatatatatatatatatatatatatatatatatatatatatctatatatatatatatatatatatatatatatatatatatatatatatatatatatatatacatatata

SEQ ID NO: 20392 - protein, 184 aa, Panicum virgatum
  misc_feature: Ceres CLONE 1811389
  misc_feature (37)..(122): Pfam Name: Tryp_alpha_amyl Pfam Description: Protease inhibitor/seed storage/LTP family
MAVLMMKNKKQMQAVVALAVVVAAAALVASASAAITCGQVGSALAPCIPYATGKASALPSSCCGGVRSLNSAARTSSDRQAACRCLKSLASTVKSVNMGTVATIPGKCGVSVPFPISMSTDCNKYVLASFSIIVLYIYIYIYIYIYIYIYIYIYIYIYIYISIYIYIYIYIYIYIYIYIYIYIY

SEQ ID NO: 20393 - DNA, 724 bp, Panicum virgatum
  misc_feature: Ceres CLONE 1811392
  misc_feature: Encodes the peptide sequence at SEQ ID NO. 20394
gggaactgaaaggaaaccgaaaaagaaacagagaaggcctcactccccactccactcccctcccctccccggccccggtgctttcttggatcgcgagaaaaccactcgagaaactcgcaatcgtagggaactgtatcggcaggagcacgaggaagtagacgaggggtggtgcaaggtgccggccgccatggatcacggcaggggacggagacgagcagggaggcagcagcggccgtcccggtctctggtcctgttctcgctgtaacgagagtcggtgccctctgaattccacttgatcggtccaactccagtcgccatgaagcggccacgcggcggcagcccctccctccttccgacggccagagcggatgatgatggttacggcgcggcagctgggatggaggcggagggggacgcggaggaggagatggtggcgtgcggcggcggcggggagaagaagcggcggctgagcgcgaagcaggtgcgcgccctggagcggagcttcgaggtggagaacaagctggagccggagcgcaaggcgcggctggcgcgcgacctcggcctgcagcctcgccaggtcgccgtctggttccagaaccgccgcgcgcgctggaagaccaagcagctcgagcgcgactacgccgcgctgcgccgctcctacgacgcgctgcggcacgaccacgacgcgctctgccgcgacaaggacgccctcctcgccgagatc

SEQ ID NO: 20394 - protein, 135 aa, Panicum virgatum
  misc_feature: Ceres CLONE 1811392
  misc_feature (47)..(101): Pfam Name: Homeobox Pfam Description: Homeobox domain
  misc_feature (102)..(135): Pfam Name: HALZ Pfam Description: Homeobox associated leucine zipper
  misc_feature: The sequence is a functional homolog of SEQ ID NO 260 in the 10/412,699 US patent application
  misc_feature: The sequence is a functional homolog of SEQ ID NO 571 in the 11/479,226 US patent application
  misc_feature: The sequence is a functional homolog of SEQ ID NO 1869 in the 11/479,226 US patent application
MKRPRGGSPSLLPTARADDDGYGAAAGMEAEGDAEEEMVACGGGGEKKRRLSAKQVRALERSFEVENKLEPERKARLARDLGLQPRQVAVWFQNRRARWKTKQLERDYAALRRSYDALRHDHDALCRDKDALLAE

SEQ ID NO: 20395 - DNA, 723 bp, Panicum virgatum
  misc_feature: Ceres CLONE 1811413
  misc_feature: Encodes the peptide sequence at SEQ ID NO. 20396
cccactcccgaatacccctgtataggcccatccactgcccactcccagccgccacccacgcccagcgccccaccgctcccccgccggtcgtcgtttccccgccggccgccgctccccctacgacctccagcggtccatcctcctcagctcctccgcctcggctgcgcaacggcaccgccgccacgcgacgcgcctaggcccgcgcccaggccccaggcggcgccccgccgccacctcctcccccctcaccgggaagccgcatctctcaccgggccgccgcagcgccgcatatttctgtcctcctgatccgccatcccaaacccgcgcgggagagcagcaggcggctccaaggaagatggggtggaaggctgcagagaagctcatcaggcactggaagatcctccgcggtgacaacgtgatgatcatcagaggcaaggacaagggggagaccgggctcatcaagcgggtcattcggtcgcagaatcgcgtcatcgtcgagggcaagaacttggttaagaaacacattaagcaaggggaagggcacacaggtggtattttctccattgaagctccacttcatgtttcaaatgtccaagtagttgatcctgtcactgggaaaccatgtaaggttggatacaagtatttggaagatgggaccaaagtcaggtttgctagagggatgaatgcatctggtgctgtgatcccccggccagaaattctgaa

SEQ ID NO: 20396 - protein, 122 aa, Panicum virgatum
  misc_feature: Ceres CLONE 1811413
  misc_feature (17)..(48): Pfam Name: KOW Pfam Description: KOW motif
MGWKAAEKLIRHWKILRGDNVMIIRGKDKGETGLIKRVIRSQNRVIVEGKNLVKKHIKQGEGHTGGIFSIEAPLHVSNVQVVDPVTGKPCKVGYKYLEDGTKVRFARGMNASGAVIPRPEIL

SEQ ID NO: 20397 - DNA, 733 bp, Panicum virgatum
  misc_feature: Ceres CLONE 1811414
  misc_feature: Encodes the peptide sequence at SEQ ID NO. 20398
accaatcagtcagcacatggaggactcgacccagttcatgcagtgggccctgagcacgctgcagcacgagcagccgccgccgggaacgccggcgccggccgccggcgcctacgacgatggctgcgacaccaccgtctcgtccatcccggtgctgcgatactcggcgtcggtggagagcatggtaccgggggagccaccagcacgggaaggccagcgcgccaccaacagctggagctcggtggacaccgacagcgggagtggcggcggcggcgcgtccgccactgcctggtcgccgccgcagcactcggccatgtgtgctgctgctgccacggccccgggcagctgcagtagcggcaccaaccagccagtgagctgggacttccattccgcgtcggcgcagctaatgaaagaagccccccagccgtactctgccgccgccgcactgcaggcagagagcgggggcggcggtggcagcggtgtcgccgtgccgaagatgacacagcacgtgtcaccgccggcgaggagggcctctgccaagatctccgcgtcgtcttcgtcagcgccgtactcgcaggaccacatcatcgcggagaggaagcggcgggagaagatcaaccagcgtttcatcgagctctcgacagtcatccccggcctcaagaagatggacaaggcgacgatcctctccgacgcgacgaggtacgtgagggatctccaggaaaagctcaggccgctc

SEQ ID NO: 20398 - protein, 238 aa, Panicum virgatum
  misc_feature: Ceres CLONE 1811414
  misc_feature (184)..(233): Pfam Name: HLH Pfam Description: Helix-loop-helix DNA-binding domain
  misc_feature: The sequence is a functional homolog of SEQ ID NO 1275 in the 10/666,642 US patent application
  misc_feature: The sequence is a functional homolog of SEQ ID NO 1704 in the 10/374,780 US patent application
MEDSTQFMQWALSTLQHEQPPPGTPAPAAGAYDDGCDTTVSSIPVLRYSASVESMVPGEPPAREGQRATNSWSSVDTDSGSGGGGASATAWSPPQHSAMCAAAATAPGSCSSGTNQPVSWDFHSASAQLMKEAPQPYSAAAALQAESGGGGGSGVAVPKMTQHVSPPARRASAKISASSSSAPYSQDHIIAERKRREKINQRFIELSTVIPGLKKMDKATILSDATRYVRDLQEKLRP

SEQ ID NO: 20399 - DNA, 721 bp, Panicum virgatum
  misc_feature: Ceres CLONE 1811434
  misc_feature: Encodes the peptide sequence at SEQ ID NO. 20400
catccaaagttgaagttcacagtgcacacacaccaccacggcaccacaccgcagcaacgatatcaaaagggcttgctgtgtgtgatctgcgctccaacagggcagaggtgacaagtgcattatgtgctccaagaagctggcgaagttcgctatacttgtactactggcgctgctacttctgtgctatggagttggaaacgtccagtgcgttcgtgagaacagcacggacctgcactcactgctagagttcaagcagggcgtcaccagcgatccaaataaagtcctgaactcctggaaaaccaaaatccattactgccggtggagcggagttacgtgcacgccgacgcgaccatggcgcgtcatgaggcttaacctcactggccaaagcttggcaggtgaaatcgccccctctctggcaaatctgacgctccttagtgtgcttgacttgtcctccaatcgcttttttggccagttacctcccctgggtcgtctccaactgctggagaccatttatctgaatgacaattcactcaatgggactatccctgacgcactcacaaaactgctccaaactaatcaatttagatctccgtaaaaatcagctatcagtgaccggaccgtcggagaacgaacccgtggaacccgccgagtccgtggagcccgaacccggagtcccgttcgtggtcgagtctgaagttacccaggatggtgttgcgttcgg

SEQ ID NO: 20400 - protein, 157 aa, Panicum virgatum
  misc_feature: Ceres CLONE 1811434
  misc_feature (33)..(73): Pfam Name: LRRNT_2 Pfam Description: Leucine rich repeat N-terminal domain
  misc_feature: SWISSPROT Homolog: EC 2.7.11.1 Non-specific serine/threonine protein kinase
MCSKKLAKFAILVLLALLLLCYGVGNVQCVRENSTDLHSLLEFKQGVTSDPNKVLNSWKTKIHYCRWSGVTCTPTRPWRVMRLNLTGQSLAGEIAPSLANLTLLSVLDLSSNRFFGQLPPLGRLQLLETIYLNDNSLNGTIPDALTKLLQTNQFRSP

SEQ ID NO: 20401 - DNA, 764 bp, Panicum virgatum
  misc_feature: Ceres CLONE 1811434-R
  misc_feature: Encodes the peptide sequence at SEQ ID NO. 20402
ccttttccacctcgggcgccgggtgctcaagctccgcgtcctatgtggattgtgcgtcaccctcaacctcctcaaggacaagctcctaggccggtcagtgcctattggaacaacccaggtatgaccgcaaagggtccgtgcttcaattgtggtggcttaggccacatctctagggattgcccctctccgaggcgtggtggtgccttcaatgcacctaggcccaatgctcctccgcctcaagcatcgcgtcaggaagtcaagccaccacaggctcctaagcgtggtcgtctcaactacaccaccgctgaagaagttccggaggatgctgaagtactcatggtgaccggaccgtcggagaacgaacccgtggaacccgccgagtccgtggagcccgaacccggagtcccgttcgtggtcgagtctgaagttaacccagttgcagatgagatggaagtggtgttcggccatttctaccccgctgatccaaacacgggggaagaataggtcgtggtggctgtagtggtgtccttgagcaaggcatcattaccttagcaagtacttatcgtatctgagcttcgtgagagtatgtaaatgcaataaactttatgtttctgtttaatatgactcgcgtgagcccaaggcttgtaaagtgaagtttgaaacccacctatgttgaacttgtaattaagctgtgaactctggtttgtataaaactgctctttgtggtttatttggcaatgtattcgattgtaaacggtatgtgc

SEQ ID NO: 20402 - protein, 153 aa, Panicum virgatum
  misc_feature: Ceres CLONE 1811434-R
  misc_feature (31)..(48): Pfam Name: zf-CCHC Pfam Description: Zinc knuckle
MWIVRHPQPPQGQAPRPVSAYWNNPGMTAKGPCFNCGGLGHISRDCPSPRRGGAFNAPRPNAPPPQASRQEVKPPQAPKRGRLNYTTAEEVPEDAEVLMVTGPSENEPVEPAESVEPEPGVPFVVESEVNPVADEMEVVFGHFYPADPNTGEE

SEQ ID NO: 20403 - DNA, 1542 bp, Panicum virgatum
  misc_feature: Ceres CLONE 1811435
  misc_feature: Encodes the peptide sequence at SEQ ID NO. 20404
ggagctttgctactcttcagcttcagtccagtcacagatcgcagtacaaaccgaatccgccgcgcaggaaggcgtcgaagcattttgggtcggcctccggagcggggagggagggaaatcgaagcgacgaggacgaagcaatggacgaggcggtgcaggaggcgaagctgctgcggcaggtgaacgccctcatcgtggcccacctccgcggccagaggctcgggcaggccgccgcagccgttgccgccgccaccatgacccccctctccgccgccgactctgtccccgccaaccacctcctccgcctcgtcgccaagggcctcgcggcggagagaggaggtgccgcttccgcgttcgactccgccgggtttggtggggtggtgccgccgctcggctccggtgccgtggatttcagtgtgcaggatgtcaggggttcgtccaagagcttccccaagcacgaggcgaggcacgtctctgaccataagaacattgcccggtgtgcgaaatttagtcctgatggcaagtattttgcaactggaagtgctgacacatccattaagttctttgaggttgctaaagttaagcagacgatggtaggagactccaaagatggcaatgcccggccagcgatacgtacattttatgatcacatgcagcccatcaacgatctcgattttcatcctgagagtccaatactgatatcagcttcaaaagacaatacaataaaattctttgacttctcaaaaaccaatgcaaggaaagcattcagagttgttcaggatactcataatgttagatctgtatgttttcatccatgtggggattaccttttagcaggaactggtcacccagttgctcatctgtatgatgtaaacactttcacatgctttttatcagcaaatccacaggattctagttctgccattaaccaggtgcgttactcgtgtactgggagcttgtatgtgactgcttctaaagatggttctctgcgcatctgggatggagtatctgctgaatgtgttcgtcctattattggagcacatggatctgcagaagctactagtgcagtttttaccaaagatgagaggtacctcctgtcttgtggaaaggattcttctgtgaagttgtgggaagttggcactggacgacttgtgaagcaatatggaggagctgttcacagacaattccgttgtcaggctgtcttcaatgaaactgaggagtttgtgctatcagttgacgaacaaaacagcgaggttgttgtctgggatgcacttactgctgaaaaggttgcaagattgccgtctggcagcaccggtgctcctagatggctcgaccactccccagtagaaccagtgtttgttacttgcggaaccgatagatccatcagattctggaaacaaactgcgtaggcttgtagattcaaccattcaaataaagactttgtttgtagcagtactctttctggataaatctttctcatgtaactcgagtgttgtatatgggagaaatttgtacaagctatacgtttatttactttgtagt

SEQ ID NO: 20404 - protein, 422 aa, Panicum virgatum
  misc_feature: Ceres CLONE 1811435
  misc_feature (161)..(199): Pfam Name: WD40 Pfam Description: WD domain, G-beta repeat
  misc_feature (105)..(143): Pfam Name: WD40 Pfam Description: WD domain, G-beta repeat
  misc_feature: SWISSPROT Homolog: EC 2.7.11.7 [Myosin heavy-chain] kinase
MDEAVQEAKLLRQVNALIVAHLRGQRLGQAAAAVAAATMTPLSAADSVPANHLLRLVAKGLAAERGGAASAFDSAGFGGVVPPLGSGAVDFSVQDVRGSSKSFPKHEARHVSDHKNIARCAKFSPDGKYFATGSADTSIKFFEVAKVKQTMVGDSKDGNARPAIRTFYDHMQPINDLDFHPESPILISASKDNTIKFFDFSKTNARKAFRVVQDTHNVRSVCFHPCGDYLLAGTGHPVAHLYDVNTFTCFLSANPQDSSSAINQVRYSCTGSLYVTASKDGSLRIWDGVSAECVRPIIGAHGSAEATSAVFTKDERYLLSCGKDSSVKLWEVGTGRLVKQYGGAVHRQFRCQAVFNETEEFVLSVDEQNSEVVVWDALTAEKVARLPSGSTGAPRWLDHSPVEPVFVTCGTDRSIRFWKQTA

SEQ ID NO: 20405 - DNA, 702 bp, Panicum virgatum
  misc_feature: Ceres CLONE 1811438
  misc_feature: Encodes the peptide sequence at SEQ ID NO. 20406
atcaggcacggcagggcgctgcagtacaccctcgctcacctctcccggggagcctctcgcttctcccagccctgagctcccctgcattccaagccacaccgacgcaggcgccaaaaataaacgccacgccactacgtggcgagggggctccgcgggtcgcccccatctccagctagctagcctcctccgcgacgacgatggaggttgccgccgaggctgccgcgccggcgcccgacgagggcgcgctggacgagcgcggcgcggcgctgcacctccccaggctggtggccggcgtcgtctccggcgccctcaccggcatcttcgctctcgctggagccttgaccggagccgtcaccggcgccgtcgcggggagagcttcggacagcggcgtcctccggggagctggactgggggcgttcgccggagctgtgctctccatcgaggttcttgaggcttcgcgagcttactggtgctccgaccggctgggctcgcacggtgcatcctccatggctgatttcattgagcagctcattcaggcccggtttgtgcaacagcaattaacatcttcaggatatacatcatctcgctggcaggtcagtaacctgtagctcattcgtagtgttctagtgacatttctgtctatgcttgctttgagtcagtatatctttgtgctgttatagaaattgaatgctaatgctgcac

SEQ ID NO: 20406 - protein, 136 aa, Panicum virgatum
  misc_feature: Ceres CLONE 1811438
  misc_feature: Useful for making plants with altered carbohydrate content
  misc_feature: Useful for making plants with altered alkaloid content
MEVAAEAAAPAPDEGALDERGAALHLPRLVAGVVSGALTGIFALAGALTGAVTGAVAGRASDSGVLRGAGLGAFAGAVLSIEVLEASRAYWCSDRLGSHGASSMADFIEQLIQARFVQQQLTSSGYTSSRWQVSNL

SEQ ID NO: 20407 - DNA, 1113 bp, Panicum virgatum
  misc_feature: Ceres CLONE 1811448
  misc_feature: Encodes the peptide sequence at SEQ ID NO. 20408
aaccactcccaccactgttcctcccctctctctctcgagctgggagatatcctaaactccaaagcgcaggagcggaggggaaagcaacaagcgatcagaagacgccgggagcgaaaggcagctagatacgcacggcgcctgccatgtcgcctctccgtgacctggactgctggtcgtcggtcacctgagagtagagcccgacgagggggagctagctgccagtttgcgcacctgctgctgagtgagtcaaagggggcaagagaagaaggaagcttgtgctgtttgttttctcccgatggcggccgcctcgtccgcgcccttcttcgggctcggcgacacgcagatgcagccctctctgcagcaaaactcctccgcggcagcagccgctcccggcgccgccgccgccgccgcgccgccgaagaagaagaggaaccagcccggcaatccaaaccccgacgcggaggtgatcgcgctgtcgccgcggacgctgctggcgacgaaccggttcgtgtgcgaggtgtgcaacaaggggttccagcgggagcagaacctgcagctccaccggcgcgggcacaacctcccctggaagctgaagcagaagaaccccaaggaggcccggcggcgggtgtacctgtgcccggagccgacgtgcgtgcaccacgacccgtcccgggcgctgggcgacctcacgggcatcaagaagcactactgccgcaagcacggcgagaagaagtggaagtgtgacaagtgcaacaagcgctacgccgtgcagtccgactggaaggcgcactccaagacctgcggcacgcgcgagtaccgctgcgactgcggcacgctcttctcaaggagggacagcttcatcacccaccgtgctttctgcgacgcgctggctcgtgagagcgcgcagatgccgccattgggcgccggcctctacgtcggctccggcagcatgagcctcgggctctccggcgccgccgcccagatgcatggcttcggggaccaagccggccagtcctcttcagcagcggcggccgctcaattcgaccacatcatgccaccgtcctcgggcccctctttgttccgttctcaggtgtcggcggcctcgtcgtcgtc

SEQ ID NO: 20408 - protein, 272 aa, Panicum virgatum
  misc_feature: Ceres CLONE 1811448
  misc_feature (71)..(93): Pfam Name: zf-C2H2 Pfam Description: Zinc finger, C2H2 type
  misc_feature: Useful for making plants with altered lignin content
MAAASSAPFFGLGDTQMQPSLQQNSSAAAAAPGAAAAAAPPKKKRNQPGNPNPDAEVIALSPRTLLATNRFVCEVCNKGFQREQNLQLHRRGHNLPWKLKQKNPKEARRRVYLCPEPTCVHHDPSRALGDLTGIKKHYCRKHGEKKWKCDKCNKRYAVQSDWKAHSKTCGTREYRCDCGTLFSRRDSFITHRAFCDALARESAQMPPLGAGLYVGSGSMSLGLSGAAAQMHGFGDQAGQSSSAAAAAQFDHIMPPSSGPSLFRSQVSAASSS

SEQ ID NO: 20409 - DNA, 750 bp, Panicum virgatum
  misc_feature: Ceres CLONE 1811448-R
cccaattcaacggcggcggcggcggcggcggcaacgccgatcacggcagcgtgatggcgtccatgggcagccacctcagctgcggcagcttcccctcttcgctgtacaactcatctccatcggccggcctggcgcagaactcggcgacggcgctgctgatgaaggcggcccagatgggctcgacgtcgagcgcccagaacggccccagcgcgctgctccgcgccgccggcttcagcgccgccagcggccagggcactactagcagggcctgcggagaagggacgtcgcacgaggcgcacttccatgacctcatcatgaactctctggcgggaggcggcggcggcggcttctccggcggtgcagggttcggcgccgtggacgacggcaagctgagcacgagggacttcctcggcgtcggcaggggcgccatggcgccgcccgggctccacatcggcgcactggacccggcccagatgaagtgatcgatgtgatgataggatcagggaaagaacaacaagaacaaaacaaggagaagaggcaacaaccaagaagtcaataaacagacggcgggcgcgtgcacgtgaaaccgagcttttcgcgtgcatatggaaggtgagctaatgagggattgatcggagagaccaagtgaactcaatctagttttgtttttctcaaatttctgtgttgttgatgatggtgccatgacaaggctaggggctagcttcatgcaacttaattttgctattccgg

SEQ ID NO: 20410 - DNA, 1279 bp, Panicum virgatum
  misc_feature: Ceres CLONE 1811452
  misc_feature: Encodes the peptide sequence at SEQ ID NO. 20411
atgccagtgccacgcgcgcaccatcatcccgagtccctgacagcctgaccccatcttccttctccggccggaaagcaactactccgcgtcccggccgctacccttttccccgcaccgcacggcggagaccacgatccccgccggccgacgaagtagggatcgcgagttgcgacgaggaaggagaggaggctcctcgatcccgctgcagttatctgtctgctcgatcacccgataactatccaacctagtagttgtttccttggctcacccttaccccttgtgtttgggtcttcgcagattcatttcgatcgggggtcgcggtgatttggtaggagccttcgggagcagcggcgatgtcgggcgtgttcggcagggtgttcgggaagtccaagcagcagagccaggccaccgcgctggcctctctggacaagctcaacgagacacttgaaatgttggaaaagaaggaaaatttgctagtgaaaaaggcgaatcttgaagtagagaaggccaagaatttcaccaaagccaagaataagagagccgcaatacagtgcttgaagaggaagaggttatatgagcaacaaattgagcagcttggaaatttccagctaaggatacatgatcagatgattatgctagaagccgcaaaagctacaacagagactgtggatgcattgagaactggagcatccgcaatgaaagctatgcacaaatcaacaaatattgatgatgttgacaaaaccatggatgaaatcaatgacaatatggagaacatgagacaaattcaggatctactgtcagcacctatgggcgcaacagctgattttgatgaggatgaactggaagctgaacttgcggatctggaaggggaggagttggaggcagagctgcttgcacccaccacgactgctcctaccaccgctccagtgcgtgtgcctactgcacagcagtcctctcggccgtcggcccagagtagtaaaaccgaagatgatgaactggcagctctacaagcagaaatggctatgtaattagtttacagtcattgacatggtcatgttggagtccagatactgcgagtatcttggaactcgggtatactaatgaagatcttcctaggaagatgtcagaattacacagagagaagccacatgccagcctgacagcttatgtatgatatcatgctatgctattgttttgtaatcaatcacctcagatgagctaataaacaaatattctgctaataaattggggatatttcagtaatgtgtatttcaatttc

SEQ ID NO: 20411 - protein, 224 aa, Panicum virgatum
  misc_feature: Ceres CLONE 1811452
  misc_feature (22)..(191): Pfam Name: Snf7 Pfam Description: Snf7
  misc_feature: Useful for making plants with modulated nitrogen use efficiency
MSGVFGRVFGKSKQQSQATALASLDKLNETLEMLEKKENLLVKKANLEVEKAKNFTKAKNKRAAIQCLKRKRLYEQQIEQLGNFQLRIHDQMIMLEAAKATTETVDALRTGASAMKAMHKSTNIDDVDKTMDEINDNMENMRQIQDLLSAPMGATADFDEDELEAELADLEGEELEAELLAPTTTAPTTAPVRVPTAQQSSRPSAQSSKTEDDELAALQAEMAM

SEQ ID NO: 20412 - DNA, 2361 bp, Panicum virgatum
  misc_feature: Ceres CLONE 1811453
  misc_feature: Encodes the peptide sequence at SEQ ID NO. 20413
attctgcttctgtctcagtcggtccagtacaaactccagtactccactccactacactcctctcgaatcgaatcaactagtgtagtttataagtaatcacacagaggcaggcattccgatccgatcccattcactgattccctcatcctctccgatgcaacctcgccggcgccgtccccgtccccgtccctaaccctagcaaggcacccatggcgttctggtggccgctcctggtgctcgccgccgcctacgcgctctgccgcctgctcctcttcctcatcccgcccaccgtcccttccatcgaagtcgacgctgccgacgtgttggccaaggaggacagcttcatctacataccaagaaagggcaaagcagctcagaccgacaaggtccaatgctacgaaccagcaaccatgaaatacttgggctatttccctgcattgactcctgatgaggtcaaggagcatgttgcacaagccaggaaagctcaaaagatatgggcaaaaagcagtttcaagcaaaggcggcagttccttcgtatccttctcaagtatatacttgaacatcaggatctcatatgcgaggtatcatctcgggacacgggaaagactatggttgatgcttcattaggcgagataatgaccacatgcgagaagataaactggcttctggatgagggtgagaagtggttaaaacctgagtacagatcaactgggagatcaatgctgcacaagagagcaaaagttgaattttaccctcttggagtgattggtgctattgtatcttggaattatcccttccataatgtttttaatccaatgctggctgcagtattctctggtaatgcagcagttataaaggtctctgaacacgcgacttggtcaggctgcttttattttcgtatcatacaagcagctctttcagctgttggtgcacctgagaatctggtgcacataataactggttttgctgaaacaggccaagctcttgtatcttcagtagacaaaataatatttgtgggatcacctggcgttggaaagatgatcatgcaaaaagcatcggagactctaatacctgtaactcttgagcttggtggcaaggattcctttattgtgtgtgaagatgtagatttacccaatgtcgttcaagtcgccattagagctgctctgcaatctagtgggcagaattgtgctggtgctgaaagattttatgtccacaacgatatctattcagcctttgtttctcaagtagtgaagatagtcaaatctatatgtgttggtccccccttatcgggcagatatgatatgggtgcaatctgtatgatagagcactctgagaaactccagaatcttgttaatgacgctattgacaaaggtgctgaaattgccgtcagagggagttttggcaatcttggtgaagatgcagttgatcaatttttccctccaactgtcctggtgaatgttaatcacacaatgaaaattatgcaagaagagacatttggaccaattctaccaatcatgaaattcagttctgatgaagaggctattaaacttgcaaacgattcgaaattcggtcttggttgtgctgttttttctggcaaccagaagcgtgccatcaaaatagcatcccaattgcactgtggtgtggcagcaatcaatgattttgcgtcaagctatatgtgtcagtcattgccatttggtggtgttaaagacagtgggtttggaagatttgctggtgtagagggcttgcgagcttgctgccttgtgaaggctgtcgtagaagatagattctggccgtatattaaaacgatgatcccaaaacctatccagtatcctgtctctgagcatggatttgagttccaggagctgctcgtggaaactctgtatggctacagcgtttgggacaggttgcggtcccttatgaatctggtaaagatgattaccgagcagaactctaccccagctccaggtacgaggatgaagaaaaggcgatgaggcgataaagaggggttcagttgaatcttgtgccaatttgctcttatgatgctgcttccatcagcgataggcttgttggggatgtaggtcacgtgcttggcggccggcactgactacatgtaagcggccgtacaatgtggatgactctgttctgttggtgcttgctgcttgtgcttgggaacgtagctttgagaatcttttctggtttacacctgttgcctgggctatggttgtgcaaggatgtgtcatgtgctgctcctggacaccatcaccatgtgctgtgctgtgctgggaataattaaatgccctccgatccgcctgtagtacgtaatagcattatgctttcgtgcaattaaatggcacgcagcct

SEQ ID NO: 20413 - protein, 593 aa, Panicum virgatum
  misc_feature: Ceres CLONE 1811453
  misc_feature (53)..(521): Pfam Name: Aldedh Pfam Description: Aldehyde dehydrogenase family
  misc_feature: SWISSPROT Homolog: EC 1.2.1.3 Aldehyde dehydrogenase (NAD(+))
MAFWWPLLVLAAAYALCRLLLFLIPPTVPSIEVDAADVLAKEDSFIYIPRKGKAAQTDKVQCYEPATMKYLGYFPALTPDEVKEHVAQARKAQKIWAKSSFKQRRQFLRILLKYILEHQDLICEVSSRDTGKTMVDASLGEIMTTCEKINWLLDEGEKWLKPEYRSTGRSMLHKRAKVEFYPLGVIGAIVSWNYPFHNVFNPMLAAVFSGNAAVIKVSEHATWSGCFYFRIIQAALSAVGAPENLVHIITGFAETGQALVSSVDKIIFVGSPGVGKMIMQKASETLIPVTLELGGKDSFIVCEDVDLPNVVQVAIRAALQSSGQNCAGAERFYVHNDIYSAFVSQVVKIVKSICVGPPLSGRYDMGAICMIEHSEKLQNLVNDAIDKGAEIAVRGSFGNLGEDAVDQFFPPTVLVNVNHTMKIMQEETFGPILPIMKFSSDEEAIKLANDSKFGLGCAVFSGNQKRAIKIASQLHCGVAAINDFASSYMCQSLPFGGVKDSGFGRFAGVEGLRACCLVKAVVEDRFWPYIKTMIPKPIQYPVSEHGFEFQELLVETLYGYSVWDRLRSLMNLVKMITEQNSTPAPGTRMKKRR

SEQ ID NO: 20414 - DNA, 1092 bp, Panicum virgatum
  misc_feature: Ceres CLONE 1811467
  misc_feature: Encodes the peptide sequence at SEQ ID NO. 20415
aagtcgacgccatcatctccagtctccacgccacgcgcttcctctgcctgtccgacttattttaggttcctcgccaagtcctcctccccccctcccccagcctcaacctcgcgttaggtagctttgcttcgaatcccacatctccatccacttctcgccagacgccatgggcgccgccgccgacaaccacgtggaggagtcgaggcccctcctcccagctgcggtcggcgccgccatccccgcggacgagaagcccccgctggcgccggctccggctccggaggccaccaagctctacgccgatggggttcccgtcgtgatcggcgagccggtcgcggcgcacgccatcccgcgggagagctggagctccgggatcctctcctgcctcggccgcaacgacgagttctgcagcagcgacctcgaagtgtgtcttcttggaagcgtagcaccatgtgtgctgtatggtagtaatgttgagaggcttgcggctggacaaagcacttttgcaaacagctgtttcacttacactggtctctatatgcttggaagctccctctttgggtggaactgcctagccccatggttctctcatcccactcgtacagctattcgccagcgctacaatcttgagggtagctttgaggctttcacaaggcaatgtgggtgctgcggtggtctgatggaggacgaggagaggcgcgagcacctagaggttgcctgtgactttgcaacccactacctctgccacccctgcgccctctgccaggaggcgcgggagctgcgccgcagggtcccccatcctggtttcaacaacgggcgctccgtcttcgtcatgatgccacccatggagcagacaatggggcgtggcatgtgagcaagctcctgcccttgccctgctctagttggatctgtgctacctgtgatggcttcgccgtcttgtctgttcgcccgtaaatacaagtttgtggtatgtgatcatgttgtgctccgtgtgtggactgctgtatggattctgaattgcattgtatcacctgtttttgtggttcgtggtcctccatcgacttgagaaattcaaaatatcagattaaagtt

SEQ ID NO: 20415 - protein, 235 aa, Panicum virgatum
  misc_feature: Ceres CLONE 1811467
  misc_feature (66)..(205): Pfam Name: PLAC8 Pfam Description: PLAC8 family
MGAAADNHVEESRPLLPAAVGAAIPADEKPPLAPAPAPEATKLYADGVPVVIGEPVAAHAIPRESWSSGILSCLGRNDEFCSSDLEVCLLGSVAPCVLYGSNVERLAAGQSTFANSCFTYTGLYMLGSSLFGWNCLAPWFSHPTRTAIRQRYNLEGSFEAFTRQCGCCGGLMEDEERREHLEVACDFATHYLCHPCALCQEARELRRRVPHPGFNNGRSVFVMMPPMEQTMGRGM

SEQ ID NO: 20416 - DNA, 1430 bp, Panicum virgatum
  misc_feature: Ceres CLONE 1811479
  misc_feature: Encodes the peptide sequence at SEQ ID NO. 20417
ggtcccttgtcgcctcctccgcgggaccggttcgccgtctcctcccgacctctgccgcccgccccgcgcgcatggaggcgctgtggaagcaggcctccaggctcaaggagcaggtcgcccgccagggcgtgttcaagcagtttggctatgggaattcagacaactcgtttacagatgagtcagaggttaaactgcatcagaaattggaaaagctgtacttatcgactcgtgcggctaaacattttcaaagggacatcgttcgtggcgtggagggctatattgtcacaggatccaaacaagttgaaatagggaataaattgtctgatgacagccagaaatatggtgttgaaaacacatgtacaagtggtgatactttatccaaagcagctacatacttcggaaaggcacgttcactgattgaaaaggagcgtggcaacatgttgaaagcatttggcacacaggtggcggagccgctgcgggcaatggtaatgggtgcacccttagaggatgctagacatctggcccagagatatgacagaatgaggcaagaagccgaagcacaggttgtcgaagtatctaaacggcagaacagagtgagggaatcacctgggaatggtgatatgatatccaagttggaagctgctgagtacaagcttgaagaactgaaatcaagcatggtgggattagggaaggaagctattgcagcaatgtcagctgttgaggctcagcagcaacgattgacattacagcgccttattgcactggttgaggctgagagagcttaccatcagagagttctggagatacttgaccagttggaagaagagatggtgtctgagcgccaaaaaatcgaagcacctcctaccccagctgcagaaaattatatggcaccaccaccttcttatgatgaagttaatggagtgtttgcatccacttctgttaatgagacaatccaatctgtcgatttcttcctaggagaggcccttgattccttcagagcggaaagtgagtttgagcttaccttgtcagctggtgacattgtaattgtccgaaagatctcaagcaatgggtgggcagaaggcgagtgcaagggcaaagctggatggttccctcatgcttatgttgaaaggcgagaacgtgttttagcaagcaaagttccacacatcttttaggagtcttgaactgtcaattacgtggtttttatttttatattgttggatgctggaacagtagctgtcttctatttatgtgcctcttagcttctgcgatgtacttaccgtgcggcatgtgtatagatcaaaattttgatttccgttttttttagtttctacctagattctgaatgtaaacatttcgggagactgattggacaatggacattagttatcttcatgttatttgaaatggtgaaatagatacagttgatgttc

SEQ ID NO: 20417 - protein, 366 aa, Panicum virgatum
  misc_feature: Ceres CLONE 1811479
  misc_feature (300)..(354): Pfam Name: SH3_1 Pfam Description: SH3 domain
MEALWKQASRLKEQVARQGVFKQFGYGNSDNSFTDESEVKLHQKLEKLYLSTRAAKHFQRDIVRGVEGYIVTGSKQVEIGNKLSDDSQKYGVENTCTSGDTLSKAATYFGKARSLIEKERGNMLKAFGTQVAEPLRAMVMGAPLEDARHLAQRYDRMRQEAEAQVVEVSKRQNRVRESPGNGDMISKLEAAEYKLEELKSSMVGLGKEAIAAMSAVEAQQQRLTLQRLIALVEAERAYHQRVLEILDQLEEEMVSERQKIEAPPTPAAENYMAPPPSYDEVNGVFASTSVNETIQSVDFFLGEALDSFRAESEFELTLSAGDIVIVRKISSNGWAEGECKGKAGWFPHAYVERRERVLASKVPHIF

SEQ ID NO: 20418 - DNA, 1357 bp, Panicum virgatum
  misc_feature: Ceres CLONE 1811504
  misc_feature: Encodes the peptide sequence at SEQ ID NO. 20419
aacccaacaagttcccgaactcctcacacaccaccacagcaacgtgcacaccagcttcgtcttcgacaacgacaggccggctcatagttcgatttgcacctcactgatctcgatatcgcctccggcaatgcagtccatgggcggcgggcgcaggaagccggcgtatccaccgctgctgctccgcttcgtcctcgccgtcgtcgtgctgagcgcggcggcgccgcgctgcgcggcgttcatcaacccgcgcatgctgttcctggtgaagccggacccgatcgtgctgcgggaccacggcggcgcgctgctcacggggaacctcaccgtcaacctgctcttctacggccgcttcaccccggcgcagcgcgcggtcgtggcggacttcgtccggtccctctcggcgcccgcgcccgcgcccgcgcccgcggcgccgccgtccgtggcgtcgtggtggcggaccacctcgctgtaccgcggcggcggcgcgcgggtggcgctcggccggcagatcctggacgagcgcatgtcgctgggccggggcccgctctcgccgggcgacgtggcggcgctggcgcgcgccgcggggcaccaccggggcgccgtcacggcggtgctcacggccgccgacgtcgccgtggcgcccttctgcgtgtcgcggtgcggcgcccacgggcgcggccgcggcggcgcgcacggcagggcgcggtacgcgtacctgtgggcgggggacccggcgcggcagtgccccggccagtgcgcgtggccgttccaccagctgccgcacgggccccaggccccgccgctcgtgccgcccaacggcgacgtcggcgccgacggcatggtcatcagcctcgccgcgctcctcgccggcacggtcaccaacccctacggcgacgggtactaccagggcgacgacgcgggcgccgggctggaggccgccacggcgtgcgccggggtcttcgggagcggggcctaccccggctaccccgggaagctgctcacggacccggccaccggcgcgagctacaacgccgtcgggctgggcgggaggaagtacctgctcccggcgttgtgggacccgacgacctcgcagtgcaagacacttgtctagctagactagacgtggccggagggagacggccaaatgctctctgcatgagggaggaaaaataaatgcctcatttatttccattccttctgttcagtgttcacttccttgctgcatgtagcacttgtagtttgctcttcgaggagcagattgtatgtatgatgatgcgtttgtaggatgcctgtgcttggatttgcatgttatgcttaaacgtggagtaatgccctctcgatctattacttttttttc

SEQ ID NO: 20419 - protein, 327 aa, Panicum virgatum
  misc_feature: Ceres CLONE 1811504
  misc_feature (53)..(327): Pfam Name: Phi_1 Pfam Description: Phosphate-induced protein 1 conserved region
MQSMGGGRRKPAYPPLLLRFVLAVVVLSAAAPRCAAFINPRMLFLVKPDPIVLRDHGGALLTGNLTVNLLFYGRFTPAQRAVVADFVRSLSAPAPAPAPAAPPSVASWWRTTSLYRGGGARVALGRQILDERMSLGRGPLSPGDVAALARAAGHHRGAVTAVLTAADVAVAPFCVSRCGAHGRGRGGAHGRARYAYLWAGDPARQCPGQCAWPFHQLPHGPQAPPLVPPNGDVGADGMVISLAALLAGTVTNPYGDGYYQGDDAGAGLEAATACAGVFGSGAYPGYPGKLLTDPATGASYNAVGLGGRKYLLPALWDPTTSQCKTLV

SEQ ID NO: 20420 - DNA, 701 bp, Panicum virgatum
  misc_feature: Ceres CLONE 1811514
  misc_feature: Encodes the peptide sequence at SEQ ID NO. 20421
ctgatggcaattacaaggcatggtatcaatcgcaatgacacaagacctctgatgagatgttcttttgaagagactgtggatatcttgcttgatgccgctgtgtatgctgaatctgactacccgaacggtgtcacggagaacattatgcttggtcagcttgctcctattggtactggaggttgcacactatttctaaatgaccagatgctgaaacagagcattgaacttcaactcccaagctatttggaatgtgactttagcatgacaccaacaccacccctctctggaacaccatatcatgaaggaatgatgtcgccaagttatctgatgagtccagacttcagggcttcccccattgatacaaatgcttctttctcgcgatatgtcaggcatatggcgttatcacctttcccttcacaaggttactctcaatactctgggggatacaatccaagtcctagctcagaagacagttacaaccccatttctccatcatacactcctatatcaccaatttatactcctatttctcaagcatacagtcctgcatcactgcttaatgctcctacttcaacatcatatagtgcagcaagtccaatttactcacccacaactccaatttacaccccatcgagcccagtttactcacagattccttcatactcacccacaactccaatttacaccccatcgagcccagt

SEQ ID NO: 20421 - protein, 233 aa, Panicum virgatum
  misc_feature: Ceres CLONE 1811514
  misc_feature: SWISSPROT Homolog: EC 2.7.7.6 DNA-directed RNA polymerase
LMAITRHGINRNDTRPLMRCSFEETVDILLDAAVYAESDYPNGVTENIMLGQLAPIGTGGCTLFLNDQMLKQSIELQLPSYLECDFSMTPTPPLSGTPYHEGMMSPSYLMSPDFRASPIDTNASFSRYVRHMALSPFPSQGYSQYSGGYNPSPSSEDSYNPISPSYTPISPIYTPISQAYSPASLLNAPTSTSYSAASPIYSPTTPIYTPSSPVYSQIPSYSPTTPIYTPSSP

SEQ ID NO: 20422 - DNA, 619 bp, Panicum virgatum
  misc_feature: Ceres CLONE 1811528
  misc_feature: Encodes the peptide sequence at SEQ ID NO. 20423
actaatccactgctccatccggccaccaccgagctccgagcaaagtccctgccaagtgccactgcgcgcccgagggcatgtccgtcgcctcatcacaccacctgcgcccggcgccggccggcgcggcgcggcgccctggctgcgcggctgccgtggcgctccggcccggcggtgcctggaccccgtcacgcggccgctgcgccgtcgcggcggcggcgggcgctgggggcgaggcggcttcagcccacgccgccgacgcggcgtcggcaatctcccccgcggcggccgccgccagggatagggtgcggcgccacacgatttcggtgttcgtcggggacgagagcgacatgatcaaccggatcgccggggtgttcgccaagagagggtacaacatcgagtccctcgccgaggggctcaacaaggacaaggcgctcttcaccatcgtcgtctccgggactgacagggtgctcaaccaagtcatcgagcaactcaataagcttgtcaacgtcctcaatgtcgaagatctatctaaagaacctcaggttgaaagagaactgatgcttataaaactaactgttaaacctgatcatcgtccagaggtcatggttttagttgatat

SEQ ID NO: 20423 - protein, 180 aa, Panicum virgatum
  misc_feature: Ceres CLONE 1811528
  misc_feature (79)..(143): Pfam Name: ACT Pfam Description: ACT domain
  misc_feature: SWISSPROT Homolog: EC 2.2.1.6 Acetolactate synthase
MSVASSHHLRPAPAGAARRPGCAAAVALRPGGAWTPSRGRCAVAAAAGAGGEAASAHAADAASAISPAAAAARDRVRRHTISVFVGDESDMINRIAGVFAKRGYNIESLAEGLNKDKALFTIVVSGTDRVLNQVIEQLNKLVNVLNVEDLSKEPQVERELMLIKLTVKPDHRPEVMVLVD

SEQ ID NO: 20424 - DNA, 587 bp, Panicum virgatum
  misc_feature: Ceres CLONE 1811567
  misc_feature: Encodes the peptide sequence at SEQ ID NO. 20425
gccgccgccgcagctgtcgctcgcaccgtcgcatctccgcagggttcgcaaagatggcggtgcctctgctaacgcagaagatcgtgaagaagcgggtcaagcagttcaagaggccccatctcgaccgctacaaatgcctcaagccaagctggcgcaggcccaagggtattgactcccgcgtcaggcggaagttcaagggatgcaccttgatgcccaacattggatacggctctgacaagaagacaaggacgtactgcgcggagattgcccacaacgtctccacccgcaagcgcaaggagattgttgagcgtgctgcacaactggacatcgtggtcaccaacaagcttgccaggctacgtagccaggaggatgagtgaaatattcagtagtcgcagttgcgttgttcttagaacagtaccgagttggagatactcttccaccatttttatgcttatgttagacatgttcttttgctatgagtgtactagtgatggctaataccatctagttttgatctgacatcatgaaagtgtgccaatgacctcatgcttatggtttgtgagtataaattttgttcctgtgcgtcc

SEQ ID NO: 20425 - protein, 107 aa, Panicum virgatum
  misc_feature: Ceres CLONE 1811567
  misc_feature (14)..(97): Pfam Name: Ribosomal_L32e Pfam Description: Ribosomal protein L32
MAVPLLTQKIVKKRVKQFKRPHLDRYKCLKPSWRRPKGIDSRVRRKFKGCTLMPNIGYGSDKKTRTYCAEIAHNVSTRKRKEIVERAAQLDIVVTNKLARLRSQEDE

SEQ ID NO: 20426 - DNA, 709 bp, Panicum virgatum
  misc_feature: Ceres CLONE 1811568
  misc_feature: Encodes the peptide sequence at SEQ ID NO. 20427
agcaggtcgcggccggcctcgaaccatctcgtttcgtttcccttcctccttccctcgctccccagccacaccacatctcgcgcaggtgggtacgcttgaataagttggaaatccttcaagttcccggctccttatggcttcctcagatatctctgttgatattcggcccgactttaactcattcgatcatttcccaagcatgcgatacattgcaacagatagaccctggctgaagttatatggaataagagttcagcctatgccgccattcagaagtttgagctgcaaacctgatccggcactcattcatcattgcctacctgatgaactacttcttgagattttcacaagaatgaacccatatacgttagggagggctgcgtgtgtctgccgcaagtggaaatatactgcacgtaatcctgctttgtggcgttttgcatgcttgaaaacttggcagaggagtggaactgaagtaaactacatgatggttcggtcgttgtatgattcttcttggaggagaatgtggttgcagagaccaagaatccgaattgatggtctctatgttagcaggaacacatatattcatactggagttacagagtggcaattcaagaaaactgtcaacgtggtttgctactaccgttacttgagatttttccctagcgggaagtttctctacaagatttcccctgataaaattaaagatgcc

SEQ ID NO: 20427 - protein, 191 aa, Panicum virgatum
  misc_feature: Ceres CLONE 1811568
  misc_feature (57)..(104): Pfam Name: F-box Pfam Description: F-box domain
MASSDISVDIRPDFNSFDHFPSMRYIATDRPWLKLYGIRVQPMPPFRSLSCKPDPALIHHCLPDELLLEIFTRMNPYTLGRAACVCRKWKYTARNPALWRFACLKTWQRSGTEVNYMMVRSLYDSSWRRMWLQRPRIRIDGLYVSRNTYIHTGVTEWQFKKTVNVVCYYRYLRFFPSGKFLYKISPDKIKD

SEQ ID NO: 20428 - DNA, 1092 bp, Panicum virgatum
  misc_feature: Ceres CLONE 1811573
  misc_feature: Encodes the peptide sequence at SEQ ID NO. 20429
gtcgcccagccctccataggctcactcagtcagcgagacctctgcctcagctcgcctcctctccaattctccatggccgaccgcgtccaccctgtgccgccgcctccgtctcgcctccccgccgacgccgaagcccccgccactgttgccggcgcggcgcccacggagaccacgccgctgcagtacccgtccttcaaccgcccgccgtcgccgccgcccggcacctacatcatccacgtgcccaaggaccaggtcctccgcgtcccgcccccggaccgcgcgcgccgctacaagaagctcgccgcgcgcccggcccgccgccgcctcctccgccgcgcctgctgctgctcctgcgccgcgctcctcctccttctcttcctcgccgcggccttcgccggcgccgtctacctcgtcttccgcccccgcgcgcccaccttctccgtcgcctccctctccatccgcggcctcggggccgccctgccgtcctccgccgcgctctcccccgagatcaacgccgccgtgcgcgcggacaacggcgccaacaggaaggtcggcgtcgactaccgcggcggcgggagcgtcacggtctcctacgccgggcagcggcttgccgcgggaccgtggcccgcgttccggcaggcgccgcggaacgtgacggtgttcgcggcggcgatgaggggccagggcgtgcggctgacggaggagcaggcggggcggcttgccgcggagcgggccgcgggcgccgtgacgctggcggtggaggcgagggtgcccgtgcggctgcgcttcgggaaggtgctgcggacgtggacggtggacgtgaaggcgcggtgcgacgtggccgtggacaggctggagggggacgcggcggcggtgaacagggggtgcagggtgaaggtcaggccgctctggtggtggtggtgatcgccgccgccgccgccgccggcgctcctgtccacatgcatagttaatgccgtctaattaatacaaacggctagtgattaattactcaacggtgtactattgtaagagagagattactagtagacgggttgcctgtggagtaaattatttcaaaacaaaattctagag

SEQ ID NO: 20429 - protein, 283 aa, Panicum virgatum
  misc_feature: Ceres CLONE 1811573
  misc_feature (112)..(254): Pfam Name: Hin1 Pfam Description: Harpin-induced protein 1 (Hin1)
MADRVHPVPPPPSRLPADAEAPATVAGAAPTETTPLQYPSFNRPPSPPPGTYIIHVPKDQVLRVPPPDRARRYKKLAARPARRRLLRRACCCSCAALLLLLFLAAAFAGAVYLVFRPRAPTFSVASLSIRGLGAALPSSAALSPEINAAVRADNGANRKVGVDYRGGGSVTVSYAGQRLAAGPWPAFRQAPRNVTVFAAAMRGQGVRLTEEQAGRLAAERAAGAVTLAVEARVPVRLRFGKVLRTWTVDVKARCDVAVDRLEGDAAAVNRGCRVKVRPLWWWW

SEQ ID NO: 20430 - DNA, 1267 bp, Panicum virgatum
  misc_feature: Ceres CLONE 1811586
  misc_feature: Encodes the peptide sequence at SEQ ID NO. 20431
cgtatccgcgacgccgcgcagcgccggaaatggcggcaccctcccacgtcctgcccttcctctcccccaccgccaccggcaccgcctcctccgtccgcgccagccccgcccgcctacgctgcgccgccgcggccggccaggcgggcttcttcacccgcctcggccgcctcatcaaggagaaggccaagagcgacgtcgagaagctcttctccggcttctccaagacccgcgagaacctctccgtcgtcgacgagctcctcacctactggaacctcgccgacaccgaccgcgtcctcgacgaccttgaggaggcacttctcgtctcggatttcgggcctaaaatctccttcaggatcgtcgacacgctccgcgaggaaatccgcgacggcaagctcaagtccggggccgaaataaaggcggccctgaagaggtgcattctccaactgctgacaagcaagggcggcaactccgagctgaacctcggcttcaggaagccgtcagtcatcatgatcgtgggagtgaatggtggtggaaagactacctccttaggaaagcttgctcacagatttaagaatgaaggagtgaaggtattgatggcagcaggtgataccttcagagcagcagctcgtaaccagctagaagtttgggctgagagaacaggttcagagatcgtcatcgacaatgataagaaggcacagcctccagcagttctatcgcaggcagtaaaacgtgggaagcgtgaagggtttgatgtggttctatgtgatacatcaggaagacttcatacaaactatggtttgatggaagagttggtttcctgcaaaaaagtcatagctaaagcccttcctggcgctcctaatgagattttgcttgttcttgatggcaccacaggcttaaacatgttacagcaagcgagggagttcaatgatgttgttggagtcacaggattcatcctgactaagctagatggcactgcgcggggtggctgtgtggttagtgttgtaaatgaacttggaatcccagtgaagtttattggggttggtgaagggatggaagatcttcaaccttttgatgctgaggcatttgtggaagccattttcccatgaattcggatttatgctcctactgtaaagttttttatactgtcattacttcagctcttcacgtaagagatagttgttgtttattacgctgaggctgtgaggcatgactatgaagcagcaaaaagcaaaactaaggaattgaagcacaaggcagttgaagagcc

SEQ ID NO: 20431 - protein, 358 aa, Panicum virgatum
  misc_feature: Ceres CLONE 1811586
  misc_feature (155)..(358): Pfam Name: SRP54 Pfam Description: SRP54-type protein, GTPase domain
MAAPSHVLPFLSPTATGTASSVRASPARLRCAAAAGQAGFFTRLGRLIKEKAKSDVEKLFSGFSKTRENLSVVDELLTYWNLADTDRVLDDLEEALLVSDFGPKISFRIVDTLREEIRDGKLKSGAEIKAALKRCILQLLTSKGGNSELNLGFRKPSVIMIVGVNGGGKTTSLGKLAHRFKNEGVKVLMAAGDTFRAAARNQLEVWAERTGSEIVIDNDKKAQPPAVLSQAVKRGKREGFDVVLCDTSGRLHTNYGLMEELVSCKKVIAKALPGAPNEILLVLDGTTGLNMLQQAREFNDVVGVTGFILTKLDGTARGGCVVSVVNELGIPVKFIGVGEGMEDLQPFDAEAFVEAIFP

SEQ ID NO: 20432 - DNA, 1997 bp, Panicum virgatum
  misc_feature: Ceres CLONE 1811587
  misc_feature: Encodes the peptide sequence at SEQ ID NO. 20433
atgtttctgatgttctgtgtctttgtgagtgagagagagccccaggccagataaatctctggacccagcagtgtcaagatcacggagagagaggggcctgctcctggaggctttgatgctggatgcttgtgtgctgaaatcgcatatattttccgggatttcctgacctgcgactacaatggcgagtaatccgtcgacgttcgcgccaatcggggtggatgccatgactggcggctacttcatggcgggcggtggaggcggcggcatgatgagcgccgatgcgccgcacttccaccccagcgtgcttcttgagcacggcgggtttggcttcggcttcggcgacgcggcggtcggcgccgccgcggcgccgtcggacctgggcgtgaactacgcggcaaacaacgccatgctggcctccttcgccagccacctcttcgctaccgctgccgcgccgcccctggatgatcacttcggcgggaggacgccgccggagatggacgaggggtatggagctggcagcgatggaagctccgcggcgagcctgcagtgccccggccactcgggcgccatggcggtttggtcgtcgtcatcgtcgtccaagaagccggccggcacttggatcaccgccggcgggtccagagccgtctcggtccacgagccgtactacctcgccggagtccccgacgtcgccggtttccactacccgcttatcgccgccgccgccgccaatgcgccggcgtcgagcgagttgtcgctgaccctgtgctccaagtctttcccggacagcgcgctgaacggcgccgagcagtgctcgtcgggagcgagccgctccgcgctgaccgagctgccgcaggcgcgcccccggccggcgcacttctccgtggtggtggcgcgctcgcggtacgcggccgtggcgcaggcggtgctcaacgacgtcgccggccacctgctggacggcgtcgcggacgtggccgccgactcgtgcagcggcggcgcgaggccgtcgagcggctcggtcggcgcgcgcgcgccgaccgtcgtgagctccaaccggctcctggcctcgtcccaggacggcggcgaggcgcagagggtcaggagccacctcctcaagatgcttcacctgatggatgagaaatacaaccaatgcttgaacgagatccagagcacgacggccaagttcaacgcgctgatgcaaccgggcgccgccggcgtcgtcagcagcggcagcatccgcgcggcgttcgcgcaccgcgccgtgtcggcggtgtaccgcggcctgaggcagcggatcgccggcgagatcatcgcagcggcgagccgggccgccggctgctggggcgagtcgtcgtcgtcggtgacggccgccggcgacgcagagcggagctgggagtcggcgttcatcaggaagcactgggcggcgcagcagctgcggcgcggcgagcagcagtgctggcggccgcagcgcggcctgccggagaagtccgtggccgtgctcaaggcgtggatgttcgagaacttcctgcacccgtacccgaaggaccataagaaggacgtgctggcttcaagaagcggccttaccaggaaccaggtgtcgaactggttcataaacgcccgcgtccggctgtggaagcccatgatcgaggagatgtacgaggaccagaagaagagctcgggtgggcagggggcggcaatggagcctcacacgagcaagcgtcgaattcgtgaggtagaagaaggccagggaactccttagcctgcatcaggagctgctctttctagcacccagctcctgccatgctgtcattgctctgttattggcccgtgtaatttccttctgttatgtacatatcattgccaatgccagcatttccaaatagatcttcagagcatcctggttagttcacttggaagagagacaaggtgtcggagaccacgattaggacaccctaatcggggtaccaaaagcacccttaaaacgcaaacacatattaggc

SEQ ID NO: 20433 - protein, 525 aa, Panicum virgatum
  misc_feature: Ceres CLONE 1811587
  misc_feature (235)..(374): Pfam Name: POX Pfam Description: Associated with HOX
MASNPSTFAPIGVDAMTGGYFMAGGGGGGMMSADAPHFHPSVLLEHGGFGFGFGDAAVGAAAAPSDLGVNYAANNAMLASFASHLFATAAAPPLDDHFGGRTPPEMDEGYGAGSDGSSAASLQCPGHSGAMAVWSSSSSSKKPAGTWITAGGSRAVSVHEPYYLAGVPDVAGFHYPLIAAAAANAPASSELSLTLCSKSFPDSALNGAEQCSSGASRSALTELPQARPRPAHFSVVVARSRYAAVAQAVLNDVAGHLLDGVADVAADSCSGGARPSSGSVGARAPTVVSSNRLLASSQDGGEAQRVRSHLLKMLHLMDEKYNQCLNEIQSTTAKFNALMQPGAAGVVSSGSIRAAFAHRAVSAVYRGLRQRIAGEIIAAASRAAGCWGESSSSVTAAGDAERSWESAFIRKHWAAQQLRRGEQQCWRPQRGLPEKSVAVLKAWMFENFLHPYPKDHKKDVLASRSGLTRNQVSNWFINARVRLWKPMIEEMYEDQKKSSGGQGAAMEPHTSKRRIREVEEGQGTP

SEQ ID NO: 20434 - DNA, 732 bp, Panicum virgatum
  misc_feature: Ceres CLONE 1811590
  misc_feature: Encodes the peptide sequence at SEQ ID NO. 20435
actgctactagcctactactgctccgccgcctagcctgctacaagtctactagaagcggcttggtggagactagagagccagacagattggcaaagcttcttcggcgggcagcgacagcgagctgagaccccgtgcgcctctagcggccgggcgcgttcggcggcctcgaggagatggacccgcgggagtgccagttcgtggtggtgccgccgccgcggccgcgccacggccagtacgaggagggcccgttcgcgcaccaccagatggtggtggccggggaccccgaccccggcggcgcggggcgaggcggcggcggcggcggggagaggaagcggcggttcacggaggagcaggtgcggtcgctggagacgacgttccatgcgcggcgcgccaagctggagccccgggagaaggcggagctggcgcgggagctgggcctgcagccgcgccaggtggccatctggttccagaacaagcgcgcgcggtggcgctccaagcagctcgagcacgactacgccgcgctccgcgcccagtacgacgcgctccactcccgcgtcgactcgctccggcaggagaagctagcgctcgccgcccaggtggacgagctcaaggggaggctgagcgggcggcaggaccagccgagcggcagcagctgcgaggtcagcggcggcgcggaggcggccgacgacggcaggatgatcagcgccagctgcgtggcggaggacgacggc

SEQ ID NO: 20435 - protein, 185 aa, Panicum virgatum
  misc_feature: Ceres CLONE 1811590
  misc_feature (52)..(107): Pfam Name: Homeobox Pfam Description: Homeobox domain
  misc_feature (108)..(152): Pfam Name: HALZ Pfam Description: Homeobox associated leucine zipper
MDPRECQFVVVPPPRPRHGQYEEGPFAHHQMVVAGDPDPGGAGRGGGGGGERKRRFTEEQVRSLETTFHARRAKLEPREKAELARELGLQPRQVAIWFQNKRARWRSKQLEHDYAALRAQYDALHSRVDSLRQEKLALAAQVDELKGRLSGRQDQPSGSSCEVSGGAEAADDGRMISASCVAEDD

SEQ ID NO: 20436 - DNA, 1597 bp, Panicum virgatum
  misc_feature: Ceres CLONE 1811591
  misc_feature: Encodes the peptide sequence at SEQ ID NO. 20437
atcccacaagactccgccgcagccgcagccgcagccatgcgcccgcttatccgaaccgcgtgctgctgcctcctccgcgcgcgtgttcgcgccatggccacgcttcccatggcgtccccggccgccgccgccgctgccgccatctcctcctcttccacccgccccatcttctcgtcacggcccaatcgcatcctcctcgcccgcttcttccccgccgcgccggcgccgtccggggcgagggggctccggacgtccgcggctgcggcggctgcggccgtcgaggtgggcggcgtcaagatcgcgcgcgacgatgttgtaaaggaggatgacccgacaaacaatgtgccagatactatcttttcgaagattggactgcagctgcacaggagggacaaccaccctctagggattctgaagaacactatttatgattactttgacaagaactttgccgggcagtttgacaagtttgatgatctttgccctcttgtctctgtcaagcagaactttgatgacgtgttggtccctgctgaccatgtaagccggagttacaatgacacatactatgttgatagtcaaactgtcttgcgatgtcataccagtgctcatcaagcagagcttctaagggatggacatacacattttcttgtaactggggatgtttatcgtagagattctattgattcaactcactatcctgtcttccaccagatggaaggcttccgtgtcttttctccagatgactggtcaggttctggcatggatgggacagcatatgcagctgcagacctcaagaaaacgctggaaggcctggcaagacatctttttggtgctgtcaagatgcgatgggttgacacttactttccattcaccaacccatcctttgagcttgaaatatattttcaggatgattggttggaagttctgggatgtggagtcaccgagcaggaaattttgaaaagaaatggcaggacagaccacgtggcatgggcctttggactgggcttagaacgcctcgcaatggtcctttttgacattccagatatacgactcttctggtcaaatgataaacgattcacatcccagttctcagaaggcaagcttggtgtcaagttcaagccattttcaaagtttcctccatgttacaaggatatgagtttctggatcaatgatgcattcacggagaacaacttatgtgaagttgtcagaggaattgctggagatcttgtagaggaggtaaagctcattgataatttcaccaacaagaaaggcatgacaagtcattgctacagaatagcctataggtccatggaacgttcactcactgatgaggagattaacagcctgcagttgaatgtcagggaaaccgtgaaaaataaattgaatgtcgagttgagatagaaggacgctagttcagatgttatactgggaactaatttttgcctgtcttatttgtaaatccattgaaaatgtaattttctttttatatatggagaaaatggaccatttggttctgtattgatcacgggtagagaaaaagtccctgctcgaattgtagcttgcagccacaatgattaagaagcattgtacaacgctc

SEQ ID NO: 20437 - protein, 454 aa, Panicum virgatum
  misc_feature: Ceres CLONE 1811591
  misc_feature (100)..(351): Pfam Name: tRNA-synt_2d Pfam Description: tRNA synthetases class II core domain (F)
  misc_feature (364)..(454): Pfam Name: FDX-ACB Pfam Description: Ferredoxin-fold anticodon binding domain
  misc_feature: SWISSPROT Homolog: EC 6.1.1.20 Phenylalanine--tRNA ligase
MRPLIRTACCCLLRARVRAMATLPMASPAAAAAAAISSSSTRPIFSSRPNRILLARFFPAAPAPSGARGLRTSAAAAAAAVEVGGVKIARDDVVKEDDPTNNVPDTIFSKIGLQLHRRDNHPLGILKNTIYDYFDKNFAGQFDKFDDLCPLVSVKQNFDDVLVPADHVSRSYNDTYYVDSQTVLRCHTSAHQAELLRDGHTHFLVTGDVYRRDSIDSTHYPVFHQMEGFRVFSPDDWSGSGMDGTAYAAADLKKTLEGLARHLFGAVKMRWVDTYFPFTNPSFELEIYFQDDWLEVLGCGVTEQEILKRNGRTDHVAWAFGLGLERLAMVLFDIPDIRLFWSNDKRFTSQFSEGKLGVKFKPFSKFPPCYKDMSFWINDAFTENNLCEVVRGIAGDLVEEVKLIDNFTNKKGMTSHCYRIAYRSMERSLTDEEINSLQLNVRETVKNKLNVELR

SEQ ID NO: 20438 - DNA, 727 bp, Panicum virgatum
  misc_feature: Ceres CLONE 1811598
  misc_feature: Encodes the peptide sequence at SEQ ID NO. 20439
accacctcatgcagctcccggcctaccctgccctgctctgctgtgaggagtagcgtgccatagctatcagtgacaccactgtctcgcaagctgccagctgccagctgccaccattcgcctgctgctgtacctgctgtgtgccaccagcccaccaccagaccagacgctctgcccatggcggcggcctccgacaagctgctgcccgcgctcgccgcggccttcctctgctgcgcgctggcgcgggtcgcccaatgcggcggcggcgccccgcagaactacacctccatgttcagcttcggcgactcgctcacggacaccggcaacctgctcgtgtccagcccgctctccaaccacatcgtcggccgctacccctacggcatcacctacttccaccgccccaccggccgctgctccgacggccgcctcgtcgtcgacttcctagcgcaagcgttcggcctgccgctgctgccgccgtacctgcaggccaaggggaaggatctccgccggggcgtcaacttcgccgtcggcggcgccaccgccatggatccgcccttcttccaggagatcggcgcgtctgacaagctctggaccaacctctccctcagcgtccagctcggatggttcgagcagctcaagccgtcgctctgcaactcaccaaagaagtgcaaggagtacttcagcaagtccctgttcctcgtcggagagattgggggaaacgactaccact

SEQ ID NO: 20439 - protein, 184 aa, Panicum virgatum
  misc_feature: Ceres CLONE 1811598
  misc_feature (38)..(178): Pfam Name: Lipase_GDSL Pfam Description: GDSL-like Lipase/Acylhydrolase
  misc_feature: SWISSPROT Homolog: EC 3.2.1.51 Alpha-L-fucosidase
MAAASDKLLPALAAAFLCCALARVAQCGGGAPQNYTSMFSFGDSLTDTGNLLVSSPLSNHIVGRYPYGITYFHRPTGRCSDGRLVVDFLAQAFGLPLLPPYLQAKGKDLRRGVNFAVGGATAMDPPFFQEIGASDKLWTNLSLSVQLGWFEQLKPSLCNSPKKCKEYFSKSLFLVGEIGGNDYH

SEQ ID NO: 20440 - DNA, 714 bp, Panicum virgatum
  misc_feature: Ceres CLONE 1811606
  misc_feature: Encodes the peptide sequence at SEQ ID NO. 20441
actgccattatccagctccatccgctctgccgcctggcggtatatatgcttgcatctggttaacgagcaagcgtgtggccatggcgatgttcatcagagccttgcaattggctctcagggagaagaggagcagcatcattgggcccggatcttcaggcttcgtcgccaatgccttctcatcctcggctccgagctcgcagagtccgcagaggctggccgggaaggtcgccgtcatcaccggtggcgcgagcggcattggcaaggcgaccgccgccgagttcgtcaggaacggcgcgaaggtggtgatcgccgacatccaggacgacctgggccacgccgtggccgcggagctcggcggcccgggcgcggcgtgctacacccgctgcgacgtggccgacgaggcgcaggtcgcggcggccgtggacctcgcggtcgcccgccacgggcacctcgacgtcatgttcaacaacgccggcatcgggggtgccacggggctgccgccgcccctgggcgccgtggacctcgccgacttcgaccgcgtgatggcggtcaacgcccggggcgtgctggcggggctcaagcacgcggcgcgcatcatggtcccgcgccgccgcggcagcatcatctgcaccgcgagcgtcgccgcgctggtgggggggcgtggcccccccggcgtacggcgcgtccaaggcggcggtgctgggcctggtgcgc

SEQ ID NO: 20441 - protein, 209 aa, Panicum virgatum
  misc_feature: Ceres CLONE 1811606
  misc_feature (46)..(203): Pfam Name: adh_short Pfam Description: short chain dehydrogenase
  misc_feature: SWISSPROT Homolog: EC 1.1.1.288 Xanthoxin dehydrogenase
  misc_feature: Useful for making plants with modulated biomass
MFIRALQLALREKRSSIIGPGSSGFVANAFSSSAPSSQSPQRLAGKVAVITGGASGIGKATAAEFVRNGAKVVIADIQDDLGHAVAAELGGPGAACYTRCDVADEAQVAAAVDLAVARHGHLDVMFNNAGIGGATGLPPPLGAVDLADFDRVMAVNARGVLAGLKHAARIMVPRRRGSIICTASVAALVGGRGPPGVRRVQGGGAGPGA

SEQ ID NO: 20442 - DNA, 706 bp, Panicum virgatum
  misc_feature: Ceres CLONE 1811617
  misc_feature: Encodes the peptide sequence at SEQ ID NO. 20443
gtcactcgcggctcgccacagccgaactcccccccactcgcccgcctcctctgcaaccaaattcgcacgccacgcctcggcaaattctagctccttcctcgtcgtcgagctgcgcatggcgaggtccatggagagcggcgacggcggcggcggcgggctggtggtgacggagctgagccacatcaaggagttggtgcggcagctggaggcgcacctcggcggctccgacgagctctgcaggcacctcaccacggagatcttctccctcaccgagcgctccatcggcatcatcaccgccgcctcctcctcctccggcctcgacgcccggaagtgggagtacgccgggctcgcctcgcccctcccggccacgcccaccagcgacgtcgccgacgggcctttcaggagcaccaagaagaggaaggtgatggagaagaggaagcagcaggtgcgcgtgagctcgccccgcggcggcgccggcgagaacccggtggacgacggccacagctggcggaagtacggccagaaggaaattcttggagccaagcacccaaggggctactaccgctgcacgcaccgccactcccagggatgcttggcgacgaagcaggtgcagcgcaccgacgaggacccggcgctcttcgacgtcatctaccacggcgaccacacctgcgttcagaggccggcggtggcggcggcgccggagcac

SEQ ID NO: 20443 - protein, 192 aa, Panicum virgatum
  misc_feature: Ceres CLONE 1811617
  misc_feature (121)..(183): Pfam Name: WRKY Pfam Description: WRKY DNA -binding domain
MESGDGGGGGLVVTELSHIKELVRQLEAHLGGSDELCRHLTTEIFSLTERSIGIITAASSSSGLDARKWEYAGLASPLPATPTSDVADGPFRSTKKRKVMEKRKQQVRVSSPRGGAGENPVDDGHSWRKYGQKEILGAKHPRGYYRCTHRHSQGCLATKQVQRTDEDPALFDVIYHGDHTCVQRPAVAAAPE

SEQ ID NO: 20444 - DNA, 1499 bp, Panicum virgatum
  misc_feature: Ceres CLONE 1811618
  misc_feature: Encodes the peptide sequence at SEQ ID NO. 20445
actttcctccccgtcggccccctcggtgctcgccgtctctaaaagcaaggcggccttgtgggcgccgacgcggacgcagcagcgattccgggagagtgacagagatcggccgatcgatcgctggctagctagcttccagctgcggggacggccggggatgaagaagtgcgcgtcggagctgcagctggaggccttcatccgcagcccggatgaccacgacgtcgccgcgcaggcggcgttcgctgcgggcctgttctcccccggcgatctctccggcttcagcttcgccgactcgaacaccctcaacggaagcattcctaatcacatatggtcccataaccacaacgtgaggcatcccgcagtctccacgacaatcaagtcgcagtcatcaatctgtgcagcagcaagcccaacatcagcgaccaacctatatctgaaagagagccaaactctggggggaacaagtggttcagattccgatagcgaatcacagttggatatcgaaggcggtccatgcgagcaaagcacaaacccacaggacgtgaagagaatgcgacggtataccaagggcaagaacaatgctctgtgcaaccttttttattcattatttgcatcccgtgattgtatcaacaagaagatctggaagttgattttttttcctgcaatgaatgttgagcaaagatgcttatataggagtccagtccaacctaaattgattgcctcaaatcacaggatggtgtcgaatcgtgaatctgctcgtcggtcaaggaagagaaagcaagcccacttagctgatcttgagacacaggttgaccagctgcgaggcgaaaatgcttcactcttcaagcagctgacagacgccaaccagcaattcacaactgcagtcacggacaacaggatcctgaagtcagatgtcgaggccctcagagtcaaggtgaagctggcggaggacatggtggcccgcggcgccctgtcgtgcgggctgggcagcctcgggctgtcgcccgtcctgaacccgcggcagccgtgccggggccccgacgtgctgcccggcctggacttcgccggcgacgacgcgtgcttcgcggggttgtccccggcggagcaggtccagaactcgccgctgcagagcatcgccagcctcgagagcctcgagaaccggatgaccagcgaggtgacgagctgcggcggcgccggcgtcgacgtctggccgtgggacggcggcctgtccaagtgaagagaagaagccggagcgtggaacgcgcacgccgagggggggcagctactgccctgtacgcgtatcgatatgcatggtactagtatgaactgcaagtgtatggcagctgccattgcaatgtcagctggagtggtgaactgaacggacttgagtttttcagagtcctcgtctcgctcggtcggtatattgcctagtagttctgtaatacactaatactagaactgagtggcaaactagctactcatatataattatatatgct

SEQ ID NO: 20445 - protein, 359 aa, Panicum virgatum
  misc_feature: Ceres CLONE 1811618
  misc_feature (184)..(244): Pfam Name: bZIP_1 Pfam Description: bZIP transcription factor
MKKCASELQLEAFIRSPDDHDVAAQAAFAAGLFSPGDLSGFSFADSNTLNGSIPNHIWSHNHNVRHPAVSTTIKSQSSICAAASPTSATNLYLKESQTLGGTSGSDSDSESQLDIEGGPCEQSTNPQDVKRMRRYTKGKNNALCNLFYSLFASRDCINKKIWKLIFFPAMNVEQRCLYRSPVQPKLIASNHRMVSNRESARRSRKRKQAHLADLETQVDQLRGENASLFKQLTDANQQFTTAVTDNRILKSDVEALRVKVKLAEDMVARGALSCGLGSLGLSPVLNPRQPCRGPDVLPGLDFAGDDACFAGLSPAEQVQNSPLQSIASLESLENRMTSEVTSCGGAGVDVWPWDGGLSK

SEQ ID NO: 20446 - DNA, 1168 bp, Panicum virgatum
  misc_feature: Ceres CLONE 1811622
  misc_feature: Encodes the peptide sequence at SEQ ID NO. 20447
acgcagcacgctgctctccgctacggaccagctgctgctgagctcagccggctggaatcgaataatcctcctgcggattccctcctcccgaaagccaaagctcccacctttccccctcgattccgagcgccagcccgctggattccgcgcgggaaccacatcgccgatccttcctgctctccccgaaaccggactctcctggtgctgcgaggcggcggcgtcccagtatctgaactgctagcatgggggctgtacttggacggcaagacaccaacaagcggagtttccatggttcaaagctggaggcgaagatggtggatgccatgcagcagagagcgtcacatggaacttcactgaaatcgttcgatggtattgtcatgaagtttcccaaaatcgatgagagttttaggaaatgcaagattatcttcgagcaatttgatgaagattccaatggcgaaatagataaagaagaactgaagcattgttttcagaagctggaaatctcattcacagaggaagagatatgtgatctctttgaagcttgtgatataaatgaagatatgggcatgagtttcaatgagttcattgtctttctgtgtcttgtttaccttcttaatgaaccagctgtctcagaagcaaaaataaagatgggactaggaaatcttgaggcaacttttgagaccttggttgatgcatttgtcttcctggataagaacaaagatgggtacgtgagcaaggatgagatgatcgaagcaataaatgagacaacagctggagagcgctcatctgggcgtatagccatgaaaagatttgaagaaatggattgggacaagaacggcatggtgagcttcaaggaatttctgtttgcattcactcgctgggtagggattgatgaaaatgaggatgatgatgaatgaagactgagtgcaaagactggttattgttcaattgttaggaccagatcagccctgcagtggctggaaatgaatgacagaggaaaggattagtcggtgttcattggttgcttgttcatcttgatgtttatgttcttaatagaatgccttgtatgtccgaacaatcgtatcatggtacagttgctatctgttgcatcgtttgttacagtatgtacgcattaacgagacaggaaatgaaaacctcaaataccact

SEQ ID NO: 20447 - protein, 224 aa, Panicum virgatum
  misc_feature: Ceres CLONE 1811622
  misc_feature (57)..(85): Pfam Name: efhand Pfam Description: EF hand
  misc_feature (147)..(175): Pfam Name: efhand Pfam Description: EF hand
  misc_feature: SWISSPROT Homolog: EC 2.7.11.1 Non-specific serine/threonine protein kinase
MGAVLGRQDTNKRSFHGSKLEAKMVDAMQQRASHGTSLKSFDGIVMKFPKIDESFRKCKIIFEQFDEDSNGEIDKEELKHCFQKLEISFTEEEICDLFEACDINEDMGMSFNEFIVFLCLVYLLNEPAVSEAKIKMGLGNLEATFETLVDAFVFLDKNKDGYVSKDEMIEAINETTAGERSSGRIAMKRFEEMDWDKNGMVSFKEFLFAFTRWVGIDENEDDDE

SEQ ID NO: 20448 - DNA, 632 bp, Panicum virgatum
  misc_feature: Ceres CLONE 1811627
  misc_feature: Encodes the peptide sequence at SEQ ID NO. 20449
atatctctcattctctcgtctctctcatatctcattctctacctctcatctctcccacctctcccacggccttatctctgggagactgggagcggaggggcgcatgagcgccgccgcgggagtcgggcgctgccgcagtgggagggcgcgcgggcgccgcagagaggggcgcgcgaggtgccgccaccgagggagccggtcgtcgccgccgcggagagggccgagcggggcgccgccgccgcgggagccgagcgcgggcagcaccccggggccggcgagctgggcagcgagcccgggcggtgctgggaggagctgtgcctggcggtgctgggcgcgcagcaccttgtctacgtggtgggctggtcggcgttcaccagggtccgcctgctgcagggtgccatgtcgccggagatggcggccaaggcggccgaggtgagggcgctgggcggcgtggcggtggaggacatgagcctgggcgacctgctcaagtactagtcctaggagggcttccgggtgctcctcctcctctgcgacgacaccacctcactccacaacttcttcctacggacgaggggcatgatgcaaacgcacggcgaggagaccaagaagttcttcaggcactcgtctacaac

SEQ ID NO: 20449 - protein, 164 aa, Panicum virgatum
  misc_feature: Ceres CLONE 1811627
  misc_feature: SWISSPROT Homolog: EC 3.1.4.4 Phospholipase D
ISLILSSLSYLILYLSSLPPLPRPYLWETGSGGAHERRRGSRALPQWEGARAPQRGAREVPPPREPVVAAAERAERGAAAAGAERGQHPGAGELGSEPGRCWEELCLAVLGAQHLVYVVGWSAFTRVRLLQGAMSPEMAAKAAEVRALGGVAVEDMSLGDLLKY

SEQ ID NO: 20450 - DNA, 1502 bp, Panicum virgatum
  misc_feature: Ceres CLONE 1811648
  misc_feature: Encodes the peptide sequence at SEQ ID NO. 20451
ggcgactgggcgagcagcgccgcccttcaccaggtcttcgtcggccccttcaccggcgacgagcatccacaagatatatcgcagtaggatccagggtgcgcccgccgcgatgggtggaagtggctggattgttcggttggcttctcttcttgctcttggtttggtgctcggctcggccgagggtagcctcggggatgctgatccgcggtacagaacttgcttgaaggagtgtcaaactacagggattattggggataatatcatcagccactgtcagaacaaagagaatgacacatctgttggaggttcttggtacgaccaggagcaaatttacatgcagtggaaacaactaaactgtaggacagactgtcgttacttctgcatgatgcagagagaaggcgaacgccagtcacttggaatgacccctgttaaatatcatggaaaatggccattcttacgtatttctgtcttccaggaacccctttcaactgcactatctgccataaacctcttgatgcacttcactggctggatttcattttaccttctagtgaagtacaaattgcctcttagaccccagaccaagagaacttattatgaatacactagcttatggcatatctatgcaatcttatcaatgaatgcatggttctggagctctatcttccatactagagatatcgacttgactgagaaattggattactcttcagctgttgctcttcttgggtactctttaatcctttcattgctaagggctttcaatgtcaaggatgaggctaccagggtgatgtttgcagcccctattttggcatttgttacaacacacatcttgtatcttaacttctacgagcttgactatggatggaacatgaaagtttgtgtggtgatggctgtggttcaacttctaacatgggcagtttgggctggtgtaacccgacatccatcacgactcaaaatttggacagttgtttttggtggggcgctggctatgcttcttgaactctacgactttcctccatacatgggctatgccgatgcccactcactgtggcatgctagtacgattccactcacatatctctggtggaacttcattaaggatgacgccgaattccgtacctcaatgcttatcaagaaggcgaagtaaccaaaagtgtcaggtctgttaacattggatcttggaggatcacatttcatggtctactcaaggaattgggacattagtgttatcggacatcaagaaacatcagtatatttgccccattaatgctcctgtcttcagtctgaaaagacatcttcatgcactcgcgattttggtccacaaattcagcatcttcttttgggcacttatgacctgtctttttgattcacctgtacgtatattctgtgattgtctttgtggtattgtggaaaagtgtggcttgtgtgtatccggtgatgtgcaacctttgtaagatcccgaagcgccctttatacaaacctgtgtcacgaagattacc

SEQ ID NO: 20451 - protein, 346 aa, Panicum virgatum
  misc_feature: Ceres CLONE 1811648
  misc_feature (70)..(342): Pfam Name: Per1 Pfam Description: Per1-like
MGGSGWIVRLASLLALGLVLGSAEGSLGDADPRYRTCLKECQTTGIIGDNIISHCQNKENDTSVGGSWYDQEQIYMQWKQLNCRTDCRYFCMMQREGERQSLGMTPVKYHGKWPFLRISVFQEPLSTALSAINLLMHFTGWISFYLLVKYKLPLRPQTKRTYYEYTSLWHIYAILSMNAWFWSSIFHTRDIDLTEKLDYSSAVALLGYSLILSLLRAFNVKDEATRVMFAAPILAFVTTHILYLNFYELDYGWNMKVCVVMAVVQLLTWAVWAGVTRHPSRLKIWTVVFGGALAMLLELYDFPPYMGYADAHSLWHASTIPLTYLWWNFIKDDAEFRTSMLIKKAK

SEQ ID NO: 20452 - DNA, 1563 bp, Panicum virgatum
  misc_feature: Ceres CLONE 1811671
  misc_feature: Encodes the peptide sequence at SEQ ID NO. 20453
ttttgttctacttttcagcaatataaaaaaaatggctgacctgtttgctttgctgatcatcacaattcacaagacaaaaaagctagtaagagagagatcctgagtcatggccactatctatctgcctatctaggtgtgtgtgatctggattgcattgcagcagattccgagcgaggtggattggatgcagagtctgaagcaacccgaatgccgttgccgtctccttccttcgcttgttgcctagttgctgaccccgaccgagcccgcatctcccttgcttctcctcttctcaggggggtctcgccgctttctcctctctctccccctccccctcctctctgctttgctgcttcgacctcgcccaccagccatgccggcggacggctccaagggcgaaatcaccttcgccggccgcttcaccgccagcgccatcgcagcatgcttcgccgagatatgcaccatccccctcgacacggccaaggtccgcctccagctgcagaagaccgtcgttggggacgcaacggcgccggcggcgctgcccaagtaccgcggcctgctgggcaccgccgccactatagccagggaggaaggggccgccgcgctctggaagggaatcgtaccgggcctccaccggcagtgcatctacggaggactacgcattggcctctacgagcccgtcaagtccttctacgtcggccaagaccatgttggggatgtgcccctctccaagaagattgccgccggcttcaccactggtgccattgctattgccgttgccaaccccacggaccttgtcaaggtcaggctccaggctgagggcaagcttgcccccggtgcgccacgccgctatgctggcgccatggatgcttatgcaaagattgctaggcaggaagggtttaccgctctctggactggcctaggaccaaatgtagcacgcaacgctatcatcaacgctgctgagttggcaagttatgatcaagtcaagcagacaattttgaaactccctggattcaaagatgatgtggtcacccacctcttttctggtctcggtgctggcttcgtcgctgtttgtgttggttctccagttgatgtggttaagtcaagaatgatgggtgactcatcagcctacaaaagcacgattgattgttttgtgaagacgctaaagaatgatggacctctggcattttataaaggcttcctcccaaactttgctagattgggatcatggaatgtgattatgttcttgacgttggagcaggttcaaaagttttttgtgaggaaaccagcaagctgaagatggagaagcttttgctgtcgggtggtgtacaatggtgcgcacattttttttcttctaccaaaaaagaaattgatgacaccttccccttgaggattgggtaatgaggataaatctgacacctcaattgcaagaagaaataacagggggcatttgcttgaatccccaaacaaataaattcagaaatagcaaacagatgtcatatatagtgtattccttcaaactggtgaacggaggaacttgaacactgcagtagttcagtgatgagc

SEQ ID NO: 20453 - protein, 307 aa, Panicum virgatum
  misc_feature: Ceres CLONE 1811671
  misc_feature (217)..(305): Pfam Name: Mito_carr Pfam Description: Mitochondrial carrier protein
  misc_feature (117)..(212): Pfam Name: Mito_carr Pfam Description: Mitochondrial carrier protein
  misc_feature (11)..(111): Pfam Name: Mito_carr Pfam Description: Mitochondrial carrier protein
MPADGSKGEITFAGRFTASAIAACFAEICTIPLDTAKVRLQLQKTVVGDATAPAALPKYRGLLGTAATIAREEGAAALWKGIVPGLHRQCIYGGLRIGLYEPVKSFYVGQDHVGDVPLSKKIAAGFTTGAIAIAVANPTDLVKVRLQAEGKLAPGAPRRYAGAMDAYAKIARQEGFTALWTGLGPNVARNAIINAAELASYDQVKQTILKLPGFKDDVVTHLFSGLGAGFVAVCVGSPVDVVKSRMMGDSSAYKSTIDCFVKTLKNDGPLAFYKGFLPNFARLGSWNVIMFLTLEQVQKFFVRKPAS

SEQ ID NO: 20454 - DNA, 1631 bp, Panicum virgatum
  misc_feature: Ceres CLONE 1811673
  misc_feature: Encodes the peptide sequence at SEQ ID NO. 20455
accgaagcccgaagtccgcagcccgcagccgccctccctcttctcctctcaggcgacgactcgccgagtcgccggctcggctgtcggctctcgccgccccaggccgaaacctatctcgccgcgccaccaggggagaacaccccctccaggaatcggccgaaacccagtcacccagcgcaccgcacacctcgtttctccttctccccccgaaccacgcaagcccttgggcgagcagggatatcgcggaccgcgatcccgtctcgctgccggcggccggctgcgggggtcgcgctgtcacccctcgggaagatctcgggagagccgttcgccccgtcaccccgtcgggccctcctcgccgcgtgacgggatcgacccaccccggcccgtctgctgtcaccgtcccgcggccgtccagatcccgcagcgtcctgccaccctcagggctgtgctcataactttgggcctaaagtttttgtcttgaatggcaacatctttggatgttccactggatgatttaattaaaagcagaaatgggaggggaaggggaagaggcaggggacaaggagggggtcgaggcagaagggacggccaaagattgactcgtggctcatggcgtgggcgtggtactggcaccttccgtggaaggggacttggagtgccttcgcgaaggccacttggtgttaatattcggtcttcatcctttgctattgccaagtcattcaataaagcaaaggattttgtttggagacatgatttgtttgaggatagcatggtggcagctgggctttctgggatagaatctggtacaaaactgtacatttcaaacttgcactatggagtgacaaaggaagatatacaggagcttttttcagaaatgggtcatttgaagcactgtgctgttcactacaacaataatagacacccaactggttctgccgaggtgatatttaccaggagaagcgaagctcttgctgcgctgaaacgatataataatgtgcgccttgatgggaaggcaatgaagattgaagtgataggagcagatttaggtatatctgctgctgttgctgcaccctggattagtgttgttccgggtgcaaggggaagaggacagagagaagttgtaatgatgcctggtggaagtgggtttggtcgaggtgcagctggctcatctagtttgcttcccgggtggaagcgtggaggttttgctcaaagagggggaggtcaagtgcgcggaggttttacccaaagaggaggacaagtgcatggacgccggcgtggccgtgggcatagtagctttggtcaaggccgtggacgtggctatgtgcgaaagggaaacgtggagaaatcagctgaacaattggacaaggagcttgacaactaccattctggtgcgatgaatgttgactaagatggtgcatccaccatccagtcaccttgaagttggatgtatgttgaacataagcttggtattctgtcaggtgtgcgcatgtctgactgctttcgttgtctagctggaagattagatttcacctgcgatttcgtgtttgatgtttgtcctatggatgataccataattggcttgtgacagaatgatgaatcgtgtttttcaaccaattgtagggttttctgtc

SEQ ID NO: 20455 - protein, 308 aa, Panicum virgatum
  misc_feature: Ceres CLONE 1811673
  misc_feature (111)..(181): Pfam Name: RRM_1 Pfam Description: RNA recognition motif. (a.k.a. RRM, RBD, or RNP domain)
MATSLDVPLDDLIKSRNGRGRGRGRGQGGGRGRRDGQRLTRGSWRGRGTGTFRGRGLGVPSRRPLGVNIRSSSFAIAKSFNKAKDFVWRHDLFEDSMVAAGLSGIESGTKLYISNLHYGVTKEDIQELFSEMGHLKHCAVHYNNNRHPTGSAEVIFTRRSEALAALKRYNNVRLDGKAMKIEVIGADLGISAAVAAPWISVVPGARGRGQREVVMMPGGSGFGRGAAGSSSLLPGWKRGGFAQRGGGQVRGGFTQRGGQVHGRRRGRGHSSFGQGRGRGYVRKGNVEKSAEQLDKELDNYHSGAMNVD

SEQ ID NO: 20456 - DNA, 720 bp, Panicum virgatum
  misc_feature: Ceres CLONE 1811676
  misc_feature: Encodes the peptide sequence at SEQ ID NO. 20457
ggcgtaacatccttctcccaactctcagcctagaactcgccttcgcttcgctcttctcctcgagttctttcgagccgctggtcgtcccgcgctcggcgctggaactggaaggtgtttgaataacagctcgaaggttcaaaggaacctacgtttgttgtaagatgtatagggctaagagagctgcactgtcaccaaaggtgaagcgccgtgttgggaagtatgagctcggacgcactattggggaaggaaccttcgcaaaggtccggttcgcgaagaacactgaaaatggggatcctgttgctatcaaaattcctgacaaggagaaggttcagaggcacagattggttgagcagattaagcgtgaaatttgtactatgaagttagtcaagcatcctaatgttgttcgactgtttgaggtgatgggaagtaaagcaagaattttcattgttctggaatatgttactggtggagagctttttgaaatcattgccactaatggaaggttgaaggaggacgaagcacggaaatattttcagcaactaatcaatgcagttgattattgccacagtaggggagtgtaccacagagacttgaagttagagaatttgctgcttgatgctgctggaaatctcaaagtatctgacttcggtttaagtgctttaactgagcaattgaaggctgatggtctgcttcatactacatgtggaactcccaactatg

SEQ ID NO: 20457 - protein, 186 aa, Panicum virgatum
  misc_feature: Ceres CLONE 1811676
  misc_feature (20)..(186): Pfam Name: Pkinase Pfam Description: Protein kinase domain
  misc_feature: SWISSPROT Homolog: EC 2.7.11.1 Non-specific serine/threonine protein kinase
  misc_feature: Useful for making plants with modulated salt sensitivity
  misc_feature: Useful for making plants with modulated biomass
MYRAKRAALSPKVKRRVGKYELGRTIGEGTFAKVRFAKNTENGDPVAIKIPDKEKVQRHRLVEQIKREICTMKLVKHPNVVRLFEVMGSKARIFIVLEYVTGGELFEIIATNGRLKEDEARKYFQQLINAVDYCHSRGVYHRDLKLENLLLDAAGNLKVSDFGLSALTEQLKADGLLHTTCGTPNY

SEQ ID NO: 20458 - DNA, 712 bp, Panicum virgatum
  misc_feature: Ceres CLONE 1811682
  misc_feature: Encodes the peptide sequence at SEQ ID NO. 20459
aacccaaaaccaacaaccgaaccaccttccttcgtcccctccagtcactgcgagtgggcccatgccgtcgtccgcggcgccccagaaagcggcggcggcggcggcgccggctgaggaggaggcggcggagcacgggcccttccccatcgagcagctacaggcttctggaatagctgcacttgatgtgaaaaagctcaaagatgctggtctctgcacagtggaatctgtagcttactctccgaggaaagatcttttgcaaattaaagggattagcgaagccaaagttgacaagataattgaagcagcttccaagttggttccactaggatttactagcgctagccaacttcatgcacagaggcttgagatcatccagattacaactggatcaagagagctcgatcaaattttggatggaggaatagaaactgggtcaatcacagagatctatggtgaatttcgctctgcaaagactcagttgtgccacactctctgtgtcacatgtcagctcccattggaccaaggtggtggtgaaggaaaggctttgtatattgatgcagagggaacattcaggccacaaagacttctccagatagcagacaggtttggcttgaatggtgctgatgtactggagaatgtggcttatgccagagcatataacactgatcatcaatcaagacttttgctggaggcagcttccatgatggtggag

SEQ ID NO: 20459 - protein, 216 aa, Panicum virgatum
  misc_feature: Ceres CLONE 1811682
  misc_feature (82)..(216): Pfam Name: Rad51 Pfam Description: Rad51
MPSSAAPQKAAAAAAPAEEEAAEHGPFPIEQLQASGIAALDVKKLKDAGLCTVESVAYSPRKDLLQIKGISEAKVDKIIEAASKLVPLGFTSASQLHAQRLEIIQITTGSRELDQILDGGIETGSITEIYGEFRSAKTQLCHTLCVTCQLPLDQGGGEGKALYIDAEGTFRPQRLLQIADRFGLNGADVLENVAYARAYNTDHQSRLLLEAASMMV

SEQ ID NO: 20460 - DNA, 680 bp, Panicum virgatum
  misc_feature: Ceres CLONE 1811686
  misc_feature: Encodes the peptide sequence at SEQ ID NO. 20461
acctagctaccaccccccgactcccacccttccccgttccgttccgttccgttccggccgccggagatccaggaacctagccccggggggacgggcggcgatgggagcaaggggcgcggtgctcgcggtgctcgcggtgctggcggtggttcttgcggcggcgtcgcgcgccgaggccgcggcggcggcggccaaggggaagtaccacgcgctcttcaacttcggggactcgctggctgacgccggcaacctcatccagaacggcacgccggagttcctcgccaccgcgcgcctgccctacggccagacctacttcggcaaggccaccggccgctgctccgacggccgcctcgtcatcgaccacctcgcgcaagagttcggcctgccgctgctgccgccgtccaaggccaagaacgccagcttcgcgcacggcgccaactttgccatcaccggcgccaccgcgctcgacacgccatacttcgtggccaaggggctcggcgacgtcatctggaactccggcgcgctcatgacccaaatccagtggttccgcgatctcaagcccttcttctgcaacaccacccaggaatgcaagaagttctttgccaaggcgctgtttgtggtcggtgagttcggtggcaacgactacaatgcacccctctttgcagggaagggcattccgg

SEQ ID NO: 20461 - protein, 193 aa, Panicum virgatum
  misc_feature: Ceres CLONE 1811686
  misc_feature: SWISSPROT Homolog: EC 3.2.1.51 Alpha-L-fucosidase
MGARGAVLAVLAVLAVVLAAASRAEAAAAAAKGKYHALFNFGDSLADAGNLIQNGTPEFLATARLPYGQTYFGKATGRCSDGRLVIDHLAQEFGLPLLPPSKAKNASFAHGANFAITGATALDTPYFVAKGLGDVIWNSGALMTQIQWFRDLKPFFCNTTQECKKFFAKALFVVGEFGGNDYNAPLFAGKGIP

SEQ ID NO: 20462 - DNA, 718 bp, Panicum virgatum
  misc_feature: Ceres CLONE 1811687
  misc_feature: Encodes the peptide sequence at SEQ ID NO. 20463
aaagcccactcgatcgatccgagtcagacagtctctctccgtacaccaaggtattcaactcttcttcccccttctcctcctgtcgtgtcgtgtctccatctccttcgcctgcgcgcggcggcgttccgtaccgtacacagcgagcgatcatggaggtggaggcggcggcggtctccttcgccagcacgtcgtggtcgttctctcccagcacgccggcggcgccgagcggcggcgcgggaggcggaggcaggagcatctcccgcctgctgccggcgcgcgtcgccggggcggtggcccggggcgtcgtcaccgtcgtcttcgcggcagtgggcgtggtcctcggggccgtgacgggcgcgctgatcgggctggccacggagagcggcctggtgcgcggcgccggcgtcggggccatctccggcgccgtcgtctccatggaggtcgtcgactcctccgtcgccatctggcgctcccacgactcggggatctggagcgtcctctacgtgctcgacgtgatctggagcctcctgaccggccgcctcgtgcgcgagaaggttgaccccgccgtgcagagcgccgtcgacagccagatgaacgcggtggactcgccgttcggggagatggcgccgacgttggcggacatgttcgagactggcgccgccggggcggcgaaaggcatgccggcccgcgccatcgaggcgctcctgtccgtgacctt

SEQ ID NO: 20463 - protein, 189 aa, Panicum virgatum
  misc_feature: Ceres CLONE 1811687
  misc_feature: Useful for making plants with modulated nitrogen use efficiency
MEVEAAAVSFASTSWSFSPSTPAAPSGGAGGGGRSISRLLPARVAGAVARGVVTVVFAAVGVVLGAVTGALIGLATESGLVRGAGVGAISGAVVSMEVVDSSVAIWRSHDSGIWSVLYVLDVIWSLLTGRLVREKVDPAVQSAVDSQMNAVDSPFGEMAPTLADMFETGAAGAAKGMPARAIEALLSVT

SEQ ID NO: 20464 - DNA, 1929 bp, Panicum virgatum
  misc_feature: Ceres CLONE 1811695
  misc_feature: Encodes the peptide sequence at SEQ ID NO. 20465
cgccccgccccgactcggcatgggcgccgccgttgggaagcccgcgttcggcctcgccgtcgcgccgaggacgcagacgcacgcggaggaacggctcgccgtcgtggagcacgccctgctccagtggacccgctcccccggcgccgactccggcgtctgggacgcggacgccagctacaccaacaggggcctcctcgccgcggtagacgacgtgctgctcctggcggaggaggaccccttcccgctccccggggcctcgtccgcgcgccgccgcctggacagcgccgtcggcgccgccgcgtcgcgcatggtggaggagttcctgcgcgtcagggtctgggacgcctccccgctgcgcgtcgccgtcgacgggctcgcgctggcgtctagcggcgcgtcgctgctggtcttccccagcgccggcgacaggaccagcgacgcgagctccggcggggaggtcgacgcgtccgacgggacccggtcgagggccagctccggcgtgcctgacgaggtcgcggccctgttggaaggcgaggtctgggatgagctcgacctcgtccgccccgcgggcgtgtccgtcctccacgagatcgcccttcggatggtccgcgccggctgcaccaaggagctcttccgggcgttcccgaacgctccctgcgatgtgcttgacaggttcctgtcaattcttcgtgttgaatgctcgcagcggacgacggaggccgtgatcaagcggtggacgacggtggcgaagatcatcgggaaggccatagtcgccatgcggaggcagctgtacgcgcagagtccagacgccttcgacagtttcagggacggatacttgctggccatcgcggagaaccgcatcctgatcctgctcgagttcgccaacggcttcacctccatcacatcgcacgagaagctcgtatacatgctcggcatgtacgaggctctcagcgacgccgcgcccagcctcctgcacttgttcagcggggcgcgcaaggagctcgtcgctgagcggacacaggacatcctcaccaaattggccgacgcgatgaggattatggtcagcggtgtcgtggccaaggtccgaggcgactgttcgcgcacgccgagcgcggcgggcggggtccacccgctggcacgcgacgccatgacctgcgccgagctgctggcgaggcaccgcaccacgctggacttgatcctcgcgggcggcggcgaaggcgaaggagacgcccccgcgggctccctcgccgccgccctcgtcgcggagctgatcgcgtgcctggaacgcaacctccaggggaaactcgccctcgcctgcgccgacgcgggaggctcgcggcacctcttcctggccaacaacatgagcttcatactgaaccgcgccgcgggcgccggcgacgtggcgtccctgctcgggggcgcgtgggccgcgcggcgccggggccggctcgcgcagcacgtagcgagctacgccgagtcgtcctggggcccggccgtcgctctcctggagacgcccgcgtgtggcaggggcaagccggcgaaaattctggcggagttcaacgccgcgtttaccagagcgcgcgacagcgaggtgtgccgccaggtcccggatcccgcgctccgagcggccctgcggaacgccgtgtcggagatggtggttcctgcatattgcgcgtttctgcagaggcaccccaagcttggatcatccgtcaggtacacggctgatgatgtggccgaatgcttgtcggaattgttcgaaggagaagccgtggatgccaggaaatcctagagatcttcagattgtactaaactgtcaataagccctaccttctataccgtttttgccagtttatatcattcagttgtggcactgctggtccctcgtcatgtaacaataatatatctgaaattctgaacatggaaaatatg

SEQ ID NO: 20465 - protein, 589 aa, Panicum virgatum
  misc_feature: Ceres CLONE 1811695
  misc_feature (34)..(580): Pfam Name: Exo70 Pfam Description: Exo70 exocyst complex subunit
MGAAVGKPAFGLAVAPRTQTHAEERLAVVEHALLQWTRSPGADSGVWDADASYTNRGLLAAVDDVLLLAEEDPFPLPGASSARRRLDSAVGAAASRMVEEFLRVRVWDASPLRVAVDGLALASSGASLLVFPSAGDRTSDASSGGEVDASDGTRSRASSGVPDEVAALLEGEVWDELDLVRPAGVSVLHEIALRMVRAGCTKELFRAFPNAPCDVLDRFLSILRVECSQRTTEAVIKRWTTVAKIIGKAIVAMRRQLYAQSPDAFDSFRDGYLLAIAENRILILLEFANGFTSITSHEKLVYMLGMYEALSDAAPSLLHLFSGARKELVAERTQDILTKLADAMRIMVSGVVAKVRGDCSRTPSAAGGVHPLARDAMTCAELLARHRTTLDLILAGGGEGEGDAPAGSLAAALVAELIACLERNLQGKLALACADAGGSRHLFLANNMSFILNRAAGAGDVASLLGGAWAARRRGRLAQHVASYAESSWGPAVALLETPACGRGKPAKILAEFNAAFTRARDSEVCRQVPDPALRAALRNAVSEMVVPAYCAFLQRHPKLGSSVRYTADDVAECLSELFEGEAVDARKS

SEQ ID NO: 20466 - DNA, 1863 bp, Panicum virgatum
  misc_feature: Ceres CLONE 1811701
  misc_feature: Encodes the peptide sequence at SEQ ID NO. 20467
gtttctctctgcccccctaccttcttctctcctccctcatctttctctctcctctcctctcccctcccctcccctcccctcccgtgcgagctcacgcccccacctcacgagcgcctccgtcgcaagagaggcagcaggcggtgcgcctgggggaggcgtcgatggatctggagaggtcgccgccggcgtcgccggcggaggcggccggtggcggaggcgggggcgggggcgcggcgtgctccatctgcctggatccggtgctcgccctcggcgggggccgctccgtcgccaagctgcaatgcggccacgagttccacctagactgtattggatctgcatttaatgcaaaaggaggaatgcaatgccctaactgtcggaagattgagaaaggtcgctggctttatgcaagcggacaccgcccttctgccgatattgatatgggtggctggccgactagtgacaactatgatatcacctctgaccttccatttggatttcagtggtgcccctttagtggattcacccagctagcttctgtgtttgaggagcgtgaagctgagccaacttcttgtaagcattcaacttaaacttcaactccttaagcttctttcttttttactgcattgatatttcccttttatgaagatcacacaattggagatcactcaagttctgcaagcagttcacttgtttgcccatatctttccctgcgtggttttcttcatcctgtgcatgtaccttctacttctaattctggtgctgaaagcacttcatttcatcggcattcaactggcttggaaggccatgcaactccagatttgagtaatgctcaagttttccatgctactgagtcaagaaatcatgacagtgagcacaggcatttgagtaatcttcctgtatcaggaattcctgatcattctatgactccatttggtataggactaccaagatatgacaccagcggccaacagagatccagatcatatgcacgtcatcatcccctaatccataggccaacacctcgcggtggaaacaatttggtggcacccttagggtcagttccagctgctgtggcagagactagaggccatggtcatggtgcaagaggccatatgtaccaacagtcaatgcactcctctatgcagagcagcccattccctcctaccactagaagggttaggccaagggccttgacaattacatctttcattgcggcagcatcctcagctgaggttggagggccacatggattttcagcccctggagctgtgaacaggagcattcctgatgctgagggcatcactagacccatcgaccgaccatatccatgggggcgagagggctttgcgcccttcccttggatccctgctgaaggtgagtctcactggtggggcaccttcaatcctatgcagaacccggcacatgcaagttttaccagaaggcctgctggtgagcggatgacgcagaatcacccagagaacggctatcagcctgtgcctcctccccagaggatgccgccgttcttgtgattagtgaaggctattcttcaattattatgtataaaatttatttgattctagacttgagagaacagggggaagaagatcagctgcgctgcactgtcaaaactggtctgttgaaggatctctatgaagtttatgccgctggtattttagcgttttcggtccagcagcactcaggctttgttgagcgctgtagttcgtcctaactgatgtgtcgttgcattgagcagaattatttgaaaacatgagttaaactgcatctttggtcgccatgagtgaaaaacaccgagtgcagctatgaatacaagagtggggtattcgtttgtgcagttcatcacag

SEQ ID NO: 20467 - protein, 141 aa, Panicum virgatum
  misc_feature: Ceres CLONE 1811701
  misc_feature (26)..(71): Pfam Name: zf-C3HC4 Pfam Description: Zinc finger, C3HC4 type (RING finger)
MDLERSPPASPAEAAGGGGGGGGAACSICLDPVLALGGGRSVAKLQCGHEFHLDCIGSAFNAKGGMQCPNCRKIEKGRWLYASGHRPSADIDMGGWPTSDNYDITSDLPFGFQWCPFSGFTQLASVFEEREAEPTSCKHST

SEQ ID NO: 20468 - DNA, 1560 bp, Panicum virgatum
  misc_feature: Ceres CLONE 1811729
  misc_feature: Encodes the peptide sequence at SEQ ID NO. 20469
ctcctttcttccggctcctgctcgaatcgagccgagtagaggcgcagctgccggcgccccagccaccccggtcgcacctccctccgatcccgcgcgcctaaggcctccctacctcgtcctgtacctccggctgctgtttccctagctagccgagggctaccttggccgaatcggcccccactctgaccggtcgccatggaagccccgctcgaagctccgggtccccgtcgatccgaaccctccagtcctcctccgcccgaatcgaggtcgtggtgagctcccccacatccccctcgacctccccagcccattcaccgaccgccacagaccactccctcaccggaaaccgagctacagcaccacctccaccacagctccgccgccagcccccctcccgaccacctcccgccctagctcttgtttcaaatcggtcgcaggcgagcccctcgtgcttccccaccactcctcggccgccggcataggctcctctcgccggaaccgagctccctgagtgcctcctctactcccagttcgcgtgaaggaccccgtgcagcaattcaaggaagtccaggggcttttatgcattgtcatagactcagatacgctagatggacaacgcgtggacatgaagcacgtaatgacggaaccaaactcccaagatggcgttggtggacgtatcctgaagagagaaggaccagctagagcaactgaagacccggcccaaggtcagaagggcccaaggccttgctagtattaacactgacttagtgttacccaggatgcactcctcggagcgtcagatactgccgctgcgaccatcgagtgggcgatctcggagctcatcaggaaccccaaggtactaggcaaggccgccgaggagctggaccgtgtggtcgggcgcgagcgcctggtgacggagggggacctgccagccctcccctacattgaggccatcctcaaggaaacctttcgcctgcaccctgttgcgccgacgctggtgccccacctagctcgggaggatgcccgcgtggacggtttcgacatccccgccggcacggccgtgttcgtcagcgtgtggtcgatcggccgtgacccggcgctgtgggacgcgccggaggagttccgtccggagcgattcattgggagcaagatcgatgtgaaggggcaggacttcgagctgctgcccttcggctccggccggcggatgtgccctgggttaggccatgggatgaaggtgaccctgctgagcatcgccaacctgctgcacggcttcgtgtggaggctcccggatggcatgaaggtggaggacctgagcatggaggagatctttctgctcgcggtgccacgcaagaacccacttgaggctgtcgtccagcccaggctaccgagccatctatatatgcgtgcttaatgtccacacatcagtacgggcatgtgttgccattcggtgtttgtagttattatagtactggtcatggtgatatttatgcaaagccttttacatgctagggtcatgttgaatgatgtgtgtaattcatgactcaataaagatacctacat

SEQ ID NO: 20469 - protein, 68 aa, Panicum virgatum
  misc_feature: Ceres CLONE 1811729
  misc_feature: SWISSPROT Homolog: EC 1.14.13.88 Flavonoid 3',5'-hydroxylase
  misc_feature: Useful for making plants with altered carbohydrate content
MCPGLGHGMKVTLLSIANLLHGFVWRLPDGMKVEDLSMEEIFLLAVPRKNPLEAVVQPRLPSHLYMRA

SEQ ID NO: 20470 - DNA, 1135 bp, Panicum virgatum
  misc_feature: Ceres CLONE 1811744
  misc_feature: Encodes the peptide sequence at SEQ ID NO. 20471
acacccacattccaccacgaattcactcccccaccatttcgattccaattctggttgctcccacccacaaccacaatgaagttcggcaagagcctgaacaaccagatcgtggagacgctccccgagtggcgcgacaagttcctgtcctacaagaacctcaagaagcggctcaagcagatcggtgccggcgccgcgggcggcgagcggcggagcaagcgccagcgcgtggggggcggcggcgccccgccggcgatgaccgccgaggaggccgggttcgtcgccctcctcgacgccgagctcgacaagttcaacgccttcttcctcgaaaaggaggaggagtacgtcatccggcagaaggagctgcaggacagagcggtgagcgcggcggagacggggtcgccggaggacctgctgcgggtgcggaaggagatcgtcgacctccacggcgagatggtgctgctcgagaactacagcgcgctcaactacaccggactggtcaagatcctcaagaagtacgacaagaggaccggcgcgctgatccggctgcccttcatccagaacgtgatgcaggaacccttcttcaccaccgacctcctgtacaagctcgtgaaggagtgcgaggcgatgctggagcagctcctgccgaggagccagccgcccgcgccaccgagcgacgacgcgagggaggacagcgacggcgacggcgacgacaagcctgtggctgccaccggctcgtcgttggccagcggcggtggcgcggccctggagctggaggagatcgaggacatggagagcacgtacatgaagagcaccgtggccgcgctcaggtcgctcagggagatccggagcgggagctccacggtgagcgccaatgggcgtgtggaggagccggagcagggctgacgggctgctgccgtttgcgtggatcgaatcgacggagcagccattgtcgtcaggtggccggacagattgatgtgtaaaatacttctgtgctcaatgctcagagaagattttcttcggttcggtgccaatgtgccatgtacccagcgattgttttcacacataatatggcaactgatgtaaaagtgggataatatcttacaccgtatatatataaaaatctagagaaggattc

SEQ ID NO: 20471 - protein, 275 aa, Panicum virgatum
  misc_feature: Ceres CLONE 1811744
  misc_feature (1)..(164): Pfam Name: SPX Pfam Description: SPX domain
  misc_feature: SWISSPROT Homolog: EC 3.1.4.46 Glycerophosphodiester phosphodiesterase
MKFGKSLNNQIVETLPEWRDKFLSYKNLKKRLKQIGAGAAGGERRSKRQRVGGGGAPPAMTAEEAGFVALLDAELDKFNAFFLEKEEEYVIRQKELQDRAVSAAETGSPEDLLRVRKEIVDLHGEMVLLENYSALNYTGLVKILKKYDKRTGALIRLPFIQNVMQEPFFTTDLLYKLVKECEAMLEQLLPRSQPPAPPSDDAREDSDGDGDDKPVAATGSSLASGGGAALELEEIEDMESTYMKSTVAALRSLREIRSGSSTVSANGRVEEPEQG

SEQ ID NO: 20472 - DNA, 665 bp, Panicum virgatum
  misc_feature: Ceres CLONE 1811749
  misc_feature: Encodes the peptide sequence at SEQ ID NO. 20473
gcggagtacacaagacgcgactccacgccaagcgcgagccaaaccctacccccagccgcgaccccgatcccccaccacaccggcgatgagctcctcctccaacggcgggaagaagcccgcggccggcggagggcccaccatacgcacgctcgccgacatcaaccgcgggcccgcaggcttcccaggcgccgggggcagcggcagcgactccgacgagccccaggagtactacaccggcggcgagaagagtgggatgcttgttcaagatccgactagaaggaatgacgtggatgcaatctttgaacaagcgaggcagacgggtgctatccaagcaccaccaacccctttccttgatagccagtcatccagctcgaggagctttacagggactggccgactgctttcaggggagacagcaccatctgctgcgcctgcggctgcgtctgcatctcaggaaccagttcacatactccacgtcatacacttatggaacaatggtttcagtgtagatgacggtccactgagagcctatgacgatcctgcaaatgcagaattcattgagagccttaagatgtcccggtgcccccaggaactggagcctgctgacagaagcacaccagttcatgtgaatattatgaaaagacttgaagattaccgggaaccga

SEQ ID NO: 20473 - protein, 193 aa, Panicum virgatum
  misc_feature: Ceres CLONE 1811749
  misc_feature (132)..(193): Pfam Name: SEP Pfam Description: SEP domain
MSSSSNGGKKPAAGGGPTIRTLADINRGPAGFPGAGGSGSDSDEPQEYYTGGEKSGMLVQDPTRRNDVDAIFEQARQTGAIQAPPTPFLDSQSSSSRSFTGTGRLLSGETAPSAAPAAASASQEPVHILHVIHLWNNGFSVDDGPLRAYDDPANAEFIESLKMSRCPQELEPADRSTPVHVNIMKRLEDYREP

SEQ ID NO: 20474 - DNA, 1618 bp, Panicum virgatum
  misc_feature: Ceres CLONE 1811754
  misc_feature: Encodes the peptide sequence at SEQ ID NO. 20475
ctcctccatttaaggccagctcaagctcaccgaggctccaagctcctcccgcagcatctccacacaagcccgagacccgagaggaggtagagcagagcagagggggagtagtcgtcgtcgtcgtcggcggcggcggcggcgcgaggtggagatggcggggttcaaggtgacgcggatctcggagggcccggtgaagccggcgtcggcgaccccggaggagacgctgccgctggcgtgggtggaccggtacccgacccaccggggcctggtggagtcgatgcacatcttccggtcgggcgcggacgcggcgcccggcgtgatccgggaggcgctgggcaaggcgctggccttcttctacccgctggcggggcgcatcgtggagggcgcggaacccgggtgccccgccatccgctgcaccgccgacggcgtctacttcgcggaggccgaggcggactgcagcctcgaggacgtgcggttcctggagcgcccgctgctgctgcccaaggaggacctcgtcccctaccccggcgacgaccgctggggcgtcgagccgcacaacaccatcatgatgatgcagatcaccaagttcacctgcggcgggttcgtgatggggctccggttcaaccacgcgtcggcggacggcatgggcgccgcgcagttcatcaacgccgtcggcgacatggcgcgggggctcgcggagcccaaggtgaagcccgtctgggaccgtgagaagttccccaaccccaagatcaagcccggcccgctcccggagctccccgtgctggcgctggactacatcgtcctcgacttccccaccggctacatcgacggcctcaagaagcagtacaaggagcacagcggcaagttctgctcgggcttcgacgtgctcacggccaagctctggcagtgccgcacccgggcgctgaacctggagcccaacgccgaggtcaagctctgcttcttcgccagcgtccagcacctgctcaagcttgacagggggtactacggcaactccatcttcccggtgaagatgtccgcgccggctgagaaggtgctcagctcgtccatcatggaggtcgtggacatgatccggcaggccaaggacaggatggccgtggagttcttccagttcgccaaggaggagaccgaccaggacccgttccagatgaccttcaactacgagtccatctacatctcggactggagcaagctcgggttctcggaggtggactacggcttcggcccgccggtgttcgccggcccgctggtgaacaatgacttcatcgcctccgtcgtcatccttaaggcgccgctgccgctcgacggcacgcggatgctcgccagctgcgtcaccaaggagcattccgaggagttcgttcgtggcatgaaggcagacctgccctgaacttctttcctttttatagctgatgaaatggcaaaacttgactgcagggagatgaatggtgacgcaaaagatgcctctgtttggttaatgctgttgttacttttggttgtatttatttgtcacattatcttcgttaatactactttagacagcaaattcgatcttttgtaccatttggtatgagacaataagaggtagactgtcaatttgatt

SEQ ID NO: 20475 - protein, 417 aa, Panicum virgatum
  misc_feature: Ceres CLONE 1811754
  misc_feature (4)..(415): Pfam Name: Transferase Pfam Description: Transferase family
  misc_feature: SWISSPROT Homolog: EC 2.3.1.162 Taxadien-5-alpha-ol O-acetyltransferase
  misc_feature: Useful for making plants with altered carbohydrate content
MAGFKVTRISEGPVKPASATPEETLPLAWVDRYPTHRGLVESMHIFRSGADAAPGVIREALGKALAFFYPLAGRIVEGAEPGCPAIRCTADGVYFAEAEADCSLEDVRFLERPLLLPKEDLVPYPGDDRWGVEPHNTIMMMQITKFTCGGFVMGLRFNHASADGMGAAQFINAVGDMARGLAEPKVKPVWDREKFPNPKIKPGPLPELPVLALDYIVLDFPTGYIDGLKKQYKEHSGKFCSGFDVLTAKLWQCRTRALNLEPNAEVKLCFFASVQHLLKLDRGYYGNSIFPVKMSAPAEKVLSSSIMEVVDMIRQAKDRMAVEFFQFAKEETDQDPFQMTFNYESIYISDWSKLGFSEVDYGFGPPVFAGPLVNNDFIASVVILKAPLPLDGTRMLASCVTKEHSEEFVRGMKADLP

SEQ ID NO: 20476 - DNA, 721 bp, Panicum virgatum
  misc_feature: Ceres CLONE 1811762
  misc_feature: Encodes the peptide sequence at SEQ ID NO. 20477
accaccaacgattgacaattcttttccacgcttccactctctgcctctgccgctctgcgtctccatcccaatcatactcctcttcgtctccctctcctcccgagaagcgcccgcccccgaccatacgttctccggcgccccacgcggacggcgagccgctgctggtcttgccggaggaggaggaggagggtggccgccgagaccggcgggaggaggaggacgaggacgccgctgagtggcccgggcgcctggggctgttccacatgccgctctgggggaccgcgtccgggtcgccggccgccgacggcgagatcgcccgcgcgccgcccgggtccagcggcggcggcggcgtcaaggtgatccggtcgctgctccccacccggcgccgcctccggctcgacccgtccgccaagctctacttcccatatgaacccgggaagcaagtccggagcgcggtcaggatcaagaacatcagcaagtcccatgtggccttcaagttccaaacgacagcaccaaagagttgcttcatgaggcctcccggcggcatactcgctccaggggaaagcatcatagcaacagtgttcaaatttgtggagcatccggagaacaatgagaagccgctagaccagaagtgcaaggttaagttcaagattgtcagcttgaaagtcaaaggacctatggagtatgtgcctgaattgtttgatgagcaaaaggaccagat

SEQ ID NO: 20477 - protein, 152 aa, Panicum virgatum
  misc_feature: Ceres CLONE 1811762
  misc_feature (42)..(152): Pfam Name: Motile_Sperm Pfam Description: MSP (Major sperm protein) domain
MPLWGTASGSPAADGEIARAPPGSSGGGGVKVIRSLLPTRRRLRLDPSAKLYFPYEPGKQVRSAVRIKNISKSHVAFKFQTTAPKSCFMRPPGGILAPGESIIATVFKFVEHPENNEKPLDQKCKVKFKIVSLKVKGPMEYVPELFDEQKDQ

SEQ ID NO: 20478 - DNA, 574 bp, Panicum virgatum
  misc_feature: Ceres CLONE 1811772
  misc_feature: Encodes the peptide sequence at SEQ ID NO. 20479
cgcaggagcaccttgactgcttgagcgtagtttaggagataggattctaggagtgatgtctaccgaggaggctgccgctgcggcgaccgaggtccccgcgaccgaagtcgagtccgaggcgccccccgcggaggaggcagaggcaaaccccgccaaggccaagaaggcggcggccaaggagaataaagtccccaaggagaagaaggcccccgaggagaacaaggcggcctaggataagaagcccgccgcggcgaggaagccggccgcccacccaccgtacgccaagatgatctcggaggcgattgcggcgctcaaggagaggaccgggtcgagctcggtggccatcggcgagtacgtggaggagaagcacggcgggcagctgccgcccaacttctgcaagctgctggccgggcagctcatcaagctcgccgccacgtggaagctgacccgcgtcaagaactcgttcatgctgccggccgccgccgacgccaagtccaaggcacccaagcccgcctgccgctgccgagccgaagccagccaaggccgccaagcccgtcgtcctgcccaatgcgtc

SEQ ID NO: 20479 - protein, 95 aa, Panicum virgatum
  misc_feature: Ceres CLONE 1811772
  misc_feature (1)..(64): Pfam Name: Linker_histone Pfam Description: linker histone H1 and H5 family
  misc_feature: Useful for making plants with modulated nitrogen use efficiency
  misc_feature: Useful for making plants with modulated oxidative stress sensitivity
MISEAIAALKERTGSSSVAIGEYVEEKHGGQLPPNFCKLLAGQLIKLAATWKLTRVKNSFMLPAAADAKSKAPKPACRCRAEASQGRQARRPAQC

SEQ ID NO: 20480 - DNA, 1923 bp, Panicum virgatum
  misc_feature: Ceres CLONE 1811774
  misc_feature: Encodes the peptide sequence at SEQ ID NO. 20481
aaggatgaggtgtgccatgcacctgctatagctagtccactataggactgcaagcaaggcgcactgcctaccctttgcatctcttcacacacccacccaccgagactacgcatacatatctgcccaatcaacccattagcggtcgtctccgctcctacttgcagaactgaaacgcagtagctcatagcagagcagctagtgcaatggatcttcaatctgcgagcatgttgcagagcatccatggccgtatcagcaacatggggccgctggctccgcctcttgttgtcgtgggtgcgaccctgatgtgcatttggttagcccactactttctcaaaaagataaaccacagacgacgcctgcaggcggtgctgccgcctggttctatgggactgccactcctcggagaaacgctcgagttcttcgctcggagtccttcaatggacctgctgcctttcttcaagcgacgaatggagaggttcggtcctattttcaagacaaacttggtcggtaaggacctgattgtctctcttgacccggacatcaaccactacgtgctccagcaagaggagaaggcgttccacatatggtttccggaatcgttcatgagactcctgggcgaggagaacatcgccaaagtttacgggtccctgcacaagaacactaggaacatgatccgccgagtcttcggcccagagaacctcaggctggtgctgctccatgatatgcaaggtgccgtggagaagacccttagctcctggcacgacagcggaagcgttgaactcaaacctgccctctcaagtatgatatttggtattgctgccaaatggatgattggtcacgaggcgtcggtattatcaggggatctgtggaaaaattttgatgcgttcaaccaaggactgttgtcctttccgctttatatccctggaacagcgttctacagatgtatgcagggacgcaataatgtcatgaagaccttgaagcaagtgcttgacgagagaaggaaaaaggcagaaacaccggaaaggatggatttcattgacgttatagtcagcgagttaaataaggagaatcccgcgctctccgaaaaccttgctttaaatgtgctattcttgatgatatttgctagctttgagacaacatcatctggactaactgcagcactcaagtttctatcagacaaccctagagcattacaagaactagaggaggagcatcagcagatccgggcaagaagggctgatccgaacacaggagtcacttgggaggaatacaaatccatgaaattcacctcccatgttataaatgaatcattaaggctagccaacgtcgcccctgtgttgtttaggaaagcaacacaagatgtcaacataaaaggttatactattccagagggatggatattgatgatctgtcctccagcagttcatttcaatcctaccaaatatgaggatcccaatgtcttcaatccatggagatggaaggatctttcggaaccagttgggagctccaaggattttattgcctttggatccggattgaggttatgtgtcggtgtagactttgcaagacttcaaatgactatgttcctccacttcttagtcaccaagtatagattgaaggtggtcagtggtggggacatggtgtttggccctggactagggtttcctaatggatttcaaatccaacttgaacgcaaaaaataattttgtcggatctacaatatctcagcaatttttctcattttgtatgcatgtagttatgctatcaactcaaataatgtaccataaacaaatgatgtcttgatctgtgttgcttgtatgatctgctgatcttatgtaagtggacgtacatcacaatgatcttatatttgctatttaagtgctacaaataaactagcaagttgatggatacaatttcacaccc

SEQ ID NO: 20481 - protein, 499 aa, Panicum virgatum
  misc_feature: Ceres CLONE 1811774
  misc_feature (57)..(495): Pfam Name: p450 Pfam Description: Cytochrome P450
  misc_feature: SWISSPROT Homolog: EC 1.14.13.93 (+)-abscisic acid 8'-hydroxylase
MDLQSASMLQSIHGRISNMGPLAPPLVVVGATLMCIWLAHYFLKKINHRRRLQAVLPPGSMGLPLLGETLEFFARSPSMDLLPFFKRRMERFGPIFKTNLVGKDLIVSLDPDINHYVLQQEEKAFHIWFPESFMRLLGEENIAKVYGSLHKNTRNMIRRVFGPENLRLVLLHDMQGAVEKTLSSWHDSGSVELKPALSSMIFGIAAKWMIGHEASVLSGDLWKNFDAFNQGLLSFPLYIPGTAFYRCMQGRNNVMKTLKQVLDERRKKAETPERMDFIDVIVSELNKENPALSENLALNVLFLMIFASFETTSSGLTAALKFLSDNPRALQELEEEHQQIRARRADPNTGVTWEEYKSMKFTSHVINESLRLANVAPVLFRKATQDVNIKGYTIPEGWILMICPPAVHFNPTKYEDPNVFNPWRWKDLSEPVGSSKDFIAFGSGLRLCVGVDFARLQMTMFLHFLVTKYRLKVVSGGDMVFGPGLGFPNGFQIQLERKK

SEQ ID NO: 20482 - DNA, 707 bp, Panicum virgatum
  misc_feature: Ceres CLONE 1811786
  misc_feature: Encodes the peptide sequence at SEQ ID NO. 20483
aggatcctcagtacctggcaaattgccaaattcttcatctcttctcctcgcgagcctctctcctccagtgagctcgccgctcccattctttccaccggtcaagtctggggaaggaatggcggagaacggagcaaagcagcccctgttacaggacggcgaccctcctaacgccggcgaaacaaggccgactcctcagggagctggagcgaagagattccggcgctgcaggacggcgccctccgccgatgcggcgcaggattctccaccaggaagcaagaaccggagccaaccggagcgcggcaggagcgccggctcgccgccgttcgcaccacccaaggagctgctgcgtggcgcgcgcccgagcttccggctcgtgggcgtcctcctgctggcctacctcctcgccgggaccatcgcgttctacctcgccatggaccacatgtccggcggccgcaccaggagccgtgtggtggacgcgctctacttctgcgtggtcaccatgacgaccgtcgggtacggcgacctcgtcccggccagcgacgccgccaagctgctggcctgcgccttcgccttcgctggcgtggccctcgtcggcaccttcctcagcaaggccgccgactacctcgtcgagaagcaggaggcgctcctgttccgcgcgctccacctccgccgcgccggcgaccgcagggcgctgcgggacatggagg

SEQ ID NO: 20483 - protein, 197 aa, Panicum virgatum
  misc_feature: Ceres CLONE 1811786
  misc_feature (89)..(172): Pfam Name: Ion_trans_2 Pfam Description: Ion channel
MAENGAKQPLLQDGDPPNAGETRPTPQGAGAKRFRRCRTAPSADAAQDSPPGSKNRSQPERGRSAGSPPFAPPKELLRGARPSFRLVGVLLLAYLLAGTIAFYLAMDHMSGGRTRSRVVDALYFCVVTMTTVGYGDLVPASDAAKLLACAFAFAGVALVGTFLSKAADYLVEKQEALLFRALHLRRAGDRRALRDME

SEQ ID NO: 20484 - DNA, 1480 bp, Panicum virgatum
  misc_feature: Ceres CLONE 1811790
  misc_feature: Encodes the peptide sequence at SEQ ID NO. 20485
acccggccgtcccgtccgattccccagccgcggcctcgccctcccactccggatcgctgcctcaccccctccgatcctccgttccggcatggctgcgcccccgccgaaggcgaaggcgccgaggggttcggcggcctaacgtttggccctgaggattccgtcggtcgcgttaccggatcttgtggctgccgtcgaggatccgatcccggtaaccgccgccggtatgggctccgacgggcgcctccgccgtgcgctggccgcgttcgggggcggcggcgacgtgtgggacctcgtggacgccgcgctcgccgtggcggcgcgggacagcccggacgagctgcgcgcgcgccgcgacagcatcgtcgagcggctctacgctggtggccgatgccgcaactgcgatggcccgccggcgcaggtgcagccgacgaaggcggctgagactgctgccgctgcgtcggcgttcccggcctcgccggacgaggaggtcgacgcggacggcttcgacgacgacgaggctgacgccggcgtggagagcaagatcctggcgatcagggacttcctggaggaccccgaccagtcggaggacgagacggtgagcctgctgcagagcctggcagacatggatatcacctacaaggctctccaggagacggacatcggccggcatgtcaatggcctacgcaagcatccatctggtgaagtgcggcagctggtgaagctgctcgtcaggaaatggaaagagatagttgatgactgggtacggctgcacaactcaggtggtgatggtggtggctcgatcataagcgatggtgactcgcctgataaagtccaacccaagtatcatcagaacagtcaggcttcagacttcaagtattcccccagcccacagagacagaatggtttgagctcagagagatttagcaatcacaatgtggtggagtcaatggagaaacggagaacaagccctgcacctgcatatcataacaccaagcagaacagcaacaacaactattctactacttcatcatcagttccagctaggacaatttgggagcaaaaggatactcttttggactctgagaaactagattcagccaggaagaggcttcaggaaaattaccaggaagcgcaaaatgcgaaaaagcagaggaccattcaagtgatggatatccacgacataccaaagccgaagaacaggaacaccgtcctccgcaagagcggtggcggaggcggactcccggcaaggcaccggtgatcttcatgtgcaacgaccatcttacatacagcggactcacaaatttgtattctatgctagtcgaaagcgaaatttgaaggggagttcttttttttctgttttatttgtacccttgcgatccaatcactctacgtctgtgatactgtctagcaacatgacgctacgctttttgcttctcatgagactgaaggaaatcaaaatgtcgttcttgtgccgtccgtg

SEQ ID NO: 20485 - protein, 344 aa, Panicum virgatum
  misc_feature: Ceres CLONE 1811790
  misc_feature (100)..(186): Pfam Name: TFIIS Pfam Description: Transcription elongation factor S-II protein N terminal
MGSDGRLRRALAAFGGGGDVWDLVDAALAVAARDSPDELRARRDSIVERLYAGGRCRNCDGPPAQVQPTKAAETAAAASAFPASPDEEVDADGFDDDEADAGVESKILAIRDFLEDPDQSEDETVSLLQSLADMDITYKALQETDIGRHVNGLRKHPSGEVRQLVKLLVRKWKEIVDDWVRLHNSGGDGGGSIISDGDSPDKVQPKYHQNSQASDFKYSPSPQRQNGLSSERFSNHNVVESMEKRRTSPAPAYHNTKQNSNNNYSTTSSSVPARTIWEQKDTLLDSEKLDSARKRLQENYQEAQNAKKQRTIQVMDIHDIPKPKNRNTVLRKSGGGGGLPARHR

SEQ ID NO: 20486 - DNA, 702 bp, Panicum virgatum
  misc_feature: Ceres CLONE 1811809
  misc_feature: Encodes the peptide sequence at SEQ ID NO. 20487
tcctctcctggccgccggctctccccttcctcctcctctctccttccagagcacgaggattcttccgaacagcgaagccctaaccggagagggggatagagatggcgctggcgatcctcgcgaggcggcgcgcggcggaggccgtgctccggcggccgcgggcggcggccgtgtcggcgtggagggcgtacgcggcggccgtgtcggcgtggagggcgtacgcggcggcgggcgaggagagcgacgtcgtcgtgctgggcggcgggcccggcgggtacgtcgcggcgatcaaggccgcgcagctcgggctcaagaccacctgcatcgagaagaggggcaccctcggcgggacctgcctcaacgtcgggtgcatcccgtccaaggctcttctgcactcatcacatatgtaccatgaagcaaagacttcttttgcgcaccatggagttaagatctcaaatctggaagtggaccttccagcgatgatggctcagaaagacaaggctgtggcaggactaacaaaagggattgaaggactctttaaaaagaacaaggtgacctatgttaaaggctttgggaaattggcttccccctcagaagtatcagttgatttaattgatggcggtagcactgttgtcaaggggaaaaacataatcattgcaactgggtctgacgtaaaatcacttcctggaataactattgatg

SEQ ID NO: 20487 - protein, 200 aa, Panicum virgatum
  misc_feature: Ceres CLONE 1811809
  misc_feature (48)..(200): Pfam Name: Pyr_redox_2 Pfam Description: Pyridine nucleotide-disulphide oxidoreductase
  misc_feature: SWISSPROT Homolog: EC 1.8.1.4 Dihydrolipoyl dehydrogenase
MALAILARRRAAEAVLRRPRAAAVSAWRAYAAAVSAWRAYAAAGEESDVVVLGGGPGGYVAAIKAAQLGLKTTCIEKRGTLGGTCLNVGCIPSKALLHSSHMYHEAKTSFAHHGVKISNLEVDLPAMMAQKDKAVAGLTKGIEGLFKKNKVTYVKGFGKLASPSEVSVDLIDGGSTVVKGKNIIIATGSDVKSLPGITID

SEQ ID NO: 20488 - DNA, 1131 bp, Panicum virgatum
  misc_feature: Ceres CLONE 1811815
  misc_feature: Encodes the peptide sequence at SEQ ID NO. 20489
aatcaaacaaacccccgtctttcaatacggattagcagcagcagcaggtgcggatcaataattatccctgactttgctttgttgttaggattaggattagggtaattaagcgtccggttaccactcatggatcaataattcatcctcatcgtcgtcgtcgtcttctcactctctctccctagcctgccgtcgcttccagactccatatatatcggcggctctgctctccagcctacacagctcgcccacccagctcctctcaccgcgcagcattcccaggcaggcaggcaggcaggatgtccggcatggaggctgggctggtccgcaagtacccgtcggacgccggcggcctccgcgcggcgcggcacggggcgcacgggcactcggccagcgcccgcaccgcgcacagcatgtccgcgtcggcgctgcgcaagaagtcggacgcgtcgctggtgcgcaaggtgcccttcgcgccgctccgccccgtcctcgccaacctccaggaggtcttcctcggcaccaagctcgccgtgctcttccccgccgtgccgctcgccatcgccgcgcagtgcgccaacttcggacaggtttgggtgtttgcgctcagcttactcggtctcatccctctcgccgagcgtgtcagcttcctcaccgagcagatcgcaatatacactggccccaccgtgggcggcctcctgaacgcgacgtgcggcaacgccacggagctcatcatcgcgctgttcgcgctgatgcagggcaagatcgaggtcgtcaagtgctccctcctcggctccgtcctctccaacctgctgctcgtgctcggcacctccctcttctgcggcggcatcgtcaacctcggcgccgaccagccgtacgacaggagccaagcggacgtcagcacgggcctcctcatcctcggcgtgctgtgccagtccctgccgctcatgctgcgctacgcggtgggcgccggcgagcactcggtcgccgcggcgaccacggggctcgatctctcgcgcgcctgcagcatcgtcatgctgctcgcctacgtcgcctacctcttcttccagctcaagacgcacgcccagctcttcgagccgcaggaggtcgacgaggacggcgaggatcaggaag

SEQ ID NO: 20489 - protein, 278 aa, Panicum virgatum
  misc_feature: Ceres CLONE 1811815
  misc_feature (106)..(257): Pfam Name: Na_Ca_ex Pfam Description: Sodium/calcium exchanger protein
MSGMEAGLVRKYPSDAGGLRAARHGAHGHSASARTAHSMSASALRKKSDASLVRKVPFAPLRPVLANLQEVFLGTKLAVLFPAVPLAIAAQCANFGQVWVFALSLLGLIPLAERVSFLTEQIAIYTGPTVGGLLNATCGNATELIIALFALMQGKIEVVKCSLLGSVLSNLLLVLGTSLFCGGIVNLGADQPYDRSQADVSTGLLILGVLCQSLPLMLRYAVGAGEHSVAAATTGLDLSRACSIVMLLAYVAYLFFQLKTHAQLFEPQEVDEDGEDQE

SEQ ID NO: 20490 - DNA, 762 bp, Panicum virgatum
  misc_feature: Ceres CLONE 1811815-R
  misc_feature: Encodes the peptide sequence at SEQ ID NO. 20491
ctgctcccaatcgtcgggaacgcggcagagcatgctggtgccatcctttttgctctcaagaacaagctggacatcaccctcggagtcgctttggggtcggcaacccagatctccatgttcgtggtgccgctgagtgtcattgtagcttggatcgcgggtattcaaatggacctcgacttcaagctgctagagactggctctctatttgtctcagtaatagtaacagccttcaccctccaggatggacaatcgcactatttgaaggggatccttctcctcctgtgttacattgtcatcggcgcatgctttttcgtcacgaggcaaccttcaggtcatggaaacggcaacggtgttgggctggctgtaccaaccggtacatggaacgcacaggtggcataacaggttaggagtcctgccaggacaagccagcatgcaagacagcagagcaatgatctaaatcagagactgaaactgcaagaatcctgtcgggcctaggttgcgcaatgagtgatgatcctaatttccagagaaatgtggaagccggccggtccgagtgctaccgagagcaaatgtattcatcgtgtgagaagccataatgggaagggtttgtgcttgtattactattggtttagttagtaggctgcggctgctgcaataagagtagcaaatatctatgcatccaatcctgtgtatatgatccatcgtgcgcttcttcgtatatgaagcttaataagataaatatgctgaggtgtattgtagttg

SEQ ID NO: 20491 - protein, 132 aa, Panicum virgatum
  misc_feature: Ceres CLONE 1811815-R
  misc_feature (1)..(103): Pfam Name: Na_Ca_ex Pfam Description: Sodium/calcium exchanger protein
LLPIVGNAAEHAGAILFALKNKLDITLGVALGSATQISMFVVPLSVIVAWIAGIQMDLDFKLLETGSLFVSVIVTAFTLQDGQSHYLKGILLLLCYIVIGACFFVTRQPSGHGNGNGVGLAVPTGTWNAQVA

SEQ ID NO: 20492 - DNA, 1763 bp, Panicum virgatum
  misc_feature: Ceres CLONE 1811823
  misc_feature: Encodes the peptide sequence at SEQ ID NO. 20493
gacgcaggagagaaaacgcgcgagttaatgcgagcgcgcccgcaccgccgcccctaggccgcccgccccgagacgggccatggcgccggcggcggagctccgcgccgtggccgtgcgtgtcgtcccgctgctgctgctcgcgctcctcgcagtctcagccgtcgacgttgtatcggcggcggcggcgccgcacaagttcgggatcaactacgggcagatcgcgaacaacctcccgcacccggcgcaggtgtcgggcctcctgcagtcgctcaacgtcaaccgcgtcaagctctacgacgccgacccggccgtgctcacggccttcgccggcacgggcgtggagttcatcgtcggcaacgaggacctccagaacctgaccgacgcgcgcaaggcccgcgcctgggtggcgcagcacgtgcagccgttcctccccggcacgcgcatcacctgcatcaccgtcggcaacgaggtgctctccggcaaggacacggccgccatgcagaacctcctcccggccatgcaggccgtgcaccaggccgtcgccgacctgggcctcgccggccaggtgaacgtctccacggcgcactcggtcaacatcctcgccagcagctacccgccgtcgtcgggcgcgttccgggaggagctcgcgcagtacatccagcccatcctcaacttccacgccgaggtccgctcgccgttcctcgtcaacgcctaccccttcttcgcctacaaggcgagccccggcagcgtgtcgctgccgtacgtgctcttcgagcccaaccccggcgtggtcgaccccaacaccaacctcacctacgacaacatgctctacgcccagatcgacgccgtgtacgcggccatgaaggccatggggcacacggacctcaccgtcaggatctccgagaccgggtggccatccaagggggacgacgacgaggtgggcgcgaccgtcgccaacgccgccgcgtacaacgggaacctgatgaagaggatcgccatgggccaggggacgccgctcaagccggacgtccccatcgatgtgttcgtcttcgcgctcttcaacgaggacatgaagcccgggccggcgtcggagaggaactacgggctgttttaccccaacggcacgccggtgtacaacctcggcttcaacggagcatccttcagccggtcgccgacgttctcctcttcttccaagccgacgactacatttctgatggcggttgttgtcctactcgccggctttttcctatgacctacaccagtattgtgcgagaagatttgctatttatttctgactaacccatttgtgcttgcatcggacatcatactagctaccagcgcccattatctgactttgaggttagcaagattttttattctcttcatcagttgattggattggaagattattagtcctgtatagaggaaggaaaaggtggatgtaccatcatggtttctatatatgcaactgttcatgaaaatcagtgaagccgctgtaaaattttgacaatgtggaatagaactgtagaagtaccaatactggttatatatagatacagcgagcatgtgacttggagtggttgtttattctgttctttcactgtattatacattcaccttattgtattagaaacagtctatcatcagatagttcttgtgtgtgtgatttgttctattgtagcgttttgcggttgatggaatgatatttgtttctcgccatcgacacaaaaaattccaactaaaaagtgcatctgtacagactc

SEQ ID NO: 20493 - protein, 390 aa, Panicum virgatum
  misc_feature: Ceres CLONE 1811823
  misc_feature (40)..(356): Pfam Name: Glyco_hydro_17 Pfam Description: Glycosyl hydrolases family 17
  misc_feature: SWISSPROT Homolog: EC 3.2.1.39 Glucan endo-1,3-beta-D-glucosidase
  misc_feature: Useful for making plants with altered carbohydrate content
  misc_feature: Useful for making plants with altered cell wall content and/or composition
  misc_feature: Useful for making plants with altered lignin content
MAPAAELRAVAVRVVPLLLLALLAVSAVDVVSAAAAPHKFGINYGQIANNLPHPAQVSGLLQSLNVNRVKLYDADPAVLTAFAGTGVEFIVGNEDLQNLTDARKARAWVAQHVQPFLPGTRITCITVGNEVLSGKDTAAMQNLLPAMQAVHQAVADLGLAGQVNVSTAHSVNILASSYPPSSGAFREELAQYIQPILNFHAEVRSPFLVNAYPFFAYKASPGSVSLPYVLFEPNPGVVDPNTNLTYDNMLYAQIDAVYAAMKAMGHTDLTVRISETGWPSKGDDDEVGATVANAAAYNGNLMKRIAMGQGTPLKPDVPIDVFVFALFNEDMKPGPASERNYGLFYPNGTPVYNLGFNGASFSRSPTFSSSSKPTTTFLMAVVVLLAGFFL

SEQ ID NO: 20494 - DNA, 1355 bp, Panicum virgatum
  misc_feature: Ceres CLONE 1811827
  misc_feature: Encodes the peptide sequence at SEQ ID NO. 20495
acaccacacggaagcaagcagcgccgccgccgccgccgcctcatccttcgtcacgcaggccggccgctgctcgcagctcggaatctccccaccgccatgcgctgggccgcgtcgatccggccggcgacggccaccgccggacgccgtcgccgttcccgacgcgcccctttctctggtctcctcgttgctctgccccaagatgtgctgtggcaaatcctgctgaggttcccggccacggagctctgccgccttcgagccgtctgccggtcgtggcgctccatcaccagcgatccggccttcatcgctgctcacaaggcccgccaccgggagacgctcgtcgtcggaagcataccggcgccccacgggttggacgttcttctcatagatttgcaaggcaaggtattgaagcgcatccacgtcaatgactgctcgagcatggaggtgcggacaaaccttaacctcgtctgcgccaccgagcaccggggcagtggttgcgccagtgtcaacgacccagctaccggggttacgcatgccttgccgaggaacatggccgccgaaacgaaatcccatgcgaggcccttgcgcgagtactctgccatgtttgtgctcgggattgtcgacacggaggtgtacaaggtgctccgtatcctcacggatgctgatcgccgccacgttcagctctttgaggtcctaacactggacaacaggggccttacaccatggagggcagtggagggcatttcaggacatgtggagactaacacgaccgcctccaatgtggtcatcaggggtgtagttcacctcgtcgcggtagaaagtggtggtgttgagaatgactgcatcgctcggttcaacctcaagacggaggagtggatgccatcgctccgaggtccgataaccagccatccggatctgaacgacattggcatacatagcgttctggaaaaatactcattagctgaggtgaatggttccttggtcgtagctcggttcacatttcagcaatacacagttaagtttgaagatttctttttggacctttggtatctgggggactcggagaattgtcagtgggaaaggaaatataggatcgatcttgacatgggcatacctggatggttttgttgctttgcatatctctcttcggcgctgcaggatggcaggttcctcctccgtttatgtaatgttgaagaagatttagaagagctaaactttgaacagatcttggtaggatacaatccggaaacagccactttggattcaaaatcactagatgtcacggtagttggccataatggcgtctacacaggaagtttgttaagtgttaggaactgttaagagctgtgatcttacta

SEQ ID NO: 20495 - protein, 413 aa, Panicum virgatum
  misc_feature: Ceres CLONE 1811827
  misc_feature (27)..(74): Pfam Name: F-box Pfam Description: F-box domain
MRWAASIRPATATAGRRRRSRRAPFSGLLVALPQDVLWQILLRFPATELCRLRAVCRSWRSITSDPAFIAAHKARHRETLVVGSIPAPHGLDVLLIDLQGKVLKRIHVNDCSSMEVRTNLNLVCATEHRGSGCASVNDPATGVTHALPRNMAAETKSHARPLREYSAMFVLGIVDTEVYKVLRILTDADRRHVQLFEVLTLDNRGLTPWRAVEGISGHVETNTTASNVVIRGVVHLVAVESGGVENDCIARFNLKTEEWMPSLRGPITSHPDLNDIGIHSVLEKYSLAEVNGSLVVARFTFQQYTVKFEDFFLDLWYLGDSENCQWERKYRIDLDMGIPGWFCCFAYLSSALQDGRFLLRLCNVEEDLEELNFEQILVGYNPETATLDSKSLDVTVVGHNGVYTGSLLSVRNC

SEQ ID NO: 20496 - DNA, 1812 bp, Panicum virgatum
  misc_feature: Ceres CLONE 1811830
  misc_feature: Encodes the peptide sequence at SEQ ID NO. 20497
aatctcgaatacaacgtgaggaccgcttctcccagaagcctcgcaaaggtcgcgtacctggtaagcgggccgattttcccccaactgcccttctctccccgatagtccttcctcccccgacacctcccctgcgccccgttccccaccggcccctgccctgccgcggttctgccctccgctccggcgagcgccagcaaccggaatcgcgccggccgtcctccgtgagcccggatctgtgacggcatgccctgaagcggccgctaggcctgcagatcgtcgacgccgccgcccccccccccccccaaggtgcaccggctgccctccgctccggcgagcgccaccgaccggattcgcgccggccgtcctccgtgaccccggggtcgcgctggccatcctccatcctccgggtccgccgccggcccccaccccaaggtgcgccgccgccttattctttcgattcgagtatcgccgccggccctgactgaagcacgaagcctccacaacgtgttgcacccaccgtggacacgaacaagagtcttatgcttctcgtcttccactccacgcctcctccacatcaccgccggagatcatggcgcggctcctctcctcccctccgtgcggcgaggcgctgagcgcgtccacgattgtggcggaggccgtgaccgggtcgcacgtcctcaagatcgaggggtactccctgaccaagggactcggcaatggcgagttcaactgctccagcatattcagcgtgggtggccatcgctggtgcatcaggtactaccctgatggcgatcgtttagacagtgccgattggatatccatctatctgcagcacgatgataccaatgctgtggacgccaaggcacgatccatattcagcgtcctcgacgagattggtgaaccagtgccatcgttcatccagaacggcaatttgaaggcctactccgccaaagttcggtgctggggtttcgacaaattcatcgaaaggaaggccctagaggaatcggcctgcctgaaagatgatatccttcgagtcaggtgcgatgtcaccgtcgtaaaggacatccgcaccgaggccatcgagcagttcgtcgtcgtaatgccatcgaacatccacgtgcaattcgggcgtctcctccaggccggagaaggggcggatgtcaccttcgaggtcgccggggagacgttcgccgcgcacaggtgcgtgctggccgcaaggtcgccggtgttcatggccgagctcttgggccccatgaaggagaaggccacgagccgcgtacgcgtcgacgacatggagcctggggtgttcgaggccatgctccacttcatctacactgacaccatggcagcaggtacggataaaggagacgacgacgcgccggcggccgctcagcatttgcttgtggcggcggacagatatgatttggagaggctgaagctgatgtgcgaggagaagctgtgcaactacattggcacgagcacggtggcgacgacgctggcgctggcagagcagcatggctgccatgggctcaagaaggcatgttttggttttctcaagacgccgagccatctcaaggaagccatggctagtgagggctttgaccatctgataagtagctgcccatctgtgatcaaggagctgctggccaagattgctccctgtccctgagatggctgcaaaatcagagaaggtgcctattttggaaaatcagagataattatggtgcctattttttcttatgtgtcaattatcgatcagtgtaaaaggccggaacactttcctatcttaaacaaatatcagtatttttgttt

SEQ ID NO: 20497 - protein, 359 aa, Panicum virgatum
  misc_feature: Ceres CLONE 1811830
  misc_feature (179)..(294): Pfam Name: BTB Pfam Description: BTB/POZ domain
MARLLSSPPCGEALSASTIVAEAVTGSHVLKIEGYSLTKGLGNGEFNCSSIFSVGGHRWCIRYYPDGDRLDSADWISIYLQHDDTNAVDAKARSIFSVLDEIGEPVPSFIQNGNLKAYSAKVRCWGFDKFIERKALEESACLKDDILRVRCDVTVVKDIRTEAIEQFVVVMPSNIHVQFGRLLQAGEGADVTFEVAGETFAAHRCVLAARSPVFMAELLGPMKEKATSRVRVDDMEPGVFEAMLHFIYTDTMAAGTDKGDDDAPAAAQHLLVAADRYDLERLKLMCEEKLCNYIGTSTVATTLALAEQHGCHGLKKACFGFLKTPSHLKEAMASEGFDHLISSCPSVIKELLAKIAPCP

SEQ ID NO: 20498 - DNA, 2538 bp, Panicum virgatum
  misc_feature: Ceres CLONE 1811839
  misc_feature: Encodes the peptide sequence at SEQ ID NO. 20499
aaaagtttcctctctcccctccccacccggtcgtcgtcgtcgcggcgcgagcgagcgggcgagacagagcgagagcggggaaaacccaaaaccctagcgccccgtccccgccggccgcgagcggggagatggcggtggatgaggtcacctcggtctacgtcggcggccttccctacgaggccaacgaggacatgctccgcaacgccttcgagtactacggcaccatcgtctccgtcaaggtgataaatgatcattctgtcaaaggcaagtgttatggttttgttactttcactcaccccaaagctgcggaggatgcaattgcaagcatggatggcaagagaataggcaatcgcgttgttagagtaaatgaagtgcgcacaagaggtccccgagattttggtcgcgatggttttagacgagatcctagaaggtatggtagagatccatactgggacagaagggatagagaacggagctatgatcgcgaaagagatccctaccatgaaagggatagtgatcgatctcgtgagcatgacagagacaaagattatgagcatggtggcttcaatcgagacattgattatcccatggatcgtgatcatgaagtagacgagaggcgtcctagagagcatgatcgtgcactagaaatacataatatggattcagatgatgacagagacaaggagcacgggtcaagaaaaagattcagccgtgcaaaaggtcgtgatagcagagatttatcgagttccattgatggtcttcaaaatgatcaggaaaagaatcacttggacaaggccattcagatgcgcgaggaccttgaaaatgaggtagtccatcttattaaagatcttgtgctgtattagtttgatctggccactatcaaaccaatttttaccctatcatatctgagggtgcctgtaaaactatgatgaatttctttcttcttcataatctgtccattcaagcaaacttgcccacattgctttggaaaaaaaaatacaagatgaatttgagctaaatatgaaaaccatgttaaaactaatatggaagttttgagagttcaccaagacttgtggatgtagatgcaaggatgtttgagcccttgcagaattttaaaacttaatctcattgccaaaatatagatacttatttaatgctgcagtccatttaatattcatcttttgcttttagattttggttgacagaattgatagtatttagcttgtcttcatttgactagcaaatatgtccgtgcgtttccacggtcgaagaccccgtaggttgtaaatactgtctgatttttttctctgcgatgtgttctctttgacacagattttgtcgtgttttgacattctcattatattttagcccattttgattacaatagtgttgtttggttctcactatatatgctttgggtcccggtgatacatgttggaccaaaccaaaatttttgatggaaacattacatgctttagaaataggtaaagatatactgcttttctggaattctgtagatgactaaccaagcattattcatggaacacatggaacttgtttactaagaaaaatcaaaatcagttgcctgatttataattatcatggtatccttttgacggcgaagcacagtgggtgtaggactcatggtaagagtgacatactcagatttatttagttttgtgcattcttagtcactcttgagatgacccacgaagcccatcagtacttcagttcaatgatttaaatgccttgcattttatattgtgaaacgagtttgaatgttgtagttttgcaggttcaccagatgaaagataaaattgcagcaaaagaacagcacattgccgacttgcagaagaaagctcaggttttatggattttttatggattttgttgtcatcatttgccctgttgttatttgagagccactgcttggccatctttagtacaaattttgatgataagtcatgaaatgtttttcgtgtaaaactgcagaaattagaggatgaactggttgctgcacgcaaagtctcttcagaacgacaattagctgttacagatttgtacaaacattttctccaacttcaagactacaatgacagagtcaagacggccgaacagaggcttcaggttgttttctcaacattgtttttttcttttatttccttctatgtattcatgtcgccatgagatcaccatctgtagcacttggtcttgttcccagaaaaaaaatgtatcaccgaccattttggttctgtacgaagtgatatactaatacctctgtttcatatcagtctcttgtcaatgctgcgatggtcgagcttgacatggccgaagatgctacaaccagagacggctcgatgtatgagaatggcgtggtttgaacttctgggcgccaccagactgtatggtttttcagtaactaatttattagactttttagcttgttgctataatgctatgtaatagaactgtgtggaaagtatcgagcaatgttatgtaaaggatcagtaaacgagtggctgctcattttcttctatt

SEQ ID NO: 20499 - protein, 244 aa, Panicum virgatum
  misc_feature: Ceres CLONE 1811839
  misc_feature (9)..(79): Pfam Name: RRM_1 Pfam Description: RNA recognition motif. (a.k.a. RRM, RBD, or RNP domain)
  misc_feature: Useful for making plants with modulated biomass
MAVDEVTSVYVGGLPYEANEDMLRNAFEYYGTIVSVKVINDHSVKGKCYGFVTFTHPKAAEDAIASMDGKRIGNRVVRVNEVRTRGPRDFGRDGFRRDPRRYGRDPYWDRRDRERSYDRERDPYHERDSDRSREHDRDKDYEHGGFNRDIDYPMDRDHEVDERRPREHDRALEIHNMDSDDDRDKEHGSRKRFSRAKGRDSRDLSSSIDGLQNDQEKNHLDKAIQMREDLENEVVHLIKDLVLY

SEQ ID NO: 20500 - DNA, 2195 bp, Panicum virgatum
  misc_feature: Ceres CLONE 1811846
  misc_feature: Encodes the peptide sequence at SEQ ID NO. 20501
gttgtgggagagcaattaatccatcctctcctcgcgagctccaacagcaatcaagctagagagaagcttaggctgcaagaagaagccagcaagtggcgaggacgcgagcagggcaagcgagatcactcggaccaagcgatccatggcgccgaggaggtcgacttcgccggccgggagccgccgccgtgtcgttccccgagtgccccgccgacttccaggactacaccccctgcaccgacccccggcgctggcggcgctacggcaactaccgcctcagcttcatggagcgccactgcccgccgccgccggagcgccagcagtgcctcgtcccgccgcccaaggggtacaagccgcccatccgctggcccaagagcaaggaccactgctggtaccgcaacgtcccctacgactggatcaacagccagaagtccaaccagcactggctcgccaaggacggcgaccgcttccgcttccccggcggcggcaccatgttccccaacggcgtcggcgcctacgtcgacgccatgcgcgcgctcatcccgaggatgcgcgacggcaccgtccgcaccgcgctcgacaccggctgcggcgtcgccagctggggcggcgacctcctcgcccgcggcatcctcgccgtctccctcgcgccgcgggacaaccacgaggcgcaggtgcagttcgctctagagcgcggcatcccggccatcctcggcatcatctccacgcagcgcctccccttcccctcggcggccttcgacatggcgcactgctcgcgctgcctcatcccctggaccgagttcggcggcctctacctcctcgagatccaccgcctcctccgccccggcggcttctgggtgctctccggcccgcccatcaactacgagaaccgctggcacggctggaacaccaccgcgcaggcgcagaaggccgacctcgaccgcctcaagaagatgctcgccgccatgtgcttcaagctctacaacatcaagggcgacatcgccgtctggcagaagtcgcccgacgccgccgcctgctacgacaagctcacgcccatcaccacgccgcccaagtgcgacgacagcgtcgacccggacgccgcctggtacgtgcccatgcggccctgcgtcaccgcccccagcgccaggtacaagaagctggggctcaacgccacgcccaagtggccgcagcggctcgccgtcgcgccggagcgcatcaacgtcgtccccggcagcagcgccggcaccttcaagcaggacgacgccaggtggaagctcagggccaagcactacaagacgctgctgccggcgctcggaaccgacaagatcaggaacgtcatggacatgaacacggtctatgggggattcgcggccagcatcatcaaggaccccgtctgggtcatgaacgtcgtctcctcctacgggcccaactcgctcggcgtcgtctacgacagaggcctcatcggcgtcaaccacgactggtgtgaggcattctcgacatacccacgcacctatgatcttttgcatcttgatggcctgttcactgcagagtctcacaggtgcgagatgaagtttgtacttcttgagatggaccgcatccttcgccccaccggttatgcgataatcagggagagcacctacttcctggattctgtagcagccattgccaaaggaatgagatggagctgtgagatgcgtaaccctgaaaacaaggatgacaaggacaagatcctaatctgccagaagaagctttgggcaggaaagcagtgagagggaattgcttgatccaagtataaaaagaaagaattcttaacccggatgggtgctatgttgatcccctcgatggtatacggctcaaatgtgctgtgatctcagccacctaggcaaaggcgcttcaccatccggtacacatgaaacatgaacactctgatgtacaagaatgttcaaagttaagataaataagagtaaacctccgtataggatccaaaagttagtactatttgccattgatcacacagttaattctttttttgtacggacagttaggggtgggtggttgataccaagagcaactgtaagttactccacagtccacactacatgtgttcatttgtacaacatatagcttggtgctgtcattgtaatagagtgccatatttatttaaacatttatggagcaagatactactcatgtgccag

SEQ ID NO: 20501 - protein, 494 aa, Panicum virgatum
  misc_feature: Ceres CLONE 1811846
  misc_feature (98)..(193): Pfam Name: Methyltransf_11 Pfam Description: Methyltransferase domain
  misc_feature: The sequence is a functional homolog of SEQ ID NO 2546 in the 10/374,780 US patent application
  misc_feature: The sequence is a functional homolog of SEQ ID NO 760 in the 10/412,699 US patent application
  misc_feature: The sequence is a functional homolog of SEQ ID NO 824 in the 10/225,066 US patent application
MERHCPPPPERQQCLVPPPKGYKPPIRWPKSKDHCWYRNVPYDWINSQKSNQHWLAKDGDRFRFPGGGTMFPNGVGAYVDAMRALIPRMRDGTVRTALDTGCGVASWGGDLLARGILAVSLAPRDNHEAQVQFALERGIPAILGIISTQRLPFPSAAFDMAHCSRCLIPWTEFGGLYLLEIHRLLRPGGFWVLSGPPINYENRWHGWNTTAQAQKADLDRLKKMLAAMCFKLYNIKGDIAVWQKSPDAAACYDKLTPITTPPKCDDSVDPDAAWYVPMRPCVTAPSARYKKLGLNATPKWPQRLAVAPERINVVPGSSAGTFKQDDARWKLRAKHYKTLLPALGTDKIRNVMDMNTVYGGFAASIIKDPVWVMNVVSSYGPNSLGVVYDRGLIGVNHDWCEAFSTYPRTYDLLHLDGLFTAESHRCEMKFVLLEMDRILRPTGYAIIRESTYFLDSVAAIAKGMRWSCEMRNPENKDDKDKILICQKKLWAGKQ

SEQ ID NO: 20502 - DNA, 2625 bp, Panicum virgatum
  misc_feature: Ceres CLONE 1811848
  misc_feature: Encodes the peptide sequence at SEQ ID NO. 20503
attgatcgctctgctgctcttcttccccctcccctcttcccactccacactcttgcaattcccctacttccatctcctgcttccaaatccatcaccatgctgcagccgcgccgcaccaggcccctcctcttcctcttcctcttcctcctcctcctcgcgccgccggctaccgctaaaggccgccaccaccaccccgccggcgacggcgtcgtcatctcccaggccgactaccagggcctgcaggccatccgccacgacctcgccgacccctacggcttcctccgctcctggaacgactccggcctcaccgcctgctccggcgcctggcccggcatcaagtgcgtcctcggcagcgtcgtcgccatctcgctcccctggcggggactcagcggcacgctctcccagcgcggcctcggccagctctcccgcctccgcaggctcagcctccacgacaacgccatcgccggccccatccccgcctccctcggcttcctccccgacctccgcggcgtctacctcttcaacaaccgcttctccggcaccgtccccgcctccatcggcgcctgcctcgcgctccagtccttcgacgccagcaacaaccgcctcaccagcgccatcccgcccgccctcgccaactccaccaagctcatccgcctcaacctcagccgcaacgcgttctccgatcacatccccgccgaggtcgtcgcctccgcctcactcctcgtcctcgacctctcctacaacaacctctcaggccccatccccgacgcgttcgcgccctccaacctcctcgacaaggaggccatcaccgggacctacaagctcctcttcctcagcctcgcgcacaactccctcgacgggcccattccggactcgctcgcaaagctcaccaagctccaggacctcgacctctccgccaacaacctcaaaggcaccatccccgccgacctcaccgccacgctccgctccttcaacgtctcctacaacaacctctcgggagcggtgcccgcctccctcgcacggaagttcggggagcccgccttcaccgggaacatcctgctctgcggctactctgcttccacgccctgcccggcctccccatccccggcgccgtccgcgccggcgtcacccgccgaggagtcccgcggccgccgcaagttcagcaccaaggagctcgcgctcatcattgccgggatcgtcgtcggcgtcctcatcctgctgctcctctgctgcctcctcctctgtttcctcacacggaggaggtctgcctccggcaccgccgcagcaggagcaaggagcgggaagcagcaggcggcggccaaggatgctgccggcgccgcggccgccgggcgcggcgacaagccaggctccggcgcggcggaggtggagtccggcggcgacgtcggcggcaagctggtgcacttcgacgggccgctcgcgttcacggcagacgacctgctctgcgccaccgcggagatcatggggaagagcacctacggcacggtgtacaaggccacgctcgaggacggcagcctggtggccgtcaagcgcctcagggagaagatcaccaagggacacaaggacttcgaggccgaggcggccgtgctcggcaggatccgccaccccaacctgctggcgctcagggcatactacctggggccaaaaggggagaagctgctcgtcttcgattacatgcccaagggcagcctcacctccttcttgcacgctcgcgctccgaacacgccggtggactgggcgatgcggatgacaatcgccaagggcacagcccgtggcctggcctacctccacgacgaaatgagcatcgtgcacggcaatctgaccgccagcaacgtcctcctcgacgagcaatgcaaccccaagatctccgacttcgggctgtcccggctgatgacgacagcggcgaactcgaacgtgctggccgctgcgggcgcgctggggtaccgcgcgccggagctgtcgaagctgaagaaggcgaatgccaagacggacgtgtacagcctgggcgtgatcatcctggagctgctgacgggcaagacccccgccgagagcaccaacggcatggacctgccgcagtgggtggcgtccatcgtgaaggaggagtggaccagcgaggtgttcgacctggagctgatgcgcgacgccgcgtcggggcccgtcggggacgagctcatggacacgctcaagctggcactgcactgcgtggacccggcgccgtcggtgcggcccgaggcctgggaggtgctgcggcagctcgagcagatcaggccggggtcagacggcggcgccgggccgagcgaggaaggtgtgccggcggcttctgcaggagacgatgagtagcgctaggaccagctgtgcaaggcaagaattacgagaagaaaaggaatcatttaggtagagagatagagagagatatatctaggaattctttgattcgtttgattgtgaagtattacttctacttctaccactggcgttgctaaggtaattttcagtttgtataggcaaatgttatttttgcactagaatcaatggctgtatgtagcagcctaggaacaaggatggaaaagagcagaaatactactagtagtataataaatgctttat

SEQ ID NO: 20503 - protein, 753 aa, Panicum virgatum
  misc_feature: Ceres CLONE 1811848
  misc_feature (456)..(726): Pfam Name: Pkinase Pfam Description: Protein kinase domain
  misc_feature (41)..(83): Pfam Name: LRRNT_2 Pfam Description: Leucine rich repeat N-terminal domain
  misc_feature: SWISSPROT Homolog: EC 2.7.11.1 Non-specific serine/threonine protein kinase
MLQPRRTRPLLFLFLFLLLLAPPATAKGRHHHPAGDGVVISQADYQGLQAIRHDLADPYGFLRSWNDSGLTACSGAWPGIKCVLGSVVAISLPWRGLSGTLSQRGLGQLSRLRRLSLHDNAIAGPIPASLGFLPDLRGVYLFNNRFSGTVPASIGACLALQSFDASNNRLTSAIPPALANSTKLIRLNLSRNAFSDHIPAEVVASASLLVLDLSYNNLSGPIPDAFAPSNLLDKEAITGTYKLLFLSLAHNSLDGPIPDSLAKLTKLQDLDLSANNLKGTIPADLTATLRSFNVSYNNLSGAVPASLARKFGEPAFTGNILLCGYSASTPCPASPSPAPSAPASPAEESRGRRKFSTKELALIIAGIVVGVLILLLLCCLLLCFLTRRRSASGTAAAGARSGKQQAAAKDAAGAAAAGRGDKPGSGAAEVESGGDVGGKLVHFDGPLAFTADDLLCATAEIMGKSTYGTVYKATLEDGSLVAVKRLREKITKGHKDFEAEAAVLGRIRHPNLLALRAYYLGPKGEKLLVFDYMPKGSLTSFLHARAPNTPVDWAMRMTIAKGTARGLAYLHDEMSIVHGNLTASNVLLDEQCNPKISDFGLSRLMTTAANSNVLAAAGALGYRAPELSKLKKANAKTDVYSLGVIILELLTGKTPAESTNGMDLPQWVASIVKEEWTSEVFDLELMRDAASGPVGDELMDTLKLALHCVDPAPSVRPEAWEVLRQLEQIRPGSDGGAGPSEEGVPAASAGDDE

SEQ ID NO: 20504 - DNA, 2126 bp, Panicum virgatum
  misc_feature: Ceres CLONE 1811850
  misc_feature: Encodes the peptide sequence at SEQ ID NO. 20505
gttttttaccatctcctcttcctttcctctccgtctccgtgtccatccccatctcctccgccttccccctcccctcccatcccctccccacgccgcattcgcatctccggatccccgccgccgccctcccccactccgcgtccctcgccattgccgccgctagcctcgatctcccctcgattccccgcgccccgattcttactctcgcgtgggtaggatatggcttggagcgggggctgctcggcccggcgcgggtgatctatcctcgcgcggggagccctctcgcgcaccacgcggaggatcccgtcgcggctggtgcgcccttctccctcctcctcctccacctctgcccccgcgcgcgcggctctagggtttgctctccttcctcgctagcgggttccatctcctcccctcccctcccgctgctctgccatcatgttctcgcacggcgctgattccgcccacgacgccgggggcgtcggcgtcagcagcgccggagccaccgtcccggcccgctttgtctggccctatggtggcaagagggtcttcgtatcaggctcctttaccaggtggtcagagcatttgcaaatgtctcctgttgaaggctgtccgaccgtatttcaggctatttgcagcctgtctccaggaatgcaccagtacaagttctttgtggacggggagtggcggcacgatgagcgccaacctactatatcaggagagtatggcatagttaacactgtatacttgacaagggaaataaactcagtattgagtccaagcacacctggaaccaggatggatgtggacaatgaaaattttcaacgtacagttacgttgtcggatggtaatattcaggacggtggtcctagagtttcagaggctgctatacaaatctctaggtgtcgtgtttctgagtatctgagtttgcatactggctatgatttgcttccagattcgggcaaggttattgctctggacattaatttacctgtgaagcaatctttccatatcctgcatgaacagggaattcctgtagctcctttgtgggactcattcagaggtcagtttgttggccttctgagcccattggattttatactcatattgaaagagctggaaactcatggctcgaacttgacagaggagcaacttgaaacacacaccatatctgcatggaaagaggctaaacggcaaacttatggaagacacgatggtcagtggcgaccacatcagcctctagtgcatgccaccccttacgagtccttgagggacattgctctaaagatattgcaaaatggcatttctacagtgccggttatttattcatcatcgtcagatggatcattcccgcagctgttgcatctcgcatccctttccggaattttgaaatgtatttgtagatatttcaagaactcaactggtaattttcctattctaaatcaaccagtatgcacaattccactgggttcctgggttccaaaaattggtgatccaaacagtcgtccattggctatgttgcggcctcatgcatcacttagctctgcccttaacatgctggttcaagctggagtcagctcaataccaattgtggatgaaaacgattcgctgcttgacacttattcgagaagtgacatcacagccctagcaaaagacaaggtctacacacatgttcgtttggaggagatgaccattcatcaggctttgcaacttggacaagatgccaatacacgttttggttttttcaatgggcagaggtgccagatgtgcctccggtccgatcctttgctgaaagtgatggagcgactgtctaatcctggggtgcggcgagtgttcattgtggaagctggcagcaaacgtgtggaaggcataatatcactgagtgatattttcaagttcttgttgagcttgtgataatggcatggatgttttgttgtgacaagtgccggagttttaactgtagcaaacagcatgtgcgaagcaagccgccatgcgatgccatggatgaatggatccctctttctcaatctctctgtcctttgttggatataagtaaggcgggattaaaggtggcggcttgtgtttgcagatgataatggccattcagttgagttgagttcagggtctgt

SEQ ID NO: 20505 - protein, 491 aa, Panicum virgatum
  misc_feature: Ceres CLONE 1811850
  misc_feature (352)..(489): Pfam Name: CBS Pfam Description: CBS domain pair
  misc_feature (171)..(312): Pfam Name: CBS Pfam Description: CBS domain pair
MFSHGADSAHDAGGVGVSSAGATVPARFVWPYGGKRVFVSGSFTRWSEHLQMSPVEGCPTVFQAICSLSPGMHQYKFFVDGEWRHDERQPTISGEYGIVNTVYLTREINSVLSPSTPGTRMDVDNENFQRTVTLSDGNIQDGGPRVSEAAIQISRCRVSEYLSLHTGYDLLPDSGKVIALDINLPVKQSFHILHEQGIPVAPLWDSFRGQFVGLLSPLDFILILKELETHGSNLTEEQLETHTISAWKEAKRQTYGRHDGQWRPHQPLVHATPYESLRDIALKILQNGISTVPVIYSSSSDGSFPQLLHLASLSGILKCICRYFKNSTGNFPILNQPVCTIPLGSWVPKIGDPNSRPLAMLRPHASLSSALNMLVQAGVSSIPIVDENDSLLDTYSRSDITALAKDKVYTHVRLEEMTIHQALQLGQDANTRFGFFNGQRCQMCLRSDPLLKVMERLSNPGVRRVFIVEAGSKRVEGIISLSDIFKFLLSL

SEQ ID NO: 20506 - DNA, 1190 bp, Panicum virgatum
  misc_feature: Ceres CLONE 1811859
  misc_feature: Encodes the peptide sequence at SEQ ID NO. 20507
  misc_feature (650)..(650): n is a, c, t, g, unknown, or other
acgcaatcacagtatcacacaactcggtcgctctagctcagagcggcgacctcagagcacgccccctgtgcgtgtcaccgtggttgtggcctggtcggaacgagagagagagagagagagagagagagagagagagagagagagagaggagattatgaagcaggcggaggtggtggtggtggagacggcgctggtggcgccaagcaaggagacgccggggcagccgctgtggctgtccaacctcgacctggccgtgccgaggacgcacacgccgctcgtctactactatccggcgcccgcgcagggcggcgccgccgcgggcttcgagtcggaccggctcaaggccgcgctggccggggcgctggtgccgttctatccgctcgccgggcggctcggtcccggcccggacggccggctgcagatcaactgcaccggcgagggcgcgctcttcgtcgtcgccagggcggacctcaccggcgacgagatctttgaggactaccagccgtcgccagagatccggagagcttttgtgccgtcaccgcagcctgacgaggcgtcctgccccatggccgtgtttcagttgactttcctcaagtgtggcggcgtggtgctgggcaccggcatccaccacgcggtgttggacggcgtgngcgcgttccagttcatgcagacgtgggcggcgctggcccgcggcgtcaacgccgccgaggcgtgcgggctggtgccgttccacgaccggaccctcctccgcgcgcggagcccgccgtgcccgaccttcgaccacttcgtctactccccggccttcctcagcggccgcccgcggcccttcgtcacccgattctaccccgtctcccccaagctcctcgccgacctcaagtcccggtgcggggccggcgtgtccacatactgcgccgtcaccgcgcacctctggcgctgcgtgtgcggtgcgcgcgggatggcgcccggcgcggacacccgcctcgggctgccggccaacgtccgccaccgcctgagcccgccgctcccgcgcagcttcttcgggaacgccgtcgtgcgcgacctcgtcaccgcgcgggtcggcgacctgcggggcagcccgctcgggtccgtggcggagacgatcaagaaggcggtggaccgcgtgggcgacgcgttcgtgcggtcggtgctggactacctggagctggaac

SEQ ID NO: 20507 - protein, 345 aa, Panicum virgatum
  misc_feature: Ceres CLONE 1811859
  misc_feature (4)..(345): Pfam Name: Transferase Pfam Description: Transferase family
  misc_feature: SWISSPROT Homolog: EC 2.3.1.144 Anthranilate N-benzoyltransferase
  misc_feature: Useful for making plants with altered carbohydrate content
  misc_feature (166)..(166): Xaa is any aa, unknown, or other
MKQAEVVVVETALVAPSKETPGQPLWLSNLDLAVPRTHTPLVYYYPAPAQGGAAAGFESDRLKAALAGALVPFYPLAGRLGPGPDGRLQINCTGEGALFVVARADLTGDEIFEDYQPSPEIRRAFVPSPQPDEASCPMAVFQLTFLKCGGVVLGTGIHHAVLDGVXAFQFMQTWAALARGVNAAEACGLVPFHDRTLLRARSPPCPTFDHFVYSPAFLSGRPRPFVTRFYPVSPKLLADLKSRCGAGVSTYCAVTAHLWRCVCGARGMAPGADTRLGLPANVRHRLSPPLPRSFFGNAVVRDLVTARVGDLRGSPLGSVAETIKKAVDRVGDAFVRSVLDYLELE

SEQ ID NO: 20508 - DNA, 1862 bp, Panicum virgatum
  misc_feature: Ceres CLONE 1811862
  misc_feature: Encodes the peptide sequence at SEQ ID NO. 20509
aaccaaacgccaaatggggccaagcatgacgcccacttccacggtgcccctcgcgcctctcctcctccgcctttccgccgcggccgcggccgcagcagcagcagctcctcgcctcaagaacccggcggcgacagcagcagcaggggcagtccatgtccatggcgtgcggtgggcgggtggcggggccaggagcaggaggaggaggtgccgggcggcggtggtagaggaggccggcgcgcgcgaggacggggtgctgctgcccaaggagggggacgatgccgcggcggcggcggcgaggcggtacgactggaaggaggagtggtacccgctgtacctggccaaggaggtgcccgacgacgcggcgctcccgctcaccgtgttcgaccgccagctcgtgctctggcgcgacggcgacggcatgctccgctgccaccaggaccggtgcccgcacaggttagcgaagctgtcggaaggccagatcgtcgacggcaggctggagtgcctctaccatggctggcagttcgatggagagggcaagtgcgtcaagataccacagctgccggagggcgccaagatcccccggagcgcgtgtgcgcgcacctacgaggtgcgcgactcgcagggcgtggtgtgggtgtggatgtcggacscgaacccgcccgacgagcggaagctcccatggttcgagccgtacgcgcgggcggggttcacggacctgtcgacggtgcacgagctcccctacgaccactccatcctgctggagaacctcatggacccggcgcacgtgcccatctcccacgaccgcaccgactggacggccaagcgcgaggacgcgcaggcgctcttcttcgacgtcaccgagcgcaccgcgcgcgggttcgccggctactggggccgcacgcgcacgccgcacctccgcaacctgctccgcttcgaggcaccctgcgtgctcaccaacacgctcgagtacacggacaaggacggcagggaccagtgcttctccgcccaattcctctgccgccccgccggccagggcaagtccatgctcgtcgtccgcttcggctccaccgtcaggtcgcccatcgccaaggtgctcccggcctggtacctgcaccagaacgcgtgcaaggtgttcgagcaggacatgggcttcctgtcgtcgcagaacgaggtgctgctccgggagaagctgcccaccagggagctctacctcaacctccgttcctccgacacctgggtcgccgagtacaggaagtggatggacagggcgggccacggcatgccctactacttcggccacagcagcctcgcgccgccgcccgtgccggccgtcgtcgagcaggcgccggcgggggccgtcgcggggatctcggcctccttcccggccaagggcggtgtcggcacggtgcacgcgcccaaccccaccaacaggtacttccgccacgtcgtgcactgcaaggggtgcagggcaagcgtcaacaagtacacctcgtggaagaacgccttcgccgtcctcgcggcagcggccgtggccgcctccatcctggcggcgaccaggcagtggaaggccatcttgctggcggcgtcagccgtgctggccgcggcgtcctacgcgtgcgacgcggtgctttctttgatcacaaccaacttcattaggacacataggcgactgtaaggcatatagcaggcatttaggtagaagggaggctttcgccctttgtatatttgttgtatctataatgagcggtgctttggcaatctaagatgcatgtcagcagcagatgatatggggattagatcttccatcttctgtcaaattgtggatagtcatgcaggatcgaggacgttgagtttgtgatttg

SEQ ID NO: 20509 - protein, 553 aa, Panicum virgatum
  misc_feature: Ceres CLONE 1811862
  misc_feature (307)..(397): Pfam Name: PaO Pfam Description: Pheophorbide a oxygenase
  misc_feature (102)..(204): Pfam Name: Rieske Pfam Description: Rieske [2Fe-2S] domain
  misc_feature: SWISSPROT Homolog: EC 1.13.12.14 Chlorophyllide-a oxygenase
  misc_feature (213)..(213): Xaa is any aa, unknown, or other
MGPSMTPTSTVPLAPLLLRLSAAAAAAAAAAPRLKNPAATAAAGAVHVHGVRWAGGGARSRRRRCRAAVVEEAGAREDGVLLPKEGDDAAAAAARRYDWKEEWYPLYLAKEVPDDAALPLTVFDRQLVLWRDGDGMLRCHQDRCPHRLAKLSEGQIVDGRLECLYHGWQFDGEGKCVKIPQLPEGAKIPRSACARTYEVRDSQGVVWVWMSDXNPPDERKLPWFEPYARAGFTDLSTVHELPYDHSILLENLMDPAHVPISHDRTDWTAKREDAQALFFDVTERTARGFAGYWGRTRTPHLRNLLRFEAPCVLTNTLEYTDKDGRDQCFSAQFLCRPAGQGKSMLVVRFGSTVRSPIAKVLPAWYLHQNACKVFEQDMGFLSSQNEVLLREKLPTRELYLNLRSSDTWVAEYRKWMDRAGHGMPYYFGHSSLAPPPVPAVVEQAPAGAVAGISASFPAKGGVGTVHAPNPTNRYFRHVVHCKGCRASVNKYTSWKNAFAVLAAAAVAASILAATRQWKAILLAASAVLAAASYACDAVLSLITTNFIRTHRRL

SEQ ID NO: 20510 - DNA, 1070 bp, Panicum virgatum
  misc_feature: Ceres CLONE 1811872
  misc_feature: Encodes the peptide sequence at SEQ ID NO. 20511
gaatccccgcgcaggcaagggcgctgaggaggagggcagacgaggcagcaagaccgagccgccggggtcgggacgggggaggccgaggagacccctgaaatcgcagatcctacctcctccttcccgcccgcccgtgcccaatcagcgcgccattcttgccgccgccgccgcatcctccgagggacatcgcataaacaagaagctgcaggatggtgctctgggtattcggctacggctccctgatctggaaccccggcttcgacttcgacgacaagatccttggcttcatcaagggctacaagcgcaccttcaaccttgcatgcattgaccatagaggcacaccagagcacccagcgaggacctgcacgcttgaaaccgacgaggaggccatatgttggggaatcgcgtattgcgtcaagggtggtatagacaaagagcggaaagcaatgcagtacttggagagaagagagtgtgagtatgaccagaagatatctgttgacttcttcaaggaaggagattctctgaagccagctgtgacaaacgtgctagtttttgtatccacacctgatccaatcggcaacaaatactatcttggtcctgcccctttggaggatatggcaaggcaaattgctacagccaatggccccaatggctataatagggatcacctgttcaacatggagaaggcattggccagcataagccatgaagatgatgcgataattgagcttgcgaatgaggtgaggatggtgctgaacagagcgaaggaggcgaaggtcactggctccgacataaccctgaaatctcatgttcagctggtgcacctgtctgctcttcccgaaggcaccgttgtggactcgagatagcaagaaccttgaagcccagctggatcagcgaaggagatgaatgtcctctgaccatactttgatgttgttccatcggagactccaaatttgctttcacctctttaatgtttgtggccatcgtgtactgaatttgaattcttctttaccacggttgtggtgagtctgtacctttcagtgtagaatgctaaagacagcactagcgac

SEQ ID NO: 20511 - protein, 218 aa, Panicum virgatum
  misc_feature: Ceres CLONE 1811872
  misc_feature (3)..(181): Pfam Name: ChaC Pfam Description: ChaC-like protein
MVLWVFGYGSLIWNPGFDFDDKILGFIKGYKRTFNLACIDHRGTPEHPARTCTLETDEEAICWGIAYCVKGGIDKERKAMQYLERRECEYDQKISVDFFKEGDSLKPAVTNVLVFVSTPDPIGNKYYLGPAPLEDMARQIATANGPNGYNRDHLFNMEKALASISHEDDAIIELANEVRMVLNRAKEAKVTGSDITLKSHVQLVHLSALPEGTVVDSR

SEQ ID NO: 20512 - DNA, 570 bp, Panicum virgatum
  misc_feature: Ceres CLONE 1811878
  misc_feature: Encodes the peptide sequence at SEQ ID NO. 20513
atcgtttggttcaaaatctcccttcccattcctctttctctctctctcagccttgttggttggtttggttggcaagagccatggcgctgacgctgcgatccaccacgtgagttcctgtcgcccatcgaccccatctccaagctcctcaacaagaccggcgccaacaacgcgccgccgagctgcgccgccgggccgtccccggcccacgcgcgacccgccgatacagacgctgggccggagatatgtcgtgcctaccagatcatcacgagggggggactcgaagatgaaaacatcgttaccttcatgtaccaccatctggctcagagcccggaaaatccaaggccaggtgtcatcatctaccatcccctctgtggctatatctatgctgggggtccaaaggagtacaccgagagggaggtcaatgtcaagaatttcttcattgttctgcttgggaacacaacagctgacagtggtgggagtgacaaggttgtggacagtgcccccaatgattatatttgtgtttactacagcgactatgggggtccgggtgtgcttgggatgcctacctac

SEQ ID NO: 20513 - protein, 88 aa, Panicum virgatum
  misc_feature: Ceres CLONE 1811878
  misc_feature: SWISSPROT Homolog: EC 3.4.22.34 Legumain
MYHHLAQSPENPRPGVIIYHPLCGYIYAGGPKEYTEREVNVKNFFIVLLGNTTADSGGSDKVVDSAPNDYICVYYSDYGGPGVLGMPT

SEQ ID NO: 20514 - DNA, 1327 bp, Panicum virgatum
  misc_feature: Ceres CLONE 1811880
  misc_feature: Encodes the peptide sequence at SEQ ID NO. 20515
tcttccgctatcaggccggcgcggcttacccgtcacgctgcgctcctaccaccacctccacggctccactatatataatccccgatcgcctagcgcacacgcgccggacccgccggccgacgaggcgcaaccgcgcaacgcaaacccacacgcgccgctgcctgcgccgtcgtgccgcaccggcccgctccttctccactcaggtgcaatcaggttacggccgccttgggccgccgcgggctgcgccgccggacagtgcttgctcaggccgagagggggagacgcggggcacgcgaccgcggctagcccgggcggcggggtgcggaggcggagaaggtaggtatggagaagtacgaggcggtgcgggacatcgggtcggggaacttcggggtggcgcggctgatgcgcaaccgtgagacccgggagctcgtcgccgtcaagtgcatcgagcgtggccaccggattgacgagaatgtgtacagggagatcatcaaccaccgctcgctacgccaccccaacatcattcgcttcaaggaggtgatacttgcacccacacatcttatgatagtgatggagtttgcagcaggcggagagctcttcgatcgaatctgtgatcgtgggcggtttagtgaggatgaggcccggtatttctttcagcagttgatatgtggcgtgagctactgccattacatgcaaatatgccatcgagatttgaagctggagaatgttctcttggatggtagccctgctccacggctcaagatatgtgattttggctattccaagtcatcactgttgcattcaagacccaaatcagcagtgggaacaccagcatatattgcacctgaggtgctatcccatcgcgagtatgatggaaagcttgcatatgtctggtcctgtggggtgactctttacgtcatgcttgtgggagcatacccatttgaagacccggatgatcccaagaatatacgcaagaccgttcagcaaataacgcaagtacaatacaagataccagattatgtccacatatctacagattgtaaacaacttcttgcccgtatctttgttaccaatccaatgaggagaatcacaatgatggaaataaagagccatccatggttcctaaagaacctgccacgggaactcacagagacagcacaggccatgtactacaagagagataacagggtaccttcttattcataccaaacgtcagacgaaatcatgaagattgtccaacatgcaaggaccatgccaaaattatccagatcaggctacgattggagcaatgagtgttcggatgaagaagaagaaaaggaagaggaac

SEQ ID NO: 20515 - protein, 328 aa, Panicum virgatum
  misc_feature: Ceres CLONE 1811880
  misc_feature (4)..(260): Pfam Name: Pkinase Pfam Description: Protein kinase domain
  misc_feature: SWISSPROT Homolog: EC 2.7.11.1 Non-specific serine/threonine protein kinase
  misc_feature: Useful for biocontainment applications
  misc_feature: Useful for making plants with modulated biomass
  misc_feature: Useful for making plants with modulated time to senescence
  misc_feature: Useful for making plants with modulated water use efficiency
MEKYEAVRDIGSGNFGVARLMRNRETRELVAVKCIERGHRIDENVYREIINHRSLRHPNIIRFKEVILAPTHLMIVMEFAAGGELFDRICDRGRFSEDEARYFFQQLICGVSYCHYMQICHRDLKLENVLLDGSPAPRLKICDFGYSKSSLLHSRPKSAVGTPAYIAPEVLSHREYDGKLAYVWSCGVTLYVMLVGAYPFEDPDDPKNIRKTVQQITQVQYKIPDYVHISTDCKQLLARIFVTNPMRRITMMEIKSHPWFLKNLPRELTETAQAMYYKRDNRVPSYSYQTSDEIMKIVQHARTMPKLSRSGYDWSNECSDEEEEKEEE

SEQ ID NO: 20516 - DNA, 483 bp, Panicum virgatum
  misc_feature: Ceres CLONE 1811881
  misc_feature: Encodes the peptide sequence at SEQ ID NO. 20517
cactcacactgtgcatttcactgcaaacagtgtcgaactcgctgcccaagaagcaagaaccggcggccatggcaggagcagaggccgagcatggaggagccgcctctccttcccctctccacgtcgtggtgttcccgtggctggcgttcggccacatgattccgttcctcgagctctccaagcggctggcgcggcgcggccacgccgtcaccttcgtgtccacgccgcggaacgccgccaggctgggcgccgtcccgccggagctcgccgcgcgcctgcgcgtcgccgcgctggagctgccgggcgtcgagggcctgccccgcggcaccgagaccacggccgacgtcacgcctgagaaggtcggcctgctctagaatgccttcaactgcctctccgccccgttagccgacctcgtcacagaggcctgctccgccccctctggcgactccaccgcggggttctcaatgaagaccgacttcatca

SEQ ID NO: 20517 - protein, 101 aa, Panicum virgatum
  misc_feature: Ceres CLONE 1811881
  misc_feature: SWISSPROT Homolog: EC 2.4.1.115 Anthocyanidin 3-O-glucosyltransferase
  misc_feature: Useful for making plants with altered carbohydrate content
MAGAEAEHGGAASPSPLHVVVFPWLAFGHMIPFLELSKRLARRGHAVTFVSTPRNAARLGAVPPELAARLRVAALELPGVEGLPRGTETTADVTPEKVGLL

SEQ ID NO: 20518 - DNA, 713 bp, Panicum virgatum
  misc_feature: Ceres CLONE 1811885
  misc_feature: Encodes the peptide sequence at SEQ ID NO. 20519
atggccatcaccaccatgtgtcgccaccccacctgcgcctccgcctccgcctccacttcccacccactcccccccccgcgccattaagccccaggtcgcgctcctcccgtcgacgcatcgggcgcttctgctggttgctcgttccgcagagccgaccggagcggggcggggcggggcgaggcgggggcgctgctagctgcggccggccatggcgggcatcgacctcaacaccgtcgagggggaggaggacgaggaggagccggaggcgccgagggcggatggcgcggtgtgcctggacctgtggcacgcgtgcgcggggcccgtcgcgccgctgccacggaagggcagcgccgtcgtgtacctgccgcagggccacctcgagcacgtcggcggggacgcggcgccgcctgcggcggtgccgccgcacgtcttctgccgcgtcgtcgacgtcaacctccacgcggacggcgcgacggacgaggtgtacgcgcgggtgtcgctgctgcccgaggatgaggaggcggagcggcgtgggcgggcgcgggcgcgggaggacgaggacgcggctcgcgacggcgagggcggggacgccatgaagccgctcgcgcggacgccgcacatgttctgcaagacgctcacggcctccgacaccagcacgcacggcggcttctccgtgccgcgccgcgccgccgaggactgcttcccgccgctgg

SEQ ID NO: 20519 - protein, 168 aa, Panicum virgatum
  misc_feature: Ceres CLONE 1811885
  misc_feature: The sequence is a functional homolog of SEQ ID NO 696 in the 11/479,226 US patent application
  misc_feature: The sequence is a functional homolog of SEQ ID NO 2380 in the 10/374,780 US patent application
  misc_feature: The sequence is a functional homolog of SEQ ID NO 962 in the 10/225,066 US patent application
  misc_feature: The sequence is a functional homolog of SEQ ID NO 202 in the 10/225,066 US patent application
  misc_feature: The sequence is a functional homolog of SEQ ID NO 2342 in the 10/374,780 US patent application
  misc_feature: The sequence is a functional homolog of SEQ ID NO 286 in the 10/412,699 US patent application
MAGIDLNTVEGEEDEEEPEAPRADGAVCLDLWHACAGPVAPLPRKGSAVVYLPQGHLEHVGGDAAPPAAVPPHVFCRVVDVNLHADGATDEVYARVSLLPEDEEAERRGRARAREDEDAARDGEGGDAMKPLARTPHMFCKTLTASDTSTHGGFSVPRRAAEDCFPPL

SEQ ID NO: 20520 - DNA, 1096 bp, Panicum virgatum
  misc_feature: Ceres CLONE 1811888
  misc_feature: Encodes the peptide sequence at SEQ ID NO. 20521
acttccgttctccaccccctccccaaaatcccctcccccccacccctcgccgccggcgctgtcgcgtcctccgccgccagtcatggccgccgcgggtcccgggctctacaccgagatcgggaagaaggccagagatctcctctacaaggactaccacacggaccagaagttcacgctcaccacctacgcctccaacggagctgccattactgctgcaagcacaaggaaaaatgaagctatcttcagtgaaatccagagccagctgaagcatgaaaatgtgacagtggatgtgaaagcaacttcagaatctactgtgacgactacatttacaattcatgagctgtgcacaccaggtctgaaggcaattttatgcattcctttcccataccagaaatcagcaaaggctgaactccagtacttgcaccaccatgttggtgtcgctgctagtgttggcctgaatgcaaaccctgttattaacttttccggtgtattcgggactaaaactgtcgctgttggtgctgacgcttcatttgatacttcatctggggacttgaccaaatacaatgctggactgagctacactactagtgactttgttgctgcagccactctgaacaacaagggagacagccttgctgcttcctactaccacttggtgaattcaaccacagctgttggraggaagaagctgactcatagcttctcaagcaatgagaacaccctcacctttgggacacagcacgccctggaccctctgaccactgtgaaggcacgcttcaacaactatggcatggcaagtgcgctcatccagcacgaatggaggcccaagtcattggtcaccatctccacggaggtcgacaccaaggccatcgagaagagctccaaggttgggctctccctggtccttaagccctgagggcgccagcttctggttttaggatgttagcgtttgttatcagcagctgaagtccagtaaacaagcttggactaaacttgtaggctcagctttggtgccgtggggtctcagatcccacaaactcaattcattgcgtgttaccctgttctagactacttgaggggtttctgcttttaccag

SEQ ID NO: 20521 - protein, 277 aa, Panicum virgatum
  misc_feature: Ceres CLONE 1811888
  misc_feature (5)..(270): Pfam Name: Porin_3 Pfam Description: Eukaryotic porin
  misc_feature: Useful for making plants with modulated drought sensitivity
MAAAGPGLYTEIGKKARDLLYKDYHTDQKFTLTTYASNGAAITAASTRKNEAIFSEIQSQLKHENVTVDVKATSESTVTTTFTIHELCTPGLKAILCIPFPYQKSAKAELQYLHHHVGVAASVGLNANPVINFSGVFGTKTVAVGADASFDTSSGDLTKYNAGLSYTTSDFVAAATLNNKGDSLAASYYHLVNSTTAVGRKKLTHSFSSNENTLTFGTQHALDPLTTVKARFNNYGMASALIQHEWRPKSLVTISTEVDTKAIEKSSKVGLSLVLKP

SEQ ID NO: 20522 - DNA, 1675 bp, Panicum virgatum
  misc_feature: Ceres CLONE 1811898
  misc_feature: Encodes the peptide sequence at SEQ ID NO. 20523
ggcccgacgcaggagagaaccgcgcgacttaatgcgagcgcgcccgccccgccgcccctaggcccgaggtccgagggagagggagagcgccccgagacgagccatggcgccggcggggctccacgccgtggccgtgcgcgtcctcctgctctcgctcctcgcagtctcagccatcgacgttgtatcggcggcgacggcggcgccgctcaagttcgggatcaactacggccagatcgcgaacaacctcccgcacccggcgcaggtgtcgggcctcctgcagtcgctcaacgtcaaccgcgtcaagctctacgacgccgacccggccgtgctcacggccttcgccggcacgggcgtggagttcatcgtcggcaacgaggacctccagaacctgaccgacgcgcgcaaggcccgcgcctgggtggcgcagcacgtgcagccgttcatcccgagcacgcgcatcacctgcatcaccgtcggcaacgaggtgctctccggcaaggacacggtcgccatgcagaacctcctcccggccatgcaggccatgcaccaggccgtgtccgacctgggcctcgccggccaggtgaacgtctcgacggcgcactccgtcaacatcctcgccagcagctacccgccgtcgtcgggcgtgttccgggaggagctcgcgcagtacatccagcccatcctcaacttccacgccgaggtccgctcgccgttcctcatcaacgcctaccccttcttcgcctacaaggcgagccccggcagcgtgtcgctgccgtatgtgctcttcgagcccaaccccggcgtggtcgaccccaacaccaacctcacctacgacaacatgctctacgcccagatcgatgccgtctacgcggccatgaaggccatggggcacacggatctcaccgtcaggatctccgagaccgggtggccgtccaagggcgacggcgacgaggtgggcgcgaccgtggccaacgccgcggcgtacaacgggaacctgatgaagaggatcgccatgggccagggcacgccgctcaagccggacgtccccatcgatgtgttcgtgttcgcgctcttcaacgaggacatgaagcccgggccggcgtcggagaggaactacgggctgttttaccccaacgacacgccggtgtacaacctcgggttcaacggagcatccttcagcccgtcgccgacgttctcctcttcttccaagccgacgactacatttctgatggcggttgttgtcctactcgccggctttttcctatgatctacaccagtattgtgcgagaagatttgcgactaacccatttgtgcttgcatcggacatcatactagtaaccagagcccataatctgactttgaggtcagcaagatttttttgttcttttcatcagttgattgattggattggaagattgtagctagtcctatatagaggaaggagaaggcggatgtaccatcatcatttctatgcaactgttcaggaaaatcagtcaaaccgctgtaaaattttgacagtatggaatagaactgtagaagtaccaatattggttatatagatacaacgagcatgtgacttggagtggttgtttagttctgttctgtcactgtattatacattcatcttattgtattagaaacagtctatcatcagatagttatgtgggatttgttc

SEQ ID NO: 20523 - protein, 387 aa, Panicum virgatum
  misc_feature: Ceres CLONE 1811898
  misc_feature (37)..(353): Pfam Name: Glyco_hydro_17 Pfam Description: Glycosyl hydrolases family 17
  misc_feature: SWISSPROT Homolog: EC 3.2.1.39 Glucan endo-1,3-beta-D-glucosidase
  misc_feature: Useful for making plants with altered carbohydrate content
  misc_feature: Useful for making plants with altered cell wall content and/or composition
  misc_feature: Useful for making plants with altered lignin content
MAPAGLHAVAVRVLLLSLLAVSAIDVVSAATAAPLKFGINYGQIANNLPHPAQVSGLLQSLNVNRVKLYDADPAVLTAFAGTGVEFIVGNEDLQNLTDARKARAWVAQHVQPFIPSTRITCITVGNEVLSGKDTVAMQNLLPAMQAMHQAVSDLGLAGQVNVSTAHSVNILASSYPPSSGVFREELAQYIQPILNFHAEVRSPFLINAYPFFAYKASPGSVSLPYVLFEPNPGVVDPNTNLTYDNMLYAQIDAVYAAMKAMGHTDLTVRISETGWPSKGDGDEVGATVANAAAYNGNLMKRIAMGQGTPLKPDVPIDVFVFALFNEDMKPGPASERNYGLFYPNDTPVYNLGFNGASFSPSPTFSSSSKPTTTFLMAVVVLLAGFFL

SEQ ID NO: 20524 - DNA, 720 bp, Panicum virgatum
  misc_feature: Ceres CLONE 1811901
  misc_feature: Encodes the peptide sequence at SEQ ID NO. 20525
atgcgcgttcgccgggccgtgatctgatcggccaaggcaaagcccatggcggagcccaccctcctcgcgccggatcccttcggggacatctccttccccgaatttcaggcgcctgctgacgtcgacaatttcgtcttcgaggacttcgatctggaggatctcgacctcgacgtggacttcgacctcgaccccttcgcctcggatgggctgctcgcgcagccgccgccgctcgcgacctcatcttcctcggccgggtctccggaggggggatcgtcgtcttccggcgccggcggggacggcgggttgaggaacgaggagtcctcggagtcgttttcgaggagcgcgagcggtacgggcggcagcggcaaggggaaaagggaggacgacgaggcgaagcggcgcgcgcggctggtgcgcaaccgcgagagcgcgcacctgtcgcggcagaggaagaagcagtacgtggaggagctggagggtaaggtgaaggccatgcaggccaccatcgccgacctctccgccacgatctcctgtgtcaccgccgagaacgccgtcctcaagcagcagctgggtggtgccgccggaaccgccccgccgccgccgccgccgccgccgccgctaccgatgtaccccgcggtgtaccctttgccgatgccgtggatgcacccagcgtacgccatgcgtggatcgcaggtaccgctcgtgccaattcctcgtctg

SEQ ID NO: 20525 - protein, 224 aa, Panicum virgatum
  misc_feature: Ceres CLONE 1811901
  misc_feature (113)..(176): Pfam Name: bZIP_1 Pfam Description: bZIP transcription factor
MAEPTLLAPDPFGDISFPEFQAPADVDNFVFEDFDLEDLDLDVDFDLDPFASDGLLAQPPPLATSSSSAGSPEGGSSSSGAGGDGGLRNEESSESFSRSASGTGGSGKGKREDDEAKRRARLVRNRESAHLSRQRKKQYVEELEGKVKAMQATIADLSATISCVTAENAVLKQQLGGAAGTAPPPPPPPPPLPMYPAVYPLPMPWMHPAYAMRGSQVPLVPIPR

SEQ ID NO: 20526 - DNA, 1796 bp, Panicum virgatum
  misc_feature: Ceres CLONE 1811907
  misc_feature: Encodes the peptide sequence at SEQ ID NO. 20527
gttgctgctgttattattaacgccgccgccgcgccgctgcgttcgtatgctccgcgttgccccggggctcctgcgtccgtaggcgcaccgcccgccgctctttcgcgacgtcggagagagaggggaggccggccgatccgtctcctcctcctcctgcgggcgcgtctgacgaatcgcggcggtttcggcacggggatctgggggggacgtttcttgaatcggatcctgagccgctgtgggcaggccggcggcggggatgaaggcggcggggaaggcggctgatgagaatcagaggcccgtggcggggaagcccgtgcccggcgtccgagagatggggaaccggcgggcgctcacggacatcaagaacctcgtcggggctgctccgtacccctgcgccgtcgccaagaagcccatgctccagaagaatggaagggatgagaagaagccgccgttggcaagcagccggcccatgaccaggaaattcgctgcctccttggcgagcaaaggagaacctgaacgtcaggtgaccacagctgatccaggacttggagctgatcacaacaaggaaccaatcggcgatggcaccatcgacatcgacgtggaacagtacgagccggtccccgatgttgacattgacatggatgagacagatcacaaggacagtgtgaacgaagatgaatctatcatagacattgacaatgcggactcagggaacccgcttgcggcaacggaatatgttgaagtgctttacaagttttacagagaaaatgaggcaaaaagttgtgtaaatcctgattatatgtccagccaacaagatataaacgcaaagatgagagcgattctgattgattggctcattgaggtgcattacaagttcgagctgatggatgagacactgtttcttacagtaaacattatagatagatttttggaaaagcaagttgttccaaggaagaagttgcagctagtgggagtaacagctatgcttcttgcttgcaaatatgaggaggtttcagttccagttattgaagacctagtactcatttctgacagagcctacacgaaagggcagattctagaaatggaaaagttgattctgaacacacttcagttcaatatgtctgttccaacaccatatgtcttcgtgaggaggtttctgaaagctgcagattcagataaacagctagagctagtgtcctttttcatgctggagctctgcctggttgaataccaaatgctgaagtaccagccatcgcttctagctgctgctgcagtttatactgcgcaatgtgctatcaatcgctgccagcactggacaaaggtttgcgaatcacatagcagatacactggcgaccaactccttgagtgctcgaggatgatggtagactttcaccagaaggctggaaccggcaagctcaccggtgtacacaggaaatacagtacgttcaagtttgggtgcgcggccaaggttgagcctgcgcttttcttgttccgtcaggcacatcgccgccatcttcaggcacaatctagttgaatctctctctatccgactggatcgattttaaccttttccatgaacacaaacatcatgttgatgttgcgccaaaagcccaacaatttcccttttttatataacacaacaatttctttagagagcttctgcttatgataatgtaacgctgggtcggttggtcagtcatgtccggctaataacgaattggcctgctttaggaattgctgttggaaccttgtaaagaaaacaagttctgaattaaattgattttgttcatgattgg

SEQ ID NO: 20527 - protein, 425 aa, Panicum virgatum
  misc_feature: Ceres CLONE 1811907
  misc_feature (163)..(289): Pfam Name: Cyclin_N Pfam Description: Cyclin, N-terminal domain
  misc_feature (291)..(411): Pfam Name: Cyclin_C Pfam Description: Cyclin, C-terminal domain
MKAAGKAADENQRPVAGKPVPGVREMGNRRALTDIKNLVGAAPYPCAVAKKPMLQKNGRDEKKPPLASSRPMTRKFAASLASKGEPERQVTTADPGLGADHNKEPIGDGTIDIDVEQYEPVPDVDIDMDETDHKDSVNEDESIIDIDNADSGNPLAATEYVEVLYKFYRENEAKSCVNPDYMSSQQDINAKMRAILIDWLIEVHYKFELMDETLFLTVNIIDRFLEKQVVPRKKLQLVGVTAMLLACKYEEVSVPVIEDLVLISDRAYTKGQILEMEKLILNTLQFNMSVPTPYVFVRRFLKAADSDKQLELVSFFMLELCLVEYQMLKYQPSLLAAAAVYTAQCAINRCQHWTKVCESHSRYTGDQLLECSRMMVDFHQKAGTGKLTGVHRKYSTFKFGCAAKVEPALFLFRQAHRRHLQAQSS

SEQ ID NO: 20528 - DNA, 721 bp, Panicum virgatum
  misc_feature: Ceres CLONE 1811913
  misc_feature: Encodes the peptide sequence at SEQ ID NO. 20529
gctcaccaagccagaccaagccaagcacccactcacaagaagagcacgtcccaggaagagagcagagagagagacggatcgaagatgagcgtggagatccttgacgggagcacggttcggagcttcgtggaggacgagggcgccttcaactcctccgtcgacagccgcttcgccgcgctggacgccgaccgcgacggcctgctcacgtacgtggagatggccggcgagctcatgagcctccgcgtgctcgagaagcacttcgtcgtggacgaggcggcggtgccggccgacgagctcgccgcgctctaccgcggcctgttcgcgcggttcgacagggacggcagcggcaaggtggaccgccaggagttccacgccgagatgagggaggtgctgctcgccgtagccaacgggctcggcttcctccccgtgcagatggtcgtcgaggaggggagcttcctcaaggtcgccatcgacagggagctcggccagatcgccaatgctgcgtaaagctcagtagctcatatgcatgggccactacttgcgcgatcagagtagtatagattactgaattttcaagtgtcataattgcaattttaacatcgatttacagtgtcacgacgaacttatgtagtatgcttcttgttctttcattacctgaaggctaaataaagacatcacacgtgtaattacaagagtaatttatttgaagggaactgctctg

SEQ ID NO: 20529 - protein, 140 aa, Panicum virgatum
  misc_feature: Ceres CLONE 1811913
  misc_feature (74)..(102): Pfam Name: efhand Pfam Description: EF hand
MSVEILDGSTVRSFVEDEGAFNSSVDSRFAALDADRDGLLTYVEMAGELMSLRVLEKHFVVDEAAVPADELAALYRGLFARFDRDGSGKVDRQEFHAEMREVLLAVANGLGFLPVQMVVEEGSFLKVAIDRELGQIANAA

SEQ ID NO: 20530 - DNA, 1935 bp, Panicum virgatum
  misc_feature: Ceres CLONE 1811923
  misc_feature: Encodes the peptide sequence at SEQ ID NO. 20531
agtcggacccgagcggaggagagagagagggagaagaaggggggcaggaggaggaggaggtggcggcgcggagggacacgcggagaggaatgcgcgacccggtgtgagcctccctcgcccccccgcgaaatcccattgattttgattccgattccgccggcggcgaaatcgggccggccagcgagcgggcgagtcgcggcggtgttgtcggggagggggtgagacggtgagggttgaggagcggcggccacggcgaccgggatgaagggagggggcgggaaggagacagtcaccgccaccttcctccgcttgctcctcctgctcctgctccccctcaccgccctctacttcttctacacgctccacctcctcctcgcctccgcgtcgtcggccgcctccaactgcccgcctgactcctccgcaatcgcctcctccgcctcggtctcccgggcgtccgccaacctcacggccgcggcggaggagaagcgccccggttccgccgccgcggcgcccgcggcgacgacgctgcggcacctggtgttcggcatcgcggcgtcgtcgcggctctgggacaagcgcaaggagtacatcaaggtgtggtggcgcccgcgcggcgccatgcggggctacgtgtggctcaaccgcgccgtgcgcaagtccaacatgtccactgcgcggacggggctcccggccatcaggatctcctccgacacctccgccttcccctacacgcaccgccggggccaccgctccgccatccgcatctcccgcatcgtctccgagacgtcccggctcggcctccccggggtgcgctggttcgtcatgggcgacgacgacaccgtcttcttccccgacaacctcctcaccgtgctcaacaagttcgaccaccgccagccctactacatcggctccctctccgagagccacctgcagaacatctacttctcctacggcatggcgtacggcggcggcggcttcgccatcagccgcccgctggccgaggcgctcgcgcggatgcaggacggctgcctccaccgctacccggcgctctacggcagcgatgaccggatccaggcgtgcatggcggagctgggcgtgccgctcaccaagcacccggggttccaccagtacgacgtgtacggcgacctgctgggcctcctcaccgcccacccggtggcgccgctcgtgacgctgcaccacctcgacgtcgtcaagcccctgttcccggacgcgaggtcgcgccccgcggcggtgcggcggctgttcgacgggccggtgaagctggacacggcggggctgatgcagcaatccatctgctacgacggcgacaaccggtggacggtgtccgtggcgtgggggttcgctgtgctggtggcgaggggcgtaatgtcgccgcgggagatggagatgccggcgcgcacgttcctcaactggtacccgcgcgccgattacacggcgtacgcgttcaacacgaggcccctggcgcgtagcccgtgccagaagcccgcggtgtactacctgtcgtcggcgcggcgcgcggccgaccgcggcggcggggagaccacggtcacgcggtacgagcggtggcgccacccgaacgagacgcggccggcgtgccggtgggacatcgccgacccggacgcgcatctcgatcacatcgtcgtgttcaagaggcctgaccccgggctctgggacagggtaaccttccagaccaaaccattccttttccttctattcaatcgacacatgatgtgcatccccatatggagagggccaactggcattggcattgacatcagtttggcattgttggtcacgtacagctacttttatcacgcaatcaaccccttcctagaggcaacctagagctaaaaaagagaaggataatcgcaatgccaacacaactttccctaatgccaagatagaacattcact

SEQ ID NO: 20531 - protein, 534 aa, Panicum virgatum
  misc_feature: Ceres CLONE 1811923
  misc_feature: SWISSPROT Homolog: EC 2.4.1.122 Glycoprotein-N-acetylgalactosamine 3-beta-galactosyltransferase
  misc_feature: Useful for making plants with altered carbohydrate content
MKGGGGKETVTATFLRLLLLLLLPLTALYFFYTLHLLLASASSAASNCPPDSSAIASSASVSRASANLTAAAEEKRPGSAAAAPAATTLRHLVFGIAASSRLWDKRKEYIKVWWRPRGAMRGYVWLNRAVRKSNMSTARTGLPAIRISSDTSAFPYTHRRGHRSAIRISRIVSETSRLGLPGVRWFVMGDDDTVFFPDNLLTVLNKFDHRQPYYIGSLSESHLQNIYFSYGMAYGGGGFAISRPLAEALARMQDGCLHRYPALYGSDDRIQACMAELGVPLTKHPGFHQYDVYGDLLGLLTAHPVAPLVTLHHLDVVKPLFPDARSRPAAVRRLFDGPVKLDTAGLMQQSICYDGDNRWTVSVAWGFAVLVARGVMSPREMEMPARTFLNWYPRADYTAYAFNTRPLARSPCQKPAVYYLSSARRAADRGGGETTVTRYERWRHPNETRPACRWDIADPDAHLDHIVVFKRPDPGLWDRVTFQTKPFLFLLFNRHMMCIPIWRGPTGIGIDISLALLVTYSYFYHAINPFLEAT

SEQ ID NO: 20532 - DNA, 729 bp, Panicum virgatum
  misc_feature: Ceres CLONE 1811925
  misc_feature: Encodes the peptide sequence at SEQ ID NO. 20533
caacagccaacagcacagggggcattccgatccgccggaaccctagcaaggagttaggtatccatggccttctggtggccgctcctcgtgctcgccgccgcctacgcgctctgccgcctgctcctcttcctcatcccgcccaccgtcccttccatcgacgtcgacgcttccgatgtcttggccaaggaggacagcttcatttacataccaagaaagggcaaagcagctcagaccggcaaggtccaatgctacgaaccagcaaccatgaaatacttgggctatttccctgcattgactcctgatgaggtcaaggagcatgttgcacaagccaggaaagctcaaaagatatgggcaaaaagcagcttcaagcaaaggcgccagttccttcgtgtccttctcaagtatatacttgaacatcaggatctcatttgcgaggtatcatctcgggacacgggaaagactatggtcgatgcttcattaggcgagataatgaccacatgcgagaagattacctggcttttggatgagggtgagaagtggttaaaacctgagtacagatcaactgggagatcaatgctgcacaagagagcaaaagttgaattctaccctcttggagtggttggtgctattgtatcatggaattatcccttccataatgtttttaatccaatgctggctgcagtattctctggtaatgcagcagttataaagggatcctttcccatggct

SEQ ID NO: 20533 - protein, 221 aa, Panicum virgatum
  misc_feature: Ceres CLONE 1811925
  misc_feature: SWISSPROT Homolog: EC 1.2.1.3 Aldehyde dehydrogenase (NAD(+))
MAFWWPLLVLAAAYALCRLLLFLIPPTVPSIDVDASDVLAKEDSFIYIPRKGKAAQTGKVQCYEPATMKYLGYFPALTPDEVKEHVAQARKAQKIWAKSSFKQRRQFLRVLLKYILEHQDLICEVSSRDTGKTMVDASLGEIMTTCEKITWLLDEGEKWLKPEYRSTGRSMLHKRAKVEFYPLGVVGAIVSWNYPFHNVFNPMLAAVFSGNAAVIKGSFPM

SEQ ID NO: 20534 - DNA, 1264 bp, Panicum virgatum
  misc_feature: Ceres CLONE 1811933
  misc_feature: Encodes the peptide sequence at SEQ ID NO. 20535
cccgcaaccccaccttcgcatcctgcccgtcgcctcgccgtcgaaatccacgccagcgcaacctaggtcaagcctccgccccctctcccccggctccgaccatgtcggcgccctccgaccccgccgcggccgctggccaggcgcccgcccctgcggccgcgtcggccgccgcttcctccagcagcggcctcaccttcaagctccaccccctcgtcatcgtgaacgtctcggaccaccacacccgcgtcaaagcccaggccgcctgctccggggacggctcctcctcgtccggggcggcggcggggcagccaccgagggtgttcgggtgcgtgatcggggtgcagcgcggccggacggtggagatcttcaacagcttcgagctcgtgctcgaccccgtctcgggcaccctcgaccgcgccttccttgagaagaagcaggagctctataagaaggtgttccccgatttctatgtgctgggctggtactccactggaagcgatgtgcatgacactgacatgcaaatccacaaggccttgatggacgttaacgaaagccctgtttatctactattaaatcctgcaatcaacctctcccagaaggatctccctgtgactatctatgagagtgagttgcatgtcatcgacgggagtcctcagctcatctttgtcagatcaaattataccattgagactgtggaggctgagaggatatctgtagaccatgtggcccatctcaaaccatctgatggcagctcagcggcaactcagttggctgctcatcttacaggaatacacagtgccatcaagatgctcaatagcagggtccgagttatccatcagtatcttgttgccatgcaaaaaggtgatattccagtggataattcgctgcttaggcaagtctcaagccttgtaagaaggttaccagctatggaatcacagaaattccaagatgacttcttaatggaatacaacgacactctcctcatgacttaccttgctatgttcactaactgttcaagcacaatggacgagttagttgagaagatcaacacaagctatgagagacctgcaaccaggagaggagggagaggtgctttcatgtagctcacttgccaatcagttactgctgctctcatctgtggagatttttggaaataccttcttgtatcctgaggcaattttttgcatgcaatctattatgcggtatacggcagctctagagttacttcaaactttctagacaaaaatgatgatttgctcgattc

SEQ ID NO: 20535 - protein, 333 aa, Panicum virgatum
  misc_feature: Ceres CLONE 1811933
  misc_feature (27)..(151): Pfam Name: Mov34 Pfam Description: Mov34/MPN/PAD-1 family
  misc_feature: Useful for making plants with modulated biomass
MSAPSDPAAAAGQAPAPAAASAAASSSSGLTFKLHPLVIVNVSDHHTRVKAQAACSGDGSSSSGAAAGQPPRVFGCVIGVQRGRTVEIFNSFELVLDPVSGTLDRAFLEKKQELYKKVFPDFYVLGWYSTGSDVHDTDMQIHKALMDVNESPVYLLLNPAINLSQKDLPVTIYESELHVIDGSPQLIFVRSNYTIETVEAERISVDHVAHLKPSDGSSAATQLAAHLTGIHSAIKMLNSRVRVIHQYLVAMQKGDIPVDNSLLRQVSSLVRRLPAMESQKFQDDFLMEYNDTLLMTYLAMFTNCSSTMDELVEKINTSYERPATRRGGRGAFM

SEQ ID NO: 20536 - DNA, 1573 bp, Panicum virgatum
  misc_feature: Ceres CLONE 1811934
  misc_feature: Encodes the peptide sequence at SEQ ID NO. 20537
ctctccatctccggctatcccccgccgtctcggcttcctcctcccctcccctcaccctcctgctctgtttcctcctcgcgcacagattccgcaaccccaccccggctcggcctataaatcgcaccagcgcaaccccgaatccccgcaaaacccatcgcccaagccaagcgcgagcagcaacgccgccgccgccgccgccgcgatgatcctccgcatccgcagccgcgacggcacggaccgcatcacggtcccggacccggcctccgccaccgtcgccgacctgcagcgcctcatcgagtcgcacctcaccgtgcccgtcccgctccagcgcctctccctcgacccggccctcctcctccccagcccctccgccgccgtccccctccttgccaacccggccgccacgctcgcctcgctccgcctcgccaacggagccttcgtctacctcgcctacccgcccgacgcgcgctccgcccgcccgccgccacccaaggcgctctccgccgccggctccttcggcaagaagatgaccatggacgacctcatcgcgcgccagatccgcgtcacccgccaggagaacgcgctctgcgccgtcgcctccttcgaccgcgacgccgccaacgcgttccagctctacgtcgccgagtccctcgcgttcgccgtcaagcgggcgggcttcctctacggccgcgtcgacgccgagaccaaggaggtcttcgtagacttcatctacgagccgccgcagcagggcgccgaggacgtcgtccacctcatgagggatcccgacgagaaggcccgcgtcgacgcaatcgccgaggggctcgggatgcgccgcgtcggcctcgtgttcacgcaggccgtggggaggaaggccagcgagacaggcgagtacaccatgtccaacagggaggttgtgcaggccgcccagctgcaggctgagggtgggatcccggagtggatcacggcaatagtgaaattggaggtggggggtgacggtactggggacgtgcactttgaggccttccagatgagtgagatctgtgtaaagctcttcaaggatggggtactggaaactgaagttggggacaccgatgatccccgcttgtccaagatgcggaaggaggtggtggcagggggtaaggatactatggaggtggacaatgacttcttcctcgtccctgtcaagatctctgatcaccagggtctactctcagtaggctttcctatagagaaccgtggcagtcctgtaggaatgagtgcgctgagaagccacctggaccggacaaagcatctgaattttgtgaagtggatctccgacttccatttgctgctcaaggtcgctactttcttagatgtaaaggcagatgtgcctcccctagctgcatgtgtaaaaactcagagcagggtgcctgagggctaccagcttctgatcgagtccttggctagtcagggataatcttgctcatggaggcaagataggacgatgctcaatttacttgtcacatcatgtgtaacctatgaatgtctcaggtgtataagtatttttcaattcttatgcgattaccattctgat

SEQ ID NO: 20537 - protein, 417 aa, Panicum virgatum
  misc_feature: Ceres CLONE 1811934
  misc_feature (156)..(414): Pfam Name: NPL4 Pfam Description: NPL4 family
MILRIRSRDGTDRITVPDPASATVADLQRLIESHLTVPVPLQRLSLDPALLLPSPSAAVPLLANPAATLASLRLANGAFVYLAYPPDARSARPPPPKALSAAGSFGKKMTMDDLIARQIRVTRQENALCAVASFDRDAANAFQLYVAESLAFAVKRAGFLYGRVDAETKEVFVDFIYEPPQQGAEDVVHLMRDPDEKARVDAIAEGLGMRRVGLVFTQAVGRKASETGEYTMSNREVVQAAQLQAEGGIPEWITAIVKLEVGGDGTGDVHFEAFQMSEICVKLFKDGVLETEVGDTDDPRLSKMRKEVVAGGKDTMEVDNDFFLVPVKISDHQGLLSVGFPIENRGSPVGMSALRSHLDRTKHLNFVKWISDFHLLLKVATFLDVKADVPPLAACVKTQSRVPEGYQLLIESLASQG

SEQ ID NO: 20538 - DNA, 1888 bp, Panicum virgatum
  misc_feature: Ceres CLONE 1811961
  misc_feature: Encodes the peptide sequence at SEQ ID NO. 20539
aacaatcgctcccgcagaaaccctaaccctagatcccccaccatggatctcctccagtcctcgtacgcgccggacgacgcctcctcgccggaggagtcggcggccgcttcctcgccggaggagtcggcggccgcttcctcgccggactcctccccgctccgcctcccatccaaatccgccgcccccgccgtcgacgacaccgcgctcgcgctctccgccgccgcctccgcctcccgcccgctcgacccctcgctccatctcgtcgccttcaaccccaccgccgaccagctctgggcgcccatcgtcgggccccagcacccccacgcccccatctcctccgcctccggcaaccgcaaccacaagctcggccacgtcgaggacgccgcggtgctgcccttcctcttcgacgagcagtacaacaccttccacaggttcggctacgccgccgatccctccggcctccacatcgttggcgacgcgcagccgcaggcgcccgagcccgacaccgtctacaacctcgccccctccgagcacaagcgccgccgcctcctggccaaggcggacaaccaggacgagccgctgccccccgaggccaaaaaccccgcatccgaggagtggatcctccacaacaaacagagcccctgggcgggcaagaaggaagcgccgcccgctgagctcaccgaggagcagaagcagtatgccgaggcccacgcagccaagaaggccgagaaggaggctcgcggcgaagggaagggcgagagggcagaggtcgtggtcaagagcaccttccacgggaaggaggagagagactaccagggacggtcctggatcacgccgcccaaggatgccaagtccaccaacgaccactgctacattcccaagaggtgtgtgcatgagtgggttgggcacaccaagggggtttcagccatcagattcttccccaagtatgggcatctgctactatctgcgagtatggattgtaagattaagatctgggacgtgctcgggtcgcggacatgtatgcgcacatatatgggtcactcaaaggctgtaagggatatatccttctccaatgatgggaccaaattcttgagtgctgggtatgacaggaatatacagtactgggatactgagacagggcaggtgatctcgaccttctcaactgggaaggtcccatatgttgtgaagctgaatcctgatgaggataaacagcatattctccttgctggaatgagcgacaagaagattgtgcaatgggatatgaaatcagggcagatcacgcaagagtatgatcagcatttaggggctgtgaacaccataacttttgtcgataacaacaggaggtttgtgacgtcaagtgatgacaaatctcttcgtgtctgggagtttggcatccctgtggtgatcaagtatataagtgaggcgcacatgcactcaatgccatcaattgccctgcacccaaactccaactggctggcagcacagagcttggacaatcaaatactgatatacagcaccaaggagaggttccagctcaataagaagaagcaatttgctggccacattgtagcaggttatgcttgtcaggtgaacttctcacctgatgggagatttgtgatgtcaggtgatggtgaaggtagttgctggttctgggattggaaaagctgcaggaggtttaagacattgaagtgccacaatggggtttgcattggatgcgagtggcatccgttggaaactagcaaggttgcgacatacggatgggatggtgtaattaaatactgggattgagctgggacagggaccgcttgagatgctcgaagttcacaacagtgcaatcctcaagggctaatcttcatggtatactgtaagttgacatgtgggatggagc

SEQ ID NO: 20539 - protein, 581 aa, Panicum virgatum
  misc_feature: Ceres CLONE 1811961
  misc_feature (280)..(319): Pfam Name: WD40 Pfam Description: WD domain, G-beta repeat
  misc_feature (324)..(362): Pfam Name: WD40 Pfam Description: WD domain, G-beta repeat
  misc_feature (410)..(448): Pfam Name: WD40 Pfam Description: WD domain, G-beta repeat
  misc_feature (542)..(581): Pfam Name: WD40 Pfam Description: WD domain, G-beta repeat
  misc_feature: SWISSPROT Homolog: EC 2.7.11.7 [Myosin heavy-chain] kinase
MDLLQSSYAPDDASSPEESAAASSPEESAAASSPDSSPLRLPSKSAAPAVDDTALALSAAASASRPLDPSLHLVAFNPTADQLWAPIVGPQHPHAPISSASGNRNHKLGHVEDAAVLPFLFDEQYNTFHRFGYAADPSGLHIVGDAQPQAPEPDTVYNLAPSEHKRRRLLAKADNQDEPLPPEAKNPASEEWILHNKQSPWAGKKEAPPAELTEEQKQYAEAHAAKKAEKEARGEGKGERAEVVVKSTFHGKEERDYQGRSWITPPKDAKSTNDHCYIPKRCVHEWVGHTKGVSAIRFFPKYGHLLLSASMDCKIKIWDVLGSRTCMRTYMGHSKAVRDISFSNDGTKFLSAGYDRNIQYWDTETGQVISTFSTGKVPYVVKLNPDEDKQHILLAGMSDKKIVQWDMKSGQITQEYDQHLGAVNTITFVDNNRRFVTSSDDKSLRVWEFGIPVVIKYISEAHMHSMPSIALHPNSNWLAAQSLDNQILIYSTKERFQLNKKKQFAGHIVAGYACQVNFSPDGRFVMSGDGEGSCWFWDWKSCRRFKTLKCHNGVCIGCEWHPLETSKVATYGWDGVIKYWD

SEQ ID NO: 20540 - DNA, 1438 bp, Panicum virgatum
  misc_feature: Ceres CLONE 1811976
  misc_feature: Encodes the peptide sequence at SEQ ID NO. 20541
cccgccacctccaccacgcatctccgagcgccgcccccacccgccttatccctccgcgatcgccccccgccgccgccgccgccaccacacacgaaccaaaaagtatctcccgcgcacgcgccggcgcccgcgctctccctcctcgctgctccgtctcgccgcggcgacgcgcgcgcccgcctagagcggtagagagcccccaccccgcccgccgcgcgcgcgcgcgccatggcctccgacgcgcggctctccctgccgtgccgcctccccgcgcgtctgcccccgcccccgccgccggcgctccgccgctcgccccgcgcctcccccgcggcggtggcgtccacctccccgaggtgccgcgtctcgataacggcggtgccggcgcgcccccgcggccggtggcgggcccgcgccgccgggggcgaggtgcagggccaggtgcagcagcagcaacagcgggaggagaacgaggaggtggtggacagcaacgtgctcccctactgcagcatcgaccgcaaacagaagaagaccatcggggagatggagcaggagttcctccaggcgctgcaggcgttctacttcgacaagaaggccatcatgtccaacgaggagttcgataacctcaaggaggagctcatgtgggaaggcaacagcgttgttatgctaagcccggatgagcaaaggcttctggaagcctccatggcatatgtggctggcaaccccatcatgacggatgctgaattcgacgacctcaagttgagattgaagaaagaaggaagcgacattgtacaggaaggtccaaggtgcagcctacggagtcgaaaggtttacagtgacttgactgttgactacttcaagatgttcctgctgaatgttccagcggctgttgtagctctgacactattcttcttcttggatgatttgacgggatttgagatcacatatcttcttgagttgccagagcctttcagtttcatcttcacatggttcgctgcactgcctttaatattttggatagcacagtctatcactaatgttatcgtgaaagacttcctgattttgaagggcccatgtccaaattgtggaaatgagaacatttccttcttcgggactatattgtcagtgcctagtggtggtgcaaaaaacagtgtgaaatgcgcaaattgtggcactgagttggtgtacgattcggcatcccggttgattacactcccagaactggcagaggcataagtaaaggtggtttaggtttcactaggaggagagatggccgagcagatcctgtgatctacagcacaaaacaaggcctgacctacagtcgggtgacaaatcgtgcagtgatgtttgtttgtcatgctggtcgatgtgtatcataaacaaatgtagatatttgtactatacagtgttgatgaaatggagatacgtgcatagagtgtac

SEQ ID NO: 20541 - protein, 334 aa, Panicum virgatum
  misc_feature: Ceres CLONE 1811976
  misc_feature: Useful for making plants with modulated nitrogen use efficiency
MASDARLSLPCRLPARLPPPPPPALRRSPRASPAAVASTSPRCRVSITAVPARPRGRWRARAAGGEVQGQVQQQQQREENEEVVDSNVLPYCSIDRKQKKTIGEMEQEFLQALQAFYFDKKAIMSNEEFDNLKEELMWEGNSVVMLSPDEQRLLEASMAYVAGNPIMTDAEFDDLKLRLKKEGSDIVQEGPRCSLRSRKVYSDLTVDYFKMFLLNVPAAVVALTLFFFLDDLTGFEITYLLELPEPFSFIFTWFAALPLIFWIAQSITNVIVKDFLILKGPCPNCGNENISFFGTILSVPSGGAKNSVKCANCGTELVYDSASRLITLPELAEA

SEQ ID NO: 20542 - DNA, 1604 bp, Panicum virgatum
  misc_feature: Ceres CLONE 1811977
  misc_feature: Encodes the peptide sequence at SEQ ID NO. 20543
ctctccgccgtctctcacccaaaatcccccgcactcgaactcgaactcgaacgctctcgactcaggaggctcggcttggctccggcagcgtcggaggaggagaagcacggggatggcgatcgggctcccctcgcctgccttcctgacctgaaccttgatcccaccagcgcagcgcaaggggcgcggggatggggtacctgccggccctgggcgggaaggcggcgcacctggtgtccgacctcgccaccgtcatcctcaaccccgtctccgagcgggagcgccagcggcaccacccctcccacctcccggatgctgctgaaggaaaagacacactatttggtgatgaagattctgacaaaaattccgagactcctgatggtcctgacacatcttccttcagatcatttctgatgtcatttgtttcttccacaacctccagcaaggattcaatggagaccatacctgagcataatctagatgtggaatatccaactttaacacctgttggaaaggcaagcagtgggaggaaaggtttgctcagtagagggaagcattccattggaaggattattaacaaggcaggactcagtaatttcagacagaaacccgcctgcagctttgagggtgaattcacaggtcaaacagaatcagttgcacccaggtttgagatgaagggatcaaaggaatcggctttgcatgataagttgccagctatgtccgaaccatctgttcttttgtcagaaatgatgcgatctgttctttattcatctcttcctgttcttgttcaaggaaggaactggatattggtttacagtacctggagacatggaatatctttgtctactctgtatagaaggagcaggctttgtgctggctactcacttctgatagttggggatcgaagaggagcagtttttggtggtttggttgaggccccactgcagcctatcataaagaggaaatatcaggggactaatgaatgctttgtgttcaccaatgtagaaggccgtcctgttatatgccgtccaacaggtgctaataactattttacattttgctcaactgattatttggcaatgggaggtggtggtcacttcgcactttatctcgatggagaccttctgaatggttctagttccacctcagagacttttaacaatccatgcttatcccatacccaggaattcaaaatcaaagatgtcgagctatggggcttcgtcaatgcttcaaaatatgaagagatgctcactatctgccgcatggaaaaacaaggaatttggaatctgtgactgctgactgcggagctcactgagttgatggttggtgccaaccatcaacgtatgtagaacgtatgtagaacatgaaggggagagtttcatatggaatagaaatgtgaagagctttgccgctcatgtttgtaaatattaacagtagatgttagcgtagtactatatagtaaaaacatctgcattggaaaccatataggactggcaagcgctctgagtgtggtgtttcgcttccccagtgcgtgttgagcagcttattgcttgtgattgtaaccatctttgatctttctgagtaataaataaactctcttctcctcg

SEQ ID NO: 20543 - protein, 366 aa, Panicum virgatum
  misc_feature: Ceres CLONE 1811977
  misc_feature (206)..(344): Pfam Name: TLD Pfam Description: TLD
  misc_feature: Useful for making plants with altered protein content
MGYLPALGGKAAHLVSDLATVILNPVSERERQRHHPSHLPDAAEGKDTLFGDEDSDKNSETPDGPDTSSFRSFLMSFVSSTTSSKDSMETIPEHNLDVEYPTLTPVGKASSGRKGLLSRGKHSIGRIINKAGLSNFRQKPACSFEGEFTGQTESVAPRFEMKGSKESALHDKLPAMSEPSVLLSEMMRSVLYSSLPVLVQGRNWILVYSTWRHGISLSTLYRRSRLCAGYSLLIVGDRRGAVFGGLVEAPLQPIIKRKYQGTNECFVFTNVEGRPVICRPTGANNYFTFCSTDYLAMGGGGHFALYLDGDLLNGSSSTSETFNNPCLSHTQEFKIKDVELWGFVNASKYEEMLTICRMEKQGIWNL

SEQ ID NO: 20544 - DNA, 2779 bp, Panicum virgatum
  misc_feature: Ceres CLONE 1811985
  misc_feature: Encodes the peptide sequence at SEQ ID NO. 20545
acttgtagctgtactcctcgcttctcccccatggactgcgacagggactgcggctcggacgccggcgcggagtgggtttgggtgcgccggccggtggaggcggaagccgcagccgcggcggccgggtggccggcggatgaggaggcgcggcccctgaaggtagtgtttgcatcgccggcgacgtacttcaccgacgcggcaccgatcgggaatggccgcctcggcgccatggtgtggggcggcgtcgaatccgagaggctccagcttaaccatgacactctgtggacaggtggacctggtaattatacaaatcccaaagcacctgctgttctttctaatgtacggagccttgtttacaatggaaagtaccctgaagccacaagtgctgcatatgatctttctggtgaccaaacacaggtctaccaacctcttggggatattaatatgatctttggtaagcatatcaagcacacaaattacaaaagagagctagatcttcacactgcaacagttaatgtcacatatagtgttgacgaggtactctactcaagggaacatttcgcctcaaacccacatcaagtcatagtgactaaaatctctgcaaacaaaccaggaaatatctcttttacagtgtctttaactactccactagaccataagattcttgtgacagatgcaaatgaaataatcatggagggtagctgtccaggcgaaaggcctcaaaatgacaacagtgcgtctgatcatcccattggaattaaattttgtgccattctttacctgcaaacgaatggggccaatagcaaagtggaagtaataaaggataagatgctgaaacttgatggtgccgactctgttgttttgattcttgcagctggtacttcatttgaagggccatttatcaaaccttcagaatctaaactggatccaaaagtatctgctttcacgacattaagcgtggctaggagcatgtcatattcacagctaaaagcataccatatggatgattaccagagtcttttccatcgtgtttccttgcaactttcacaaggctctaattatcagcttgcggacaatagaataggtcagtcagcacaggctggctctcaggatgctactgtgtcaaattatgcttttccaatagctgactgcaccagatcggcagtccttaatgattctgtgaagcctacggtagacagaattataacttttaaggacaacgaagacccttctctggtagaacttctgtttcaatttggtcgctatctactcatttcatgctcaaggcctggaacccagatttccaacctgcaagggatatggagcaatgacccttcaccaccatgggatgcagctccccatccaaatataaatctgcaaatgaattactggccagcacttccatgtaaccttagcgaatgccaagaaccactgtttgactttattggctccctatcagtcaatggggctaagacagcaaaagtgaattatgaagctagcggctgggtcagtcaccaagtcacagacctgtgggcaaaaacatcaccggatgctggtgatcctgtatgggctctatggccaatgggtgggccatggcttgccactcacctttgggagcactatggttttacattggacaaacaatttttagagaaaacagcatatccactactggaaggatcatcttcctttttgttggattggttaattcaaggacacagggaatatttggagaccaatccttctacttctccagaacattattttattgctccagatggtaagaaggcctgtgtgagctactcaacaactatggacatgtcaattatacgggaagttttctcagctgttatattgtctgctgatattttagggaaatcggacactaatgtggttcagagaataaaaaaagcactgccaaatctcccaccagtgaaagttgctagagatggtacaatcatggagtgggcacaagactttcaggatcctgaggttcatcacagacatgtctctcacttgtttggtctttaccctggacatactatgtcacttgagcaaacacctgacctctgcaaagctgttgccaatagtctttataaaagaggtgatgaaggcccaggttggtctacttcatggaagatggctctatgggcccatcttcacaacagtgaccatgcatacaaaatgatactgcagctaatcactttggtagatccaaaacatgaggtttcaagggaaggaggcctgtacagcaatctgttcactgcacatccacctttccaaattgatgcaaatttcgggtttcctgctgcactgtcggaaatgctggtacagagcactgggactgacttgtacctgctccctgctctaccccgcaacaagtggcctcatggctgtgttaaaggcctgaaggcccgaggtggtgtgactgtaaacatcagctggaaggaagggagcctccatgaagctctgctgtggtctagtagtagcctgaattcccttgcgaagctgcactatggagaccagactgccaccatcagcatctcttcgggtcaagtctacaggttcagcagggaattgaagtgcttgaagacttggccactgtgatggcgcatatctgcttcgctcggaaggtagaatcagctatggagaaaattcaagaaaccttccgggaagccagcaaataatcgatttcgataaatcgtcgcacatatcaaatactagtggagactcatgggccatgttttagaaaacttaataaataaaaatttatatttat

SEQ ID NO: 20545 - protein, 858 aa, Panicum virgatum
  misc_feature: Ceres CLONE 1811985
  misc_feature: SWISSPROT Homolog: EC 3.2.1.51 Alpha-L-fucosidase
MDCDRDCGSDAGAEWVWVRRPVEAEAAAAAAGWPADEEARPLKVVFASPATYFTDAAPIGNGRLGAMVWGGVESERLQLNHDTLWTGGPGNYTNPKAPAVLSNVRSLVYNGKYPEATSAAYDLSGDQTQVYQPLGDINMIFGKHIKHTNYKRELDLHTATVNVTYSVDEVLYSREHFASNPHQVIVTKISANKPGNISFTVSLTTPLDHKILVTDANEIIMEGSCPGERPQNDNSASDHPIGIKFCAILYLQTNGANSKVEVIKDKMLKLDGADSVVLILAAGTSFEGPFIKPSESKLDPKVSAFTTLSVARSMSYSQLKAYHMDDYQSLFHRVSLQLSQGSNYQLADNRIGQSAQAGSQDATVSNYAFPIADCTRSAVLNDSVKPTVDRIITFKDNEDPSLVELLFQFGRYLLISCSRPGTQISNLQGIWSNDPSPPWDAAPHPNINLQMNYWPALPCNLSECQEPLFDFIGSLSVNGAKTAKVNYEASGWVSHQVTDLWAKTSPDAGDPVWALWPMGGPWLATHLWEHYGFTLDKQFLEKTAYPLLEGSSSFLLDWLIQGHREYLETNPSTSPEHYFIAPDGKKACVSYSTTMDMSIIREVFSAVILSADILGKSDTNVVQRIKKALPNLPPVKVARDGTIMEWAQDFQDPEVHHRHVSHLFGLYPGHTMSLEQTPDLCKAVANSLYKRGDEGPGWSTSWKMALWAHLHNSDHAYKMILQLITLVDPKHEVSREGGLYSNLFTAHPPFQIDANFGFPAALSEMLVQSTGTDLYLLPALPRNKWPHGCVKGLKARGGVTVNISWKEGSLHEALLWSSSSLNSLAKLHYGDQTATISISSGQVYRFSRELKCLKTWPL

SEQ ID NO: 20546 - DNA, 2110 bp, Panicum virgatum
  misc_feature: Ceres CLONE 1811993
  misc_feature: Encodes the peptide sequence at SEQ ID NO. 20547
ccacctgctccgctccttcgctcgtgctccgctgctcttgcctggattcgggcggcccctcctccctgcgaccggccggcggcggtctcctcctcgcagcagaggccggtcgcccctgtccctgccgcatccgccaggcagctccctggctgcagctcccgcctgtctgcagcaggcaccaggcagcggcctccagaaagcgccgcagctcctgcctgctcccgccctgcagcgcccaccaggaagccccgcctccctcaccagcaggttgatgagattgttgtgagttgtaaggtcaaatccattctcagtagtcagcaccgatgtctccttcggctcttctacctgctctctccgtcctcctcctgtgctgctcgcctccggctcttgctttcgtttctgagcctgcgctttcgcgagctgcttgtggagatgaccaatttgtcgtcttggatgcctctgatgggctcgtcaacctgtcggtcaatggggttctggtgcaagacagcgttcttgcctgccagaagctccgcttctactttcggagtggttgcctccgctgtggcgaggtgtcagatgcgtggagggttgcggttaagcagtactgtggtgaagggagcgaatctagccacgcaacttcacatcaaaatgtcccaaggaagctgttgaggcagtccacagataatagctcgagaaaggattatgacccatgtggaggtttgagcttgcatgaaaataatcaggacaccagtgattcttcagaaaatgatgatcacctccttgctttccccggtgtgattcttctatgctgtggtctcatgtttccatgcttccatgctgaaagaaaagaagccagtaggaatgatgctgcaagtattcagcgcaatacaattgaatcagtttcgtcttatgaagtaagcatgtcatctgagaaagtgccaccaactccgcatcgaatacctccaagtccttcgagatttgcaccatctccacaagtagctagagttggatctgtcaacttaagcatccagcagatcctcagggcaactcagaatttctcaccttcctttaagttaggtgaaggaggatttgggatggtctacagggctgtcttgccaaatggcactgttgttgcagtcaagagggctaaaaaggatcaatttgctggtcctagggatgagtttagcaatgaagtagacttgcttgccaagatagaccaccgaaatttggtgaggttactgggctttactgacaaaggaaatgagcgtattatcatcactgagtatgttccaaatggcactctaagagaacatctcgatggtcagcatggcagagtcctggattttaatcagcgcctagaaattgcaatcgatgttgctcatgcacttacttatctccatctgtatgcggagaagacgataattcaccgcgatgtgaaatcatcaaatatcttactgacggatagctaccgggcaaaagtgtctgactttggatttgcaaggagtggccctagtgacacggagaagacgcacatatcaacaaaagtgaaaggcacagctgggtacctggatcctgaatacctgagaacataccagctaactccaaagagtgatgtcttctcctttggcatattgcttgtggaaattctttctgctcgccgacccgtagagctgaagcgaactcctgaagagaggataactatcagatggactttcaagaaatttaatgaaggaaacatgagagagatattggatccattgctggaggaccacgttgatgatgaggtgcttgagaagctccttagcttggcgttccaatgtgctgctccaacacgggatgaccgcccgaccatgaaggaagttggggagcagctgtgggaaataaggaaagagtacgcaaagagcatcaggaaggtgtgacgatcatggataatttctgatgtgtaaccacacaataaactgcaaatggtttacctaagttaaatacatgaagggttcgggtagttactggcagaaagtaaatgaatatgtggcgagcattatttataaaagatttgttcgtatacatattagtctaatgcattttaaacaattatgtgcctaggcatcag

SEQ ID NO: 20547 - protein, 531 aa, Panicum virgatum
  misc_feature: Ceres CLONE 1811993
  misc_feature (245)..(517): Pfam Name: Pkinase_Tyr Pfam Description: Protein tyrosine kinase
  misc_feature: SWISSPROT Homolog: EC 2.7.11.1 Non-specific serine/threonine protein kinase
MSPSALLPALSVLLLCCSPPALAFVSEPALSRAACGDDQFVVLDASDGLVNLSVNGVLVQDSVLACQKLRFYFRSGCLRCGEVSDAWRVAVKQYCGEGSESSHATSHQNVPRKLLRQSTDNSSRKDYDPCGGLSLHENNQDTSDSSENDDHLLAFPGVILLCCGLMFPCFHAERKEASRNDAASIQRNTIESVSSYEVSMSSEKVPPTPHRIPPSPSRFAPSPQVARVGSVNLSIQQILRATQNFSPSFKLGEGGFGMVYRAVLPNGTVVAVKRAKKDQFAGPRDEFSNEVDLLAKIDHRNLVRLLGFTDKGNERIIITEYVPNGTLREHLDGQHGRVLDFNQRLEIAIDVAHALTYLHLYAEKTIIHRDVKSSNILLTDSYRAKVSDFGFARSGPSDTEKTHISTKVKGTAGYLDPEYLRTYQLTPKSDVFSFGILLVEILSARRPVELKRTPEERITIRWTFKKFNEGNMREILDPLLEDHVDDEVLEKLLSLAFQCAAPTRDDRPTMKEVGEQLWEIRKEYAKSIRKV

SEQ ID NO: 20548 - DNA, 715 bp, Panicum virgatum
  misc_feature: Ceres CLONE 1812001
  misc_feature: Encodes the peptide sequence at SEQ ID NO. 20549
ccgctcttcccttttgactcctcccacctgcaaaaccgcagggccgcatcccccccgcgccgcccaccggcggcagccagccaccgcccccggcgtctacaaaaacaagcataccaccgctcgccggacccaatcaaccccaatcaatggcgtcgtccctcctctccaccccgtcccgaaccctagcgcccgccccggcccccgcggggctccgcgggagggcgccggcccaggtgcacctcccgcgcgggtgccccgccccccgccggagccgcgtgctccgcgtgcgcgcgtcggtggcgatcgagaaggagacgcccgagagcgagccgcccccgacgttcctgcgcgaggacggccgcggcgcggggtccgggtccgtgcgggagcggttcgaggccatgatccggagggtgcagggggaggtctgcgccgcgctggaggaggccgacggcagcggcgcgcggttcgtcgaggacgtgtggtcgcgtcccggcggcgggggcggcatcagccgggtgctcgaggacggccgcgtcttcaagaaggccggggtcaatgtgtccgtcgtgtacggggtcatgccgccggatgcgtaccgcgcggccaagggggaggccgggaagaatggcgccgcggaggcgcagaaggctggccccgtgcccttcttcgccgcggggattagctcggtgctccatcccaagaatccatttgc

SEQ ID NO: 20549 - protein, 189 aa, Panicum virgatum
  misc_feature: Ceres CLONE 1812001
  misc_feature (76)..(189): Pfam Name: Coprogen_oxidas Pfam Description: Coproporphyrinogen III oxidase
  misc_feature: SWISSPROT Homolog: EC 1.3.3.3 Coproporphyrinogen oxidase
MASSLLSTPSRTLAPAPAPAGLRGRAPAQVHLPRGCPAPRRSRVLRVRASVAIEKETPESEPPPTFLREDGRGAGSGSVRERFEAMIRRVQGEVCAALEEADGSGARFVEDVWSRPGGGGGISRVLEDGRVFKKAGVNVSVVYGVMPPDAYRAAKGEAGKNGAAEAQKAGPVPFFAAGISSVLHPKNPF

SEQ ID NO: 20550 - DNA, 719 bp, Panicum virgatum
  misc_feature: Ceres CLONE 1812022
  misc_feature: Encodes the peptide sequence at SEQ ID NO. 20551
gaaaaacaggggaagagtccatttgaaataggagagttttacttcaatgagctcataaacagaagtatgatccaaccgatacaacataaatatggcatgctaaatagttgccgcatacatgatatggtgctcgatcttatccgttccttgtcaagtgaggaaaactttgttactgtactgagtgatatggatagcaaatctccatcaaatacgattcggaggttgtcccttcaaaatggcaagaaaagtgacataatagctcaagctacaagaaacttgttgcaacgtgcaaggtcagttgttatcttcccagcagccattgctcaagtgccggctgctggcagctgccgatttttacgtgttctggatttggagcattgcaacctttcacatactgatagccttaagtaccttggaaatttataccagttgaggtacttaagactatattctacgcatatttctcagctcccggaagaaataggaaacctgcagtttctacaaacattggatgtgaggagcaatcctatttccatcttgccttcaagtgttgtccagctaagaaatttgatatgcctagacattgacaagactacaagagtgccaaatggaattggaaacctaacatgccttgagcagttgtcatggttatgcattgatgggtccaccataaacattatagaggagttgggccagctaacggagactacaagagtgcc

SEQ ID NO: 20551 - protein, 239 aa, Panicum virgatum
  misc_feature: Ceres CLONE 1812022
  misc_feature: SWISSPROT Homolog: EC 3.1.3.16 Phosphoprotein phosphatase
EKQGKSPFEIGEFYFNELINRSMIQPIQHKYGMLNSCRIHDMVLDLIRSLSSEENFVTVLSDMDSKSPSNTIRRLSLQNGKKSDIIAQATRNLLQRARSVVIFPAAIAQVPAAGSCRFLRVLDLEHCNLSHTDSLKYLGNLYQLRYLRLYSTHISQLPEEIGNLQFLQTLDVRSNPISILPSSVVQLRNLICLDIDKTTRVPNGIGNLTCLEQLSWLCIDGSTINIIEELGQLTETTRV

SEQ ID NO: 20552 - DNA, 1669 bp, Panicum virgatum
  misc_feature: Ceres CLONE 1812023
  misc_feature: Encodes the peptide sequence at SEQ ID NO. 20553
tcttcgagcttgcgcgcgcgcgccccgcagcagccatgaagtcgtcgtctcagaaccagagcccgaagaccccgtcgccccgcggcggcacggccggagccggggcggagcacgcgcgctcggcctcggagccgtggctggcggccgcggcggcggcgagcgccagcgacgactcgtgcgtcaacgacgtggacaacttcgcgcgcaccgtggcggccgtcaagtccaagtcggcgtcctgcgcgcgcccggacatgctggcctccgtgctgtcgcactacgccgccaagtggctcccggacgtggcgccctcggcgtcgtccccggcgtcctcggcgtcggggcggttcctgccgccggagtcccccacggcgacgtggctcaagaagcggctcctgctggagtccctcgtcgcggcgctcccgcccgacccgccggcgccggggtgcagcggggccgccggcgacgacggcatcacgtgcgacttcctgctcaagctgctccgcgcggggagcatggtgggcgcggacgcggcgctgctgcgggacctggaggcccgcgccgcgcggcggctggaccaggccacgctgggcgcggtcatgatcccggcgttcgggcacgccggcgggcacgcggcgctgctgctggacgtgcccctcgtgctgcggctcgtgcgcgagttcctcaaggagggcgccgcggccgcctcctccgccagcaaggccagctccgccgcggccgtcgggggcggcggcgcggcggccgccagggtggccaggctggcggacgcgtacctggccgaggccgcgctcgaggccggcctgcgccccgccgagttcggggagctcgcccgcgccgtccccgcccacgcccgccccgcggacgacgcgctctaccgcgccgtcgacacctacctcaaggcgcatccaaacacgtccaaggaggagcggaagtcgctgtgccggctgatcgacgcgcgcaagctcacggcggaggccgcggcgcacgccgtccagaacgagcgcatgccggtgcgctccgtgatgcaggtgctcttctccgagcacggcaagctcaaccgcctcgccgagctgagcgcctccttcagcggcccgcggagccccaacccggcgctggagctccccggccgctgcccctccaagcgcgaggtcctcgcgcagcaccaggaggtgcgccgcctccgcgaggacgtcgccaggctccaggtgcagtgcaacgcgctgcaggcccaggtggacaggctgacctcggacaggaggcggcgcggcggcggcggcggcttcttcaagtggagcgcgttctggttcggtggcggcatgggcgcggacgtcgcgagggtcgacgactcggagagcggcatggaacgccggacgccagccaaggggaagaaggacagcgccgcttcggcgacgccgaacgccaagtggcgcaagtcaacttcatgacgtggagttggaaccgggctggggaagggatgggttgttaatttttgtttcttttttatttttattttttctttttgtttggttacagtaatttctgggtttgaaagctctgttgtgattctgtcatcgagtttctgttcatgatgaaattatctcactggactgtatgaaaaggtatgacggccccagcattgattaagcag

SEQ ID NO: 20553 - protein, 476 aa, Panicum virgatum
  misc_feature: Ceres CLONE 1812023
  misc_feature (45)..(322): Pfam Name: NPH3 Pfam Description: NPH3 family
MKSSSQNQSPKTPSPRGGTAGAGAEHARSASEPWLAAAAAASASDDSCVNDVDNFARTVAAVKSKSASCARPDMLASVLSHYAAKWLPDVAPSASSPASSASGRFLPPESPTATWLKKRLLLESLVAALPPDPPAPGCSGAAGDDGITCDFLLKLLRAGSMVGADAALLRDLEARAARRLDQATLGAVMIPAFGHAGGHAALLLDVPLVLRLVREFLKEGAAAASSASKASSAAAVGGGGAAAARVARLADAYLAEAALEAGLRPAEFGELARAVPAHARPADDALYRAVDTYLKAHPNTSKEERKSLCRLIDARKLTAEAAAHAVQNERMPVRSVMQVLFSEHGKLNRLAELSASFSGPRSPNPALELPGRCPSKREVLAQHQEVRRLREDVARLQVQCNALQAQVDRLTSDRRRRGGGGGFFKWSAFWFGGGMGADVARVDDSESGMERRTPAKGKKDSAASATPNAKWRKSTS

SEQ ID NO: 20554 - DNA, 729 bp, Panicum virgatum
  misc_feature: Ceres CLONE 1812024
  misc_feature: Encodes the peptide sequence at SEQ ID NO. 20555
acatccatatgcttagctcccagcccggcacccatgggcgcctgcttctcctccgcctccgctgcccccgccggcgccgccgagcgccgcccctccaaggaggacaagaaggggcgccgcggcggcgcgtctcccgaaggcgcggcaaaggcggcggcggcggcccccgtgcgggtagagttcggctacgagagggacttcgaggcgcgcttcgaggtcggccgcctgctcggccacggccagttcggctacaccttcgccgccaccgaccgccagtccggggaccgcgtcgccgtcaagcgcatcgacaaggccaagatgacccgtcctgttgctgtggaggatgtgaaaagagaagtgaagattcttaaagcacttaaaggacatgagaatattgttcacttctataatgcatttgaggatgattcatacgtgtatattgtaatggaactatgtgagggtggtgaactattggaccggattttggcaaaaaaaaatagccgttacagtgagaaagatgctgctgtagtagtgcgccaaatgcttaaagtaactgctgagtgtcatctgcgtgggctagttcaccgagatatgaagcctgagaacttccttttcaaatcaaataaggaggactcgccgctaaaggcaacagattttggtttgtcagacttcataaaaccagggaggaaagtccacgatattgttggcagtgcctattatgttgcaccg

SEQ ID NO: 20555 - protein, 231 aa, Panicum virgatum
  misc_feature: Ceres CLONE 1812024
  misc_feature (60)..(231): Pfam Name: Pkinase Pfam Description: Protein kinase domain
  misc_feature: SWISSPROT Homolog: EC 2.7.11.1 Non-specific serine/threonine protein kinase
MGACFSSASAAPAGAAERRPSKEDKKGRRGGASPEGAAKAAAAAPVRVEFGYERDFEARFEVGRLLGHGQFGYTFAATDRQSGDRVAVKRIDKAKMTRPVAVEDVKREVKILKALKGHENIVHFYNAFEDDSYVYIVMELCEGGELLDRILAKKNSRYSEKDAAVVVRQMLKVTAECHLRGLVHRDMKPENFLFKSNKEDSPLKATDFGLSDFIKPGRKVHDIVGSAYYVA

SEQ ID NO: 20556 - DNA, 1977 bp, Panicum virgatum
  misc_feature: Ceres CLONE 1812037
  misc_feature: Encodes the peptide sequence at SEQ ID NO. 20557
tttttttttgcccctccaataattttcgcatcaccaatcgtctcctcgcctcccgcacgcctgcggcccgcccgtgcgcccctgccctcctcccacagcgtctcctcgttggctcccctctccgcgatccgctcagatctcgctgggatccgccgtatctggcctggatttcgccttcggaacccacggctctgtccgggcagggagccgggaagggtcgttctgtcccgggcggcggcggatccgtgtctctattggaggcggttcggcggagtcgcgccgcgtcacgttcgtggtcctgattgtggcgccgtcggcgaggtgggattcgctggggatttgtggtctacggagctgggacacggcatggactacggtggggctgtggacagcagcgaaatttggcattggtttacaggaaccgatgatgatcttccaccgtcatatcagaacagcagaggtatgaaaggcagtggacgtataactggtaatggaagagatactattggtgctggtccatatactagaggtcaacaacctcagacagatatggaaacacaaatacatcaccttgagcaagaagcatattgttcagttcttcgagcattcaaggctcagtctgatgctataacatgggaaaaggaaagtctcattactgagcttaggaaggagctacgagtatctgataaagaacacagggagttgctaaacggagttaatagtgatgatattatccgaagaataagggaatggagagagtcaacaggtgtgcttcagatgaattcagttaataatgctcagcgtttgcatgaccccatgcccagtcctaccacctctgctcgcaagaggcaaaagacatctcaacccattccctctgcatctgtacctgcgccatctgctatgcactcacagcctttagctgcaacaatgcaaccatcatcttcaggagcaaaaaaggcagccccacctggctcaaaagtgaaaaagaacaaaccaggccagaagatacctggtggccctgcagtcaaatctatgccatcttctgctggtccttttgggcgggaaccagttattaatagaaatacttctgctggccttcctcctgaaggaccacaattaaatccgttaatcggccgtaaagtcatgactcggtggcctgatgataatagcttttatgaagctgtaataacagattatgatgcagaaaaggatctttatgcacttgtttatgacatgaatacagcacatgagacatgggagtgggttgattttaaggagatggcagctgaggatgtaagatgggaaggtgaggagcctgatttaaaccttcctggtcgtggtgctgccgttcatggtgttaagaagtcaaccaatcgtggtggccctatgttaggtgccggaagaggaagggccccccaaaagaactcacttaagaaagattatccaccttcacaaaacggtgttgggaagaagagttctgactacatagaaattcttcatacagagacactcataaaggaggtggagcgggttttcagtgctggcaaccctgacccccttgagatggagaggtcgaagaaagtgctaaaggagcatgaacaatcattaatcgatgcaattgcaaggcttgctgaggcgtctgatggtgagggtgatgaccatgcgcgatctttggactacaaccgtgggtggaggaaccaacatggaggacgatatgctgatgacatggctatcgatggcctcatgtctggagatgcagatgccatgtgaaccattgccaaatgtacacaattccctaattggttttttttagccagttgtgaaatccggatgctgatttattctagatttctgattggttctaacgaatgcatcagttgctaggattgttgtgcttttgtagtagatctgtactcagttcatgcttgacactgtaaatttagatttggagctaattttgttctgtagtcttttgat

SEQ ID NO: 20557 - protein, 467 aa, Panicum virgatum
  misc_feature: Ceres CLONE 1812037
  misc_feature (62)..(135): Pfam Name: ENT Pfam Description: ENT domain
MDYGGAVDSSEIWHWFTGTDDDLPPSYQNSRGMKGSGRITGNGRDTIGAGPYTRGQQPQTDMETQIHHLEQEAYCSVLRAFKAQSDAITWEKESLITELRKELRVSDKEHRELLNGVNSDDIIRRIREWRESTGVLQMNSVNNAQRLHDPMPSPTTSARKRQKTSQPIPSASVPAPSAMHSQPLAATMQPSSSGAKKAAPPGSKVKKNKPGQKIPGGPAVKSMPSSAGPFGREPVINRNTSAGLPPEGPQLNPLIGRKVMTRWPDDNSFYEAVITDYDAEKDLYALVYDMNTAHETWEWVDFKEMAAEDVRWEGEEPDLNLPGRGAAVHGVKKSTNRGGPMLGAGRGRAPQKNSLKKDYPPSQNGVGKKSSDYIEILHTETLIKEVERVFSAGNPDPLEMERSKKVLKEHEQSLIDAIARLAEASDGEGDDHARSLDYNRGWRNQHGGRYADDMAIDGLMSGDADAM

SEQ ID NO: 20558 - DNA, 501 bp, Panicum virgatum
  misc_feature: Ceres CLONE 1812043
  misc_feature: Encodes the peptide sequence at SEQ ID NO. 20559
atcatcacctgcaacgagcaatcaatccccagattttcaccgacggaacacaggcaaggccgtgactagcagcccatcgaccggcgaccagcagctagcaatggcggcggcagcggcggaggggacggcgaagaagagcggcggcgagatgacggtggtgcgcgggctggacgtggcgcggtacatggggcgctggtacgagatcgcgtcggtcccgtccttcttccagccccgggacggccggaacacgcgcgccacgtacgcgctgcaggaggacggcgcgacggtggacgtgctcaacgagacgtggagcaagggcaagcgctcaagattctcgtgggatgcgagctcttaccccttttagttactctgctatagaaattgtcgggtctgagtctattgttcagtgctgccaggtttttgaatatctgtttatcttgaatagttgaactgctgggcggtgaaacatgtgctgtgtctaatgtacaccagttttctgtg

SEQ ID NO: 20559 - protein, 87 aa, Panicum virgatum
  misc_feature: Ceres CLONE 1812043
  misc_feature (23)..(86): Pfam Name: Lipocalin_2 Pfam Description: Lipocalin-like domain
MAAAAAEGTAKKSGGEMTVVRGLDVARYMGRWYEIASVPSFFQPRDGRNTRATYALQEDGATVDVLNETWSKGKRSRFSWDASSYPF

SEQ ID NO: 20560 - DNA, 1663 bp, Panicum virgatum
  misc_feature: Ceres CLONE 1812054
  misc_feature: Encodes the peptide sequence at SEQ ID NO. 20561
atacgcatacgcatccgcttcactccgtcgcctgcctcccagcgctcatccatccacgaccgcccctgtcataaaagcctccgaatccggagcctcgtgtgccccgtcctcgtcgtcgccggcggagccgcctccgcccaccgcagctcgctgacctcccgccggggaaggagagccgcagcgagcttctccaccgccgccttccgcctgaccccaccctccgagattgggaccggcggcagcggcggccggccacggcgatcccgctcgtgctagtcgtgctccccctcggcctgctcttcctcctctccggcctcatcgtcaacaccatccaggccattctatttgtgacaataaggcccttctcaaagagcttctatcggcggatcaacagattcctggccgagctgctgtggcttcagctggtttgggttgtggactggtgggcaggcttcaaggtacaacttcatgctgatgaggaaacttaccgatcaatgggtaaagagcatgcactcatcatatcaaatcatcggagtgatatcgattggcttattggatggatattggcacagcgctcaggatgccttggaagtacgcttgctgtgatgaaaaagtcatcaaagttccttccagttattggctggtccatgtggtttgcagaatacctctttttggagaggagctgggcaaaggatgaaaagacactaaagtggggcctccaaaggctgaaagacttccccagaccattttggctagcccttttcgttgagggtactcgctttactccagcaaagcttctcgcagctcaggagtatgcagcttcacagggcttaccagctccgcgaaatgtacttattccacgcaccaagggatttgtatctgctgtgagtattatgcgggattttgttccagccatttatgatacaactgtaatagttccaaaagactcacctcaaccaacaatgctgcggattttgaaagggcaaccatcagtgatacatgttcgcatgaaacgccatgcaatgagtgagatgccaaagtcagatgaggatgtttcaaagtggtgcaaagatatatttgtagcaaaggatgccttactggataagcatttggcaacaggcacatttgatgaggagattagaccaattggtcgtccggtgaaatcattgctggtgaccctgttttgggcatgcctcctcctattcggcgccatccagttcttcaagtggacgcagctcctatcgacatggagaggcgtagcattcaccgctgccgggatggccctcgtgacgggagtcatgcatgtgtttatcatgttctcccaggcggagcgttcgagctccgcaagggcagcacgcaaccgtgtgaagaaagagtgatagtatgacggtattccgtgtctgctaaaaggcaatccaccaaacggttgcagattcaattcatagacgccaaatttgtgggtctctgggctagacattgttgtactcaacaggaagcgcatagcgctattcttgtattttgtatgcaggaagggagttgttttctttgatttttttccccttttcagcggaactgtaggttatggattcgttggtacttttacccctgccgtgttatgtggaagtcttcagtgatttatggattagctaagctttccatctct

SEQ ID NO: 20561 - protein, 294 aa, Panicum virgatum
  misc_feature: Ceres CLONE 1812054
  misc_feature (2)..(143): Pfam Name: Acyltransferase Pfam Description: Acyltransferase
  misc_feature: SWISSPROT Homolog: EC 2.3.1.51 1-acylglycerol-3-phosphate O-acyltransferase
MGKEHALIISNHRSDIDWLIGWILAQRSGCLGSTLAVMKKSSKFLPVIGWSMWFAEYLFLERSWAKDEKTLKWGLQRLKDFPRPFWLALFVEGTRFTPAKLLAAQEYAASQGLPAPRNVLIPRTKGFVSAVSIMRDFVPAIYDTTVIVPKDSPQPTMLRILKGQPSVIHVRMKRHAMSEMPKSDEDVSKWCKDIFVAKDALLDKHLATGTFDEEIRPIGRPVKSLLVTLFWACLLLFGAIQFFKWTQLLSTWRGVAFTAAGMALVTGVMHVFIMFSQAERSSSARAARNRVKKE

SEQ ID NO: 20562 - DNA, 660 bp, Panicum virgatum
  misc_feature: Ceres CLONE 1812079
  misc_feature: Encodes the peptide sequence at SEQ ID NO. 20563
ttataatttccactgctgtgatgactgttggcattgcacttgtcagttggttagggctcccatatacattcacaatcttcaattttggtgcacagaagacggtgtataactggtactgccatttcttaaatggatttcccatattttgatctgaatctttttaacacatgatctcactttgaaatcaatttggtaggcaattattcctctgtgtggctgttggtttgtgggctggactagttattggatttgttacagagtattacacgagcaatgcgtacagcccagtgcaggatgttgctgactcctgcagaactggagctgctacaaatgtcatctttggccttgctctgggatacaaatcagtcattatccctatttttgctattgctttcagtattttcctcagcttcagccttgctgcaatgtacggtgttgctgtggctgctcttggaatgctcagcacaattgctactggcctcgccattgatgcatatggtcctattagtgataatgctggaggaattgctgaaatggctggcatgagccacagaatccgtgagagaacagatgctctcgatgctgctggaaacactactgctgccattgggaagggttttgccattggttcagcagccttggtatctcttgccctctttg

SEQ ID NO: 20563 - protein, 78 aa, Panicum virgatum
  misc_feature: Ceres CLONE 1812079
  misc_feature: SWISSPROT Homolog: EC 3.6.1.1 Inorganic diphosphatase
  misc_feature: Useful for making plants with modulated water use efficiency
MYGVAVAALGMLSTIATGLAIDAYGPISDNAGGIAEMAGMSHRIRERTDALDAAGNTTAAIGKGFAIGSAALVSLALF

SEQ ID NO: 20564 - DNA, 1610 bp, Panicum virgatum
  misc_feature: Ceres CLONE 1812080
  misc_feature: Encodes the peptide sequence at SEQ ID NO. 20565
atcatcatcgtcgttccgggctgcgagcgagttccatggcctccaccacctgcctctccctttccttgttcgcctcctcggcggctccctctgatgccggaccccgccgctcatccttcgcctccacctcctcctcctcctcgtcttcctcctcctccaagagaaacgaaaagctcccggccagggctctccgggaggattggcggcagaaatccaagcccatccctcctgccgccgtctaccctgccaaggaccactgcagccgctgtggcctctgcgacacatactatgttgcgcatgtcaagaccgcctgcgccttcctgggcgacggcatgtcccgtgtcgaggatcttgagccactagtccatgggagaggcaggaaggaaagcatggatgaaatgtactttggagtacatgatcaactcttgtatgctaggaagactcaaccaattcaaggagctcagtggacaggaattgtgacaacaatcgctgttgagatgctgaaagcaaatatggtcgatgctgtggtttgtgtacaaagtgatcctgacgacaggcttgctccaaggcatattttggccaggacaccagacgaagttattgcagccaaaggtgtgaagccaacattatcgccaaatctcaatacgcttgccttagtagaggcagctggtgtaaagcgtcttcttttctgtggtgtcggttgtcaagtgcaagccttgagatctgtagaaaagtaccttggtttggaaaagctttatgtgcttggcacaaactgtgttgacaatggtacacgtgaaggactcgataaattcttgaaggcggcaagcagtgaaccagaaactgttcttcattatgaatttatgcaggactacaaggttcacttaaagcatttagatggacatattgaagaggttccctatttttgcctgccagcaaacgacctggttgatgttattgcaccatcatgctacagctgctttgactacacaaatggcttggcggatttagtggtggggtatatgggcgtaccaaaatatgctggggtttccatgacgcagcatcctcagtacattacagtcaggaacgatcgtgggagggagatgctgagcctggtggagggccttctggagagcacgccgacagtgagcagcggcgcgaggcaaccatttgttatggagacagtgaaagccgacgatgcggcaaaattagggaaaggagcttcgagaccagctcctaggtttgtgggcaacattctggccttcttgctgaacctggttggccccaagggcctggagttcgcacgctactctctggactaccacacgatccgaaattacctgcatgtgaggcgggcatggggagaacagagggctgagcagcacgtcccgggatacgccaagaagatcgtggaggcctacgaccgggatggacggatccagtcaatgctcaactccagcagtcaatcaagggcctgaatgaatgactagacctgcattgtatttggatgatcatgattgcaagattattagttattattgcagggacatatatgattactgtaacgtaacgtgatatagtactatatatatgatagtagaatacatacacac

SEQ ID NO: 20565 - protein, 479 aa, Panicum virgatum
  misc_feature: Ceres CLONE 1812080
  misc_feature (210)..(385): Pfam Name: FrhB_FdhB_C Pfam Description: Coenzyme F420 hydrogenase/dehydrogenase, beta subunit C terminus
  misc_feature (128)..(207): Pfam Name: FrhB_FdhB_N Pfam Description: Coenzyme F420 hydrogenase/dehydrogenase, beta subunit N terminus
  misc_feature: SWISSPROT Homolog: EC 1.12.98.1 Coenzyme F420 hydrogenase
MASTTCLSLSLFASSAAPSDAGPRRSSFASTSSSSSSSSSSKRNEKLPARALREDWRQKSKPIPPAAVYPAKDHCSRCGLCDTYYVAHVKTACAFLGDGMSRVEDLEPLVHGRGRKESMDEMYFGVHDQLLYARKTQPIQGAQWTGIVTTIAVEMLKANMVDAVVCVQSDPDDRLAPRHILARTPDEVIAAKGVKPTLSPNLNTLALVEAAGVKRLLFCGVGCQVQALRSVEKYLGLEKLYVLGTNCVDNGTREGLDKFLKAASSEPETVLHYEFMQDYKVHLKHLDGHIEEVPYFCLPANDLVDVIAPSCYSCFDYTNGLADLVVGYMGVPKYAGVSMTQHPQYITVRNDRGREMLSLVEGLLESTPTVSSGARQPFVMETVKADDAAKLGKGASRPAPRFVGNILAFLLNLVGPKGLEFARYSLDYHTIRNYLHVRRAWGEQRAEQHVPGYAKKIVEAYDRDGRIQSMLNSSSQSRA

SEQ ID NO: 20566 - DNA, 578 bp, Panicum virgatum
  misc_feature: Ceres CLONE 1812090
  misc_feature: Encodes the peptide sequence at SEQ ID NO. 20567
aataaaatattatataaaaataaaataaaagctcgacgtcgtcacctctctcgccgtcgaggaatcacggcgggcggcggcgtcggcggcggcggccgggggtcctggccgctcaccaccatgcccgaccccaccacaaaacccccctcgccgcgcccccgccgccgccgcaggctctgcggcctctgcctcggcaccgcgctcctcgccctcctcgtctccgcgctcgtccacgccgtcgccccgccgcggcgccgggcccccccccccgcgcgcttctccgtcatcatagacggaggcagcacgggcacccgggcactcgtcttcgtcacgggggcccacggccgcccggatctggcgcgctccgccgtgatgcacgtctccccgggcctctcgtccttcgcagccgaccctgcgcgggctggggagtcgcttctgccgctcatacaactcccgagggataaggttggcagcgcggggggcgccactgcgcaggcggacgtgcggctgatgcccaccgctgggctgcgtctgctcgaatacgccgcccgggaggcgatcctgccgtcctgcatgga

SEQ ID NO: 20567 - protein, 152 aa, Panicum virgatum
  misc_feature: Ceres CLONE 1812090
  misc_feature: SWISSPROT Homolog: EC 3.6.1.6 Nucleoside-diphosphatase
MPDPTTKPPSPRPRRRRRLCGLCLGTALLALLVSALVHAVAPPRRRAPPPARFSVIIDGGSTGTRALVFVTGAHGRPDLARSAVMHVSPGLSSFAADPARAGESLLPLIQLPRDKVGSAGGATAQADVRLMPTAGLRLLEYAAREAILPSCM

SEQ ID NO: 20568 - DNA, 607 bp, Panicum virgatum
  misc_feature: Ceres CLONE 1812091
  misc_feature: Encodes the peptide sequence at SEQ ID NO. 20569
gtcatccgaagccgcgccgagacgaccgaagaaggaagcatccggaggcgcacggacctgcctctccttcctcccatggcgccgcccctcggcgccgtatcctcctcgtcgcccctcttctcgccctcctcattccgccccctcatccgccgccatgcgcctccgagctatgtctccttgcggacgcgtggccgttcgcagcccgaggcggcggcggcggccgcggccgagtccgccggcaggccgcttctcgaggtgcgaggtctcaccggataccgtgaaggagaccgggcatcagatcctcgccggcgtcgacctcaccatccgcgagggagagattcatgctatcatggggaagaacggctccggaaagagcaccctcacaaagggtcttgttggacatccacattatgaggtaactggtggcaccattctcttcaagggtgaggacttggttgacatggagccagaggaaagatctctcgcaagcctttttatgagtttccaagcacctattgagattactggagtgagcaattttgattttctgctcatggcagtcaatgctcgcagagaaaagagtgatctaccagcattgggaccccat

SEQ ID NO: 20569 - protein, 150 aa, Panicum virgatum
  misc_feature: Ceres CLONE 1812091
  misc_feature: SWISSPROT Homolog: EC 3.6.3.20 Glycerol-3-phosphate-transporting ATPase
MRLRAMSPCGRVAVRSPRRRRRPRPSPPAGRFSRCEVSPDTVKETGHQILAGVDLTIREGEIHAIMGKNGSGKSTLTKGLVGHPHYEVTGGTILFKGEDLVDMEPEERSLASLFMSFQAPIEITGVSNFDFLLMAVNARREKSDLPALGP

SEQ ID NO: 20570 - DNA, 483 bp, Panicum virgatum
  misc_feature: Ceres CLONE 1812105-R
  misc_feature: Encodes the peptide sequence at SEQ ID NO. 20571
acttgcagacattgatctgttcccagagaatggagctggtggcggcatcagggaagccagtgtgttgaggtacaaggagaagaggcgcactcggctgttctcgaagaaaatccggtaccaagtgcggaaggtgaacgccgactgccggcctcggatgaagggaaggtttgttaggagcccatctcttcttcagcaagccctggaggaagagagctagacagtgatacttgctagccttttttatcagcatctttttgtcccttttagtttatcattagctaagagatgtgagtgaggattttccccagggctttttttcggagttttgctctggagaggataggatgcctttagagtggattgtcatggtatggcggtgaaatagtttgtctcaggtttacaatgtgaggtaaaggaaggaaataaagtgatgttagaatatagagtcatatagcaagcagcacaaatgatgggtttaggttt

SEQ ID NO: 20571 - protein, 71 aa, Panicum virgatum
  misc_feature: Ceres CLONE 1812105-R
  misc_feature (17)..(61): Pfam Name: CCT Pfam Description: CCT motif
  misc_feature: The sequence is a functional homolog of SEQ ID NO 172 in the 10/225,068 US patent application
  misc_feature: The sequence is a functional homolog of SEQ ID NO 250 in the 10/374,780 US patent application
  misc_feature: The sequence is a functional homolog of SEQ ID NO 274 in the 10/225,066 US patent application
  misc_feature: The sequence is a functional homolog of SEQ ID NO 530 in the 11/435,388 US patent application
  misc_feature: The sequence is a functional homolog of SEQ ID NO 794 in the 10/412,699 US patent application
  misc_feature: The sequence is a functional homolog of SEQ ID NO 1932 in the 11/479,226 US patent application
  misc_feature: The sequence is a functional homolog of SEQ ID NO 936 in the 10/412,699 US patent application
  misc_feature: Useful for making plants with altered alkaloid content
  misc_feature: Useful for making plants with altered lignin content
LADIDLFPENGAGGGIREASVLRYKEKRRTRLFSKKIRYQVRKVNADCRPRMKGRFVRSPSLLQQALEEES

SEQ ID NO: 20572 - DNA, 1371 bp, Panicum virgatum
  misc_feature: Ceres CLONE 1812105
agcttctctgctcagctaagggaattcccctgctcctgctcttgtgttcttgctgggcctctgctctgcttcttccccacttcttgccacagaggagtccagccgttgcaaagacagaatcttttcacttcatcctcccaaagtgttgttggtgtcccaggtggaggcaaagtgtgtggatttttttattagcttttgctcttgattaggtttagacatttcttgctcctgtgttcttggattgatgtttgtggaattaatccaagaatagctggagctgttaatttcaccttccctgaagacgagggcgaagtgatcgtattgagcagctgtagtagttgttgctgaggcgttgcaatgtcgtcttcctgcataccaaccggcctgcggctggacctggacatggtgaaggcggcgacgtcgcctgtagcgcactcgtcgccgctgcgcccggtgcactcgtcgccgtcgtcgacgctgtcggaggcgtcgaacgcgtcgtcgtcggcgacgtcggtgtcgctgaagcgggcgcgcgcgccgcggaagcagccgaaccaggcgtacaacgaggccgccgcgctgctcgcctccatccacccctccgtcttccccgtcaagaagaaccccaagacggcgacgcgcccgccggcgcggcagctctccggccttgccgcggcgttcgacccatcctccgaccttctcccgccgctccccgtcctcgcggactccgcattcctgctccgggacatgcccgcgccgtcgccgcagccgcaaagcccgtctggccccaagaactgctcgtcgccggccccggtgagcagcgtgttccgggacttccgcgacccggcgccgtcaccggcgagccccgacaccgtcgacgtcgacgagctcggcgaaatcgacttcgatgacgacggcttcgacgccgagtcaattctcgacgtcgacgaggccaccgccggcgcggccgagggcctcgacggcatcatgggcagcctcaccgtggagagcaacacgtccaccacgtccgatgactccatcctgtcaagctccggcatacacccctacctcaggagcctcatggtggtcggcctcgtcggcaggttcgagctcggcctcgggttccggcacggcgctcggcccaacctcaaccgcgcactgaagcggcgggacgacgacggcgcctggtggatgtggccggccgtgccggtgaaggacttaacggtggcaccaccgacaccgccagcagcggcagcgtcggacactgcaatggcagcgcaagtgcaggcggcgccagagaagaaaaaaagcaagaagaagaaggtggtgaagatggagaaggttatggccaaggggaagaaggagctg

SEQ ID NO: 20573 - DNA, 2379 bp, Panicum virgatum
  misc_feature: Ceres CLONE 1812115
  misc_feature: Encodes the peptide sequence at SEQ ID NO. 20574
aaaccgcgcgcgcgctagaagccattgtgttgccatgcccctgtcaattgccatgccttcttccctccgccaccatggccgccgccccggcctgctcgtgcttctcctgctcgcctcctccttggccccttcccgcggcaacgacgacgcctacgccgcctccgcgtgccggtggcggccgtacccctgcggcggcgtgaacatcagctacccgttctacctcgccggcgacaccggggcggtcccgggccgggacggcgagtcctactgcgggtacccgggtctcgccgtcacctgcgacggcgtcggcagcggcagccgggccgtcctgaagctcggcggcgacagctacgccgtctcggggatcgactacgcgaacctgaccgtctcgctcgcctacgccgactccgcggccagcgacggtggctgcccgagcgtggaccacaacgtgaccatcccgccggacgtccggctgttcctccccatctccgccgtagactacctcttcttcttcgccaactgctccttcgggcaccccgacgccgaggccgaccccgcgcctcccaagcccaaacctcccaagccgccgaccatcaagcccatcacctgcggcggcgccgacaaagcgcccggcggcggcctgtcgttcgtgctcccgagcggcgctgtgcctcccggcgactggtccagcgcgtgcgcgcggatcttcgaggtgcccgtgctcaggggcgccgcgccgcgcgacgcgcaggaccccaagtggaggagcgacgggtacggcaaggcgctcagcgcggggttcctgctgggctgggaccggagctccggggagtgcggccggtgcgagcagtccgacggcaagtgcgggttcagccgcgccggcgagttcctgggctgcctctgcgccaatggccgcgtgggcgacggcggctgcagtaagacacttgctgactcttcctcactaggaaggtcaaataagaaacacggagtgattattggcgtctcgactgctgctggtcttggcgtgcttgttactgctgccgccggaattttgttcatcatgcgcaagaggaagaagaaggacgtggtcaactcgtcctcgaagctcctcaagtacagcggctctggcgggaccccgcgttcccgggtcggcgacatggagtccggcggcatcgaggacccgccgacgcacctcttcacctacgaggagctcgaggaggccaccaattccttcgatgagcaccgggagctcggtgatggcggcttcggcaccgtctacaaagggtacctcaaggacgggcgcgtggtggcggtgaagcggctgtacaacaacagctaccggcgcgtggagcagttccagaacgaggcgggcatcctgtccgggctgcgccaccccaacctggtcatgttctacggctgcacgccctgcgcgagccgcgagctcctcctggtgtacgagttcgtggccaacggcacggtcgccgaccacctgcacgggcaccgcgccccggagcgcgcgctctcgtggccgctccgcctcagcgtcgccgtcgaggccgccgcggcgctcaactacctccacgccatcgagccccccgtcgtgcaccgcgacgtcaagaccaccaacatcctcctcgacgccgacttccacgtcaaggtcgccgacttcggcctctcccgcctcttccccctcgacgtcacgcacgtctccaccgcgccccagggcacgccagggtacgtggatccagagtaccaccagtgctaccagctgacggacaagagcgacgtgtacagcttcggggtggtgctggtggagctcgtctcgtccaagcccgccgtggacatcacccggcaccgcaacgagatcaacctggccggcatggccatcagcaagatccagaactgccacctcgagcagctggtagacctcgacctgggctacgaggccgacccggcgacgaagaagatgatgaccatggtcgccgagctggccttccgctgcctgcagcagaacggcgagatgcgcccgccgatgaaggaggtgctcgaggtgctcaggagcatccagggcgagtgccgggcggcggagaaggacggggacaagcccaaggacggggccttctcccccaccacggttcacgctccgtgggacagccgggccacgacgcccaacaccagcagggattagattagtgctcgagatttatctgtgtttgttgccgctgctgcatagagatgcgcttgatgtgtggcatgccagattacctgtccctttggctttcagggctcgtagttcctggtgttgtagatatttgttttgttggcaccgtcagaacagagggaatgtacatatataaaagagtggtgaatggcacttac

SEQ ID NO: 20574 - protein, 711 aa, Panicum virgatum
  misc_feature: Ceres CLONE 1812115
  misc_feature (394)..(668): Pfam Name: Pkinase Pfam Description: Protein kinase domain
  misc_feature: SWISSPROT Homolog: EC 2.7.11.1 Non-specific serine/threonine protein kinase
MPSSLRHHGRRPGLLVLLLLASSLAPSRGNDDAYAASACRWRPYPCGGVNISYPFYLAGDTGAVPGRDGESYCGYPGLAVTCDGVGSGSRAVLKLGGDSYAVSGIDYANLTVSLAYADSAASDGGCPSVDHNVTIPPDVRLFLPISAVDYLFFFANCSFGHPDAEADPAPPKPKPPKPPTIKPITCGGADKAPGGGLSFVLPSGAVPPGDWSSACARIFEVPVLRGAAPRDAQDPKWRSDGYGKALSAGFLLGWDRSSGECGRCEQSDGKCGFSRAGEFLGCLCANGRVGDGGCSKTLADSSSLGRSNKKHGVIIGVSTAAGLGVLVTAAAGILFIMRKRKKKDVVNSSSKLLKYSGSGGTPRSRVGDMESGGIEDPPTHLFTYEELEEATNSFDEHRELGDGGFGTVYKGYLKDGRVVAVKRLYNNSYRRVEQFQNEAGILSGLRHPNLVMFYGCTPCASRELLLVYEFVANGTVADHLHGHRAPERALSWPLRLSVAVEAAAALNYLHAIEPPVVHRDVKTTNILLDADFHVKVADFGLSRLFPLDVTHVSTAPQGTPGYVDPEYHQCYQLTDKSDVYSFGVVLVELVSSKPAVDITRHRNEINLAGMAISKIQNCHLEQLVDLDLGYEADPATKKMMTMVAELAFRCLQQNGEMRPPMKEVLEVLRSIQGECRAAEKDGDKPKDGAFSPTTVHAPWDSRATTPNTSRD

SEQ ID NO: 20575 - DNA, 672 bp, Panicum virgatum
  misc_feature: Ceres CLONE 1812135
  misc_feature: Encodes the peptide sequence at SEQ ID NO. 20576
aatattttccatcgcggccgccacagccagagccgccgcgcccgagcgttttgcttccgggagcggcgaggcgggacggttagttcacgtggggggagcgggagcccccctcgctctctcattcgacgcggcgtgacctgaggagcggcgggggaacgagatggcggccgagggggaggcggcggcgctggagttcacgccgacgtggatcgtggcggcggtctgctcgatcatcgtgctgctctcgctcgtcgccgagcgctgcctccactacctcggcaagaagctcaagaagaagaaccggaagccgctctacgaggcgctgctcaaggtcaaggaagagctgatgcttctggggttcatctccctgctgctgacggtgttccaggggatgatccagaggacatgcatccctgccggatggacggacaacatgctgccatgccagaggctggaagtgaaggctggcgccaccaaggagcatttcgttgctgccgggatccttggcaggatcgggaggcggctgctcagtgaaggcgacgctggggccgacaactgcctgaagaagggaaaagttccacttctgtcccttgaagccatacatcagctgcacattttcatatttgttctggcgattacacatgttattttcagcgttgcaactatgctttt

SEQ ID NO: 20576 - protein, 170 aa, Panicum virgatum
  misc_feature: Ceres CLONE 1812135
  misc_feature (5)..(169): Pfam Name: Mlo Pfam Description: Mlo family
  misc_feature: Useful for making plants with modulated biotic stress sensitivity
MAAEGEAAALEFTPTWIVAAVCSIIVLLSLVAERCLHYLGKKLKKKNRKPLYEALLKVKEELMLLGFISLLLTVFQGMIQRTCIPAGWTDNMLPCQRLEVKAGATKEHFVAAGILGRIGRRLLSEGDAGADNCLKKGKVPLLSLEAIHQLHIFIFVLAITHVIFSVATML

SEQ ID NO: 20577 - DNA, 1714 bp, Panicum virgatum
  misc_feature: Ceres CLONE 1812140
  misc_feature: Encodes the peptide sequence at SEQ ID NO. 20578
agagccggggaaggctacagcggcgccaggcgggccagcagcagagcgcagcgcaccgcgggatagcaggaggaccgccgctcggaaagtgcggagccgtttcgtctcccccctctagctacctcttccagggcttgcctccgcccgtccactcgcccacgcctcgcgctccagggggaggtgagtctcgatcgctactgctgctggtggtggtagcgcgcgctagccccgataagagagggacgaacgaagccccgcgtgcttgatcgatcgccctctcgcgccatgtcgtccgccgcgggcgggtacggcggcgggacgggggagcggcgccgagccccactgccacggccacggccacggccacggcgacttcctgctgcaccaccatgcacagcacgtggccgccgcgcagcagctctaccacgtgccgcagcacagccgccgcgagaagctgcggtacccgcaggacgacggctcgcccccgcacgcccccgctcccgccccgcaccagcactggccgccgcccccgcccccgccggggttctactcctacgcgtcctcctccacgtcctcctactccccgcacagccccaaggggctgccgcacgtcgcggcgcacggccacggccccgccccgccgctcgcggcgcagatcccgacgcagaacttcgcgctctcgctctcctcgtcctccaacccgccgccgccggtcccgcagcagcagcagcagcccaggaggccgcacccgcacggcgcccccgcggggcccttcgggcccttcaccggctacgcggcggtcctcggccgctcccggttcctcgcccccgcggagaagctgctcgaggagatctgcgacgtggggcgcgcggccccgcacgtggaccggaccgcctccgacgaggccctgctcgacgcggatccgatggagggcatcgatcacgacatggacggcgccgcctccgacgccgggcccatctccggcgccgagcagcagtggaagaagaccaggctcatctccatgatggaagaggtctgcaagaggtaccgcctgtactaccagcaggtccagactgtcatcaactcgtccgagacggtcgccgggttcagcaatgctgccccgttcgccgcgatggcgctgagggccatggcgaagcacttcaagtgcctcaagggcatgatactgagccagctgcggaacacgtccaaggctgctgccgggaaagaggggctcagcaaggacatcgccatgttcgggctcgccagtggcagcgctgccgtcctccagagagcgggcagtgtggcggcgttcggccagccgcacaacatctggcggccgcagcgagggctcccagagcgtgctgtctctgtgctccgctcttggctgtttgagcacttcctgcatccatatcctactgatggtgacaagcaaatgctagctaaacagacaggcttaacgcggaaccaggtatcgaattggttcatcaatgcaagagtccggctatggaaaccgatggtggaagaaatccacaaccttgagatgaggcaggtccaaaagcatccagcccttgacaacagccagctctccatgcatcaccagacccagcattcgtctgagagcagcaggaagccctcagatccttctgactccatccagcaggggcaggtcaccttcgcatacaacgggctgtcgacaccgcagcatcagcacagc

SEQ ID NO: 20578 - protein, 262 aa, Panicum virgatum
  misc_feature: Ceres CLONE 1812140
  misc_feature (1)..(88): Pfam Name: POX Pfam Description: Associated with HOX
  misc_feature: Useful for making plants with modulated light quality response
  misc_feature: Useful for making plants with modulated light quality sensitivity
MEGIDHDMDGAASDAGPISGAEQQWKKTRLISMMEEVCKRYRLYYQQVQTVINSSETVAGFSNAAPFAAMALRAMAKHFKCLKGMILSQLRNTSKAAAGKEGLSKDIAMFGLASGSAAVLQRAGSVAAFGQPHNIWRPQRGLPERAVSVLRSWLFEHFLHPYPTDGDKQMLAKQTGLTRNQVSNWFINARVRLWKPMVEEIHNLEMRQVQKHPALDNSQLSMHHQTQHSSESSRKPSDPSDSIQQGQVTFAYNGLSTPQHQH

SEQ ID NO: 20579 - DNA, 149 bp, Panicum virgatum
  misc_feature: Ceres CLONE 1812140-R
tttggcttgatcactttgaatcgatttctttggagggtggagaaaaaaaacccgttgctgacttgtcagcccttcttgtagatccaggtgtgttgccaaatatttgacttgctgggctaatagagagcatgagaatacattcactagtc

SEQ ID NO: 20580 - DNA, 1656 bp, Panicum virgatum
  misc_feature: Ceres CLONE 1812149
  misc_feature: Encodes the peptide sequence at SEQ ID NO. 20581
gcgggggtggaagcgggttaatccagcaccggaatgacgtgatctccccccgttcgattccatccagtgccctcatcactgcaggctgcaagcagacggcggccttgaaaaatccgaccaccatcctcgctccgcatcactcattcctccgcccgacactcccaagccccactccactgccaccgaccggtagcggcgccacaatgcggccgcctaccctcctcccgctcgccgccgccgccctcctcgtcctcgccgccgccccgacgcccgccgcctcccgccaccaccgccccgcgcaggcggcggacaccgagacgctcgacgtcgccgcctccctctcccgcgcccgcgccgcgctctccaccgatgccgcctcgctgcaccagtccgccgccgccgggaagccgaagcgccggtccccgcggccgcgggagggcgcctcctcgctcacgctgcggctccacgcgcgggacttcctgcccggggagcagggccggcacgagagctaccggtccctggtgctgtcccgcctccgccgcgacgagtcccgcgccgcggcggtggcggcgcgcgcggcgctggcggcggacggggtgacgcgcatggacctgcgccccgccaacgcgtcgacggtgttcgcggcctccgcggcggcgatccagggccccgtggtgtccggcgtggggcagggcagcggcgagtacttctcccgcgtcgggatcggcagccccgcgcggcagctgtacatggtgctggacaccggcagcgacgtcacctgggtgcagtgccagccctgcgccgactactaccagcagacggaccccgtcttcgacccctccctctccgcctcctacgccgccgtctcctgcgactccccgcgctgccgggacctcgacaccgccgcctgccgcaacgccacgggcgcctgcctctacgaggtggcctacggcgacggctcctacaccgtcggcgacttcgccaccgagacgctcacgctgggggactcgcagcccgtcggcaacgtcgccatcgggtgcggccacgacaacgaggggctcttcgtcggcgccgcggggctgctcgcgctcggcgggggcccgctctccttcccgtcccagatctccgccaccactttctcctactgcctcgtggaccgcgactcccccgccgcgtccacgctccagttcggggacggcgccgccgaggccggcaccgtgacggccccgctcctccgcagcccgcgcacgagcaccttctactacgtcgccatgaccggcatctccgtgggcaggcagccgctgtccatcccgccctccgccttcgccatggacgccgcctcggggtcgggcggcgtcatcgtcgactcgggcaccgccgttacgcggctccaggccgcggcctacgcggcgctccgcgacgccttcgcccggggcacgccgtcgctgccgcgcgcgcccggggtgtcgctgttcgacacgtgctacgacctgtcgggccggacgagcgtggaggtgcccgcggtggcgctgcggttcgagggcggcggcgcgctgcggctgccggcgaagaactacctgatccccgtggacggcgccgggacctactgcctggcgttcgcgcccacgaacgccgccgtgtccatcatcggggacg

SEQ ID NO: 20581 - protein, 484 aa, Panicum virgatum
  misc_feature: Ceres CLONE 1812149
  misc_feature (167)..(484): Pfam Name: Asp Pfam Description: Eukaryotic aspartyl protease
  misc_feature: SWISSPROT Homolog: EC 3.4.23.12 Nepenthesin
  misc_feature: Useful for making plants with modulated biomass
MRPPTLLPLAAAALLVLAAAPTPAASRHHRPAQAADTETLDVAASLSRARAALSTDAASLHQSAAAGKPKRRSPRPREGASSLTLRLHARDFLPGEQGRHESYRSLVLSRLRRDESRAAAVAARAALAADGVTRMDLRPANASTVFAASAAAIQGPVVSGVGQGSGEYFSRVGIGSPARQLYMVLDTGSDVTWVQCQPCADYYQQTDPVFDPSLSASYAAVSCDSPRCRDLDTAACRNATGACLYEVAYGDGSYTVGDFATETLTLGDSQPVGNVAIGCGHDNEGLFVGAAGLLALGGGPLSFPSQISATTFSYCLVDRDSPAASTLQFGDGAAEAGTVTAPLLRSPRTSTFYYVAMTGISVGRQPLSIPPSAFAMDAASGSGGVIVDSGTAVTRLQAAAYAALRDAFARGTPSLPRAPGVSLFDTCYDLSGRTSVEVPAVALRFEGGGALRLPAKNYLIPVDGAGTYCLAFAPTNAAVSIIGD

SEQ ID NO: 20582 - DNA, 507 bp, Panicum virgatum
  misc_feature: Ceres CLONE 1812149-R
  misc_feature: Encodes the peptide sequence at SEQ ID NO. 20583
tccatcatcgggaacgtgcagcagcagggcacccgcgtcagcttcgacaccgccaagggcgccgtcggcttcacgcccaacaagtgctagcctggcagagtggcagggcagggcgagcgccctccctggcagagagtagtattagtggagtgattagtagcggaggtaattaatgtaatgttatttggcgggccggttgtggggccgggaggtgacgaggaggacccaccaggggtctctgcactgccgctgccggtctggggagacgcgaaaggccaaggcgaggacagcctgggcggtggggtcccgtgtttttctcggtctttgagtatggatggggtgcgtgcttgcgtgtcgtcgggcttcctttggggttgggtgggcatgggtgtgcatggatgtgcgtgcggggagccgtggcatgaccaactgcctcttgccatggggtgctccggtttatttaaaatttcatctcatgtccagaaaatggaagtttccatccctcgg

SEQ ID NO: 20583 - protein, 29 aa, Panicum virgatum
  misc_feature: Ceres CLONE 1812149-R
  misc_feature: Useful for making plants with modulated biomass
SIIGNVQQQGTRVSFDTAKGAVGFTPNKC

SEQ ID NO: 20584 - DNA, 1787 bp, Panicum virgatum
  misc_feature: Ceres CLONE 1812164
  misc_feature: Encodes the peptide sequence at SEQ ID NO. 20585
accgacaagatgttagcaggccggtcgtgccatcggctttggtggagtcgtacggggcaagcgatcaggcacctggcaatccctttcagggccaacccattacaccagcagcgacacctacaccgcagcatcgcttgccgtagctcacagaaccctcaagggtctgatggcaacccctccgaaggagataagtcggcaagcagcagcagccctgagggaggccaacaagaagcacagcggcagtactataactttctgaacctgaaagtagccaaggatgacttggtgaccattggactggcttttgccatctcatttgggataagatggttcatcgcagagccacgcttcattccatctctttccatgtacccaacatttgatgttggggacaggctcatcgcggagaagctgacatacaggttctcaagggaccccattgctggggatgttgtcatcttccaccctccttttgagcgaaagacattcctggatgacgatgtgttcatcaagcgagtcgttgctgtggaaggtgacacgattgaggtccatgacggcatcctgtttgtcaatgggcagccacgcagcgagccgttcatcaatgagcggcctgcctatgtgctcagcagcctcacagtcccacccggcgatgtctttgtgatgggcgacaaccgtaacaacagctatgacggccatgtctgagggccactgccaaaggagaacatcctgggcagggcttgcttcaagtactggccgctgcagaagtttggccccctggaggactacacagctctggcagctccggctgtggccagctgacagcgcggctggtggtgcagcagggctgactcctcattctcaagcctgctgctggtggttgctgggtgtctcttgactgtcaggtcgaggtcgaggttttggcccaggcatggggactcacaagggggaggctcgcaggcaggggttgcagcttttgcgccatgcgttgtttaattatttcagtgattattacagcatggtttgaggagcggcctaggcaatgagcacatgattttgaagttccctcatgctgacatggttctgtaattactctgcatgtacctcctaggtttcagatttgcttggcaaagatcagacagttttgagaaggcatatgccacaatgccccccttaacacatgcaggcggtgttttttgctgggctgaatgtggcagtggctttggctgccacagtgccacacatagtactgttctgccatacctgtaaacgtattcatctgtccttgcacttctgtgttgatatcaaagctcacacgactgttgactgtgaaattttccatgcagagcattttgaaccagcagttctgcaacttgttcatgctgattatgatggcgctgtcaagctgcttgttggacctgctcaagcagcttttgtttccaaggttatcagctcctgtatgaacgttgttggtgctcaagttcttggtgctggtttcgaaagcaccttgatgctgagcaatccagccaggcttaacgccgtaaaccatgacacggtcatgctatctatcacaggtttcagattcatggctgtcactttttgtccttgagttggggaggtttggcgtggtatttataatgctggagtgccactgactgtggctgtaacaggtgaaggggctaattgtccatggcattgatgtccctatttgtgtccctatgtccctatttgtgtctttgtgtgtaggtgagctctatcattgtacattcaatgttgtgagtgtgcctgtc

SEQ ID NO: 20585 - protein, 233 aa, Panicum virgatum
  misc_feature: Ceres CLONE 1812164
  misc_feature (117)..(193): Pfam Name: Peptidase_S24 Pfam Description: Peptidase S24-like
  misc_feature: SWISSPROT Homolog: EC 3.4.21.89 Signal peptidase I
TDKMLAGRSCHRLWWSRTGQAIRHLAIPFRANPLHQQRHLHRSIACRSSQNPQGSDGNPSEGDKSASSSSPEGGQQEAQRQYYNFLNLKVAKDDLVTIGLAFAISFGIRWFIAEPRFIPSLSMYPTFDVGDRLIAEKLTYRFSRDPIAGDVVIFHPPFERKTFLDDDVFIKRVVAVEGDTIEVHDGILFVNGQPRSEPFINERPAYVLSSLTVPPGDVFVMGDNRNNSYDGHV

SEQ ID NO: 20586 - DNA, 1441 bp, Panicum virgatum
  misc_feature: Ceres CLONE 1812177
  misc_feature: Encodes the peptide sequence at SEQ ID NO. 20587
accaaccagtccgagtccagcaaaccactccgactgactcaccacccagcctccgacgcctcccgcgccccaatccggaagagaaggcgcggccgccggcgccggcgccggcgccggcgccgatcggaccccatgctccgcgcggctctctcccgctcagcctccgggctccgccggtccccggcgatggccgcgtccgtcccgctctccaccgccgccgccccgtggctctccaacggccccgcctcgtccccgccaagggtgcgcctcctcatcggcggcgagttcgtcgagtcgcgcgccgacgagtacgtcgacgtcaccaaccccgcgacgcaggaggtggtgtcgcggatcccgctcacgaccgccgacgagttcagggccgccgtggacgccgcccggactgccttccccgggtggcggggcacgcccgtcaccacgcgccagcgcgtcatgttcaagttccaggagctcatccgggcaaacatggacaagcttgcggagaacattacgacggagcaggggaagacactgaaagatgcttggggtgatgtttttcggggtctagaggtggtggagcatgcttgtggaatggggactttgcaaatgggtgaatatgtatcaaatgtttctaatgggattgatactttcagcattagggagccacttggcgtgtgtgctgggatatgcccgtttaattttcctgctatgattcccctgtggatgtttcccatagcagtaacatgtggcaatacttttgtcctgaagccatcagaaaaggacccaggggctgctatgatgcttgcagagctagcaatggaggctggtttacctaagggtgttttgaacattgtccatggtacccacgatgttgtcaacaatatttgtgatgatgaggatattaaggctgtatcctttgttggttccaatacagctggtatgcatatatattctagagcatctgcaacaggcaagcgtgttcagtgcaacatgggagcaaagaatcatgcaattatacttcctgatgctgacagagatgccacactgaatgcccttatagctgctgggtttggtgcagcagggcagaggtgcatggcattgagcactgctgtttttgttggaggttcagaatcatgggaggatgaacttgtgaaacgtgcaagtggcctcgttgttaattcaggaatggttaatgatgcagaccttggtccagtgatcagcagacaggcgaaggaccgtatctgcaaattagtccaaaatggtgttgacagtggtgcacgtcttttgcttgacgggagggatattgtggttccgcagtttgaggatggcaattttgttggtccgacccttctggctgatgttaaaaatgacatggagtgttacaaggaggaaatttttggtccagttcttctattgatgaaggcaaagagcctaaatg

SEQ ID NO: 20587 - protein, 436 aa, Panicum virgatum
  misc_feature: Ceres CLONE 1812177
  misc_feature (52)..(436): Pfam Name: Aldedh Pfam Description: Aldehyde dehydrogenase family
  misc_feature: SWISSPROT Homolog: EC 1.2.1.27 Methylmalonate-semialdehyde dehydrogenase (acylating)
MLRAALSRSASGLRRSPAMAASVPLSTAAAPWLSNGPASSPPRVRLLIGGEFVESRADEYVDVTNPATQEVVSRIPLTTADEFRAAVDAARTAFPGWRGTPVTTRQRVMFKFQELIRANMDKLAENITTEQGKTLKDAWGDVFRGLEVVEHACGMGTLQMGEYVSNVSNGIDTFSIREPLGVCAGICPFNFPAMIPLWMFPIAVTCGNTFVLKPSEKDPGAAMMLAELAMEAGLPKGVLNIVHGTHDVVNNICDDEDIKAVSFVGSNTAGMHIYSRASATGKRVQCNMGAKNHAIILPDADRDATLNALIAAGFGAAGQRCMALSTAVFVGGSESWEDELVKRASGLVVNSGMVNDADLGPVISRQAKDRICKLVQNGVDSGARLLLDGRDIVVPQFEDGNFVGPTLLADVKNDMECYKEEIFGPVLLLMKAKSLN

SEQ ID NO: 20588 - DNA, 650 bp, Panicum virgatum
  misc_feature: Ceres CLONE 1812177-R
cgtcctgtgctattggggccgcaacttcactcatcctacgtgtttgagcaacttgatgaggtgctgctccgtggttgagccgcggccgcgccaggaggaggagaaggtggaggaggaggagcaggagctgcctgagcgcgaggacgaggagcgggagcacgctgagggcgagcggcaccctgatgatgacgatcaccaggacgagcacagcgaggctgcgggttatgatcaccagggcgagggtgaccaccacgaccacgagggtctctagagcaggagcacagccagccgccagccgcagcccgtgtgctgtttcagcagcgaacctgagcatgaaggcgttctgcactcggtccgtctcgtcgccttggctacggtgaatcggtgttggcttttttgggtgtcattagtttgttgttattagtcggatttgttattgtactttgacaaagtttgtcatgaaatgctgggctgccatcggtcccagtcctatcatggatcatgtctcttcaacttcagtcctttttgtatgtattacaatgtctgggaaatcgctagctctatctacgccgtgtttagttgcaaaaattttagggtgtaaaacactgtagtactttcgtttgtatttggtaattattgtcccgtcatac

SEQ ID NO: 20589 - DNA, 683 bp, Panicum virgatum
  misc_feature: Ceres CLONE 1812179
  misc_feature: Encodes the peptide sequence at SEQ ID NO. 20590
caggcccatcccacaccaggacaagcagctgctcgtcctcgactcctcgcactgtccgctggcatgggtcacgagcaagaccacggcggccgcggccgcggcgccggccacctcctcctcttcccgttcctggcgcaaggccacctcatcccgttcctcaccctggccaggcgcctcgagagccaagggcggcgtcgcggcagcagccagcgccgtctcgtggtcaccatcgtcagcacgccccgcaacgtcgccgacctccggcgcgcggtgccggccggatcgtccatcggcttcgccgagctgccgttctcgccgtcggaccatggcctgccgccagacgccgagagcaccgatgccgtcccgttccgttccctccccgccttctacttcaccacggagctgctccggccgtcgttcgaggagctcgtggcggagctcgcggggagagaagggcgccagaacgtgtgcgtcctcgcagacatcttcctgggctggacggccgagagcgcccgcgcgctcggcgtccagcatcgcgtgttcctcacctccagcgcctatgcctccgctctcaccttctccatctggctccgcccgccggtgttcacgcgccccgccgcgcccgccaacgagcatgcgctacacgacttccccgacgtgcgcgtccggtacgtggaactcct

SEQ ID NO: 20590 - protein, 206 aa, Panicum virgatum
  misc_feature: Ceres CLONE 1812179
  misc_feature: SWISSPROT Homolog: EC 2.4.1.238 Anthocyanin 3'-O-beta-glucosyltransferase
MGHEQDHGGRGRGAGHLLLFPFLAQGHLIPFLTLARRLESQGRRRGSSQRRLVVTIVSTPRNVADLRRAVPAGSSIGFAELPFSPSDHGLPPDAESTDAVPFRSLPAFYFTTELLRPSFEELVAELAGREGRQNVCVLADIFLGWTAESARALGVQHRVFLTSSAYASALTFSIWLRPPVFTRPAAPANEHALHDFPDVRVRYVEL

SEQ ID NO: 20591 - DNA, 1710 bp, Panicum virgatum
  misc_feature: Ceres CLONE 1812183
  misc_feature: Encodes the peptide sequence at SEQ ID NO. 20592
tcgctcattcgcaccagccgccgccagccgggaatattggcctgtgaccacggcgtccattggttgtctcgacggccgcagtcgtggacgaggagaatgcgctggagtcgtcgacaaatggggacggtggcgtgggcttggtggcagagatcatccacagtagcgccagcttcctagccctccatttcgccgtggatttcttcaggttaatgagatctgattcttcccccagcgcaaggtagaagaacagcttgagcccttaagaggccgggaaccggccggcaagcaagggaaaacctgagaaatcgactgttgtcgatcgattgctgctgcaactccgaaatctcaggcaaatacttcgcatcttcttccccggcatcgaaatctggagaaaatggtggagaacggcgtccggcaacacctgttacaccacgacagccctcctgacgtcccgccaaagataccaccggggagggcgaggaggttccggcgctgccagacggcgccgtcgcacaacgtcgagcaggggtccactcttcagagctggcagggcgccaacgctgccgcaccggtggtgccgcccaaggggctgctcacgggtggtacgggcccgagcttctggctcgtcggcgtactcctactcgcatacctcttcgccgggacctccgccttctacctcgccatggaccacatgtccggcgaccgcagcggcaaccgcgcgctggacgcgctctacttctgcgtggtcaccatgacgaccgtcgggtacggcgacctcgtcccgtccagcgacgccgccaagctgctcgcctgcgccttcgccttggccggcgtcgccctcgtcggcgccttcctcagcaagaccgccgactacctcgtcgagaagcaggaggcgctcgtctttcgcacgttccatctccaccacgctaacgactacaagtccacgcgcgacatggaggccaacaaggtcctctacaagctctacacctccgccgcgctgctagccgtgatcctcgcctccggcatggcgttcctggtgaaggtagaagggatgcgccccgtggacgccttctactgcgtgtgcactacggtgaccacgctcgggtacggcgaccggagcttctcgtcggcggccgggcgggcgttcgcggccgtgtggatcacggtgagcacgctagtggtggcgctcttcttcctgtacgcggcggagctgggcgcggagcggcggcagaaggcgctggcgcaatgggtgctcacgcggcggaccaccagcatggacctcgaggcggcggacctcaacggcgaccatagggtcagcgccgcggagttcgcgttgtacaagctcaaggagctcggcaagatcagcaaggaagacatctctgagttcattgaggtgttcgacatgctcgacgccgaccactccgggaccctctcgtgccacgatctggccgtcacacaacccggctagcccggcaatcaccggccggttgccacttgcaaggcaatgtggcacacagcagaattctgtggacatgcatgtctttccgcaggataagctctgcctctcgaacactaccttccagaaatactcgggaacggaattcctttgtgtatgtatagtaggatagcgaacattataacatctccaagagactctgtatttgaacttggttagctaaaaattaaagaaacgggagaaaatttccatcc

SEQ ID NO: 20592 - protein, 357 aa, Panicum virgatum
  misc_feature: Ceres CLONE 1812183
  misc_feature (80)..(163): Pfam Name: Ion_trans_2 Pfam Description: Ion channel
  misc_feature (201)..(276): Pfam Name: Ion_trans_2 Pfam Description: Ion channel
MVENGVRQHLLHHDSPPDVPPKIPPGRARRFRRCQTAPSHNVEQGSTLQSWQGANAAAPVVPPKGLLTGGTGPSFWLVGVLLLAYLFAGTSAFYLAMDHMSGDRSGNRALDALYFCVVTMTTVGYGDLVPSSDAAKLLACAFALAGVALVGAFLSKTADYLVEKQEALVFRTFHLHHANDYKSTRDMEANKVLYKLYTSAALLAVILASGMAFLVKVEGMRPVDAFYCVCTTVTTLGYGDRSFSSAAGRAFAAVWITVSTLVVALFFLYAAELGAERRQKALAQWVLTRRTTSMDLEAADLNGDHRVSAAEFALYKLKELGKISKEDISEFIEVFDMLDADHSGTLSCHDLAVTQPG

SEQ ID NO: 20593 - DNA, 2479 bp, Panicum virgatum
  misc_feature: Ceres CLONE 1812185
  misc_feature: Encodes the peptide sequence at SEQ ID NO. 20594
agaccattccttcggtttctcctttctctcgttctccgtctggagctgagcgcgttctccccccgaatctgcaccgtggctctccccaaggagctcaggaggccccccccagaaacaaagtgatggaacttatccaagaagctgatagatctaaatggatggtgcacagtaaccatagcataaaatgcttcacaaaaggcgacatagacaaaatgaccaacagctatcgaacttgtcttggaagaggtgccttcggagaagtatacaaaggggttcttgaggacggaagcatggttgcagtgaaaaggtttatccacaatgtgaaagaaaacttcgctaaagagctgatcgtccatcgtgaaatcaaccacaagaacgtagtgaggctcattggttgctgtgaggaggaaaatgcccttatgctggtcactgaatatgtcgctaatggaaatctaagtgatgctcttcaccatgacaatcttcccatccctttggatataagacttagggtcgccgtcgagtgtgcggaggcgttggcgtacattcattctcacatgtatactcgggttatccatggcgacatcaagcctggtaacatacttttagatagcaacttccatgcaaaattgtcagacttcggaatatcaagactagccaacacggataagacactgcacaccgagaatgtcataggaagcataggttacatggatcctctgtttgctttggatgggcgtctcactgtgaagtatgatgtttatagctttggagttgttctccttgagctgatggccaggaaaaaggcaacaacagtagttgacaacgtcaacattgtttatgcatttactagtgctcttgcaagggggtccggaggtgtgagatggatgtttgatgctgaaattgcaagcaaggataatatgaaggttgttgaaggggttgcaaagatagcaggtgaatgcgtaacgatggaaagggagaaacgccctgagatgattgacgtggtggaacgtcttagggtgctacgacagaaagcttcacgtcaggatcaggcatcgcaacactcaggtctgttctcttgggctaggaggaacaagacagcacctccagcttcagcgaacatcccagccaatattttgccgtcagatgcttgtgattcagggaccagttctaagaacagcagcaagaatgccatcacctttgataccaagatatcctgctcttcatcgtcggtgccacctactcctcgtacggagacagagattctggagtcatcaaatgtccgaaagttcaccttcagtgagctgaaaggctccacaaggaacttcagattggacagcatgctcggggagggaggctttggctcggtgtacaagggatggatggatgagcgcacgcttgcacctgtgaaaccgggcactgggatgattgtcgcggtgaagaggctcaagctcgacagcttccaagggcacagagaatgggtggatgcggtaaattacctagggcagttgtcccaccctaatcttgtgaaacttattgggtactgctgggaggatgaagaacggcttcttgtgtttgagtacatgccaagagggagcttggagcatcatcttttcaggagagggtcgtacttccaaccgctcccatggaacttacggatgaaggttgcacttgaggcggccagaggccttggtttcctgcacggcgaccaggctaaagttatctatcttgatttcaagacctccaatattcttctcgactcggagtacaatgcaaaattgtctgatttcggtttggcaaaagatggtccaagtggttatacaagttatactatccctactatgctcatggggacgaccttcacggggacaaacggatatgctgcccctgaatatattgcaacattcatggggacacacggatatgctgcccctgaatatattgcaacaggccatttgaccgcgaagtgtgatgtgtacagctacggtgttgttcttctggagttgctgtctgggcagcgtgctctggacaagaaccgcccacctggccagcacaggctggtggagtgggctaggccttacatcaccaacaagcggagggtgtcccgtttcttggactcgcagttggattcccagtattgccttcctgcggcgcagaagaccacagccctagcactgcaatgcttgtcgatggacccacaatgcaggcctggcatggatcaggttgtgaccttgttagaaggccttcaagacaccaagagtgcattgaaatctggcaagtaggagaattgctagttacggttgtccttgcctctttgaaggatcgtcgtcttgtaggactccaatggagtaaaacggtgaacggatgagggatttcaggggcaactagcttctgacgagtgtataatattaatatatcttgctttgtgtattgctacctgcttcgttggtgcaactttttctctacatatgtatattttagc

SEQ ID NO: 20594 - protein, 718 aa, Panicum virgatum
  misc_feature: Ceres CLONE 1812185
  misc_feature (401)..(704): Pfam Name: Pkinase Pfam Description: Protein kinase domain
  misc_feature (35)..(297): Pfam Name: Pkinase Pfam Description: Protein kinase domain
  misc_feature (342)..(593): SWISSPROT Homolog: EC 2.7.11.1 Non-specific serine/threonine protein kinase
  misc_feature (20)..(228): SWISSPROT Homolog: EC 2.7.12.1 Dual-specificity kinase
  misc_feature: Useful for making plants with modulated drought sensitivity
  misc_feature: Useful for making plants with modulated heat sensitivity
MELIQEADRSKWMVHSNHSIKCFTKGDIDKMTNSYRTCLGRGAFGEVYKGVLEDGSMVAVKRFIHNVKENFAKELIVHREINHKNVVRLIGCCEEENALMLVTEYVANGNLSDALHHDNLPIPLDIRLRVAVECAEALAYIHSHMYTRVIHGDIKPGNILLDSNFHAKLSDFGISRLANTDKTLHTENVIGSIGYMDPLFALDGRLTVKYDVYSFGVVLLELMARKKATTVVDNVNIVYAFTSALARGSGGVRWMFDAEIASKDNMKVVEGVAKIAGECVTMEREKRPEMIDVVERLRVLRQKASRQDQASQHSGLFSWARRNKTAPPASANIPANILPSDACDSGTSSKNSSKNAITFDTKISCSSSSVPPTPRTETEILESSNVRKFTFSELKGSTRNFRLDSMLGEGGFGSVYKGWMDERTLAPVKPGTGMIVAVKRLKLDSFQGHREWVDAVNYLGQLSHPNLVKLIGYCWEDEERLLVFEYMPRGSLEHHLFRRGSYFQPLPWNLRMKVALEAARGLGFLHGDQAKVIYLDFKTSNILLDSEYNAKLSDFGLAKDGPSGYTSYTIPTMLMGTTFTGTNGYAAPEYIATFMGTHGYAAPEYIATGHLTAKCDVYSYGVVLLELLSGQRALDKNRPPGQHRLVEWARPYITNKRRVSRFLDSQLDSQYCLPAAQKTTALALQCLSMDPQCRPGMDQVVTLLEGLQDTKSALKSGK

SEQ ID NO: 20595 - DNA, 809 bp, Panicum virgatum
  misc_feature: Ceres CLONE 1812186-R
  misc_feature: Encodes the peptide sequence at SEQ ID NO. 20596
atggaatgatgggggtgcgtgtgggatacattgcatttccaaacgaagctgatggcttccatgatcagctcctcaaagtgcaagataacatacctatctgtgcttccatcatcgggcagcgcctggcgctttactcacttgaggctgggcctgcgtggatcaaagaaagggtggaagacttggtaaaaaaccgagagctgctcgtggatgcgctgtctccactcggcaaggacaatgtcaagggtggggagggcgccatctacctctgggcaaaactaccggatgactgctcggacgatttcgaagttgtcaggtggctcgcaaacaagcatggggtcgctgtgatcccagggagcgccagtggaggccctggatacatccgcgtctcctttggtgggctcaaggaggaagataccaggcttgctgcagagagactaaggcgcggcttgcaggagctggtgactgatggaatggtacagtaaccacccattggtgtaagtaaaggcttaacattcaagttttacaggactccgattttccaatggtataaaaattcgtctgggattaatctgagagaagaaaaggacctattttcaagaatacattgttgaaaagggcaattggtggaaggagaactgagacagaataaaaggcctgtcaatgcagcctgcagagtcacctatgttataactagcatatcaccattgagtacttgttgctgtttgacttccagttttccatcttactgatgacagcaattgtacacaaaccaaagtacaagactataagagttatgagctgttcctgac

SEQ ID NO: 20596 - protein, 159 aa, Panicum virgatum
  misc_feature: Ceres CLONE 1812186-R
  misc_feature: SWISSPROT Homolog: EC 2.6.1.1 Aspartate transaminase
  misc_feature: Useful for making plants with modulated nitrogen use efficiency
GMMGVRVGYIAFPNEADGFHDQLLKVQDNIPICASIIGQRLALYSLEAGPAWIKERVEDLVKNRELLVDALSPLGKDNVKGGEGAIYLWAKLPDDCSDDFEVVRWLANKHGVAVIPGSASGGPGYIRVSFGGLKEEDTRLAAERLRRGLQELVTDGMVQ

SEQ ID NO: 20597 - DNA, 1051 bp, Panicum virgatum
  misc_feature: Ceres CLONE 1812186
gtcttcatgtgtctttgtttagacgttgcctggttgggggcttggggcaggagacttgggaccagaggggtgaggagttggtgagcgagctcgggatcagcgggtgaccccaaagttcatagttcttctgcttcgaaggggggatgggtagcttcgcgaagctggcgaggagggcggtggagacggacgcgccagtcatggtgaagatacaagaactgcttcgaggggccacggacgtgatgtcgcttgcccaggtatctgatcgtagtttttgatttggctgtgcaatgaattgatgcgtcgtgagggagatgtaaggttaatggcacaagcaggtggggatatttgcattgcttaagaaatggaagtcaatggaggcataggaagcgatcaactgtatagcaattcgctcccccatattatttatgtcagttgttcaagttgtttgtagttgggtacagatcgttagctatgtttcatggaacacatcatacagtttttacttgctattcctgaaaatggttcttatgttgccaaagtgggacacatttgtctgtaatcctctccttttttggccaagtgtatgcaatccatttagcgacaagcatgtctgtaagggtccaatcagcatgaccagaccatgccgcatctcctagaaattagtttctgtttttaacctctgtaaatcttgaatgcagggagttgtttactggcaacctcctgagtcagctatgaataagattgaaaaaatcatcagggaaccagcagtcagtagatatggttctgatgatggacttcctgaacttcgtgaagcacttctcgaaaagctacgcagagagaataagcttaccaagtcatcagttatggtcactgctggtgcaaatcaggcttttgtgaacttggtcctcactctttgtgatgctggtgattccgttgtcatgtttgcaccatattatttcaatgcctacatgtcattccagatgacaggtgttactgacatattagttggtgcttgcgaccccaagacacttcatcctgatgttgattggtt

SEQ ID NO: 20598 - DNA, 1428 bp, Panicum virgatum
  misc_feature: Ceres CLONE 1812189
  misc_feature: Encodes the peptide sequence at SEQ ID NO. 20599
gtcgcatcccggctgtttcgtccgcgtcgcccaaccaatcggcagtctcgctctctcccccctcccatccccgtctcgcccgctaccgctagcgcgctgagctgtggcgtctgagggaagccttccactccccagcagcagcagcagcagccttgacccgaccgccgtccgctgggggcgtcgctggagacgcgcccgcctcgggttcttcgccgtccccctccccggccggcgtcctggtgccagtcgggcccgatcggccgcgtagcctccgggcatccgcagagatatattgtaaaatggaagcactacgtaatatgaaactgcccccaggatttggattctatccttccgataccgaactcattggtcactatctaaagaggaaaatacatggccagaaaattgaacacgatcttataccagaggtggatatatacaagcacgaaccatgggatttacctgcaaagtgcaattttccaatcgaggacaacaagtggcatttcttctcctctcgtgataggaagtaccctactggttctaggtcaaacagggcaacagttgctggttactggaaatcaactgggaaggaccgaggcataaagctgaacaagcgaactctaggaacaaagaagactttagtttttcatgcaggccggcctccctctggtagacgcactgaatggattatgcacgagtactacatagatgagaaggaatgtcaagtcagccccgatatgaaggatgcttttgttctctgtcgtgttactaaaagaagtgactgggcattggataatgataatgaggcgggcgacaggaaccctcatcatcagcaacaaattgatgcttccacatcagttgtaaagccagaacatgctgctacatcagttgtaaatcctgaagatgctgctacatcagttttaaatccagaagatgctgctatgtcagttgttaagccagaagatgctgctgcctcagtcatctgtgcaggcgaatcaaatgatgttgctatggcatccattactgctgataaagaatctccaaatggtagtaatgaactggatgaatggctggaagaattgctggatccttcaccttcatttaaccctttacctgatactggttgtgccatcctacctctgtctgagcaatatgctgaatcatcgaatactggttgtgtggttcccaagactggaccagaccatgcaagccctatcaaggatgggacagatgccacagactacctattcactgatgatcttcctgatgatctttacaatatggtgtttcctggtattgatgacttcagtaataatatgttcttggagccagctggcctcctgtcagaagcttctgccaccaaccaagcttaccacatgatggggcttccaaacaacttcggggatggaactctgaaggatgaattgc

SEQ ID NO: 20599 - protein, 376 aa, Panicum virgatum
  misc_feature: Ceres CLONE 1812189
  misc_feature (9)..(137): Pfam Name: NAM Pfam Description: No apical meristem (NAM) protein
MEALRNMKLPPGFGFYPSDTELIGHYLKRKIHGQKIEHDLIPEVDIYKHEPWDLPAKCNFPIEDNKWHFFSSRDRKYPTGSRSNRATVAGYWKSTGKDRGIKLNKRTLGTKKTLVFHAGRPPSGRRTEWIMHEYYIDEKECQVSPDMKDAFVLCRVTKRSDWALDNDNEAGDRNPHHQQQIDASTSVVKPEHAATSVVNPEDAATSVLNPEDAAMSVVKPEDAAASVICAGESNDVAMASITADKESPNGSNELDEWLEELLDPSPSFNPLPDTGCAILPLSEQYAESSNTGCVVPKTGPDHASPIKDGTDATDYLFTDDLPDDLYNMVFPGIDDFSNNMFLEPAGLLSEASATNQAYHMMGLPNNFGDGTLKDEL

SEQ ID NO: 20600 - DNA, 550 bp, Panicum virgatum
  misc_feature: Ceres CLONE 1812189-R
tcatgactagtgttgagcaccagaagaaacatgcaaacgatgccacctctgtcaagcaatctgatgcagccaagccaggtgaaggccacagcaatcaaggatatctcaggggcgcaaagaatgcattcagatgttcatcagctggattaaaggcatacatactcttcgccatcttcatggttggagttgctgctgctgtagcactgcattaccaccgttcgggtgccagcctataacattgaatcagcatacatcggcatgcttagttttagctgtagaggtcagtggtatcggcttgggcgattctacaccagtaaggatgtttggaacggtagtagcatcttcccgtcttcatccttgcagtagtttgttgactttacttgcattgaactggaatagtaattgagttcctcagcttatgtcactgggattgctggccttttgtggacattggtgcaaccactaaccccagctgtctccaccagttttttatggtgctgtacatatgaagttctttttgttcgactagctactgctatgtgtgcctgtc

SEQ ID NO: 20601 - DNA, 2324 bp, Panicum virgatum
  misc_feature: Ceres CLONE 1812202
  misc_feature: Encodes the peptide sequence at SEQ ID NO. 20602
atcgccgccgaacgggcagacagcaagcagttgagctccgcggcgctctgcttcccctcaaggagaaagctccgcgctctgctcgaaagggtctgcctacctacctctcccgcgcgagctccgtgagccatgggcggcggcggcgcgggggcgaacggcggagggtcgccggcgggggcgcgggtgccggtgccgccggcgcggccgttcctggactcgttccgggcgaacctcaaggagaccttcttcccggacgacccgttccgctccgtggtgcgggagcgcggggccgcgcggcggacgctggccgcgctgcgctacttcttcccgttcctcgagtgggcgccggcgtacacgctgggcgccttcagggccgacctcgtcgccggcatcaccatcgccagcctcgccatcccgcagggcatcagctacgccaagctcgccaacctgccgcccatcctcgggctctactcgagcttcgtgccgcccctggtgtacgcgctgatggggagctccaaggacctggccgtggggaccgtggcggtggcgtcgctgctcatcggctccatgctcggcagcgaggtgtccccgacggagaacccggcgctgtacctgcacctcgccttgaccgccaccttcttcgccggcgtcttccaggcctcgctcggcctcctcaggttgggcttcatcgtggacttcctgtcgcacgcgacgatcgtggggttcatgggcggcgcggcgacggtggtgtgcctccagcagctcaagggcatcctgggcctcgagcgcttcaccacctccaccgacgtcgtctccgtcatggactccgtcttctcccagacacaccagtggcggtgggagagcgtcctgctcggcagcggcttcctcttcttcctcctcgtcacccgcttcatcagcaagaggcggcccaaactattctggatatccgcggcggcgccactgacttcggtcatccttgggagtgtcctggtgtacctcactcatgctgaaaaccatggcatccaagtgatcggttacctgaagaagggtctgaacccaccatcagtgacaagcctgcagttctcgccaccttacatgatgctcgcactgaagaccgggatcatcaccggcgtcattgccctcgctgaaggcattgcagtagggaggagcttcgccatgttcaagaactacaacatcgatggcaacaaggagatgatcgccattggaacgatgaacatcgtcggatcattcacatcctgctatctcaccaccggcccgttctcgcggtccgccgtgaactacaacgccgggtgcaagacggccatgtcgaacgtggtcatgtcgctggcggtgatgttcacgctgctgttcctgacgccgctgttccactacaccccgctggtggtgctctcggcgatcatcatctcggcgatgctggggctgatcgactaccagggcgccatccacctgtggcaggtcgacaaggtggacttctgcgtgtgcatgggcgcctacctcggcgtcgtcttcagcagcgtcgagatcggcctggtcgtcgcggtctccatatccatcctccgggtgttgctgttcatcgcgcggccgaggacgacgatgctcggcaacgtccccaacacgatgatctaccggaggatggaccagtacaccacggcgcagacggtgcccggcgtcctggtgctgcgcatcgacgcgcccatctacttcaccaacgccagctacctgcgagagaggatcttgcggtggatcgacgaggaggaagagcgcacccagggcaagggcgagatggacgtgcagtacgttgtccttgacatgggtgccgtcggtagcatcgacacgagcgggacaagcatgctggatgagctcaagaagaccttggaacgaaagggcatgcagatcgtgctggcgaaccctggcagcgagatgatgaagaagctggacagctccaaggtcctggagctgatcggccacgagtggatcttcccgacggtgggggaggccgtgtcgtcgtgcgactacgtgctgcactcgcacaagcccggcgtggtcatggacagtgcggcagcccacgagaacatggtctgaatctgaatggggaaggacgacggtgacacggtgtgtgcagatgtaatagttgagagtgagtctgacgacacgagttgtcaacaagcaagccgagatatgaatatggataccaacatcatatctcgagtattgtactggtgcattgccaaggaaaccacagaaatccaatcaaatccggcctctgcagatgcaaatatgcaacgcaggaggaattcgaacgc

SEQ ID NO: 20602 - protein, 657 aa, Panicum virgatum
  misc_feature: Ceres CLONE 1812202
  misc_feature (179)..(489): Pfam Name: Sulfate_transp Pfam Description: Sulfate transporter family
  misc_feature (512)..(630): Pfam Name: STAS Pfam Description: STAS domain
MGGGGAGANGGGSPAGARVPVPPARPFLDSFRANLKETFFPDDPFRSVVRERGAARRTLAALRYFFPFLEWAPAYTLGAFRADLVAGITIASLAIPQGISYAKLANLPPILGLYSSFVPPLVYALMGSSKDLAVGTVAVASLLIGSMLGSEVSPTENPALYLHLALTATFFAGVFQASLGLLRLGFIVDFLSHATIVGFMGGAATVVCLQQLKGILGLERFTTSTDVVSVMDSVFSQTHQWRWESVLLGSGFLFFLLVTRFISKRRPKLFWISAAAPLTSVILGSVLVYLTHAENHGIQVIGYLKKGLNPPSVTSLQFSPPYMMLALKTGIITGVIALAEGIAVGRSFAMFKNYNIDGNKEMIAIGTMNIVGSFTSCYLTTGPFSRSAVNYNAGCKTAMSNVVMSLAVMFTLLFLTPLFHYTPLVVLSAIIISAMLGLIDYQGAIHLWQVDKVDFCVCMGAYLGVVFSSVEIGLVVAVSISILRVLLFIARPRTTMLGNVPNTMIYRRMDQYTTAQTVPGVLVLRIDAPIYFTNASYLRERILRWIDEEEERTQGKGEMDVQYVVLDMGAVGSIDTSGTSMLDELKKTLERKGMQIVLANPGSEMMKKLDSSKVLELIGHEWIFPTVGEAVSSCDYVLHSHKPGVVMDSAAAHENMV

SEQ ID NO: 20603 - DNA, 592 bp, Panicum virgatum
  misc_feature: Ceres CLONE 1812214
  misc_feature: Encodes the peptide sequence at SEQ ID NO. 20604
ggtgctccgcggtggagcgagaccgagagcggaggagactcgtcgccagaagcgaagcgaaaagagaaacccaagcaatccgccctcgtcccccgctcgccacgatgctcgcgaccgcctcgccgggcctccacgccgccgcgcgccgcctcacgctgccgtcgcgggcccgctgcgtcttacgcctcccgcggcggtgcccgggacgtcccgcgtggctgcccgcggcggcgtcggcggctgcgccggaggccgccccgcccgcgaaggagggggcggaggagctggggttcccggagatgacgtccgggacgcgggggcggtactacaggctccggggaaagggtgggggaggaaagacaagctgcgcggcgtccctggccgtgcgcttgggcaacaacggccaccccaccctcgtcgtctccaccgagcgcgcacactcgcggagcgactccttcacgcaggacttgagtggcgggacgctcgagcaggtagagggtcctgatgctcccctgctggcgctcgagatgattcctgagaaggctctcgaacagttttgggaatctaatcgaagtagtggaggacactgggg

SEQ ID NO: 20604 - protein, 162 aa, Panicum virgatum
  misc_feature: Ceres CLONE 1812214
  misc_feature: SWISSPROT Homolog: EC 3.6.3.16 Arsenite-transporting ATPase
MLATASPGLHAAARRLTLPSRARCVLRLPRRCPGRPAWLPAAASAAAPEAAPPAKEGAEELGFPEMTSGTRGRYYRLRGKGGGGKTSCAASLAVRLGNNGHPTLVVSTERAHSRSDSFTQDLSGGTLEQVEGPDAPLLALEMIPEKALEQFWESNRSSGGHW

SEQ ID NO: 20605 - DNA, 1650 bp, Panicum virgatum
  misc_feature: Ceres CLONE 1812222
  misc_feature: Encodes the peptide sequence at SEQ ID NO. 20606
cccgattttttttccggcctataacttcgcccccgttcccccctgtgcgcccccgtccgtcgtcttcgcgaggtcgaaccccaaggcgaggcagcgaaaccctcaagggctagtgcgaggggagagagagcgcgcgaggcggccaagggcgagatgaagctcaacgtcaagaccctcaagggcaccagcttcgagatcgaggcgagccccgaggagacggttgctggggtgaagcggatcatcgagacaaatcagggtcagagtgtctaccccgcggacagtcagttgctcatataccaagggaaaattctcaaggatgacaccactttggaaagcaacaaggttgccgagaacagcttccttgttataatgctgtccaaggctaaggcatcgtcaagtggaccttctaccactactcctgcaaaagctcctgcaactcctgcccaacctgctacgcctgcagcccctgctgcttcagttgcaagatcaacacctccacaagcacctgctgccacggcagtaacggcacctccaagtgcacagccttcacctgctcctgctccagctgctactactgctccagctgctacagttgctgcatctgatgctgatgtgtacggtcaggcagcatcgaaccttgtctctggcaacactctagaacagacaatccaacagattcttgacatgggtggtggtacatgggaacgtgatactgttgtccgtgctctacgtgctgcatataataaccctgagagggcaattgattacctgtattctggaattcctgagaatgttgaggccccgcctgtggcccgggcacctgcttctggccaacaaacaaatccacagtctccttcacttgctcaggctacagttgcaccaccagtgcagccatccgctgcctctgcagggcctaatgcaaatcctctaaacctttttcctcagggtgttccaagtggtggggccaatccagctgctggtgctggtgctggtgcaggagctggtgcccttgatgctttgcgacagcttccacagtttcaagcactgcttcaattggtccaggctaatcctcaaatcttacagccaatgcttcaagagctaggcaaacaaaacccacaaatcctgcggttgattcaggaaaatcaggctgagtttctccgcttggtgaatgaaagtcctgagggtggtgctggaggaaacatactaggtcaactagcagcagcaatgccacaagcggtgactgttactccggaggaacgggaggctatccagcggctcgagggaatggggttcaatcgtgagcttgtgctagaggttttctttgcgtgcaacaaggacgaggagcttgctgccaactacctcctggatcacggccatgagttcgacgagccgccgcaatagatgctagatgctagattggtgatatcgtgggggtggaggtggggggaaacccagggagaagcagagcagctcagtgtcgttcttattccttctggcagttgagtaatacctggtcgtctatgcagtgctgctgactatcttttatttccatatatgtgtcggaaatgctttctaagtacatattaattccatatttcgtgccctcgtgctgttgtgcaaaaggagttcgctcagccgcccagctttgat

SEQ ID NO: 20606 - protein, 415 aa, Panicum virgatum
  misc_feature: Ceres CLONE 1812222
  misc_feature (286)..(344): Pfam Name: XPC-binding Pfam Description: XPC-binding domain
  misc_feature (167)..(206): Pfam Name: UBA Pfam Description: UBA/TS-N domain
  misc_feature (367)..(403): Pfam Name: UBA Pfam Description: UBA/TS-N domain
  misc_feature (6)..(78): Pfam Name: ubiquitin Pfam Description: Ubiquitin family
MKLNVKTLKGTSFEIEASPEETVAGVKRIIETNQGQSVYPADSQLLIYQGKILKDDTTLESNKVAENSFLVIMLSKAKASSSGPSTTTPAKAPATPAQPATPAAPAASVARSTPPQAPAATAVTAPPSAQPSPAPAPAATTAPAATVAASDADVYGQAASNLVSGNTLEQTIQQILDMGGGTWERDTVVRALRAAYNNPERAIDYLYSGIPENVEAPPVARAPASGQQTNPQSPSLAQATVAPPVQPSAASAGPNANPLNLFPQGVPSGGANPAAGAGAGAGAGALDALRQLPQFQALLQLVQANPQILQPMLQELGKQNPQILRLIQENQAEFLRLVNESPEGGAGGNILGQLAAAMPQAVTVTPEEREAIQRLEGMGFNRELVLEVFFACNKDEELAANYLLDHGHEFDEPPQ

SEQ ID NO: 20607 - DNA, 3359 bp, Panicum virgatum
  misc_feature: Ceres CLONE 1812224
  misc_feature: Encodes the peptide sequence at SEQ ID NO. 20608
ctgatacagcagccgtcaagctttcttccagggaggggagagaaagagagggcgctcccaatcctcttctttctccatcttcgtgcccacctgggccacctcaaaaccagcatcttgctttcccgatggtattagagctccacccgaccgtaccagcgtccaggaaccgggtgtgaggaacctctccctgccgccgcccaattccgccccccattgcgccaagaaccgatgcagctcgcccaaagatgaaagattccggcttgcgacggtgccggtgctctaccgccgattccggggaggagatggaggcctgaagctcgcgggttgggaggaggccaatgggggtgcttcaggtgatgcttccgctcttggtgctgctcgccgccgcggcgaggcttgtcgcggcggcgggggcgcggccgagcgaggtggccgtgggcgcgctcttcacctacgactccaccattggccgcgcggcgcggctcgccatcgagctcgccgtcgacgacgtcaacgccgaccgcaccgtgctcgcggggacccagctcaagttgatcacccaggacaccaactgcagcggctttctcgggaccatcgaagcattgcagctaatggaaaacaatgtcgttgccgttattggcccacaatcctctgggataggccatgtcatttcccatgttgttaatgagctacatgttcctcttctatcatttgcggccacagacccaactctttctgcatcagagtacccttacttcataaggacaaccataagtgactacttccaaatgaacgccgttgctagcattgttgaacactatcagtggaaagaggtaactgctatattcgttgatgatgattatgggcgaggtggtgtctcagcccttggtgatgcacttgcagaaaagagggcaaggatttcatataaggcagctattcctcctaactcaaatacagacatgatcaacgatgtattgtttagagcaaatatgatggaatcaagggtcatggttgtgcatgtcaatcctgacacggggatgagcatattttctattgctaacaagctccagatgctggccagcggctatgtctggatagtgactgattggctagctgctgttctggattcctcagcgtctagagaccttaaatatatgagtcatattcagggactaattgttcttcgtcagcacactcctgaatctgctgccaagaataagttcatatttaaatggaatggtgtggctcgtaatagaagtattacttctggcttgaactcatacggcttttatgcatatgactcagtttgggctgttgctcatggtattgatcaatttctcaatagtgggcaacagatcaacttctctacagatccaagattgcacgattctaatggaagcaatttgcagctatcaactctcaagatatttgatggtggtgagcagatgctacagcaacttctcctcacaaattttacaggcctaactggtccagtccaatttaattcagaccgcgatttggtacgcccagcatatgatatccttaatattggtggttctggctcccagttgatcggctattggtccaattactcaggcctctctgtaactgctcctgaaattttgtatcagaagccaccaaatacttcttcatttgtccagcggctccacaatgtggtctggccaggtgattccaccactacaccaaaggggtgggttttcccaaacaatggacagcctctgcgagttggtgttccaatgaaagcaagctttaaggaactagtggcaggtggcaggggccctaataatgtgactggttactgtgttgatatattcaatgcagcaattaatctgcttccttatccagttccctgccaattcataacaataggggatggtacaaagaacccaaactatgacgatattattaatatggttgcttccaattcccttgatgcagctgttggtgactttgctattgtgagaaatagaacaaagattgcagaattcacgcagccttatattgaatcagggcttgtgatagtagcaccagtgaaacaagcaacttcaagtgcctgggctttccttaaacctttcacattggagatgtggtgtgtgacaggtggtctttttctttttgtggggatagttgtttggattcttgaacatcggactaatgaggagtttcgaggctctccacgacgacaagttataacaatattttggtttagcttctcaacaatgttctttgcacacagacagaacactgtaagtgcacttgggcggttcgtgttgatcatatggttgtttgttgtgctgatcatcaattcaagttatactgcaagtttgacgtcaatcctcacagtccaacagctagcaacgggaataactgggattgacgatttgatttcgagtgctttacctattggatatcaggccggaaaatttaccagaaattacctgatcgaagagctcaatattcctgagtctcgactgattccacttaatacaatccaggaatatgctgatgcccttaaacatggaccaaaagatggcggtgttgctgcaattgttgatgagatgccatatgttgacattttcttgtcatatcactgcaatttcagagtagtgggacaggagttcacgaaggagggatggggctttgcattccagagagattccccccttgctgcagacttatcaacagccatccttcagctttcagagagtggccagcttcagagaattcacgacgagtggttgacgcggtctagttgctcctctgatgacagtgaagtgggagcgaccaggcttggccttggaagcttttggggccttttcctcgtttgtgccctgatatgtctccttgctctgctggtgttcttcatacgagtctgctggcagtatagcaagtactccaattctgaagctgctggtgagcccagtgcagctgatgctaatgctgctgccgctgccgttgccgctgatgctgccgaaagacagcgaaggccatcacgccttggcagcttcaaagaactgatacagtttgtcgacaagaaggaggaagaagttaggagaacgatgaaacgaagatcaagcgagaaagataaccaacctgcaggatcctcagatgttcagtcagtggtttcagcatagaacattctttccgactaaagtccttcagaaggcaaagcagggaagcataataccgatagcttattgatttaggttaacttgcttagggtaggagatcaaagaaccatttttcatctgggccattagaatttcgtctcagatacatatacacaagttgtactaaacaattgtttctggtaattgagttcttttatcaagctgtgc

SEQ ID NO: 20608 - protein, 938 aa, Panicum virgatum
  misc_feature: Ceres CLONE 1812224
  misc_feature (46)..(406): Pfam Name: ANF_receptor Pfam Description: Receptor family ligand binding region
  misc_feature (587)..(851): Pfam Name: Lig_chan Pfam Description: Ligand-gated ion channel
  misc_feature: SWISSPROT Homolog: EC 4.6.1.2 Guanylate cyclase
MGVLQVMLPLLVLLAAAARLVAAAGARPSEVAVGALFTYDSTIGRAARLAIELAVDDVNADRTVLAGTQLKLITQDTNCSGFLGTIEALQLMENNVVAVIGPQSSGIGHVISHVVNELHVPLLSFAATDPTLSASEYPYFIRTTISDYFQMNAVASIVEHYQWKEVTAIFVDDDYGRGGVSALGDALAEKRARISYKAAIPPNSNTDMINDVLFRANMMESRVMVVHVNPDTGMSIFSIANKLQMLASGYVWIVTDWLAAVLDSSASRDLKYMSHIQGLIVLRQHTPESAAKNKFIFKWNGVARNRSITSGLNSYGFYAYDSVWAVAHGIDQFLNSGQQINFSTDPRLHDSNGSNLQLSTLKIFDGGEQMLQQLLLTNFTGLTGPVQFNSDRDLVRPAYDILNIGGSGSQLIGYWSNYSGLSVTAPEILYQKPPNTSSFVQRLHNVVWPGDSTTTPKGWVFPNNGQPLRVGVPMKASFKELVAGGRGPNNVTGYCVDIFNAAINLLPYPVPCQFITIGDGTKNPNYDDIINMVASNSLDAAVGDFAIVRNRTKIAEFTQPYIESGLVIVAPVKQATSSAWAFLKPFTLEMWCVTGGLFLFVGIVVWILEHRTNEEFRGSPRRQVITIFWFSFSTMFFAHRQNTVSALGRFVLIIWLFVVLIINSSYTASLTSILTVQQLATGITGIDDLISSALPIGYQAGKFTRNYLIEELNIPESRLIPLNTIQEYADALKHGPKDGGVAAIVDEMPYVDIFLSYHCNFRVVGQEFTKEGWGFAFQRDSPLAADLSTAILQLSESGQLQRIHDEWLTRSSCSSDDSEVGATRLGLGSFWGLFLVCALICLLALLVFFIRVCWQYSKYSNSEAAGEPSAADANAAAAAVAADAAERQRRPSRLGSFKELIQFVDKKEEEVRRTMKRRSSEKDNQPAGSSDVQSVVSA

SEQ ID NO: 20609 - DNA, 1818 bp, Panicum virgatum
  misc_feature: Ceres CLONE 1812238
  misc_feature: Encodes the peptide sequence at SEQ ID NO. 20610
gacagcgcccacgcctccaccccctcgtcaccggcggcgatgccagccgcctctagaagcccccaggcagaccactgtttgttggttcctcaattcttcacctagcacttcggttggcagtttcagttgtcaagtttaaatccctgatgacctgctacatatgcccatccttgactgcagagctcggtgagcgcgcgggcgtgtgcctggagcggatgtattgtgacgcacgggaggcagcaatgatgtggagagcgaggggaagaatgtggaaggccatcagagatgttgccaagtgaaatgacatggcatctgcaaagttgtgactagtaatcatacacgctttatttcagttcatcagctcctaaatcatacgtgctttatttcagttcatcagctcctaacacatctttcagtcaatgtgtacctgcacttctatatgcttagtcattcacatatcacaaattttctggagagggattgcgtctgaaaaaagaattgttttgtgcagcaagttggacgccaagattgcttgctggagattgaacatgcgctggagttgcttgcttgctggagatcgcccatttctggaacctggagttgcttgcttgctggagatcgcgcgtgcagacttttctttttcatggagaacaaagtttggtgcacagatattcgttggccaatctgaaacaatccttttctgtacataaatcaatcagttgtatgagggccacaagaacatggagtacaaacgggattagtactcccactccaaccacagcagcagctagcgaccggtctcactctcagcaatcgcctcacgcaatggccgcctccaccatggcgatctcctccccggcgatggccggcacccccatcaaggtgggctccttcagcgagggccgcatcaccatgcgcaagaccgcggccaagcccaaggtggcagcgtccggcagcccatggtacggccccgaccgcgtcaagtacctcggccccttctccggcgagcccccgagctacctcaccggcgagttccccggcgactacggctgggacaccgcggggctgtccgctgaccccgagaccttcgccaagaaccgcgagctggaggtcatccactcccggtgggccatgctcggcgcgctcggctgcgtcttccccgagctgctcgctcgcaacggcgtcaagttcggcgaggccgtctggttcaaggccggctcccagatcttcagcgagggcggcctcgactacctcggcaaccccagcctcatccacgcccagagcatcctcgccatctgggccgtccaggtcgtgctcatgggcgccgtcgagggctaccgcattgccggcggcccgctcggcgaggtcgtcgacccgctctaccccggcggcagcttcgaccccctcggcctggctgacgaccccgaggccttcgccgagctcaaggttaaggagctcaagaacggccgcctcgccatgttctccatgttcggattcttcgtccaggccatcgtcaccggcaagggcccgctcgagaacctcgccgaccacctcgccgacccggtcaacaacaacgcctgggcctacgccaccaacttcgtccccggcaactaagctccgatccattggcaatgcaacttcattgtcttccggagggggcgtacgtggatccattgatgctgcaagctgccgcgtgtgcgtctcttgtttcacgttgcatttcaggggcaagtcgagatgatgaattgccgttgtacactaagatgaacgatgatgcttgtgcaatagtagtggttttgttccttgttggttgatcat

SEQ ID NO: 20610 - protein, 257 aa, Panicum virgatum
  misc_feature: Ceres CLONE 1812238
  misc_feature (56)..(224): Pfam Name: Chloroa_b-bind Pfam Description: Chlorophyll A-B binding protein
MAISSPAMAGTPIKVGSFSEGRITMRKTAAKPKVAASGSPWYGPDRVKYLGPFSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWAVQVVLMGAVEGYRIAGGPLGEVVDPLYPGGSFDPLGLADDPEAFAELKVKELKNGRLAMFSMFGFFVQAIVTGKGPLENLADHLADPVNNNAWAYATNFVPGN

SEQ ID NO: 20611 - DNA, 1410 bp, Panicum virgatum
  misc_feature: Ceres CLONE 1812246
  misc_feature: Encodes the peptide sequence at SEQ ID NO. 20612
aaaaataccctcggccgagagaacccagaaaatcgcagcgcgcgaaaacgcaggtgaagcccgcccactcgccaccgccgccagcgcgcacagcaaccaccaccggcggcgaccgctccggcggaagactaggagatggccccgctagtgccgatgtcgcagccatgggtggagaaataccggccgaggcaggtgaaggacgtcgcgcaccaggaggaggtgattcgggtgctcaccaacaccctccagactgccgatctgccgcacatgcttttctacggcccgccgggcacggggaagaccaccaccgcgctcgccatcgcctaccagctctatggtccagagctgtacaagtcgagagttttggagctcaatgctagtgatgatcgcggaattaatgtggtgaggacgaaaatcaagaactttgctgctgttgctgttggtactacacggaaagctggttatccctgcccaccttacaagattattatacttgatgaagctgattctatgacagaagatgcccagaatgctttgaggcgtactatggagacttactccaaagtgaccagattcttttttatatgcaactatatcagcaggataatagaaccacttgcatcgagatgtgcaaagtttaggttcaagcctctttcagaagacgtgatgagcaatcgcattatgcatatatgcaatgaagaaggtctcaatcttgattctcaggctctatccacactgagtgccatttctcaaggtgatcttcgtcgtgctataacctatcttcagagtgcagcccgcttatttggatcttctatttcctccgctgacttgatcagtgtttctggggtcatcccggaagatgttgtcaagtcactgcttgcagcctgcaggtctggtgaatttgacgtggcaaacaaagaagttagcaatattatcgccgagggatatccagtttcacagctgatggcacagtttctagatgtgattgttagcgcagacgatattccagatgagcaaaaggcaaggatatgtaaaaagcttggggaaactgataagtgcttggtcgatggtgcagatgagtatcttcaacttttggatgttgccagcgagactattcgtgctcttttcaacatgccacaaacgttggtgttctgagagaagtttacaaagaggaacgcttctggtaatgaccgattatgaacatttgcaagccctggaaggtgtctttctcggtgcttctgagatgccgcacaaggctaatctccatcgctatgctgtcactgcatttccggtagacttgtgatgggttaaatgtgatgaactcgcccaaaaactttaactgaactgcacctgtggatgtccagtatggcacggaacatttctcaacttacatcttgtgcattatatttc

SEQ ID NO: 20612 - protein, 339 aa, Panicum virgatum
  misc_feature: Ceres CLONE 1812246
  misc_feature (237)..(326): Pfam Name: Rep_fac_C Pfam Description: Replication factor C
  misc_feature (44)..(226): Pfam Name: AAA Pfam Description: ATPase family associated with various cellular activities (AAA)
  misc_feature: SWISSPROT Homolog: EC 2.7.7.7 DNA-directed DNA polymerase
MAPLVPMSQPWVEKYRPRQVKDVAHQEEVIRVLTNTLQTADLPHMLFYGPPGTGKTTTALAIAYQLYGPELYKSRVLELNASDDRGINVVRTKIKNFAAVAVGTTRKAGYPCPPYKIIILDEADSMTEDAQNALRRTMETYSKVTRFFFICNYISRIIEPLASRCAKFRFKPLSEDVMSNRIMHICNEEGLNLDSQALSTLSAISQGDLRRAITYLQSAARLFGSSISSADLISVSGVIPEDVVKSLLAACRSGEFDVANKEVSNIIAEGYPVSQLMAQFLDVIVSADDIPDEQKARICKKLGETDKCLVDGADEYLQLLDVASETIRALFNMPQTLVF

SEQ ID NO: 20613 - DNA, 528 bp, Panicum virgatum
  misc_feature: Ceres CLONE 1812251
  misc_feature: Encodes the peptide sequence at SEQ ID NO. 20614
gcgcaaaccattcccctcccccttctagatggagagatagagaagaaaagataagctcagctcagctcgcaagcaagaggtggagatgcggagcccacgaggaggagggcgcgcccatgagcacgtcgacctgatcccgggcatccccgacgacgtcgccgtcgactgcctggcgcgcgtgccccacgcgtcccaccgcgcgctgcgccgtgtctgccgcggctggcggagcgccgccgccgcgccggccttcgccgcggcgcgcgccgccgcgggtgcacacgaggacctcatctacatgctgcagttcgggaacccctccgccaccaccgactcctactacggagggccctgggactgcggcgcaccgcccagcgcggccgccatcggcgtcactgtctacaacgtgcacctcgcgtccagtggctccgggagcgcggcgcgccccccgctgctgctcttgtccgcccagtgcgcctcggtgggtactcccgcaccgaaagctcggggcctgccaccccctcagct

SEQ ID NO: 20614 - protein, 147 aa, Panicum virgatum
  misc_feature: Ceres CLONE 1812251
  misc_feature (15)..(62): Pfam Name: F-box Pfam Description: F-box domain
MRSPRGGGRAHEHVDLIPGIPDDVAVDCLARVPHASHRALRRVCRGWRSAAAAPAFAAARAAAGAHEDLIYMLQFGNPSATTDSYYGGPWDCGAPPSAAAIGVTVYNVHLASSGSGSAARPPLLLLSAQCASVGTPAPKARGLPPPQ

SEQ ID NO: 20615 - DNA, 492 bp, Panicum virgatum
  misc_feature: Ceres CLONE 1812279
  misc_feature: Encodes the peptide sequence at SEQ ID NO. 20616
acactcgcagacacaaccgaaaaaccaagggggaaaaatagtaaagaaacggaggcgaggcggccctcctcctccccctcctccccgtttcttatctatcctgatccaaatccgcctcgcttcttatatcctcctccgaggaaaacaattccatcccccaccaccccatctcgtcctgctcgcctccgtcgccgccgccgccgccgtcgccatggccaccgaggaagccgccaagccgtccccgctcccgccctacccggagatgatcctggcggctatcgatgggctgggcgacaagaacgagtcgaacccgtcagccatctcgaggtacatcgagggtaagtaccgcgagctgcctccggcgcacacctccctgctgactgcgcatctgtcgagcatgaaagagaccagccagctcctcttcctcgataacagctacttcggccccgaccccccccatccgccccctaaactcggccctccgcatcaaca

SEQ ID NO: 20616 - protein, 93 aa, Panicum virgatum
  misc_feature: Ceres CLONE 1812279
  misc_feature (11)..(80): Pfam Name: Linker_histone Pfam Description: linker histone H1 and H5 family
MATEEAAKPSPLPPYPEMILAAIDGLGDKNESNPSAISRYIEGKYRELPPAHTSLLTAHLSSMKETSQLLFLDNSYFGPDPPHPPPKLGPPHQ

SEQ ID NO: 20617 - DNA, 726 bp, Panicum virgatum
  misc_feature: Ceres CLONE 1812282
  misc_feature: Encodes the peptide sequence at SEQ ID NO. 20618
accttgcaatctcgcattcctccgatctctcgagcctttcttcctcgtcccgagaagccccacgaagagcagcggcggcaatggactccaccggcaccggagctggcggcaaggtgaagaagggagcagctgggcgcaagaccggcgggccgaggaagaaggcggtgtcgaggtccgtgaaggccgggctccagttccccgtcggccgtatcgggcgctacctcaagaagggccgctacgcgcagcgcgtcggcactggcgcccccgtctacctcgccgccgtcctcgagtatctcgccgctgaggttctggagctcgccggcaacgcggccagggacaacaagaagacccgcatcatcccccgccacgtgctcctggcgatccgcaacgacgaggagctcgggaagctgctctccggcgtcaccatcgcccacggcggcgttctccccaacatcaacccggtcctgctgcccaagaagacggcggagaaggcgtccagcggcggcagcaaggaggccaagtcgcccaagaaggccgccaagtcccccaagaaggcatagagggtgggcttagatccaatgtctagcgccgtttcgtgttttcatgtgattgatgtttaggttgtagatgtggaaaagttgtggtcggagatgaaccagtggtgtcgtgacttgtgatctgtggttttcatgaagaaatactgggtaaaacttacacgatgtgcct

SEQ ID NO: 20618 - protein, 159 aa, Panicum virgatum
  misc_feature: Ceres CLONE 1812282
  misc_feature (31)..(104): Pfam Name: Histone Pfam Description: Core histone H2A/H2B/H3/H4
MDSTGTGAGGKVKKGAAGRKTGGPRKKAVSRSVKAGLQFPVGRIGRYLKKGRYAQRVGTGAPVYLAAVLEYLAAEVLELAGNAARDNKKTRIIPRHVLLAIRNDEELGKLLSGVTIAHGGVLPNINPVLLPKKTAEKASSGGSKEAKSPKKAAKSPKKA

SEQ ID NO: 20619 - DNA, 651 bp, Panicum virgatum
  misc_feature: Ceres CLONE 1812288
  misc_feature: Encodes the peptide sequence at SEQ ID NO. 20620
gcgcacccaacagcgaacacttccccacgaaatcctgcagcagcggcgggtaactctgttcacactcgtcaatcgccggcgaagaagtgcagtacttaccacacctgcaatggcggattaccaaactagccttgtgactgagccacagttgctgaacaacgagatcatcactcagaaggccactaataactttgtttctgacactgccagaaaagacaaatccattggctacttggatgtgtttgttcatcaggcacgcgatatccacaatgtctgtatctaccacaagcaggatgtgtatgcaaagctatgccttacaagcagcccagatgtttcatgctcaaccaaggtgattaacagtgctgggcgcaacccaatattcgatgaaagcctacagcttgacgtgcagactgtggacgcttcactcaaatgtgagatatggatgttaagcagaataaggaactacctggaggaccagctccttggttttgcccttgttcctctggcagacatcgtaatgggtaacgggaagctggtccaggagttctccctgacatccactgacctgttccacacaccagctggttttgtgcagctgtccttgtcatatgctggttgttccccagatatcatccttatgtcatcacccaa

SEQ ID NO: 20620 - protein, 180 aa, Panicum virgatum
  misc_feature: Ceres CLONE 1812288
  misc_feature (42)..(129): Pfam Name: C2 Pfam Description: C2 domain
  misc_feature: Useful for making plants with modulated biomass
MADYQTSLVTEPQLLNNEIITQKATNNFVSDTARKDKSIGYLDVFVHQARDIHNVCIYHKQDVYAKLCLTSSPDVSCSTKVINSAGRNPIFDESLQLDVQTVDASLKCEIWMLSRIRNYLEDQLLGFALVPLADIVMGNGKLVQEFSLTSTDLFHTPAGFVQLSLSYAGCSPDIILMSSP

SEQ ID NO: 20621 - DNA, 1572 bp, Panicum virgatum
  misc_feature: Ceres CLONE 1812298
  misc_feature: Encodes the peptide sequence at SEQ ID NO. 20622
tcgcgaaccgttgttaattagcagctcgcggcctgtgacaggctggcagctcatcggcatccctcatcttgcgaaacgaaaccacctagtggctaactcagttcagggagggtggtgcgagagtgctgccgcggccatggcgatgcggcgggtcgtggcggcggcggcgctgttggcctgcgtcctgctgccgatggcggcgtccccggtgcgcggacgcaacatcacggccatcctcgacgggtacaaggagtataagctgtacaacaagtacctgtcggagacgaaggtgtgcgacgagatcaactcgcggcagtcgacgtcgatgaccatcctcgtgctctccaacgacgccatgaccacgctcgcctccgacgccggtgactcgctccccgccatcaagaacgcgctccgcctccactcggtgctcgactactacgaccgcaagaaggtcaagaagtacggcgacgagagcgccgccacgctctaccaggccaccggcgacgccgccagcaccacggggaacgtcaaggtcgtcgaccaggaggacaagaactacggcttctcggccgccacgcccggcgccaggatctgtaccgtcaccaaggaggtggagacccacccgttcaagttcgccatcctcgaggtcacggcgcccatcgagttcgacggcctcttcgacaccccgtccacgaccaacctcacgctgctcctggagcggtccggctgcaaggtgttcgcgtcgctcgccgcccgctccggcgtgctcaagacgtacgaggcggccatggacaaggggctcaccttgttcgcgcccaacgacgacgcgttccaggccaaggacgtgcccgacctcaagagcatgtccagcgctaacctcaccaagctcctccagtacaacgcgctgccgtcgtacaacaccaagacgtcgctcaagttcgtcaagggcacgctccgcacgctggccacaaccaaggccggcgtcacggtggtcgccaagggcgacgacgtctccctcgacaccggcaagagcaagtcccgcgtggcggacacggtcgtcgacagcgtgcccttctgcctgctcaccgtggacagcctcctggtgccgccggagctctacgtcggcgcaccggaggccgccccggcgccggcgcccgcggaggcgccacagggctccccgtccgcggacgccccgtcggtgggcgcggaccacgcggcggaccacaagatcaagaagccgtcgtcctctggcgcctcgcggccgatcggcgcgttcgccgccgcgtgctccctcgtgctggcctccctgttgttgtgatggagctgaacgcgggcagcacattcagattcagggagtgttgccagacagctcgcctcgcttcttcaccaaacacaatactccgtctcccctgtgatcgaaaaatcttttcctccgtctgttcgttgattggatttgttgctgcattgcgattcctctgtgtaatttgagcaaacactgtaaattattctctcttcctatttttcgtggtagtttcagaacacattctccggttgcagaacagcatcccctcc

SEQ ID NO: 20622 - protein, 393 aa, Panicum virgatum
  misc_feature: Ceres CLONE 1812298
  misc_feature (197)..(324): Pfam Name: Fasciclin Pfam Description: Fasciclin domain
  misc_feature: Useful for making plants with altered carbohydrate content
MAMRRVVAAAALLACVLLPMAASPVRGRNITAILDGYKEYKLYNKYLSETKVCDEINSRQSTSMTILVLSNDAMTTLASDAGDSLPAIKNALRLHSVLDYYDRKKVKKYGDESAATLYQATGDAASTTGNVKVVDQEDKNYGFSAATPGARICTVTKEVETHPFKFAILEVTAPIEFDGLFDTPSTTNLTLLLERSGCKVFASLAARSGVLKTYEAAMDKGLTLFAPNDDAFQAKDVPDLKSMSSANLTKLLQYNALPSYNTKTSLKFVKGTLRTLATTKAGVTVVAKGDDVSLDTGKSKSRVADTVVDSVPFCLLTVDSLLVPPELYVGAPEAAPAPAPAEAPQGSPSADAPSVGADHAADHKIKKPSSSGASRPIGAFAAACSLVLASLLL

SEQ ID NO: 20623 - DNA, 710 bp, Panicum virgatum
  misc_feature: Ceres CLONE 1812307
  misc_feature: Encodes the peptide sequence at SEQ ID NO. 20624
gtcctcgtccagctccgtaaccaccggacagagcagagcacgcgccatgaggaccaccaccaggactgcgctgccgctcctggcgctggcagcggcgctctgcctcagcctcgcgctgctgctccccggcgcggccgcggcgagcaaggcccggccgcggccgcggcagggtgactacctgaaccgcctgcgcgggtcgccggcgtccgcgcgccagtcgtggcaggtcgagtcgtcgctggcggtcgcaccggcgtcgtcgccaacggccagagcgcagcggcacgcggcgccggtggtggcggggcacaaggaggacgaccgcgtggaccggctgccggggcagcccgatggcgtggacttcgcgcagtacgccgggtacgtgacggtggacgcggcggccgggcgcgcgctgttctactacctcgccgaggccgccggcaacgtgtcggcggcatcccggccgctcctcctctggctgaacggcgggcccgggtgctcgtcgctggggtacggcgccatggaggagctgggcccgttccgcgtgaagagcgacggcaagacgctgtaccggaacccgtacgcgtggaacaacgcggccaacgtgctgttcctggagagccccgccggcgtggggttctcctactccaacacgacggcggactacagccggagcggcgacaacaagacggccgaggatgcccttcttt

SEQ ID NO: 20624 - protein, 221 aa, Panicum virgatum
  misc_feature: Ceres CLONE 1812307
  misc_feature (98)..(221): Pfam Name: Peptidase_S10 Pfam Description: Serine carboxypeptidase
  misc_feature: SWISSPROT Homolog: EC 3.4.16.6 Carboxypeptidase D
MRTTTRTALPLLALAAALCLSLALLLPGAAAASKARPRPRQGDYLNRLRGSPASARQSWQVESSLAVAPASSPTARAQRHAAPVVAGHKEDDRVDRLPGQPDGVDFAQYAGYVTVDAAAGRALFYYLAEAAGNVSAASRPLLLWLNGGPGCSSLGYGAMEELGPFRVKSDGKTLYRNPYAWNNAANVLFLESPAGVGFSYSNTTADYSRSGDNKTAEDALL

SEQ ID NO: 20625 - DNA, 1754 bp, Panicum virgatum
  misc_feature: Ceres CLONE 1812319
  misc_feature: Encodes the peptide sequence at SEQ ID NO. 20626
gagcaagtaatggagcggcggcggtcgccgaggctgctgctccatgtgctcttcttggtcgccgcttcttggcctctcgggagcacagggattggatgcctcggagttggcccggagaacaatggagcttcggctagttctaggaattccagaagactgctgcagaagggagacaggaatgaagatggcttatttcatctcccacacacaaggactttctcgcacaagagcagatcacatagaagagctccaacgccagcagcagcaccagtgtctgctccatcacccttaccattcatatcccctccagaacgctcgccttcttcatcaccacatgcttcaagatccatgccacgccagtctacttcacaatatcatccaactgcagcttctccacatttggacaggcctaggcctacacctaagcaagatgaacatgatcgttcagttcaaactccagttcattcctcgcataaacattcctggacaacctacggtgtggtcgcagtggggattgctgttttcattttggtatcagcagctagtgtgctctgcttccgagccaagaaaatgggaactgtgaggccatgggcaacaggtctcagtggtcagttgcagaaagcatttgtaactggtgtaccttccttgaaacgatcggagctggaaacagcatgcgaggatttcagcaatataattggttctacctctagctgcatgctgtacaaggggaccttgtcaagtggggttgagattgctgtggcctcaagcttggtaacatctgctaaggattggtcgaaagaaaatgaatcacagtataggaagaagatcacaagtttgtccaaagtaagccacaagaattttatgaacttgcttggctactgcgaggaagagcatccctttactagagcgatggtatttgaatatgctccaaatgggacactttttgagcatctccacatcagggaagcagagaagcttgactggatgacgcggctgcgggtatccatgggcattgcttactgtcttgagcacatgcatcagctgaaaaccccagttgtgcctaggaatttcgactcaacaacgatataccttaccgatgacttcgctgcaaaagtctcagatctcgaattttggaatgacgcaaaggggcatagttcaaccaacggcgacctgacatcatcatcggacctggagaacattgtgcgcaagtatggcatagtactgctggaaatattgaccggacgagtcccctattctgaggatgggccactggagcattgggcttcacgctacttcaatggcgagatgcgtcttgaggagctgattgaccctggcatcggctccttccctgaagacgctgcgcgtgcgctctgcgaggttgcaaggtcctgcattgatccagatccaaagaagagaccgcagatggcagaggttgcagctcggatgagagagatcactgcgttggggcctgacggagcgactccaaaggtgtctccgctgtggtgggctgagcttgagatcatgtcttctgagagttgaagttgcttgcatgccagatgacattcttttatctgtcggttgctgctaattcctgtttgtggatttggtgattaggtagaaaggcgggtgagagtttgttctgtgtgcaaaattgcatttaggaagtggtactgtacatgtaaagaaggttgacagcttaacatacgcaggcattacagccaatgtgagcaatagaaagaaggggtgtattgacg

SEQ ID NO: 20626 - protein, 509 aa, Panicum virgatum
  misc_feature: Ceres CLONE 1812319
  misc_feature (224)..(479): Pfam Name: Pkinase_Tyr Pfam Description: Protein tyrosine kinase
  misc_feature: SWISSPROT Homolog: EC 2.7.11.1 Non-specific serine/threonine protein kinase
MERRRSPRLLLHVLFLVAASWPLGSTGIGCLGVGPENNGASASSRNSRRLLQKGDRNEDGLFHLPHTRTFSHKSRSHRRAPTPAAAPVSAPSPLPFISPPERSPSSSPHASRSMPRQSTSQYHPTAASPHLDRPRPTPKQDEHDRSVQTPVHSSHKHSWTTYGVVAVGIAVFILVSAASVLCFRAKKMGTVRPWATGLSGQLQKAFVTGVPSLKRSELETACEDFSNIIGSTSSCMLYKGTLSSGVEIAVASSLVTSAKDWSKENESQYRKKITSLSKVSHKNFMNLLGYCEEEHPFTRAMVFEYAPNGTLFEHLHIREAEKLDWMTRLRVSMGIAYCLEHMHQLKTPVVPRNFDSTTIYLTDDFAAKVSDLEFWNDAKGHSSTNGDLTSSSDLENIVRKYGIVLLEILTGRVPYSEDGPLEHWASRYFNGEMRLEELIDPGIGSFPEDAARALCEVARSCIDPDPKKRPQMAEVAARMREITALGPDGATPKVSPLWWAELEIMSSES

SEQ ID NO: 20627 - DNA, 671 bp, Panicum virgatum
  misc_feature: Ceres CLONE 1812320
  misc_feature: Encodes the peptide sequence at SEQ ID NO. 20628
tccccgagacgcagcacggcagcagcagcagcagcggtgcggacaggcagagcctgctcacagtctcacactccactctgccaccctctgtctgagctgcctccgttgccatggccgcgcggatcttgctcccgctgctcctcttcctcctcggctcgcattgctggaccggggcggcggcggcggcgaggcggcagctgctgcaggcgcggcgcaccggggatcccaactcgcaggtcaagttcgacttctcgccgttcctcatcgagtacaagagcgggcgcgtgaagcggctgatgggcaccgacgtggtggcggcgtcctcggacgcgctcacgggcgtcacctcccgcgacgtcgtcatcgacccgtccacgggcgtcgcggcgcggctctacctcccgagcttccgcgccagcgcccgggtgcccgtgctggtctacttccacggcggcgcgttcgtggtggagtccgcgttcacgcccatctaccacgcctacctcaacacgctggcggcgagggcgggcgtggtggccgtgtccgtgaactaccgcctggcgccggagcacccgctcccggcggcgtacgacgactcgtgggcggcggtccggtgggtgctcgcgaacgcggccgggtcggacccgtggctgtcccagtacggcgacctgtcg

SEQ ID NO: 20628 - protein, 186 aa, Panicum virgatum
  misc_feature: Ceres CLONE 1812320
  misc_feature (109)..(186): Pfam Name: Abhydrolase_3 Pfam Description: alpha/beta hydrolase fold
  misc_feature: SWISSPROT Homolog: EC 3.1.1.3 Triacylglycerol lipase
MAARILLPLLLFLLGSHCWTGAAAAARRQLLQARRTGDPNSQVKFDFSPFLIEYKSGRVKRLMGTDVVAASSDALTGVTSRDVVIDPSTGVAARLYLPSFRASARVPVLVYFHGGAFVVESAFTPIYHAYLNTLAARAGVVAVSVNYRLAPEHPLPAAYDDSWAAVRWVLANAAGSDPWLSQYGDL

SEQ ID NO: 20629 - DNA, 1897 bp, Panicum virgatum
  misc_feature: Ceres CLONE 1812322
  misc_feature: Encodes the peptide sequence at SEQ ID NO. 20630
atggccatccaaccacacccacgagcgcaacctcccaaaggcgccaccaattccacaacctcccatactcgtgagtcgaggctccaacccctgcccaggaggaggacgcgcccaccatggccatggcgacggcgctccgcaagctctccgccaacgcgctccgccgccagcctctccctcgcatcacgccgctctactacatggcgtccctgccggcgacggaggagagatccggtattacctggccaaagcagttgaacgcgccgcttcaagaggtcgaccccgagattgctgacatcatcgagctcgagaaggcccgccaatggaaggggctggaactcatcccgtcggagaatttcacgtcggtgtcagtgatgcaggctgtgggttccgtcatgaccaacaagtacagcgaggggtaccccggcgcaagatactacggtgggaatgaatacattgatatggccgaatccttgtgtcagaaacgtgctttggaggctttccgcttggacccagcgaagtggggagtgaatgtgcaacctctatcgggttcacctgccaacttccaggtgtacaccgcgctattgaagccacatgaaaggatcatggctttggatcttccacatggtggacatctttctcatggttaccagactgacactaagaagatttcggcaacttcgatattctttgagacgatgccctacagattggatgaaagcactggattaattgattacgatcagttggagaaaagcgctgttcttttcaggccaaagttgatcatagctggtgcaagtgcatatgctcgcctatatgattatgaccgtatgcggaagatatgcaacaagcagaaagcaatacttctagcagacatggcgcatatcagtgggctggtcgcagctggcgtcattccatctccttttgattatgcagatgtagtgactaccactactcacaagtcacttcgtgggccacgtggagccatgatcttttacaggaagggagttaaagaaataaataagcaaggaaaagaggttatgtatgattttgaggacaagatcaacgctgccgtctttccaggtctgcagggtggtcctcataaccacaccattactggcttagctgttgcgcttaagcaggcaactactccagagtaccgagcttatcaagagcaagttatcagcaacagtgctaagtttgcacagagcttggtagcaaaaggatacgagcttgtctctggtggaactgataaccatttggtccttgttaacctcaagaataaggggatagatggttcaagggtggagaaggttttagaaactgtgcatattgcagcaaacaagaacactgttcctggtgatgtttcagctatggtaccaggaggcatcaggatgggaaccccagctcttacatccagaggatttgtggaggaagatttcgctaaggttgctgacttctttgatgcagcagtgaacttggctgtgaagattaaggctgcaacgacaggtggaacgaagctgaaggactttgttgccaccttgcaatctgatagcaaaatccaagctgagattgcaaagcttcgcattgatgtggaggaatttgcaaaacagtttccaacaattggatttgagaaagagaccatgaaatacaagaactaagatctgaatgataagcagcaagcaaagatgccatgacaattgttgggagttcagatgggcatgatcatgtaaacataaacccatggcgaaagtggaatggcatcttatgttaagagagatattggcaatttacagcatatgcaacttctgtcaatagcccatattgtaaacacctactgcaagatcttataatgaataatagcccatactaagcatcactcttcttggacagttgc

SEQ ID NO: 20630 - protein, 514 aa, Panicum virgatum
  misc_feature: Ceres CLONE 1812322
  misc_feature (51)..(449): Pfam Name: SHMT Pfam Description: Serine hydroxymethyltransferase
  misc_feature: SWISSPROT Homolog: EC 2.1.2.1 Glycine hydroxymethyltransferase
  misc_feature: Useful for making plants with modulated nitrogen use efficiency
MAMATALRKLSANALRRQPLPRITPLYYMASLPATEERSGITWPKQLNAPLQEVDPEIADIIELEKARQWKGLELIPSENFTSVSVMQAVGSVMTNKYSEGYPGARYYGGNEYIDMAESLCQKRALEAFRLDPAKWGVNVQPLSGSPANFQVYTALLKPHERIMALDLPHGGHLSHGYQTDTKKISATSIFFETMPYRLDESTGLIDYDQLEKSAVLFRPKLIIAGASAYARLYDYDRMRKICNKQKAILLADMAHISGLVAAGVIPSPFDYADVVTTTTHKSLRGPRGAMIFYRKGVKEINKQGKEVMYDFEDKINAAVFPGLQGGPHNHTITGLAVALKQATTPEYRAYQEQVISNSAKFAQSLVAKGYELVSGGTDNHLVLVNLKNKGIDGSRVEKVLETVHIAANKNTVPGDVSAMVPGGIRMGTPALTSRGFVEEDFAKVADFFDAAVNLAVKIKAATTGGTKLKDFVATLQSDSKIQAEIAKLRIDVEEFAKQFPTIGFEKETMKYKN

SEQ ID NO: 20631 - DNA, 1122 bp, Panicum virgatum
  misc_feature: Ceres CLONE 1812326-R
  misc_feature: Encodes the peptide sequence at SEQ ID NO. 20632
gcgcgaggagagcgtgtacatggcgaagctcgccgagcaggcggagcggtacgaggagatggtggagttcatggagcgcgtggcgcgctcggcgggcggcggcggggggggggaggagctctccgtcgaggagcgcaacctgctgtccgtcgcctacaagaacgtcatcggcgcccgcagggcctcgtggcggatcatctcctccatcgagcagaaggaggagggccgcgggaacgaggcccacgccgcctccatccgcgcctaccgcgccaagatcgaggccgagctcgcccgcatctgcgacggcatcctcgcgctcctcgactcccaccttgtcccctccgccggcaccgccgggtgcgagggcttcgagctcaagatgaagggggactaccacgtgtaccttggtgagttcgagtcgtgcgcggagaggaaggaagctgcagagagcaccatgaatgcttaccaagctgcccaggatattgccctggcagatctggctccaacccaccccatcaggcttgggctcgccctcaacttctcggtgttctactatgagatcctgaactcccctgaccgcgcctgcaaccttgccaagcaggcttttgatgaggctatctctgagctagacagcttgggtgaggagtcctacaaggacagcactctgatcatgcagctcctgcgtgacaacttgaccctatggacatctgacaccaatgaggatggcggtgacgagatcaaggaaaccgctgccccgaaggaatccggagagggtcagtaagatggatccaagctctcgatcggatgcgcctgctgatgatcgggagcgaccagagccaatgttcctggatttcgatagctctaccttctagtatacctaccatcaccaccaccgtcctcgcactgagatgatgctgcattgccgctgtttaattaagtaccctagatgtttgttatgacgctttgtttcagttttaagttgataaagtgatggctggatgctggttttcatgctccaatcccggccaccagcaaaagaaaaaacctgcttccgcgttgcagcgttgttagaatgattgcttatgttacttgatgacctatggagtactatttgacatgccg

SEQ ID NO: 20632 - protein, 259 aa, Panicum virgatum
  misc_feature: Ceres CLONE 1812326-R
  misc_feature (1)..(242): Pfam Name: 14-3-3 Pfam Description: 14-3-3 protein
  misc_feature: The sequence is a functional homolog of SEQ ID NO 789 in the 11/479,226 US patent application
  misc_feature: Useful for making plants with modulated drought sensitivity
  misc_feature: Useful for making plants with modulated water use efficiency
  misc_feature: The sequence is a functional homolog of SEQ ID NO 786 in the 11/479,226 US patent application
  misc_feature: The sequence is a functional homolog of SEQ ID NO 2350 in the 10/374,780 US patent application
  misc_feature: The sequence is a functional homolog of SEQ ID NO 344 in the 10/412,699 US patent application
  misc_feature: The sequence is a functional homolog of SEQ ID NO 790 in the 10/225,066 US patent application
  misc_feature: The sequence is a functional homolog of SEQ ID NO 805 in the 11/479,226 US patent application
  misc_feature: The sequence is a functional homolog of SEQ ID NO 801 in the 11/479,226 US patent application
  misc_feature: The sequence is a functional homolog of SEQ ID NO 342 in the 10/412,699 US patent application
  misc_feature: The sequence is a functional homolog of SEQ ID NO 782 in the 11/479,226 US patent application
  misc_feature: The sequence is a functional homolog of SEQ ID NO 797 in the 11/479,226 US patent application
  misc_feature: The sequence is a functional homolog of SEQ ID NO 793 in the 11/479,226 US patent application
REESVYMAKLAEQAERYEEMVEFMERVARSAGGGGGGEELSVEERNLLSVAYKNVIGARRASWRIISSIEQKEEGRGNEAHAASIRAYRAKIEAELARICDGILALLDSHLVPSAGTAGCEGFELKMKGDYHVYLGEFESCAERKEAAESTMNAYQAAQDIALADLAPTHPIRLGLALNFSVFYYEILNSPDRACNLAKQAFDEAISELDSLGEESYKDSTLIMQLLRDNLTLWTSDTNEDGGDEIKETAAPKESGEGQ

SEQ ID NO: 20633 - DNA, 531 bp, Panicum virgatum
  misc_feature: Ceres CLONE 1812326
  misc_feature (239)..(239): n is a, c, t, g, unknown, or other
  misc_feature (242)..(242): n is a, c, t, g, unknown, or other
  misc_feature (244)..(244): n is a, c, t, g, unknown, or other
  misc_feature (248)..(248): n is a, c, t, g, unknown, or other
  misc_feature (249)..(249): n is a, c, t, g, unknown, or other
aaccgcgtccgcttcttcccagatcccctgcgcccgccgcatccctgtagccgcccctgctgccactctcgccggcgagcccgatccgatccgccgcctcccgcagcccgcagccatgtcgccgtcggagccgacgcgcgaggagagcgtgtacatggcgaagctcgccgagcaggcggagcggtacgaggagatggtggagttcatggagcgcgtggcgcgctcggcgggcggcgccngcngngggnnggggctctccgtcgcggcgcgcgcttgctggccgtggcctcctggggcgtcgtccgcgcccgctgggtgtcgtggcgcgtcgtgtgctcgttcgggcgctgcggcgcgggccgcgtccgcgcggccctcgccgcctcctccgggccggtgggcgccggcgtgcgcgcccgcctcgtccggcgcttgttcctcgccctcgtcgcctccgcggggctcttggcctccgccgtcgccggcggcggcgtgtccgcgcgctccctcttcgcgtcctgccgcggccgc

SEQ ID NO: 20634 - DNA, 473 bp, Panicum virgatum
  misc_feature: Ceres CLONE 1812336
  misc_feature: Encodes the peptide sequence at SEQ ID NO. 20635
atgcagctctcactctccttcccaagatgtgatttactcctctgtccggttcgtcgtgtgaatccgattcctgtggtttagcctttgctagctcctgcctccaggtggtggatagctagccgaggatgagaggaggacgagaggaagaacatgcgatggcctctgcgtgctatcctgatctcttcctccttccttgcacagaagcccgactggggcggcatcaggcaggtcgcgtcgcccatgccggtcaccgtgtccttggcggtcgtccggcccggcgcctagtcctatgagctcgtccagactgctaaatcggtggcgtccccggggccggccattcctgccatggccgattctaaggctacttgcgggaatcggctggcttacatccgtctgcagaacactgaggctaaacggtatgcgtaccatgactctgctggtgaccgagccggggatgggccagtacatctccg

SEQ ID NO: 20635 - protein, 44 aa, Panicum virgatum
  misc_feature: Ceres CLONE 1812336
  misc_feature: SWISSPROT Homolog: EC 4.1.2.13 Fructose-bisphosphate aldolase
MRWPLRAILISSSFLAQKPDWGGIRQVASPMPVTVSLAVVRPGA

SEQ ID NO: 20636 - DNA, 826 bp, Panicum virgatum
  misc_feature: Ceres CLONE 1812342
  misc_feature: Encodes the peptide sequence at SEQ ID NO. 20637
accaatcgtgccctaccacgctcgcactcccatccgctccgatccgcacggcgccgctagggggttggggcagctgcgtcgccgccgtcggggccgccccgagccgccgccgctcgcctcgccggcccctccccccacggcatctgtctccggtgttggtgatatgcccaagaacatagagcttgtatctttgtttcaagaacatagagtttgatgctgtcgtctgcacacaccatgcccatggtggtaaaggagcggttgaacttggacttgcggttcaacgagcatgtgaaagccagtcagagcctctgaagtttctgtatcctttggaatctagcataaaggagaagattgaatccatagctaagttctatggtgctagtggtgtcgaatattctaagttgctgcaggctgagaagcagattgagatgtacaccaaacaaggcttctccaacctcccaatctgcatggcgaaaacccagtactcattctcacatgttccctccatgaagggcgccccgaccggctttgttctaccaataagggacgtgagggccagcataggagctgggttcatctacccgctcgtgggcaccatgagcacaatgcccggccttcccacaaggccctgcttttacgagatcgacgtcgacactgccaccgggaaggtcatgggcctgtcataaactgtagctcagctggtgccgtttcgagaccggccggatcacatttgcattgtagcggaattgtgcagctacagaattttgggtcattcctttcgttgagataaataatagtaataagtatccgttcctggcttccggct

SEQ ID NO: 20637 - protein, 85 aa, Panicum virgatum
  misc_feature: Ceres CLONE 1812342
  misc_feature: SWISSPROT Homolog: EC 6.3.4.3 Formate--tetrahydrofolate ligase
MYTKQGFSNLPICMAKTQYSFSHVPSMKGAPTGFVLPIRDVRASIGAGFIYPLVGTMSTMPGLPTRPCFYEIDVDTATGKVMGLS

SEQ ID NO: 20638 - DNA, 661 bp, Panicum virgatum
  misc_feature: Ceres CLONE 1812344
  misc_feature: Encodes the peptide sequence at SEQ ID NO. 20639
ctcctcttttttttccattttcctcctcctttgtgttttttaaaaatcctctgcaaggttgctcgttggggatgtagcaacaaaagggggctttggcagcttcttgcgtctcttgctggggttgtgctggtgaaatttggtcctcatgtagatctgtgcactgatgtgcgattcttttgcagtctctgaacccccgacgagcggcggaataggctccaatggggaagtctccggcgaagtggatcaagtccgtgctcttcgggaagaagtcgtcgtcgcggtccaccaccaccaattccaaggatttatcgaagggtgcaagcaacaaagggtatgctggtaaggagcccgcattcgctgagagctccccggtgatctcggagccggtgcttgttagcgcccacaacaatgagaccgtgcgggaggtggctaagggtgagaattccaactcgcaaggcgaagttgcagtgcctgatgtcaatcaagatttggagaagcatgtcactgtggggtctgatgcttccaatgatgctgagaggttgagggaagagcatgcggctgtgaaggcacaagctgcgttccgtggttatctggcacgccgagcattccgtgcattgaaagggatcataagacttcaggctttgattcggggtcatcttgt

SEQ ID NO: 20639 - protein, 147 aa, Panicum virgatum
  misc_feature: Ceres CLONE 1812344
  misc_feature (111)..(131): Pfam Name: IQ Pfam Description: IQ calmodulin-binding motif
MGKSPAKWIKSVLFGKKSSSRSTTTNSKDLSKGASNKGYAGKEPAFAESSPVISEPVLVSAHNNETVREVAKGENSNSQGEVAVPDVNQDLEKHVTVGSDASNDAERLREEHAAVKAQAAFRGYLARRAFRALKGIIRLQALIRGHL

SEQ ID NO: 20640 - DNA, 883 bp, Panicum virgatum
  misc_feature: Ceres CLONE 1812352
  misc_feature: Encodes the peptide sequence at SEQ ID NO. 20641
agccgcgtgcttttcccccgcgccgccgacgcgcgcgccgccgcccgctcgaccccgcacggcccgcctctcctgccggcgccacctctcctgcccggcgccacctgggctccctgcaggtggagaccgagatctccatccgggccgccgccggcgacgatgcgcagcagttcttgcggacgccggctccgcggacgccttcgacaaccactacttccagaacctgctgaagcataagggcctgctctcctccgaccagggcctcttcttcggcgccgacgccggcgccaccaaggcgctcgtgcaggcctacaacgccaacccccagcgcttcctctgcgacttcggccgctccatggtcaagatgggcaacatccgcccgctcagcggctccgccgccagatccgcaagaactgccccgccgtcaactgatctgcaagaactgttgcgcacgtgtgatcgtttgggccgctccccagggaggtcgccagggccggcgagggcggcgcgctgcggttcacgcaccggctcctctccacccgcatgcttctccatctttgccggcaaaacttagttccagttgtagaattgcttcacttaatctcactagaatttcttctaggtgcttaatatgccaatatctgctgtaaaaatttcttatttacttgcctggaattttattcttatacacaggatgaatttaagttggcgtttgatttgctggtagctgaaacatcatttgagggctgcttacaatagatgttctaggagaatcactacctggttgttcatctttaggcaaatgcatggcaccccctataatccgaacctgatataaacatgaatacctttatgcacaatctttgagaagacttggttgctc

SEQ ID NO: 20641 - protein, 190 aa, Panicum virgatum
  misc_feature: Ceres CLONE 1812352
  misc_feature: SWISSPROT Homolog: EC 1.11.1.7 Peroxidase
AACFSPAPPTRAPPPARPRTARLSCRRHLSCPAPPGLPAGGDRDLHPGRRRRRCAAVLADAGSADAFDNHYFQNLLKHKGLLSSDQGLFFGADAGATKALVQAYNANPQRFLCDFGRSMVKMGNIRPLSGSAARSARTAPPSTDLQELLRTCDRLGRSPGRSPGPARAARCGSRTGSSPPACFSIFAGKT

SEQ ID NO: 20642 - DNA, 2597 bp, Panicum virgatum
  misc_feature: Ceres CLONE 1812359
  misc_feature: Encodes the peptide sequence at SEQ ID NO. 20643
aacttcgaacacaacccaccaccccttccgagaggcggaatcctccgcctccgctcgccgtcgagccgccggagggggagattgggtcagatggggacgtcggtgcaggtgacgcctctcagcggggcgtacggagcggcccctgtgctacctgctcgccgtcgacggcttccgcttcctcctcgactgcggatggaccgacctctgcgacacctcgcaactccagcccctcgccaaggttgcaccaacaatagatgctgttcttttgtcacatcctgacatgatgcatctaggagctttgccctatgctatgaaacatcttggactctctgcaccagtgtatgcaacagaacctgtgtttagacttggacttttgaccatgtacgatcattttctttctcgatggcaagtctcagactttgacttgtttactttggatgatgttgatgctgcattccaaaacgttgtgagattgaaatactcacaaaattaccttttgaatgataaaggtgaaggaattgttattgctccacatgtggctgggcatcttttggggggtacagtgtggaagataacaaaagatggagaagatgttgtgtacgctgttgacttcaaccatcggaaagagatgcatttgaatggtaccgttcttggatcttttgtgcggccagctgttctgataactgatgcttacaatgctttgaacaatcaaggctacagaaaaaagcaggatcaagatttcattgattcattagttaaagttctggcaagtggtggaagtgtgttacttcctgttgatactgctggtagggtgttggaacttcttttgatattggataagtactggggtgaccggcgtctggagtaccctatctactttcttacaaatgtttctacaagtactatcgactatgtcaagagttttcttgaatggatgggtgatcagatcgcaaaatcttttgaaagcagtagagctaatgccttcttgttaaaaaaggtcacacttataattaacaaagaagagcttgaaaaattgggagatactccaaaggtggttctggcgtccatggcaagtttggaggttggcttttctcatgccatatttgttgagatggcaaatgaagcaaggaatctagtgctctttactgagaagggacagtttggtacacttgctcgaatgcttcaagtggacccaccccctaaagctgtgaaggtcactatgagcaagcgaattcctttggtgggtgatgagctaaaagcttatgaagaagaacaggaacggataaaaaaggaagaagcaataaaggctagccttgtcaaagaagaggaactaaaggcttcgcatggaccaaatgcgaaggcttctgacccaatggtcattgatacaagttcatctcgtaaatccgccaaggccggttcacattttggtgggaacaatgatattctcattgatggatttgtccctccttcaaccagtgttgctccaatgtttcccttctttgaaaatactgctgaatgggatgactttggcgaggtcatcaatcctgatgattatacgatgaaacaagaagaaatggatagtactttgatgcttggtcctggagattgtttagatggtaaaattgatgatggctcagcacgtctgcttcttgattcaacaccctcaaaagttatttccaatgagatgacagttcaagtgaaatgctcattggtttatatggactttgaaggtcgctctgatgggcgttctgtgaagtcagttatagctcatgtggctccactgaaacttgttctggtgcacggatcagcggaagctactgagcatttgaaaatgcattgtgcaaagaatttagactcacatgtttatgctcctcagattgaggaaacaattgatgtaacatcggatttatgtgcctataaggtccaactttcggagaagttaatgagtaacatcatttgtaagaagttgggtgagcatgaaattgcttgggtggatgcagaagttggaaaggaagatgagaagcttgttttgcttcccccgtcatcaatgccgccgccccacaagccagttcttgtgggtgatttaaaattgtctgattttaaacaatttctggaaaataaaggttggcaggttgaattttctggtggtgcattatggtgtggcgaacacatcacggtgcgcaagattggtgattcccagaagggcagcactggttctcagcagatcgtgctcgagggccccctgtgcgaggactactacaagatccggaagcatctctactcgcagttctacttgctgtgaggccgaccgtgcgggtgctccgtttatcctggtatgcgccgctgcaacgcagtcgggttgtgcaagtgatgagtgaatggactgagggaagctgatgttgtggtggtccgggagccccctgtgttggtggtagatctaatgggacatttggaaccttacgcgtgagtgtttaatggacatgcctggttgtagccctgctaatgggttggaacccgcaccatacccaaccccacccaaaattaacatatatagatacccaaccccacccaactcaattagttaatttcttaactct

SEQ ID NO: 20643 - protein, 673 aa, Panicum virgatum
  misc_feature: Ceres CLONE 1812359
  misc_feature (469)..(511): Pfam Name: RMMBL Pfam Description: RNA-metabolising metallo-beta-lactamase
MMHLGALPYAMKHLGLSAPVYATEPVFRLGLLTMYDHFLSRWQVSDFDLFTLDDVDAAFQNVVRLKYSQNYLLNDKGEGIVIAPHVAGHLLGGTVWKITKDGEDVVYAVDFNHRKEMHLNGTVLGSFVRPAVLITDAYNALNNQGYRKKQDQDFIDSLVKVLASGGSVLLPVDTAGRVLELLLILDKYWGDRRLEYPIYFLTNVSTSTIDYVKSFLEWMGDQIAKSFESSRANAFLLKKVTLIINKEELEKLGDTPKVVLASMASLEVGFSHAIFVEMANEARNLVLFTEKGQFGTLARMLQVDPPPKAVKVTMSKRIPLVGDELKAYEEEQERIKKEEAIKASLVKEEELKASHGPNAKASDPMVIDTSSSRKSAKAGSHFGGNNDILIDGFVPPSTSVAPMFPFFENTAEWDDFGEVINPDDYTMKQEEMDSTLMLGPGDCLDGKIDDGSARLLLDSTPSKVISNEMTVQVKCSLVYMDFEGRSDGRSVKSVIAHVAPLKLVLVHGSAEATEHLKMHCAKNLDSHVYAPQIEETIDVTSDLCAYKVQLSEKLMSNIICKKLGEHEIAWVDAEVGKEDEKLVLLPPSSMPPPHKPVLVGDLKLSDFKQFLENKGWQVEFSGGALWCGEHITVRKIGDSQKGSTGSQQIVLEGPLCEDYYKIRKHLYSQFYLL

SEQ ID NO: 20644 - DNA, 1727 bp, Panicum virgatum
  misc_feature: Ceres CLONE 1812370
  misc_feature: Encodes the peptide sequence at SEQ ID NO. 20645
aaggccacaaaatatcgatcatggacatggatagcctgtccctgcaggactacttcagctgcctgctattgcttgctctcctctactccctaaccaaatgtttctacactgcatccgcccgctccagcggccatcgcggcctccggctccccccgagcccatggcagctccctatcatcggcagcctccaccacctggccggcgcgctcccacaccgctcgctgcgccgcctctcgcagcgctacggccccatcatgctcctccggttcggcgaggtgccggtcgtcgtcgtttcctccgctgaggccgccagggaggtcatgaggacgcacgacgtgctgttcgccacgcggccccagctcgcggccatcaacaccctcaccaaggaaggccacgccatcgcgttcacaccgtacggcgagcactggcgccagatccgcaagatctgcgccgtggagctgctcagcgccgcccgcgtccggtcgttccggcccgtccgcgaggaggaggtggcgcggctcgtcggagccgtctcgtcggcgtcaggtaacaattagcttatgaacctcagcgagatgattgcagcgtatgtcgccgacaccgcggttcacgccatcatggggaggcgactcgacgaccgcggcgccttcctcagctacgtcgacgaagccgttcggttggccagtggcttcagcctacctgatttgttcccgtcttcatggatcgctcgagctctgaactggagggaggcgcgtaaggcggaggtgtaccgagagggattgttcaagtttcttgatgctgtgataaccgagcatatggaaagaaagtcgcaagacagcaactcgcaggaagacttgatagatgtcctcctgaggattcgaagccaaggctcatctcagttccttactatgagcataataaaaggtgttgtttttgatcttttctcagctgggactgaaactgctgcaacaacgttgcaatgggccatggcggagttgatgaggaaccctgacatgatgtccagggcgcaagctgaggtaaggggagccttcatgagctgcggaaaggttgtggaggagggattgagagaattgaagtacctgcattggatcatcaaagagaccctgcgcctgcacattcccggcccgctgctgatcccaagagagtgccgagaaacttgcaaggtcctgggctacgatgtgcccaagggtgctatggtgctcgtgaatgcatgggcaatctcgacggatccacattgctgggaggaaccagaaaggttcaagccagagaggttcgagagtgacacaagagacttcaaagggaatgactttgagttcacgccgtttggagccggacgacgtatttgccctgggatgttatttgggcttgctaatgtcgagcttgctcttgcaaaccttctattccattttgattggagcctacctgacagcattcgtcccagtgaactagatatgactgaagatatgggaattacggcaaggagaaaaaaggacctctggttgagagctacagtgtgttcgaatctgccccattagataactatttcaatgtatcatgctaaaaaagacagaattatttcaatgcatgctttgtaatccttggttggccctttgcttcacgctcttgggccatccaattatatatgtactagtctatcaacccattctcctgcacgggctaattagaattaatataagaataaggtc

SEQ ID NO: 20645 - protein, 326 aa, Panicum virgatum
  misc_feature: Ceres CLONE 1812370
  misc_feature (1)..(317): Pfam Name: p450 Pfam Description: Cytochrome P450
  misc_feature: SWISSPROT Homolog: EC 1.14.13.68 4-hydroxyphenylacetaldehyde oxime monooxygenase
MIAAYVADTAVHAIMGRRLDDRGAFLSYVDEAVRLASGFSLPDLFPSSWIARALNWREARKAEVYREGLFKFLDAVITEHMERKSQDSNSQEDLIDVLLRIRSQGSSQFLTMSIIKGVVFDLFSAGTETAATTLQWAMAELMRNPDMMSRAQAEVRGAFMSCGKVVEEGLRELKYLHWIIKETLRLHIPGPLLIPRECRETCKVLGYDVPKGAMVLVNAWAISTDPHCWEEPERFKPERFESDTRDFKGNDFEFTPFGAGRRICPGMLFGLANVELALANLLFHFDWSLPDSIRPSELDMTEDMGITARRKKDLWLRATVCSNLPH

SEQ ID NO: 20646 - DNA, 563 bp, Panicum virgatum
  misc_feature: Ceres CLONE 1812408
  misc_feature: Encodes the peptide sequence at SEQ ID NO. 20647
acacgcttgactcgcactgtgtccacggccatggcggccgcggtctcgccgccgctcctcctcgcagtcctcctcctgaccaccgccggcacaacccaatgccacgggcacaagcgccaccaccaccagactgacggaaccaggaggcccagcaaggctgccgccgaggaatccaggccaccggccgccaccgctcaccacaccatctgccagaagaccccgcactcggcctcctgcctcgcggccgtggcctcgcatctcgacgccgtcgccggcgcgagcgggaaggcggccgaggcgtccgctgtttccgtacagctcctcccgccggacgtgctctccgtcgtgctcgcctccctccgcggcgcggcatccgcgctgacgtcgctctcccccgccatctccacgctctccgtgcgggccgccttccccacgggcgccccgctccgacgcgacgccgcgcaggactgcaaagagcaccacgccgcgtcgctgtcctcgctctcgcgcgccgactcgctgctcgcggagaccgacgacagcgctggccggctcgaaaatcg

SEQ ID NO: 20647 - protein, 177 aa, Panicum virgatum
  misc_feature: Ceres CLONE 1812408
  misc_feature: Useful for making plants with altered carbohydrate content
MAAAVSPPLLLAVLLLTTAGTTQCHGHKRHHHQTDGTRRPSKAAAEESRPPAATAHHTICQKTPHSASCLAAVASHLDAVAGASGKAAEASAVSVQLLPPDVLSVVLASLRGAASALTSLSPAISTLSVRAAFPTGAPLRRDAAQDCKEHHAASLSSLSRADSLLAETDDSAGRLEN

SEQ ID NO: 20648 - DNA, 643 bp, Panicum virgatum
  misc_feature: Ceres CLONE 1812418
  misc_feature: Encodes the peptide sequence at SEQ ID NO. 20649
atctcagctgacagggttacggccgcgcgatgccaccacagcttccgactatcgggtgctccctggggaaggggcttgtggccttctgacgaagatcgaaaaaacatatgaggcagcgggcctctggaccctccccattcttgctggaatgctcttcctcgcagctgacgccctcgcggtccacccgggccaccagactgagaggatctccggaattgctggcgatgtgttagaagatacccctgttgggaggctgaaggtttatgtctattatctccccagccaatacaatattaaactgctgaagaatgatcccaagtgcttaaaccacttgtttgccgctgaaatctttatgcaccgtttcctgttgtccagcgctgttctaactttcaatcctgaggaagcatattggttctacacgcctgtatacacgacatgctatctgactccttcaggtcttcctttgccgttcaagtctcctcgaatgatgctcaccgcaattgatctgattgccactcactggccttattggaatagatcagagggtgcagaccatttctttgtcacaccacatgactttggcgcttgcttccactaccaggaagagaaagcaatcggacggggaatccttcccttgcttcag

SEQ ID NO: 20649 - protein, 213 aa, Panicum virgatum
  misc_feature: Ceres CLONE 1812418
  misc_feature: Useful for making plants with altered carbohydrate content
  misc_feature: Useful for making plants with altered cell wall content and/or composition
SQLTGLRPRDATTASDYRVLPGEGACGLLTKIEKTYEAAGLWTLPILAGMLFLAADALAVHPGHQTERISGIAGDVLEDTPVGRLKVYVYYLPSQYNIKLLKNDPKCLNHLFAAEIFMHRFLLSSAVLTFNPEEAYWFYTPVYTTCYLTPSGLPLPFKSPRMMLTAIDLIATHWPYWNRSEGADHFFVTPHDFGACFHYQEEKAIGRGILPLL

SEQ ID NO: 20650 - DNA, 682 bp, Panicum virgatum
  misc_feature: Ceres CLONE 1812418-R
  misc_feature: Encodes the peptide sequence at SEQ ID NO. 20651
cggcggcggcgaagaaggccgagcagcccggagggctgtacatgaaggtgagcatggacggggcgccatacctcaggaaggtggacctccggatgtacaaggggtaccgggagctcagggaggcgctggacgccctcttcacccagtccttctccgcctccgccggagcgaagggcggcgacggccagcacgccctcgcctacgaggacaaggacggcgatctcatgctcgtcggagatgtgccctgggagtaagtaccatcggatcaacatgttagctctctgtcagatctgaagatgaatgagtgagcagaactctaattgtgagctctctatctttgcagcatgttcatctcttcgtgcaagaagctcaggataatgaatggttctgaggccaggtgaccgctgatgcacaggcagaggctgcaactcatggggtgaatcgaggagcacaggtcgtgcaaaggagctgtgtggcttggagtcttggactctccagtgctgtacaaagagatggttgtttctgaaaccaaggagaaggatctacgaattgtgtatatagttgtttaggctcttagttagccgccttgttttttgagttgtgttttgtatgagcgaaggctgtaaaagaactgaaaaagaaaaaagagaaacttgacttaagtttggtcattttcctctcc

SEQ ID NO: 20651 - protein, 83 aa, Panicum virgatum
  misc_feature: Ceres CLONE 1812418-R
  misc_feature (1)..(83): Pfam Name: AUX_IAA Pfam Description: AUX/IAA family
  misc_feature: The sequence is a functional homolog of SEQ ID NO 648 in the 11/479,226 US patent application
  misc_feature: The sequence is a functional homolog of SEQ ID NO 636 in the 11/479,226 US patent application
  misc_feature: The sequence is a functional homolog of SEQ ID NO 652 in the 11/479,226 US patent application
  misc_feature: The sequence is a functional homolog of SEQ ID NO 739 in the 10/374,780 US patent application
  misc_feature: The sequence is a functional homolog of SEQ ID NO 656 in the 11/479,226 US patent application
  misc_feature: Useful for making plants with modulated nitrogen use efficiency
  misc_feature: The sequence is a functional homolog of SEQ ID NO 2004 in the 10/374,780 US patent application
  misc_feature: The sequence is a functional homolog of SEQ ID NO 660 in the 11/479,226 US patent application
  misc_feature: Useful for making plants with altered terpenoid content
  misc_feature: The sequence is a functional homolog of SEQ ID NO 290 in the 10/412,699 US patent application
  misc_feature: The sequence is a functional homolog of SEQ ID NO 674 in the 11/479,226 US patent application
  misc_feature: The sequence is a functional homolog of SEQ ID NO 2002 in the 10/374,780 US patent application
  misc_feature: The sequence is a functional homolog of SEQ ID NO 644 in the 11/479,226 US patent application
  misc_feature: The sequence is a functional homolog of SEQ ID NO 598 in the 10/666,642 US patent application
  misc_feature: The sequence is a functional homolog of SEQ ID NO 904 in the 11/435,388 US patent application
AAAKKAEQPGGLYMKVSMDGAPYLRKVDLRMYKGYRELREALDALFTQSFSASAGAKGGDGQHALAYEDKDGDLMLVGDVPWE

SEQ ID NO: 20652 - DNA, 1556 bp, Panicum virgatum
  misc_feature: Ceres CLONE 1812424
  misc_feature: Encodes the peptide sequence at SEQ ID NO. 20653
aaactatcagtcttcaccgaaacttgaaagggtgcccgcagtgctctcaccgccgccggagtcgatctgccggcctggtgctcccatgcgcccatcaccgtgttcagtaagcaatacaaaagaagaaaacatggaccataaggaggagatttgtgccgccaagctaactgatgatctagtagtagacatactgtcccggttgccattcaaatctttttgccgttttaaatgcgtatgcaaatcctggcttactttctcgtccgatcctcactactgccagaagctgcccaaagttccagctggttttttctaccaagatagtgacaactctgctgtccagcttgttagtctgtccaaaaatgacgaaggaattgatggaactcttagtttcttgccagattatgaacaactaaaatttattgactgttgcaatggcctagtcctttgtgagtaccggagcaaccatacttctccagacattcttcgcttcattgtgtgtaacccggcaacacgagagtggagaatacttcctgatactcaacgagatgcagacaacttctattacaaaacaatgttgggctttgatccatcaagatcaccacacttctgtgtcttcaacttccacgagaagcgtggcactggcaatcttgtgcttggtaccaggcgagttgagatgttttcgtctcgcaactccctgtggcttgtgaattctgatttgtgggatcctgagaataatacgatatcggtttctgtgagaccacacgtgttccttgatggattcttgtattcacattcagatcttgatgttttggtgttggaggacgtggtggcagaggcagaaaacattggcgtcccaccctctaattggacaattaagttgccactccacaggatcgactgtatggcggatcattgcttcagaggttgccttggtcaattttcaggtatgttacactatgcagtggcagaggaggatggtcacacagttctcatatggagttatgctgatggtaatcctcatggatggactgttgagcatagacttagtatgagaaatgcattaggaagggatgactttgttcactatgaggatggctggatttggacttgtaattatgaaattattgcttttgacctggaaagggaggttcttttcctcatcgatgaaacgacaaataagcttctttcctacggaatcagcactaggaaggttgatgagattaaagatggctcccactggtatatgtactatgttccctgctactcaaagcttccagaccaggaaccttactgaagagtgaagatgtagtgagtggcgtgtttcactacttcaattttgaccctatcccccatcagtattcgtactcatgatttctgccactcatcagcatgaacaagtgttgcaggctgctattttgaaaattaagaacttcctctgtttcttttcttttaagatgctacaggtagtggtatgttaatgtactaactaacctgggaagctatgtaatgtaagaaaaaccatcaccagattccagtccatggtcttgtatgctctt

SEQ ID NO: 20653 - protein, 387 aa, Panicum virgatum
  misc_feature: Ceres CLONE 1812424
  misc_feature (7)..(54): Pfam Name: F-box Pfam Description: F-box domain
MDHKEEICAAKLTDDLVVDILSRLPFKSFCRFKCVCKSWLTFSSDPHYCQKLPKVPAGFFYQDSDNSAVQLVSLSKNDEGIDGTLSFLPDYEQLKFIDCCNGLVLCEYRSNHTSPDILRFIVCNPATREWRILPDTQRDADNFYYKTMLGFDPSRSPHFCVFNFHEKRGTGNLVLGTRRVEMFSSRNSLWLVNSDLWDPENNTISVSVRPHVFLDGFLYSHSDLDVLVLEDVVAEAENIGVPPSNWTIKLPLHRIDCMADHCFRGCLGQFSGMLHYAVAEEDGHTVLIWSYADGNPHGWTVEHRLSMRNALGRDDFVHYEDGWIWTCNYEIIAFDLEREVLFLIDETTNKLLSYGISTRKVDEIKDGSHWYMYYVPCYSKLPDQEPY

SEQ ID NO: 20654 - DNA, 1518 bp, Panicum virgatum
  misc_feature: Ceres CLONE 1812427
  misc_feature: Encodes the peptide sequence at SEQ ID NO. 20655
aaagccgccgtcacaagaggccgcgcacggcacccccagctagcccccgccgcgccatgtcccgcctcgacgcggcctcgctcctcttccccgcctggccgtggccgccgcgggccaagccccacccccgcggccgcctcctgtgcctcggcctctccgccacgctctcgcctccctcgcgctccgacccgcgcccaccccgggccccaactacggcgcgctcttcctctccctcggctccaacgacaccgccgccgcgcacctccgcgcgctcaccctccacccgcacgtcgcgggcaccagggccaactccctcgccgcccgctacgtgcgcgacgcgctctccttccccgcccacgtcacgccctactccgtgctcctctcctaccccgtccaccgctccctctccctctccgcgccgggccgcggcgccacctccttcgccctgaggcaggagacctaccggggcgacccctacgcggccgccgcggcggaggccatcccgacgttctacgcgtacgccgcgtccgggtcggtctccgcggaggccgtgtacgccaactacggccgcgaggaggacttcgcctacctcgccgcccgcggcgtccacgtcgcgggcaaggtcgcgctcgcgcggtacgagaggatccactgcgaggacatcgcgcacaacgcgcgcgccgcgggcgccgcgggcgccgtggtgtacacggacccgctccagtacggcggcgcccccggggaggcgccgttcccggactcccggtggctgccgcccagcggcgtgaaggtgggcagcctgttccgtggcgtgggcgacccgaccacgccgatgtgggcgtcgtccgacggctgcgagcgcctcagcgtggaggaggccatgcgcaccgacgacatgccgctcatcccggcgctgccggtgtcggcgcgcgacgccatggagatacacggcgccatcggcggggccgtggcgccgccgggctggcagggccgggaggacagccccgtgtaccgcctcgggcccgggccggcggttctgaacctgacgtatcttgggaacgatacaatggcaacgatcgagaatgtctttgccatcatcgaaggcgctgaagagccagataggtatgttattctgggtaaccatcgtgatgcttggacatttggagcatccgaccccaacagcggaactgcagctatgattgagttagctcaaaggttttcggtgatgcaaaagcaaggttggagacctcgacgaaccgttatcttctgtagctgggatgcagaagaatatggattgacaggatcgactgaatgggttgaagaaaaccaggagatgctatcttctagagctgttgcttatcttaatattgacgtttcagtcattggcccaggattcctgccgtctacaactccccaacttgatgagttgcttcaggaaataactaaagtggttcaagatcctgacaattcatctcagtctgtatatgattcatggatcaaaccaatggttctccaaag

SEQ ID NO: 20655 - protein, 228 aa, Panicum virgatum
  misc_feature: Ceres CLONE 1812427
  misc_feature (97)..(219): Pfam Name: Peptidase_M28 Pfam Description: Peptidase family M28
  misc_feature: SWISSPROT Homolog: EC 3.4.17.21 Glutamate carboxypeptidase II
  misc_feature: Useful for making plants with modulated flowering time
MWASSDGCERLSVEEAMRTDDMPLIPALPVSARDAMEIHGAIGGAVAPPGWQGREDSPVYRLGPGPAVLNLTYLGNDTMATIENVFAIIEGAEEPDRYVILGNHRDAWTFGASDPNSGTAAMIELAQRFSVMQKQGWRPRRTVIFCSWDAEEYGLTGSTEWVEENQEMLSSRAVAYLNIDVSVIGPGFLPSTTPQLDELLQEITKVVQDPDNSSQSVYDSWIKPMVLQ

SEQ ID NO: 20656 - DNA, 1177 bp, Panicum virgatum
  misc_feature: Ceres CLONE 1812444
  misc_feature: Encodes the peptide sequence at SEQ ID NO. 20657
gtgtgccgtggtgcaagcctttttggttcgcaggcttcttccccgtgcaggtgtctgctcctgctctcccagggccgcagaactgaagcacggagagagcgagagacggagaagatgagggagatcatcagcatccatatcgggcaggcgggcatccaggtggggaattcatgctgggagctctactgcctcgagcatggtatccagcctgatggcctcatgcccagtgacacctctgttggggttgcgaaggatgcattcaacacgttcttcagtgaaacgagcgcggggaagcacgttccgagagccttgttcgttgacttggagcccacagttatcgatgaggtgaagactgggatatatcgccagctcttccatccggagcagctcatctcccacaaggaagacgctgcgaacaactttgcccgtggacattacacagttggaagagaagtaatagatctctgccttgatcggataagaaaattggcagacaactgcactggtcttcaaggctttctagttttcaatgctgttggtggtggaactggctctggacttggttcgttacttttagagcgtctatcagttgattatggtaggaagtcgaagcttggattcaccatctatccttcaccgcasatttcaactgctgttgttgagccttataatagtgtgctctccacacattccctgattgaacacactgatgtcgttgtgcttcttgacaatgaagctatctatgacatatgcaagagatcccttgacattgagcgcccaacatataccaatctgaacaagctcatatctcaagttatatcatctctgaccacctcgctgaggtttgatggagctattaatgttgacataactgagttccagaccaaccttgtgccttatcctcgaatacactttatgctctcttcttatgctccgattatctcagtggagaaggcctaccatgaacaacactctgttcctgagatcacaaattctgtgtttgagccatcaagtgtgatggcaaaatgtgaccccaggcatggtaagtacatggcatgctgtttgatgtatcgtggcgacgttgtgccaaaggatgtgaatgctgctgtccattcaatcaagaccaagagagcagtgcagttcgtggattggtgtcctactggattcaaatgcggga

SEQ ID NO: 20657 - protein, 354 aa, Panicum virgatum
  misc_feature: Ceres CLONE 1812444
  misc_feature (49)..(246): Pfam Name: Tubulin Pfam Description: Tubulin/FtsZ family, GTPase domain
  misc_feature (248)..(354): Pfam Name: Tubulin_C Pfam Description: Tubulin/FtsZ family, C-terminal domain
  misc_feature: Useful for making plants with altered cell wall content and/or composition
  misc_feature (176)..(176): Xaa is any aa, unknown, or other
MREIISIHIGQAGIQVGNSCWELYCLEHGIQPDGLMPSDTSVGVAKDAFNTFFSETSAGKHVPRALFVDLEPTVIDEVKTGIYRQLFHPEQLISHKEDAANNFARGHYTVGREVIDLCLDRIRKLADNCTGLQGFLVFNAVGGGTGSGLGSLLLERLSVDYGRKSKLGFTIYPSPXISTAVVEPYNSVLSTHSLIEHTDVVVLLDNEAIYDICKRSLDIERPTYTNLNKLISQVISSLTTSLRFDGAINVDITEFQTNLVPYPRIHFMLSSYAPIISVEKAYHEQHSVPEITNSVFEPSSVMAKCDPRHGKYMACCLMYRGDVVPKDVNAAVHSIKTKRAVQFVDWCPTGFKCG

SEQ ID NO: 20658 - DNA, 2278 bp, Panicum virgatum
  misc_feature: Ceres CLONE 1812450
  misc_feature: Encodes the peptide sequence at SEQ ID NO. 20659
cttttccagttcccattgtcaccacctctcccttcacctctgcttccctctctctatataaaccaaaccccaaaagtgccatttcattcgcattcggcagctaccacaggtttgtcgacgcatcgggagaaggcatggccaggatcagagaggtggccgccaggggagagatgccgggaggcgatggcgcggcggcggcggcggtggagaaggcggtgaggtgcctcggcaggggggtcgacatggcgggcgacctgaggctgaagcactgcaaggatgctgggggctgcctggtcctgaggagcggcgagaagaaggcggcggcggcgaaggtcgtcgtgcctggcttcggggtcgccgccgatgtgcccgccgacgtcaagtgcggcaagggcgatcgcatcaggttcaagtccgacgtgctcgagttcaacaagatgtctgaggtgttcaaccaccggaattcgctgacggggaagatcccgtcggggctcttcaactcgtgcttcgacctggaatatagctcatgggctgaggacgcctccgccaccaagtgcttggcgttcgacggctacttcatctccctcctcgacctccggctcgactgccagccgctcgccctcgccgaccacatcgtccgtgccgtcccggcggcatgggacccgtcagccattgcaagtttcatcgagaagtacggaactcacatcgttgttggactaagcttgggtggccaggatgtggtgtatgtgaagcaggacaactcgtctccactgtccccatctgagatcaaagagcacttggacacgctaggcgaccagctgttcaccggggcatgcactctgccccattcaaaccgcaaatccagggaccacaaaattaaggttcctgaggccttcaatgtatttggtgcccatgtgacacagcaaaggcttgaaggaatgattgctccagtgtcctgcaaagagggtgtgacagtcatacactccaagaggggaaggaacacagcagcgagtgaccactcagagtggctgctcactgtggtgacaatgccggaagcaatcaacttcaagcttgtgcccatcacatcccttctcaagggagtaactggtgtaggcttcctgtctcatgccataaacctatatctcagatataaacctcgaatagaagaactgagctacttcctggacttccagcaccacagattgtgggccccagtactcagtgacctaccacttggtccctgctcaaaccgacaaggtgctagcccggccctgcacttcagccttgtcggttcaaagctgtacgtcagctcaagcgaggtgattgttccaagattaccggtcaccggcatgagattgcatctggagggccagaaaaacaatcgactaggcatccacctgcagcatctgtcgaacaccccaacgttcatcgacgcaagatcagccaagcagccggtatggcgcggatcagagacgatctccgacgagcggtactacgagccggtccagtggagaatgttcgcccatatctgcacggtgccggtgaagtacgaccctcgctgggacagcgccgccgccggcggctcgccggcggcgtacgtcgtctccggcgctcagctgcacgtcaaggctcacgactcgaccaacatactccacctccggctcctgtacgccgagctgccggggcacacggtggtgcgctccagatgggcgcacaacacggtgaggctttcgggcaagacgagcttcctgtccatgtcgttcgcggcgtcttcgggcgccgccggcgaggagcagcggcagccggcgagggttcacatcgactccggtgtgttcgccggagggccacccgtgcccgtcggggcccagaggctgctcaagtttgtcgagacgtctcaggtgaccatggggcctcaggacagtcctggatactggctggtcaccggcgccaagctggatgttgagaaggggaagatctccctccacgtcaagttctccctgcttgctccagtttcttgacgtggttctagaagaactttttttttttggagcatcaggttctggaagaactgtacagtactctgctgctaggagaaaagtaggggattccttgtcgccattcaccttctcatttttgtcacagaaccatatctgcagaatgccaaaagtagggcattctttgtgcagtaatggtaataaacatgagtgatagaattacctacaaatcgtaggaatactatcatggcctaagatatatgcaagcatataacctgctactt

SEQ ID NO: 20659 - protein, 627 aa, Panicum virgatum
  misc_feature: Ceres CLONE 1812450
  misc_feature (139)..(338): Pfam Name: MACPF Pfam Description: MAC/Perforin domain
MARIREVAARGEMPGGDGAAAAAVEKAVRCLGRGVDMAGDLRLKHCKDAGGCLVLRSGEKKAAAAKVVVPGFGVAADVPADVKCGKGDRIRFKSDVLEFNKMSEVFNHRNSLTGKIPSGLFNSCFDLEYSSWAEDASATKCLAFDGYFISLLDLRLDCQPLALADHIVRAVPAAWDPSAIASFIEKYGTHIVVGLSLGGQDVVYVKQDNSSPLSPSEIKEHLDTLGDQLFTGACTLPHSNRKSRDHKIKVPEAFNVFGAHVTQQRLEGMIAPVSCKEGVTVIHSKRGRNTAASDHSEWLLTVVTMPEAINFKLVPITSLLKGVTGVGFLSHAINLYLRYKPRIEELSYFLDFQHHRLWAPVLSDLPLGPCSNRQGASPALHFSLVGSKLYVSSSEVIVPRLPVTGMRLHLEGQKNNRLGIHLQHLSNTPTFIDARSAKQPVWRGSETISDERYYEPVQWRMFAHICTVPVKYDPRWDSAAAGGSPAAYVVSGAQLHVKAHDSTNILHLRLLYAELPGHTVVRSRWAHNTVRLSGKTSFLSMSFAASSGAAGEEQRQPARVHIDSGVFAGGPPVPVGAQRLLKFVETSQVTMGPQDSPGYWLVTGAKLDVEKGKISLHVKFSLLAPVS

SEQ ID NO: 20660 - DNA, 644 bp, Panicum virgatum
  misc_feature: Ceres CLONE 1812456
  misc_feature: Encodes the peptide sequence at SEQ ID NO. 20661
aggcgccgatcgagctcgccgctgtaaccaccgtgacagcccagtacacgcacacgagcagtccgtgctccgacgacgactccggcatcaatggcggcggccgttattggaggcgagtcgtcactgatgcagcggtgcaagccgtacgtggcgatggtgtcgctgcagttcgggtacgccggcatgaacgtcatcaccaaggtgtctctcaaccacgggatgagccactacgtgctcgtcgtctaccgccacgccttcgccacgctctccatcgcgcccttcgcgctcgcgctcgagcgcaaggtccgccccaggatgacgccctgggtcttcctccagatcttcgtcctcgctctgctcgggccggtgatcgaccagaacttctactacgcggggctcaagttcacctcgcccaccttctcctgcgccatgagcaacatgctcccggccatgaccttcatcatggccgtgctcttcaggatggagaaggtgaacctgaagaaggcgaggtgcgtggccaaggtggtgggcacgctcgtgacggtggccggcgccatactcatgacgctctacaagggccgcgccgtcgagatggtctggaccaagcacgtgcacctccacgacccgcacccggccgccgccgc

SEQ ID NO: 20661 - protein, 184 aa, Panicum virgatum
  misc_feature: Ceres CLONE 1812456
  misc_feature: Useful for making plants with modulated biomass
  misc_feature: Useful for making plants with modulated flowering time
MAAAVIGGESSLMQRCKPYVAMVSLQFGYAGMNVITKVSLNHGMSHYVLVVYRHAFATLSIAPFALALERKVRPRMTPWVFLQIFVLALLGPVIDQNFYYAGLKFTSPTFSCAMSNMLPAMTFIMAVLFRMEKVNLKKARCVAKVVGTLVTVAGAILMTLYKGRAVEMVWTKHVHLHDPHPAAA

SEQ ID NO: 20662 - DNA, 1913 bp, Panicum virgatum
  misc_feature: Ceres CLONE 1812458
  misc_feature: Encodes the peptide sequence at SEQ ID NO. 20663
agacgcaaagcgtacgctggccactgaaagccagacttcgaaagcatgccaccaccatggactgactagctagcagctgtcggttctttatctcaattcgtcactcgtcaggaccacggggtcgcctgtccatttcgtacaatttccgtgcagagcagcagcaagtctggatggaagctggggtcgaagctccaggccggggatccatggggaagaagaagacgttcgtgctctacccgtcgctgggcgtgggccacctgatccccatggtggagctggccaagcacctcctccgccgcggccacggcgcgctcatcgccgtggtcgacccgcccgacgccgaccccgcgtcggccgccgcggtggcgcgcctcgcggcggccaacccggccatcgcgttccgcctcctgccagcgccggccagccccgacgccggcgcgcacccggtgaagcgcaaccacgacacgctcgcgctcgccaaccccgcgctgcgggacctcctccactcgctgcccgcggtccacacgctcctgctcgacatgttctgcgtcgacgcgctagacgtcgcggcggagctcggcgtcccagcctacttcttcttcgcctccgcggccggggacctcgccgtcttcctcaacctgccgtacctctaccccacactcccgtcgttcagggagatgggcaggacgctcgtgcgctgccccgggatgccgccgatccgggcgctggacatggtgatcacgatgcaggacaaggagagcgaccagaccaaggttcggctgtaccagttcaagcgcatcccggagggcagcggcgtgctggtcaacagcttcgattggttggagcccagggccctgaaggcgctcagggacggcgtctgcgtgcccggccggccgacgccgagggtctactgcatcggcccgctggtcaacaacgggaggaagggaggagagagcggcgagacgcacgagtgcctcgcgtggctggacacgcagccggagcggagcgtcgtgttcctctgcttcgggagcaagggcgccttctccgccgcgcaattgcaggagattgcccgcggattggagagctccggccaccggttcttgtgggctgtgaggagcccgccggaagaaggtgatcggtatcccgaaccggacttggagcggctgctcccggcggggttcctggagaggacgaagggcaggggaatggtggtgaaaaactgggtcccgcaggcggaggtcgtgcagcacgaggcggtcggcgcattcgtgacgcactgcgggtgggactccgcgctcgaggcgatcatgtccgggctgccgatgatatgctggccgctgtacgcggagcaggggatgaacaaggtgttcatggtggaggagatgaagatcgcggtggagatgcagggatacgaggagcttgtcagcgcggaggaggtggaagccaaggtgaggctggtgatggagaccgaggaagggaaggtccttcgggagaggctcgcggtggctagggagaaggcattggaagctaccaaggaaggcggttcctctgaagtggcactcgccgagttcttgagagatttggagaagaagagcagctacggagggggagaacgcccctgatcagctgactcctcagtgctatacttaaggaccagtttgttggcaaaagaaccgccacaggtatgctagatgcaggaggtcatttgattgtcaactgttaactttctgaatcaagtcgccgattattgtgcttatctcgtatagcatattgtgatttgtgctgaatgttttactgagtaaagcttgcagtttttcattagccccagcttggaaggggcagctactacatactacatttgtgccaattcttacttcgatgttctggaacgattttctgcttgcactcggttt

SEQ ID NO: 20663 - protein, 471 aa, Panicum virgatum
  misc_feature: Ceres CLONE 1812458
  misc_feature (6)..(463): Pfam Name: UDPGT Pfam Description: UDP-glucoronosyl and UDP-glucosyl transferase
  misc_feature: SWISSPROT Homolog: EC 2.4.1.218 Hydroquinone glucosyltransferase
  misc_feature: Useful for making plants with altered carbohydrate content
MGKKKTFVLYPSLGVGHLIPMVELAKHLLRRGHGALIAVVDPPDADPASAAAVARLAAANPAIAFRLLPAPASPDAGAHPVKRNHDTLALANPALRDLLHSLPAVHTLLLDMFCVDALDVAAELGVPAYFFFASAAGDLAVFLNLPYLYPTLPSFREMGRTLVRCPGMPPIRALDMVITMQDKESDQTKVRLYQFKRIPEGSGVLVNSFDWLEPRALKALRDGVCVPGRPTPRVYCIGPLVNNGRKGGESGETHECLAWLDTQPERSVVFLCFGSKGAFSAAQLQEIARGLESSGHRFLWAVRSPPEEGDRYPEPDLERLLPAGFLERTKGRGMVVKNWVPQAEVVQHEAVGAFVTHCGWDSALEAIMSGLPMICWPLYAEQGMNKVFMVEEMKIAVEMQGYEELVSAEEVEAKVRLVMETEEGKVLRERLAVAREKALEATKEGGSSEVALAEFLRDLEKKSSYGGGERP

SEQ ID NO: 20664 - DNA, 1239 bp, Panicum virgatum
  misc_feature: Ceres CLONE 1812464
  misc_feature: Encodes the peptide sequence at SEQ ID NO. 20665
gccccccgcgccgtccgcgtttcggtgccatcgccattcgcggatttctttggaggaaaaggcaagcaagcgaagcggcgggcgccgaaatactccacagataccactcacctaccgctccaatccgcccatccaccgggcagcggaaagcttatcaccctccctccctctccctccccgcatttcccttcctcccctcctccctcgccgcacagcgccaggaggccgccgccgggaggtgtgtctctgtctccctctccgctggatcctccggcctctcgccgtcttctgaaggggagatccggccgctcgggcgtcggctgggttctttttctgctggagcaggaagctggcatcctgccatgtcgtcgcctatggcctcccctactctgaaggatcatctctctgcgcccacaggccccttgcatctcaaagtatgggaggtcgtatgcattgccctaggagttttcatggtggtcgtcttctttgttgctgtgtggcttacaatccggagtaagaaaagggtaagacgggcctccgcgaatatcccgatcacccaaattccagcgatttccaaggaaatcaaggaggtgagggtggagcaagtgccagcaagcgacttcgcagcccatgatggggtcctcatgacgatccaagacaagtctagcgaccgagattcagacaaggtcatggcccatctgggtgttagcaaatcgaggcgtggtgatgagagccactcagggtcgttccgctacatggacaaggatgcaggattccaatcagctgaggaagggggctcagggacgttccatcaggcttcagctcatgcaataactgccccttcacctctggttggtctgccagagttctcataccttggttggggtcattggttcacactgagggatctggaacttgctaccaatcgcttttcaaaggacaacattatcggcgagggtggatatggtgtagtttatcgtggccagctaatcaatggttctcctgtcgctgtcaaaaagcttctcaataacctaggtcaagctgagaaggaattcagagtagaagttgaggctattggtcatgttcgccacaagaatttggtccggcttctgggttattgtgtggagggtactcaaaggatgcttgtctatgagtatgtgaacaatggtaacctagagcaatggcttcatggagctatgagtcagcgtggctcccttacatgggaggcccgaataaaga

SEQ ID NO: 20665 - protein, 288 aa, Panicum virgatum
  misc_feature: Ceres CLONE 1812464
  misc_feature (186)..(287): Pfam Name: Pkinase_Tyr Pfam Description: Protein tyrosine kinase
  misc_feature: SWISSPROT Homolog: EC 2.7.11.1 Non-specific serine/threonine protein kinase
MASPTLKDHLSAPTGPLHLKVWEVVCIALGVFMVVVFFVAVWLTIRSKKRVRRASANIPITQIPAISKEIKEVRVEQVPASDFAAHDGVLMTIQDKSSDRDSDKVMAHLGVSKSRRGDESHSGSFRYMDKDAGFQSAEEGGSGTFHQASAHAITAPSPLVGLPEFSYLGWGHWFTLRDLELATNRFSKDNIIGEGGYGVVYRGQLINGSPVAVKKLLNNLGQAEKEFRVEVEAIGHVRHKNLVRLLGYCVEGTQRMLVYEYVNNGNLEQWLHGAMSQRGSLTWEARIK

SEQ ID NO: 20666 - DNA, 1461 bp, Panicum virgatum
  misc_feature: Ceres CLONE 1812473
  misc_feature: Encodes the peptide sequence at SEQ ID NO. 20667
aagaaaattaaatcaaaaggaaaacctcacgtaatcacgttcaaccactcgtcttaaaagttccactggtgtggaaagtgaggaacgcgctctctgcagtctgcccacctctggctctggcagtcaaagcggggggcccctatttgttgcggggaaggttggcaggtccgtgccccgcgacgcgagcccgcggccgaaatttcacgcaaccaaaccaaaccccaaggccaaaccggaggagagaggtagcagcaaagcgagcgcggggcggcggccggcaccgggcggcggcaatgtcggcgctgcagagctggcgcaaggcgtacggcgcgctcaaggactccaccaccgtcagcctcgccaacctcaactccgacttcaaggatctcgatgtggcgatcgtgagggccaccaaccacgtggagaacccgcccaaggagcgccacctgcgcaagattgtggcggcgacctccatcgcgaggccccgggcggacgtcgcctactgcatccatgcgcttgcccggcgactagccaagacacggaattggatcgttgccctgaagacacttgtggtgattcataggcttctccgcgaaggtgatcctgcattccgtgaagagtttcttacgtttacacagagagtgcggattttgcagctatcaaacttcaaggatgactccagccctgttgcttgggattattcttcatgggttcgcacatacgggttgtttttagaggaaaaactagaatgcttcagggtcttgaagtatgacattgaagctgagtgtttgcccaaacaaggtcaaggacctgaaaagggccacagtagaactagagaattaaattctgaggacttgctggagcaattgccggcgctgcagcaattattatatcgacttattggatgtcggccagaaggagccgcaaataacaattatctggtgcaatatgctctagctctggttcttaaagaaagtttcaaaatttactgtgcgataaatgatggaattatcaaccttgttgataagtttttcgagatgccaaggcacgaagcactcaaagctgttgacatttacaggagggctggccagcaggctggaagcctatctgacttctatgaaagttgtcggagcttagagcttgcaagaaatttccagtttcccactctgagggagccaccacaaacattcctttcaaccatggaggagtatgtgaaggaggctccacgaattgtaccagttacagagccactggagcttcctgagcgacttcttctgacatataaaccggaagaagcagaaaaagctcctgagcctgttcctactgtagaggaaaaaccacaagttgttgaagaacctgctccagtatcatcttcttctgaaatagcatcacctcctccccagcctgagatcgcagatactggtgatttactggggttaagtgatccaaacccatctgtgt

SEQ ID NO: 20667 - protein, 389 aa, Panicum virgatum
  misc_feature: Ceres CLONE 1812473
  misc_feature (29)..(310): Pfam Name: ANTH Pfam Description: ANTH domain
MSALQSWRKAYGALKDSTTVSLANLNSDFKDLDVAIVRATNHVENPPKERHLRKIVAATSIARPRADVAYCIHALARRLAKTRNWIVALKTLVVIHRLLREGDPAFREEFLTFTQRVRILQLSNFKDDSSPVAWDYSSWVRTYGLFLEEKLECFRVLKYDIEAECLPKQGQGPEKGHSRTRELNSEDLLEQLPALQQLLYRLIGCRPEGAANNNYLVQYALALVLKESFKIYCAINDGIINLVDKFFEMPRHEALKAVDIYRRAGQQAGSLSDFYESCRSLELARNFQFPTLREPPQTFLSTMEEYVKEAPRIVPVTEPLELPERLLLTYKPEEAEKAPEPVPTVEEKPQVVEEPAPVSSSSEIASPPPQPEIADTGDLLGLSDPNPSV

SEQ ID NO: 20668 - DNA, 1299 bp, Panicum virgatum
  misc_feature: Ceres CLONE 1812488
  misc_feature: Encodes the peptide sequence at SEQ ID NO. 20669
gactcgaacgggcggagcccccctcctcaaaggcagctcgtctctctctctctctcgcctcgcgcagaccaagagccccccccccccccccccaaaagcgaaccagcaaaccccccgcggcggcgctaggttttgcggctccccgcggcagcagcggcaccgccaccggcagcggcagcggcagcggcgatggcggggcaggagcggaggacgatcgatctggaggagggatgggccttcatgcagaagggcatcaccaagctgaagaacatcctcgagggcaagcccgagccgcagttcagctccgaggactacatgatgctctacacgacgatatacaacatgtgcacgcagaagccgccgcacgactattcgcagcagctctacgacaagtaccgcgagtccttcgaggagtacatcacctccatggtactaccttcgttaagggagaagcatgatgagtttatgttgagggagctagtgcaaaggtggtcaaaccataaagtcatggttcggtggctctcacgcttctttcattaccttgatcggtacttcatctcaagaaggtcacttaccccacttaaagaagttgggcttacttgcttccgagagttgatttatcaagagattaaaggacaagtaaaagatgcagtgatagctctgatagacaaagagcgtgaaggtgaacagattgacagggctttattgaagaatgtcctggacatatttgttgaaattggactgggtcaaatggattgttacgagaatgactttgaagacttcttgcttaaggatactacagagtactactctgtcaaggctcaaagctggatccttgaggactcctgtccagattatatgatcaaggctgaggagtgtttgaagcgggagaaggagcgagttggtcactatttgcatattagcagtgaacagaagttattggagaaaatgcaaaatgaattgcttgctcaatatgcaactccgctgttggagaaagagcattctggatgttctgctttgcttcgtgatgataaggttgaggatctttctaggatgtacaggctcttctccaaaatcacccgtggcctggaacctatttctaatatgttcaaaacgcatgtcacgaatgagggtacagccttggtcaagcaagcagaagattctgctagtagtaagaagccagagaagaaggatatggttggcatgcaggaacaggtctttgtgtggaaaatcatcgagttgcatgacaaatatgtggcttatgtgacagattgtttccagggccatacactctttcat

SEQ ID NO: 20669 - protein, 369 aa, Panicum virgatum
  misc_feature: Ceres CLONE 1812488
  misc_feature (15)..(356): Pfam Name: Cullin Pfam Description: Cullin family
MAGQERRTIDLEEGWAFMQKGITKLKNILEGKPEPQFSSEDYMMLYTTIYNMCTQKPPHDYSQQLYDKYRESFEEYITSMVLPSLREKHDEFMLRELVQRWSNHKVMVRWLSRFFHYLDRYFISRRSLTPLKEVGLTCFRELIYQEIKGQVKDAVIALIDKEREGEQIDRALLKNVLDIFVEIGLGQMDCYENDFEDFLLKDTTEYYSVKAQSWILEDSCPDYMIKAEECLKREKERVGHYLHISSEQKLLEKMQNELLAQYATPLLEKEHSGCSALLRDDKVEDLSRMYRLFSKITRGLEPISNMFKTHVTNEGTALVKQAEDSASSKKPEKKDMVGMQEQVFVWKIIELHDKYVAYVTDCFQGHTLF

SEQ ID NO: 20670 - DNA, 645 bp, Panicum virgatum
  misc_feature: Ceres CLONE 1812488-R
aagagccagcaaacagatccatctcccccaacgatgtgtttgagttcaattcaaaattcaccgacagaatgagaagaattaagattcccctcccccctgtcgatgagaagaaaaaagttgtcgaagatgttgacaaagataggaggtatgcaattgatgcatcaattgtgcgcatcatgaagagccgtaaagttatgggtcatcagcagctagttgcagaatgtgttgagcagctcagccgtatgttcaagccggacttcaaagccatcaagaagaggattgaggatctcatcacaagggactacttggagcgtgacaaggacaatgcgaacatgtacaaatacctggcttgattggtggtggttggcaagtcaaaacaaagcttccagacttgcacgataccacggggtggagctcctgcactgtcgtggtgcctcgacaacttttgccattatttgcagcaccttttggacatttccgtgcgtgcagccagccacagcacgggctggccgcattttgtacattcatcgtctaataggataatcgtgttgacatacattagatatatggtgatatgaggataggagaggtactccagtaccgtcaatcgtgccttttatgccatgcttaatatctctacccctc

SEQ ID NO: 20671 - DNA, 1073 bp, Panicum virgatum
  misc_feature: Ceres CLONE 1812499
  misc_feature: Encodes the peptide sequence at SEQ ID NO. 20672
tgccctcactcctcagtcctcactctgcatcactcacctcagctcagcccagctcaatcgagcgcccgtgaggagccacaacggctgccatggtcgagttggtgatggcgcccggctgcggcggcggtgggggagggggaggcgaggtgaaagcggaagaggggcaggcgcaggggcaggtgctggcgctggtgctggccgcgctccgtaagtcggtggtgctgccgtgccagatggcggacgccgacgaccccgcgggggcggcccgggggatggagatcggttggcccaccgacgtccgccacgtcgcgcacgtcaccttcgaccgcctccacggcttcctcggcctccccgtcgagttcgagctcgagatccccggccaggtccccagcgccagcacgagcgtgttcggggtgtcgccggagtcgatgcagtgcggctacgacgacaaggggaactcggtgcccaagatcctactgcagatgcaggagcggctgtacgcgcaggatggactcaaggcagaggggatcttccggatcaccccggaaaacagccaggaggagcatgtgagggagcagctcaacagtggcatcgtgcctgacgacatcgacgtgcattgcctggccagtctgatcaaggcctggttcagagatctccctgaaggcgtgcttgacagcctctcacctgagcaagtccttcactgcaacacagaggaacaatgcattgagctcgtggagcttcttccaccaactcaagctgcacttcttcattgggttgtagagctcatggctgatgttgttgaggaagaggagtcaaataagatgaatgcgagaaatgttgccatggtttttgcacccaatatgacacagatgtccgatccactgactgctctgatgcacgctgttcaagtcatgaacttgctcaagaccttgattctcaaaacacttcgggaacgtgatgatgatgatgatgatgcaggagcctattcatcattttcatcttccccatctttttctgaagaaatcgatggagagggtcatgacccacaagatgacgaaaatgatagtggcagt

SEQ ID NO: 20672 - protein, 327 aa, Panicum virgatum
  misc_feature: Ceres CLONE 1812499
  misc_feature (126)..(266): Pfam Name: RhoGAP Pfam Description: RhoGAP domain
  misc_feature (63)..(109): Pfam Name: PBD Pfam Description: P21-Rho-binding domain
  misc_feature: SWISSPROT Homolog: EC 2.7.11.1 Non-specific serine/threonine protein kinase
MVELVMAPGCGGGGGGGGEVKAEEGQAQGQVLALVLAALRKSVVLPCQMADADDPAGAARGMEIGWPTDVRHVAHVTFDRLHGFLGLPVEFELEIPGQVPSASTSVFGVSPESMQCGYDDKGNSVPKILLQMQERLYAQDGLKAEGIFRITPENSQEEHVREQLNSGIVPDDIDVHCLASLIKAWFRDLPEGVLDSLSPEQVLHCNTEEQCIELVELLPPTQAALLHWVVELMADVVEEEESNKMNARNVAMVFAPNMTQMSDPLTALMHAVQVMNLLKTLILKTLRERDDDDDDAGAYSSFSSSPSFSEEIDGEGHDPQDDENDSG

SEQ ID NO: 20673 - DNA, 1303 bp, Panicum virgatum
  misc_feature: Ceres CLONE 1812506
  misc_feature: Encodes the peptide sequence at SEQ ID NO. 20674
tctctgtctctctgctcccgtggtcttcctttcctggcggcgacggctgggctagcggcggcgccattcgcacgtctttgcccggccctttgccggcgacgagcatccaccagtgagtttcagttgcaattcgtgtggaaggtggattgtctgatctgatacttagaaaattgggttggactctacatgtcaagaaagtatggcaccaggaagcaaggcagagagaaaagcagcattagatgctggagcatggatgttcaatgttgtaacatcagttggtatcatcatggtcaacaaagccttgatggcaacacatggttttagttttgctacaacactgactggacttcactttgcaaccacaaccttgatgacacaagtaatgaaatggcttgggtatattcagccatcctatttgccattaccggaactagtaaagtttgtcttttttgcaaacctatccatcgttgggatgaatgttagtttgatgtggaactctgtgggattctatcagattgcaaagttgtgtatcattccagttttatgcattctggaaatcctatttgacaaagtccgttactcaagagatacgaagctcagtatagtgcttgtcctggtaggggttgccgtatgtactgtgactgatgttagtgtgaactctcaagggttattagcggcagtaatagctgtttggagcacggcactacaacagcattatgttcatcaccttcagcgaaagtactcgctcggttcattcaacctcttaggtcatactgctccagctcaggcagcatcactgttagtattggggcctttcgtggacttctggttgaccaacaaaagagttgatacttttaactacacatcaatagttacgttcttcattgtgttgtcatgcataattgctgttggtaccaacctaagccaattcatatgcattggaagattcacagccgtctcattccaagttctaggccacatgaagacgattctcgtgttgaccttggggttccttttctttggcaaagagggcctcaattcccatgtcgcccttggcatgcttctggctgtaatcggcatgatttggtacgggaatgcgtcatcgaaacctggagggaaagagcggcaggtttactcgacaccaagcgagaaaactcagaagcatgggatactgtcctcgcagtccgagcttgatcagaaaagttgaaatgggaacagcaaagccatcctgtgcttcttgattcgacagagcaaaaaatcttgggcttcttgagcgttgatcagcctaatttattctttttat

SEQ ID NO: 20674 - protein, 335 aa, Panicum virgatum
  misc_feature: Ceres CLONE 1812506
  misc_feature (156)..(299): Pfam Name: TPT Pfam Description: Triose-phosphate Transporter family
  misc_feature: Useful for making plants with altered cell wall content and/or composition
MAPGSKAERKAALDAGAWMFNVVTSVGIIMVNKALMATHGFSFATTLTGLHFATTTLMTQVMKWLGYIQPSYLPLPELVKFVFFANLSIVGMNVSLMWNSVGFYQIAKLCIIPVLCILEILFDKVRYSRDTKLSIVLVLVGVAVCTVTDVSVNSQGLLAAVIAVWSTALQQHYVHHLQRKYSLGSFNLLGHTAPAQAASLLVLGPFVDFWLTNKRVDTFNYTSIVTFFIVLSCIIAVGTNLSQFICIGRFTAVSFQVLGHMKTILVLTLGFLFFGKEGLNSHVALGMLLAVIGMIWYGNASSKPGGKERQVYSTPSEKTQKHGILSSQSELDQKS

SEQ ID NO: 20675 - DNA, 2767 bp, Panicum virgatum
  misc_feature: Ceres CLONE 1812512
  misc_feature: Encodes the peptide sequence at SEQ ID NO. 20676
agaggagcagcagcagcgggtggttcaagtggaggaggaggaaggcgcgggaggggcagcggggcgccggcggggaggaggaccatcaccacaaggtggtggtggacgggtcggagatccgggagctggtggaggaccgggaggctttcgggatgctcgtggacaccgcgttccggcagctcgacgccgacggggacggcaggctctccgtgcgggagctccgccccgccgtggccgacatcggcgccgcgttcggggtgcccgcggagggggcgtcgccaaacaccgaccacatctgctcggaggtacgtgctcgccggccgtgaattatgctttgcagccgtagcttgcttgctgtacttccggcgaccaagctaccatggtacgtagctgacaaagcgagatgatcattggcgtcttgaagcatcatgtggttaggcttagatcgggattaatgaatcacagcctcacagtcacaggcatgtgtattttcgtctcagacaatatatttgcatttaattttcacagctgcgaccttaatcagaatatattactcggcacggacagggtgtattaggatttaagaagttcaaactttatatgttttgagcatcggttaatgattagagtccaaaagttgtatatttggatttgtatgtcatatatctttaatacttttgtaacagttaatgacgtgttcaaagataaattgacgatcaaattattttcagagtctttcaaagatttttttattaaaatcctgatacgtacgccatacagaaagaactttcgtctacaatagtaccttacaccggattcctgctcgatttgattcacacctcgagatgccaatttaagtacgacaggccagttgggaatagctgcatgcatatcatttaaattttgaaaatcatatacatttatcacatggcagcgactttagcatagaacatacaggagaacagaataaggacacaaaaactgttgcccggccgtgtgtttatcgatcagatgacgaagatattgtactagtagcagctgagatttattgggctttctgacctgctccacttctagtactagcctatgcctatcaacaattgccacgcatgcttcgagtctgctaactgaattatcaaccataggaatgttaatcatgagttccaaatcggcaaaaggcagattccaaaacgcaatgcaggatggaggtttgcccgggggtccatgtcaagatgccatagccccgagggcatcccattggaccgaccagaacctgaaacatcacgatccaaatctgaacgtcttatcctgaaccatttgacatttgggcgtatcgctcgaattcatcggtgccaacaaatctggcgctcgcaaatgaagacaaaaaaatgtcatcaacggataattaaacagttcgtcctttgtcacgacacggccgatgcctctggaatgatcctctggcagcaagcatctgctgctgaccgctggatacgaagaaattcagactatttgcaggctcacttcactggttctctctgaacaagtcaagacggccgccagtcgcccacactgcagactgcacaacctgactgctggctggcgcgcaggtggtgagcgagctgactcatgggacgtcccagggcgaggtgagcaaggccgagttccaggaggccctgtccgacatcctcctcggcatggcggcggggctcaagagggaccccatcgtcatactgcgcatggacggcgaggacctccgggacttcgtcgccagcagcagatacgagccgtcagcggctgccattttctcgcaggtcggctctgaaggtgtgcccctgcgccggtgcctgtcggccgccctgcagcagctcgccgtcgaccatggagtgccgccggcttcggacgcctgggttgccgagaacatcgtggagccggcactgcggcagcttcctgccgatcagcttgagcagccggcctcccgagatggtttcgtcgagcggctcagggagctgctgggcgccgtcgccgaacggctccaggagcaggccgtgatcgtcgcccacaccgagaacacctacgacgggagtggcgtcaagaggctgctggccaacaaattcgagctcgacaagctgctggattctgtttggagaggcgtgccaggagaacataagaacaaggcatcaaaggaatgtctcatagccgcccttgataagatggccgatgctgcaaacctgccacattatggcgctgttcaacaggtggatgctgtggtgaacgaggccatcaagacggcgaacgccgacggtggaaagacggtagacgaagccgagttcaagaaattgctcacggatacccttggggccgtcatgcggcaactgaacagcaaccccatcttcgtctccaccaacaccgtcgtgcacgagccattgtccggttcatccggcctattctcctcgccaccgcccgtgtcatcatcgccgaagtgaataaaactacactatacatcatacatgacagttgtatatggagggaacagagtgtcagtatttgagcggtgcctgtggtgttgctttttgtctgatcacaggcactgaagcagcatgttatgctcatgctggctcggttgcaacctgacgaagtgcaacgatgcagttcgtcaagtttgttaacctgattcaagtttactggaataatgtgttaaagccacagacacattgtctatcagaaaaaaagccagacatattgatccatggaaatgcaactattttgc

SEQ ID NO: 20676 - protein, 107 aa, Panicum virgatum
  misc_feature: Ceres CLONE 1812512
  misc_feature (52)..(80): Pfam Name: efhand Pfam Description: EF hand
RSSSSGWFKWRRRKAREGQRGAGGEEDHHHKVVVDGSEIRELVEDREAFGMLVDTAFRQLDADGDGRLSVRELRPAVADIGAAFGVPAEGASPNTDHICSEVRARRP

SEQ ID NO: 20677 - DNA, 1694 bp, Panicum virgatum
  misc_feature: Ceres CLONE 1812513
  misc_feature: Encodes the peptide sequence at SEQ ID NO. 20678
aaaaatcccccacctccctcccatttcaaaacctcctccggttctccccttccaccatttccgcataggcctgcttgtcaccttcccaatccctcctcccccaccttcccagtccccagcagcagcaggagtcttggccaccatgtctcccaccaccaccccgtcccccgcgcccgcggcggcgccgtcctccaagggcgacaagcgcagcctcatgtcctcgctcatggacgccaccgcgctgctccgctccgcctccttcaaggaggactcgtacgtcgccgccgcgctcccgccgtccgagctccgcgcgctcgccaacctcaaggcgctgctcgccaggcacccggaccccatctccatctggggcgtcccgctcaacagcccccagcagccccctcccgcggcagccgacggcgccgccgctcctccggtggacgagcgagccgacgtggtgctcctcaagttcctccgcgcgcgcgacttccgcgtccgcgacgcgcacgccatgctgctgcgctgcgcggcgtggcgcgccgagttcggcgccggcgcggtgctggacgaggacctgggcttcaaggacctggagggcgtcgtcgcctacatgcacggctgggaccgcgagggccaccccgtctgctacaacgcctacggcgtcttcaaggaccgcgacatgtacgagcgcgtcttcggcgacggcgaccgcctcgcgcgcttcctccgctggcgcgtccaggtcatggagcgcggcgtcagggcactcagcctcaggccgggcggcgtcaacgccatcatccaggtcaccgacctcaaggacatgcccaagcgagagctaagggccgccagcaaccagatcctctcgctcttccaggacaactacccggagatggtggcgcgcaaggtgttcgtcaacgtgccgtggtacttctccgtgctcttctccatgatctcgcccttcctcacggagcgcaccaagagcaagttcgtcatcgcgcgcgagggcaacgtcgccgagacgctctacaagttcatccagccggagctggttcccgtgcagtacggcgggctcagccgcgccggcgacctcgagaacggcccgcccaagccggcgtccgagttcactatcaagggcggcgagaaggtcttcctggagatcgacggcatcgaggccggtgcgacaataacatgggacctggtggtcggcggctgggacctggagtacggcgcggagtatgtgccggcggccgaggggagctacacgctgtgcgtggagaagacgaggatggttccggccaccgccgaggagcccctgcacaatgccttcactgcgagggaggccggcaagatggtgctgtccatcgacaactccggctcccggaagcggaaggtcgccgcgtaccggtacttcgtgcgcaagccgtcggcgtagtgctcggcattccagtggcggtgggcggcagcttgccggccggcggtggcgacgggagtttgacatgggtcggacggagaactgcttccttgctggggctttgttgtggtcttgttggagggtgaaattaaggttaggggtacttaattactagtgctataatgacatgcatgtattatgccatatgtagaatataatgtaagagctgttgaacttttgtcatcaccaccgttataaagctaatgagttcagttttttgggc

SEQ ID NO: 20678 - protein, 429 aa, Panicum virgatum
  misc_feature: Ceres CLONE 1812513
  misc_feature (153)..(337): Pfam Name: CRAL_TRIO Pfam Description: CRAL/TRIO domain
  misc_feature (76)..(139): Pfam Name: CRAL_TRIO_N Pfam Description: CRAL/TRIO, N-terminus
MSPTTTPSPAPAAAPSSKGDKRSLMSSLMDATALLRSASFKEDSYVAAALPPSELRALANLKALLARHPDPISIWGVPLNSPQQPPPAAADGAAAPPVDERADVVLLKFLRARDFRVRDAHAMLLRCAAWRAEFGAGAVLDEDLGFKDLEGVVAYMHGWDREGHPVCYNAYGVFKDRDMYERVFGDGDRLARFLRWRVQVMERGVRALSLRPGGVNAIIQVTDLKDMPKRELRAASNQILSLFQDNYPEMVARKVFVNVPWYFSVLFSMISPFLTERTKSKFVIAREGNVAETLYKFIQPELVPVQYGGLSRAGDLENGPPKPASEFTIKGGEKVFLEIDGIEAGATITWDLVVGGWDLEYGAEYVPAAEGSYTLCVEKTRMVPATAEEPLHNAFTAREAGKMVLSIDNSGSRKRKVAAYRYFVRKPSA

SEQ ID NO: 20679 - DNA, 703 bp, Panicum virgatum
  misc_feature: Ceres CLONE 1812519
  misc_feature: Encodes the peptide sequence at SEQ ID NO. 20680
gtaatccgccatcctttgtcagacgcaggaaaaggtatcggtcgtcggaatcacgcaggccggcaggcgggtctccgttcctcttcttcctctggtccggcagccatggcgtcgaacgggagcagcacggtggtgggagagatgcagagcagcttggagcgggtgaggcggcagctctcctcaacgtccacccggcagctcctccagggccctctcttgaagcgatccgacacgctaagaaaatggaacgagcggtgggtcatacttgatcctacaactggaaagatagaatacaagcttcgtagaagtgacaaagatgctaggggagtaattgtgtttgatacaacaagcacggtgacattatcacctatgaactttcatgggctggcgaaatatgatggatgctgtttctatattggaactccacagaaaaaggaatactttctttgtgcagaaactcccagcgctgcaagagcatgggtatccactttacatgcggctcagttggtactccaggctcataaggaggcagtgaattcattgggtgacaatggtcctgcaaaattggggacagttgctactgttgtggctgtagccaatgccactgcaattgaggcaacaaaggaggtggaagccgcaatgaagatttccttgcgggcagctttgggttcaactacaaataaacttaacaaagggcaattag

SEQ ID NO: 20680 - protein, 199 aa, Panicum virgatum
  misc_feature: Ceres CLONE 1812519
  misc_feature (31)..(134): Pfam Name: PH Pfam Description: PH domain
MASNGSSTVVGEMQSSLERVRRQLSSTSTRQLLQGPLLKRSDTLRKWNERWVILDPTTGKIEYKLRRSDKDARGVIVFDTTSTVTLSPMNFHGLAKYDGCCFYIGTPQKKEYFLCAETPSAARAWVSTLHAAQLVLQAHKEAVNSLGDNGPAKLGTVATVVAVANATAIEATKEVEAAMKISLRAALGSTTNKLNKGQL

SEQ ID NO: 20681 - DNA, 1208 bp, Panicum virgatum
  misc_feature: Ceres CLONE 1812524
  misc_feature: Encodes the peptide sequence at SEQ ID NO. 20682
acagaggacaggacagccacccatcgatctgcatcctttgccctgtcgagcacgaggggaagatcgagggagctagcagtcgagagagcacgcggccggcgcaatggtgacgacggagcagcagtcggcggggaaggtggccgccttcaacctcgccgaggccgggttgggcgaccggccggagctggacgacgacgggcgcgagaggcgcacggggacgctggtgacggcgagcgcgcacatcatcacggcggtgatcgggtccggcgtgctgtcgctggcgtgggcgatcgcgcagctggggtgggtgatcggccccgtcgtgctgctggccttctccgtcatcacctggttctgctccagcctcctcgccgactgctaccgcgcccccgaccccgtccacggcaagcgcaactacacctacggccaggccgtcagggcatacctcggggtttccaagtaccggctttgctcgctggcgcagtacatcaacctcgtcggcgtcaccatcggctacaccatcaccacggccatcagcatgggggcgatcaagcggtccaactgcttccaccgcaacggtcactccgctgactgcgaggcctccaacacgaccaacatgatcatcttcgccggcatccagatcctgctctcgcagctgcccaacttccacaagctctggtggctctccatcgtcgccgccgtcatgtccctcgcctactcctccatcgggctcggcctctccattgccaagattgcaggtggggtgcacgccaagacgtcgctgactggggcgaccgtgggggtcgatgtgtccgcgaccgagaagatctggaagacgttccagtccatgggagacatcgccttcgcctactcctactccaacgtcctcatagaaatccaggacacgctgcggtcgagcccgccggagaacgcggtgatgaagaaggcctccttcatcggcgtgtcgacgaccaccatgttctacatgctgtgcggcgtgctgggctacgcggcgttcggcaaccaggcgccgggcaacttcctcaccggcttcggcttctacgaccccttctggctcatcgacgtcggcaacgtctgcatcgccgtccacctcatcggcgcctaccaggtcttctgccagcccatctaccagttcgtcgaggcctgggcgcgcgcccggtggcccgacagcggcttcctcaacgcca

SEQ ID NO: 20682 - protein, 368 aa, Panicum virgatum
  misc_feature: Ceres CLONE 1812524
  misc_feature (36)..(368): Pfam Name: Aa_trans Pfam Description: Transmembrane amino acid transporter protein
MVTTEQQSAGKVAAFNLAEAGLGDRPELDDDGRERRTGTLVTASAHIITAVIGSGVLSLAWAIAQLGWVIGPVVLLAFSVITWFCSSLLADCYRAPDPVHGKRNYTYGQAVRAYLGVSKYRLCSLAQYINLVGVTIGYTITTAISMGAIKRSNCFHRNGHSADCEASNTTNMIIFAGIQILLSQLPNFHKLWWLSIVAAVMSLAYSSIGLGLSIAKIAGGVHAKTSLTGATVGVDVSATEKIWKTFQSMGDIAFAYSYSNVLIEIQDTLRSSPPENAVMKKASFIGVSTTTMFYMLCGVLGYAAFGNQAPGNFLTGFGFYDPFWLIDVGNVCIAVHLIGAYQVFCQPIYQFVEAWARARWPDSGFLNA

SEQ ID NO: 20683 - DNA, 1783 bp, Panicum virgatum
  misc_feature: Ceres CLONE 1812526
  misc_feature: Encodes the peptide sequence at SEQ ID NO. 20684
aacttgccatggactcagtcgtcggaaccagctagcctatggactggagcaccagtcagcagcaccagctgccatggatgagctcttcttcggcagctgcttgcctctagccgctctagtagccacgatcttcctctccttgctcttcagactgctggcgctggatggcaaagaaacggccggtgcaaggctccccccggggccgtggaacctccccgtcatcggcagcctccaccacctcgccagcgcgcccccgcaccgcgcgctgctccgcctggcgcgccggcacggcccgctgatgctgctccggctcggcgaggtgcccaccgtcgtcgtctcctccccggaggcggccgcggaggtgatgaggacccacgatcccgtcttcgccagccggccgcagggcgcgatggtggacgtcgtcggcttcggcggcaagggcatcatcttcgccccctacggggaacactggcggcagatgcgcaaggtctgcgtggtcgagctgctcagcgccaggcaggtgcggcgcatggagcgcatccggcaggccgaggtgtcgcgcctcgtcgagtccgccgccgcggcgtcggcctcgccggcggcggtcaacctcagccaggtactgacggcgctcgccaacaacgtcatcgcgagggcggtgttcggcggcgagtgccggcagcaggaggcgtacctccgggcgctcgaggcggtggcgacgttggcgggagggttcagcctgccggacctgttcccgtcgtcacggctggcgcgctggctgagctgcgccgcgcgtgatctgaggaggagccacgcccgggtcgtgagcatcaccgccggcatcgtccaggagcgcatggagaagcggaggaccacaactcccgtcgcagatgccgacgttcaagacgaggacctgctcgacgtgcttctccggctgcaggaggaaggatccctcaccttgcccctcaccacggagatcatcagcgccgttatctccgacatatttggagcagctacggacaccacggccagtacactagaatgggtcatggcggagctcatcagggatccacaggccatgtcaagggcaacgtgtgaaatccgacaaaagctcggccagggaagagtcactattaccaacgcagaccttggcgacctcccctacctaaggatggtcatcaaggagactctaaggctacgcccagctgctccgttgattcttcgtgccagccaagaaaactgccggatcatgggctacgacatacccaagggttcccccgtcttcatcaacaccttcgcagttgcgagggacccaaaatactgggacaaggccgacgagttcaggccagagaggtttgcgagcagcacgccggagtacaagtggacagacatcgagttcatcccattcggagctgggcgcaggcagtgtccgggagctctgttcgcgaccacaaccatggagctcacactggcgaacctcctgtaccacttcgattgggcgcttcctgatggcgccgacccgaaggccctcgacatgagtgaggtgttcgggctcacaatacacaggagatccaatctctgtatgttgccagccttgcatttgcctcactaagtggtacgagactcatgtagggacactatgtttcagcagaataaatgtgatgaggtcactaacagcatcctctgccgcgatgtctcatgtcatcatccagttatatttcctggattagatgggaatattcggtgcctggctcttagcaacttaaaactattcttagttatt

SEQ ID NO: 20684 - protein, 512 aa, Panicum virgatum
  misc_feature: Ceres CLONE 1812526
  misc_feature (41)..(505): Pfam Name: p450 Pfam Description: Cytochrome P450
  misc_feature: SWISSPROT Homolog: EC 1.14.13.68 4-hydroxyphenylacetaldehyde oxime monooxygenase
MDELFFGSCLPLAALVATIFLSLLFRLLALDGKETAGARLPPGPWNLPVIGSLHHLASAPPHRALLRLARRHGPLMLLRLGEVPTVVVSSPEAAAEVMRTHDPVFASRPQGAMVDVVGFGGKGIIFAPYGEHWRQMRKVCVVELLSARQVRRMERIRQAEVSRLVESAAAASASPAAVNLSQVLTALANNVIARAVFGGECRQQEAYLRALEAVATLAGGFSLPDLFPSSRLARWLSCAARDLRRSHARVVSITAGIVQERMEKRRTTTPVADADVQDEDLLDVLLRLQEEGSLTLPLTTEIISAVISDIFGAATDTTASTLEWVMAELIRDPQAMSRATCEIRQKLGQGRVTITNADLGDLPYLRMVIKETLRLRPAAPLILRASQENCRIMGYDIPKGSPVFINTFAVARDPKYWDKADEFRPERFASSTPEYKWTDIEFIPFGAGRRQCPGALFATTTMELTLANLLYHFDWALPDGADPKALDMSEVFGLTIHRRSNLCMLPALHLPH

SEQ ID NO: 20685 - DNA, 664 bp, Panicum virgatum
  misc_feature: Ceres CLONE 1812545
  misc_feature: Encodes the peptide sequence at SEQ ID NO. 20686
actccccctctacccatgctaccgaatcccaagggaaatggaagcatcaaccctgctatggttcctctacgtctccctcgcctcctgccttctctataagctcttcctttcaaccaaaacgagctctggtccggcgaggcggccgccgggcccggcgcctctgccggtcctcggcaacatcctcgacctccacggggagctgcaccacgccctcgccaggcttgcagagacgcacggccccgttatgtccctgaggctcggcgccaccgacaccgtggtggccacctccgccacggcggcgcgcgacgtgctgcagaggtacgaccacctcctggcggcgcggtcggtgacggacgccgggcgcgcgctggggcaccacgagctctccgtcatctggctccccggcaccagcccgctgtggaagcggctccgcgccgtgggcaccgcccacctcttctcggcgcgcgggctggacgcgacgcgcgccgcgcgggaggacaaggcgagggagctggtcgcctgcctgggccgccacgccggcgaggccgtgggcgtggggagcgtcgtgttctcgtgcgcgctcaacatcgtgtccaacgtgctcttctccgaggacgtggccgacctgagctcggaccgcgcgcaggagctggagatgctggtc

SEQ ID NO: 20686 - protein, 208 aa, Panicum virgatum
  misc_feature: Ceres CLONE 1812545
  misc_feature: SWISSPROT Homolog: EC 1.14.13.71 N-methylcoclaurine 3'-monooxygenase
MEASTLLWFLYVSLASCLLYKLFLSTKTSSGPARRPPGPAPLPVLGNILDLHGELHHALARLAETHGPVMSLRLGATDTVVATSATAARDVLQRYDHLLAARSVTDAGRALGHHELSVIWLPGTSPLWKRLRAVGTAHLFSARGLDATRAAREDKARELVACLGRHAGEAVGVGSVVFSCALNIVSNVLFSEDVADLSSDRAQELEML

SEQ ID NO: 20687 - DNA, 1491 bp, Panicum virgatum
  misc_feature: Ceres CLONE 1812547
  misc_feature: Encodes the peptide sequence at SEQ ID NO. 20688
acgcacaattccgtgaagttctatttgcagcgcatcggatctgttgaggggcgcaagtgcaaacttgttctagttttaaagggaaatggatcgatcttaaccacccacgatccaccaggtcaccgcacgatcggcgttcggcaacgcaaacgcaactgcctcctcccccggcaccaccaccacgctccgcccgccgccgtcggcgcctcctgctcccctcatatactccgactccaccagccgcgcccctctgtcttccctccaccagcctccagatctccctccctctcccccgttcacacacactcgcatcgcgcgcgcgcgctgagagaccccaaggcgcaagcaaagcacacccacccatggcgcctctgctcctgctcttcctcctcggcggcctctgcgccctcttctccctcaccgcctcctcgcgcgccggcgccgccaagaagtgctgcgacgtcaagggcgcaggcggcgagggggaggaggcggcgcggcgggagggggcgaggaagcaggcgcggcccgacccggaggcggacctgggcatcgtcttctccacgttcgaccacgacggcgacggcttcatcacggcggtcgagctggaggagtcgctgcgccgcctcggcatcgccgtgtccgccgacgaggccgccgccatggtggcgcgcgtcgacgccaacagcgacgcgctcatcgacatccacgagttccgggagctctacgactccatacccaagaagcggaagcaccagcaccccgccgccgatctcggcgccgcgagggaggtccccgtggaggacgcggaggaggaagaagaggccgcggaggaggaggaggagagggacctgcgggaggcgttcgacgtcttcgacggcaacaaggacgggctcatctccgccgaggagctcggcaccgtgctgggctccctaggcctgcgccgcgccggcgccagcgccggcaggcccgccgtcgccgagtgccgcgacatgatacgcctcgtcgacagcgacggcgacggcatggtcagcttcgaggagttcaagcgcatgatgaccgtcgtcaaggcctaaagctcctcctcctcttcttctcacagatcaaacgcggagtataaccaaaacttggagcggatttatttgcaaaagcaagtaacgttattttgttcttggatcggaacagattcatcgtgttgttggtagaagcgcgatcaattaacaccaggagctcgtatttgtttatggggagttgaaagctggagtagcttctcgttctgtgtttctctcccctgttcttgaattttcatcacttcctcctccccctttccggtctaattatttcatagtacttccttttagttctggttactgttttgactgacaagcatcagacatgtatgtaaatattagttcttgctcgctgtcaggttgatctgtggaaaaagaacaacaggatgaatggaaatcccaacgaatatgactttgttcg

SEQ ID NO: 20688 - protein, 237 aa, Panicum virgatum
  misc_feature: Ceres CLONE 1812547
  misc_feature (207)..(235): Pfam Name: efhand Pfam Description: EF hand
  misc_feature (163)..(191): Pfam Name: efhand Pfam Description: EF hand
  misc_feature: SWISSPROT Homolog: EC 2.7.11.1 Non-specific serine/threonine protein kinase
MAPLLLLFLLGGLCALFSLTASSRAGAAKKCCDVKGAGGEGEEAARREGARKQARPDPEADLGIVFSTFDHDGDGFITAVELEESLRRLGIAVSADEAAAMVARVDANSDALIDIHEFRELYDSIPKKRKHQHPAADLGAAREVPVEDAEEEEEAAEEEEERDLREAFDVFDGNKDGLISAEELGTVLGSLGLRRAGASAGRPAVAECRDMIRLVDSDGDGMVSFEEFKRMMTVVKA

SEQ ID NO: 20689 - DNA, 228 bp, Panicum virgatum
  misc_feature: Ceres CLONE 1812555
  misc_feature: Encodes the peptide sequence at SEQ ID NO. 20690
aaaacccaatcccgagccagccagccaggccaccaaaccctaatcccccgcgccacgcgcgcggcctcccatgggctgaccgcgccgcggtggggagccccggatccggagctagggttccgccatggagtgggacagcgagtccgacggcgccggcagcgtcggcgccggcgaggaggaagaggatgaggaggaggaggaggaggaggaggaggtggggggggtggt

SEQ ID NO: 20690 - protein, 34 aa, Panicum virgatum
  misc_feature: Ceres CLONE 1812555
  misc_feature: Useful for making plants with altered alkaloid content
MEWDSESDGAGSVGAGEEEEDEEEEEEEEEVGGV

SEQ ID NO: 20691 - DNA, 1265 bp, Panicum virgatum
  misc_feature: Ceres CLONE 1812557
  misc_feature: Encodes the peptide sequence at SEQ ID NO. 20692
aaagaaagggggctatttctcttcccccgtctctgtttcatcagcatcggcggcgatggcggcgctgaggaggctgctggcggatgcgccgccggggcagcaccacaagcagggcggcgcgccgtcggactggagcgcggggtacctcaatgggtggctgtcgcagcagacgccagtgctcgggctccgcctctgggtgctcatcggcatcgccgtcggcgccgccatcgtgcttgtgctcctcctcatcttcgtctgcctctcgcgccgccgccgccgccgcgacgaggtgctcgcagccaacctctaccccgccgacaccaagctgctcaagcagcacctgcagcaggccacgccgaccaaggatatccaggagatcgtccgccgccagcaccagccgcagacgccgccgcagcccgcggtgcatctcgcgaaagcagagccgccgctgacgccgccgccgcagcatagggcgcaggcgccggtggtgccggccccacccgcgcggaaaacgcctggcagcggcatgtcggccacgacgagcggcgggagcgagcgggacggggccacgccgaggagcaccgggagcgccgcgggggcgccggaggtctcgcacctcgggtgggggcactggttcacgctccgtgagctggaggaggccacggatgggctcgccgaggataatgtcatcggggagggcggctacgggatcgtgtacaggggcacgttgcacgactccaccatgatcgccgtcaagaacctgctcaataataggggccaggctgagaaggagttcaaggtggaggtcgaagcaatcggtcgtgttcggcacaagaatctcgtcaggttgcttggctactgcgtagagggcgcttacaggatgcttgtatatgagtatgttgataatggtaatcttgatcagtggcttcatggtgatgttggggaagtgagcccgctaacctgggacatcaggatgaacattatgcttgcaactgctaaagggctggcctatcttcatgaggggctggagcccaaggttgtccatcgtgacatcaaagctagcaatattcttcttgatcagcagtggaatgccaaagtatcggattttgggctcgcaaagctattgtgctcagagaaaagctatgttacaacccgtgttatgggaacctttggctatgtggcacctgaatatgccagtactgggatgttaaacgagaggagtggatgtctatagctttggcatacttataatggagatcatcact

SEQ ID NO: 20692 - protein, 392 aa, Panicum virgatum
  misc_feature: Ceres CLONE 1812557
  misc_feature (206)..(392): Pfam Name: Pkinase_Tyr Pfam Description: Protein tyrosine kinase
  misc_feature: SWISSPROT Homolog: EC 2.7.11.1 Non-specific serine/threonine protein kinase
  misc_feature: Useful for making plants with modulated heat sensitivity
MAALRRLLADAPPGQHHKQGGAPSDWSAGYLNGWLSQQTPVLGLRLWVLIGIAVGAAIVLVLLLIFVCLSRRRRRRDEVLAANLYPADTKLLKQHLQQATPTKDIQEIVRRQHQPQTPPQPAVHLAKAEPPLTPPPQHRAQAPVVPAPPARKTPGSGMSATTSGGSERDGATPRSTGSAAGAPEVSHLGWGHWFTLRELEEATDGLAEDNVIGEGGYGIVYRGTLHDSTMIAVKNLLNNRGQAEKEFKVEVEAIGRVRHKNLVRLLGYCVEGAYRMLVYEYVDNGNLDQWLHGDVGEVSPLTWDIRMNIMLATAKGLAYLHEGLEPKVVHRDIKASNILLDQQWNAKVSDFGLAKLLCSEKSYVTTRVMGTFGYVAPEYASTGMLNERSGCL

SEQ ID NO: 20693 - DNA, 1663 bp, Panicum virgatum
  misc_feature: Ceres CLONE 1812563
  misc_feature: Encodes the peptide sequence at SEQ ID NO. 20694
aaaaccctagaaactacctaaccaccctgcgcgccgccatgtcgtccacgacgccggccgtcgcgtcccccgcctccgagcattccaaatcgaagaagaagaagcacaagtcgaaggacgatcccgccgccgccgccgccgccgccgcggccgacccgccgtcgctcgctgaggcagaggagaagaccgacggctacctcatcaagccccagtccctggtgccgtccctcgacacctccacctggccgctcctcctcaagaactacgaccgcctcaacgtccgcaccggccactacaccccgctcccctccggccactcgccgctcaagcgccccctcgccgagcacctccgctacggcgtcatcaacctcgacaagccgtcgaacccctcctcccacgaggtggtcgcctggatcaagcgcatcctccgcgccgagaagaccggccacagcgggacgctcgaccccaaggtcaccggcaacctcctcgtctgcatcgaccgcgccacgcgcctcgtcaagtcgcagcagggcgccggcaaggagtacgtctgcgtcgcccgcttccacgccgccgtgccggacaccgcgcgcgtggcccgcgcgctggaggcgctcaccggcgcggtgttccagcgtccgccgcttatctctgcggtcaagcgtcagctcagggtgcggaccatctacgagagcaagctcctggagcacgaccccgagcgtcatctcgccgtgttctggatctcctgcgaggcaggtacctatgtccggactctctgtgtgcaccttgggctgctccttggagttggcgcgcatatgcaggaactgcgccgtgtcaggtcggggatcctcggggagcaggacaacatggtgaccatgcacgatgtgatggacgcgatgtggtcgcttgacaactacaaggatgagtcgtacttgaggcgtgttgtgatgccacttgaggtactgcttactagctacaaaaggcttgtggtgaaggactctgctgtgaatgctatatgctatggtgctaagcttatgatccctgggttgctccgatttgagaatgatattgagactggggaggaggtggttctcatgacaacaaagggtgaggcaattgctattggtattgctgagatgactactgctgtgatggccacatgtgaccatggtgcagttgcaaagatcaagagggtggtgatggacagagacacttacccgaggaagtgggggcttggcccggtggcactcaagaagaaaaagatgattgcggatggtctccttgacaagcatgggaagccaaatgagaagaccccggctgagtggcttcggaatgtggtgcttcccactggtggtggtgtttcgattgccagcattgcagctgctcctgagccagagaaggtgaaggtggaaccagaagcagccgtgactgaagaggtcaaggagaagaagaagaagaggcggaaggatgaggaggagactgatgcagatgcctctgttccttcaaagaagatcaaggttgaggaagctgctgaggcagtggagggagagaagagtgagaagaagaagaagaaaaagaaagacaagggtgaatcaggatcagctgaggttgtggaggtcaaggaggaggttgatgtggctgatgataagggcagagaaaaggc

SEQ ID NO: 20694 - protein, 541 aa, Panicum virgatum
  misc_feature: Ceres CLONE 1812563
  misc_feature (127)..(264): Pfam Name: TruB_N Pfam Description: TruB family pseudouridylate synthase (N terminal domain)
  misc_feature (65)..(123): Pfam Name: DKCLD Pfam Description: DKCLD (NUC011) domain
  misc_feature (314)..(387): Pfam Name: PUA Pfam Description: PUA domain
MSSTTPAVASPASEHSKSKKKKHKSKDDPAAAAAAAAADPPSLAEAEEKTDGYLIKPQSLVPSLDTSTWPLLLKNYDRLNVRTGHYTPLPSGHSPLKRPLAEHLRYGVINLDKPSNPSSHEVVAWIKRILRAEKTGHSGTLDPKVTGNLLVCIDRATRLVKSQQGAGKEYVCVARFHAAVPDTARVARALEALTGAVFQRPPLISAVKRQLRVRTIYESKLLEHDPERHLAVFWISCEAGTYVRTLCVHLGLLLGVGAHMQELRRVRSGILGEQDNMVTMHDVMDAMWSLDNYKDESYLRRVVMPLEVLLTSYKRLVVKDSAVNAICYGAKLMIPGLLRFENDIETGEEVVLMTTKGEAIAIGIAEMTTAVMATCDHGAVAKIKRVVMDRDTYPRKWGLGPVALKKKKMIADGLLDKHGKPNEKTPAEWLRNVVLPTGGGVSIASIAAAPEPEKVKVEPEAAVTEEVKEKKKKRRKDEEETDADASVPSKKIKVEEAAEAVEGEKSEKKKKKKKDKGESGSAEVVEVKEEVDVADDKGREK

SEQ ID NO: 20695 - DNA, 704 bp, Panicum virgatum
  misc_feature: Ceres CLONE 1812576
  misc_feature: Encodes the peptide sequence at SEQ ID NO. 20696
agccggaggcccggacagagaagtgatcgagcggcagacttattagcctctcagcccatcgatccaccgcctagctagctctcctagcagaaatggcggtggagatcctcgagtcatgcatggtgacgcccggcgaggcggcgacgcccaagcatggcgtgtggctctccaacctcgacctcctcgtggccaggagccacacgcccaccgtctacgtctaccggcccagccccggcccggccttcttctcgccggacgtcctcaaggccgccctgtccaaggtgctcgtccccttctaccccctcgccggccggctcggtcgggacggcgctggccgcccggagatccactgcaccggcgacggcgtgctcttcgtcactgcgcgcgccgacgctacgctccaagatctcggcggcttcgtcccgtcggacgagctgcggcggctgcttgtcccctcggccgacggcggcgacgaccgcgccggcattctggccatgttccaggtgacgttctttaagtgcggcggcgtgtgcgtcggcgccgcgatccatcacacggcggcggacggcctcgcggcgctggacttcgtgaacacgtgggctgccatcgcgagaggcgccggcgaggcggcgccgcgcccgtggctggaccgcacgctcctccgcgcgcgctcccctcccgccgtgcggttcgaccatgccgag

SEQ ID NO: 20696 - protein, 203 aa, Panicum virgatum
  misc_feature: Ceres CLONE 1812576
  misc_feature (1)..(203): Pfam Name: Transferase Pfam Description: Transferase family
  misc_feature: SWISSPROT Homolog: EC 2.3.1.144 Anthranilate N-benzoyltransferase
  misc_feature: Useful for making plants with altered carbohydrate content
  misc_feature: Useful for making plants with altered cell wall content and/or composition
  misc_feature: Useful for making plants with altered lignin content
MAVEILESCMVTPGEAATPKHGVWLSNLDLLVARSHTPTVYVYRPSPGPAFFSPDVLKAALSKVLVPFYPLAGRLGRDGAGRPEIHCTGDGVLFVTARADATLQDLGGFVPSDELRRLLVPSADGGDDRAGILAMFQVTFFKCGGVCVGAAIHHTAADGLAALDFVNTWAAIARGAGEAAPRPWLDRTLLRARSPPAVRFDHA

SEQ ID NO: 20697 - DNA, 2091 bp, Panicum virgatum
  misc_feature: Ceres CLONE 1812609
  misc_feature: Encodes the peptide sequence at SEQ ID NO. 20698
gtcgtctcgcgagtcgcgagtcgggactcgtctcgtctcgtcgtttcccctcggcttcgactcggagcccaagccaacccaccccccacgccagatcccaccccgctccgaatcgccgccactttgctcccttccagcccttccaggccccgccgcgcctcctcgcctcaccgcggatcaaaacccccgcgtagccagtttaatcgcggccggttcgagcccttcgcgggaggtgtcgttcactgattgctcggaggatctctccgcggggaggctcgggcccaggactccctccctccctcccagctccagcgcgtggtcctcaacctcggcggtctagcgagtcctgattgcgtgggtcacgggtcctgagctgtgaaggcagagagacaacaaaagtaaggcttcagtagccgttccaggtcaaggcatgatggagaggtcgctgctggaggcactggccacggcggcacagggaggcacatcggggacatcggtcctgagcatgctcaagtatgccgtgatgcccatcgccaaggtgttcaccgtctgcttcatggggttccttatggcctccaagtacatcaacatcctccagcccaacggccgcaagcttctcaacgggcttgtgttttcgcttctgcttccttgccttatattttcccagttgggtagagcaatcactatcgagaagatgatacagtggtggtatattccagtaaatattgttgtaggcgcagcatctggctctttgattggctttgttgtggcatctatcatcaggcccccatatccatactttaagttcactattatccatataggaataggaaatattggaaatatacctctggtcctcattgcagcgttatgtcgggatccatctaatccatttggtgattctgataagtgcaaccaagatggaaatgcatatatctcatttggtcaatgggttggtgcaattattgtttacacatatgtattcaagatgcttgctccaccaccaggacggacctttgatggctctgaagatgatgaacttccagtcaagggatctgaagagaatgcggtgtcacaactcgccaaatatccgattccaacaagcactcacactagtgctgtaccagaggatgagcctttgttatctgctggggaagttcaaaaagaatatgccgcttctgtaggatcaaagataatgggccatgttaaatgtgtgattaaattcctgaaagacaagcagcttctccagccaccaattattgcatctgcttttgcaattgtcattggtgttgtcccattcttgaagaattttgtgcttacagatgatgcgcctctcttctttttcacagacagctgtctgattcttggggaagctatgatcccgtgcattttacttgctgtcggtggcaatctcgttgatggtcctggtgaaggaagtaagaggcttggtgtgcgtacaaccgttgctataatttttgcacggttgatcttggtccctcttgctggggttggcatcatcttgttagttgataaacttggtttcattccgaaagatgacaaaatgttcaagtttgtcctgctactgcagcattctatgcccacatcagtgctgtcaggtgccgttgcaaacttgagagggtgtggtaaagaatcagctgcaatcttgttctgggttcacatttttgccgtgttctctatggcaggatggatcattttctatttgagcttgctcttctaaacaccttaccgcacaggaagatctttgaaagaaaatatcatcctaagtatcacgaaaatagcgacattatatgtacaatagcctgtaaatcatggtgacagcttcagagtctgtgaattgtatcagcatagatatacggtacctcccaatgctacggtaattgtggttctgctgctgctgctgcaagcagtgggtgaagatggcaccgcggtgtgttgccctgcagttcacagagaaccatttagatagggatgccaggttcttccaataaatacccagcttttcagtttttctttgttccaaacaatatagtaccatgtgatcgtattcaatcctcgacagggttcaagtgc

SEQ ID NO: 20698 - protein, 434 aa, Panicum virgatum
  misc_feature: Ceres CLONE 1812609
  misc_feature (28)..(426): Pfam Name: Mem_trans Pfam Description: Membrane transport protein
MERSLLEALATAAQGGTSGTSVLSMLKYAVMPIAKVFTVCFMGFLMASKYINILQPNGRKLLNGLVFSLLLPCLIFSQLGRAITIEKMIQWWYIPVNIVVGAASGSLIGFVVASIIRPPYPYFKFTIIHIGIGNIGNIPLVLIAALCRDPSNPFGDSDKCNQDGNAYISFGQWVGAIIVYTYVFKMLAPPPGRTFDGSEDDELPVKGSEENAVSQLAKYPIPTSTHTSAVPEDEPLLSAGEVQKEYAASVGSKIMGHVKCVIKFLKDKQLLQPPIIASAFAIVIGVVPFLKNFVLTDDAPLFFFTDSCLILGEAMIPCILLAVGGNLVDGPGEGSKRLGVRTTVAIIFARLILVPLAGVGIILLVDKLGFIPKDDKMFKFVLLLQHSMPTSVLSGAVANLRGCGKESAAILFWVHIFAVFSMAGWIIFYLSLLF

SEQ ID NO: 20699 - DNA, 1025 bp, Panicum virgatum
  misc_feature: Ceres CLONE 1812615
  misc_feature: Encodes the peptide sequence at SEQ ID NO. 20700
gcgcccccaccactcgctccggtgctgtgaccgtgtctctccccaccacctgtctcccagcctcgtcagattcctccgttccgatcgaagcctcgctagctacgcccggccatggcaaagctccctccctgcctactcttcgccggcgccgtcttcgccgccgcggcgcacgcggcggcggcgggcggcgccgtgacgggcgtgtcggcggcggcggcgtcggacccggaggacaagtgcgtgtacacggtgtacgtgcgcacggggtccatctggaagggcggcacggactccaagatcggggtgacgctgctggacggcgacgggtcgggcatccggatcgcggacctggagcggtggggcggcctcatgggcgccggccacgactactacgagcgcggcaacctggacatcttcagcggccggggcccctgcatgcgccaggccccctgcgccatgaacctcacctccgacggcaccggcccgcaccacggctggtactgcaactacgtcgaggtcaccgccacggggccccacctcgggtgcgcgcagcagctcttcaccgtcgagcagtggctcgccaccgacgcgtcgccctaccgcctctactccaccgtcgacaactgcggcgggaagaagcgccgggaggacgccgaggccgccgccgcgatgtgaaccgaagctccagcctccatggcttcgatcacctgcgccccctatgtaattatgtgatctcgctgatcggattgcgcctctgcgatgaggtcacggatcgatctctgtagtagtgcttgctagtacgggagaataaaaccagccaccgtttcttcaggctcccatcgctgctgggagttcgtgtttgactaggctgatgaggttgtttgtatgtctgcgtcagtttatttgcctttgatgcggtctcctgccacttggcattggtttccccctccgtgtctagctatggtgattgtgattttttgatcgtgtcggcagaatcgatcaatgcaaggaacctttgccctgtt

SEQ ID NO: 20700 - protein, 187 aa, Panicum virgatum
  misc_feature: Ceres CLONE 1812615
  misc_feature (43)..(172): Pfam Name: PLAT Pfam Description: PLAT/LH2 domain
MAKLPPCLLFAGAVFAAAAHAAAAGGAVTGVSAAAASDPEDKCVYTVYVRTGSIWKGGTDSKIGVTLLDGDGSGIRIADLERWGGLMGAGHDYYERGNLDIFSGRGPCMRQAPCAMNLTSDGTGPHHGWYCNYVEVTATGPHLGCAQQLFTVEQWLATDASPYRLYSTVDNCGGKKRREDAEAAAAM

SEQ ID NO: 20701 - DNA, 690 bp, Panicum virgatum
  misc_feature: Ceres CLONE 1812618
  misc_feature: Encodes the peptide sequence at SEQ ID NO. 20702
gtgggaagggaggagccagccagccagccacccacagcggccacacatcctcggcggctccatggctccttcctcctcccgccccccgcgccaccacctgcctctcctcctaaccctcgccgtcgtcttcgtctccctctccggcctcctcgcctcggtcccaacgtcagccgccgatatctgatggggaaggttacctcgaaaggacgttcctgagtccagcttctatcagagccactgctgtcatcatcagctggatgaaagatgccgggctcacgacgtgggttgatcaaatcgggaatattcatgggcggtttgagccggaaaattctaccaaagaggccttattgattggatctcatatggacactgttattgatgctggaatgtatgacggatcattgggtattattagtgcaatctctgccttgaaggttttgaaaattactgggaaactgcaaaggctaactagaccagtcgaggtcattgcattcagcgacgaggagggtgttaggttccagacaacttttctgggaagcgccgctgtagctgtggcactacagtccaagatgttctgaaaataaattcttttgaggctactgctgctgctattactcaaaccaggtacaagccagagtcagtgggaagctatgttgaggtatgaagcatttgaatgtctttcatgtgttt

SEQ ID NO: 20702 - protein, 106 aa, Panicum virgatum
  misc_feature: Ceres CLONE 1812618
  misc_feature: SWISSPROT Homolog: EC 3.5.3.9 Allantoate deiminase
MKDAGLTTWVDQIGNIHGRFEPENSTKEALLIGSHMDTVIDAGMYDGSLGIISAISALKVLKITGKLQRLTRPVEVIAFSDEEGVRFQTTFLGSAAVAVALQSKMF

SEQ ID NO: 20703 - DNA, 689 bp, Panicum virgatum
  misc_feature: Ceres CLONE 1812622
  misc_feature: Encodes the peptide sequence at SEQ ID NO. 20704
cccgccgtcgtcctcgccttctccccttccccgccgaaccccaccgccacctcctcccaccgccgccatgggccgcaagcttcccgccgagcaagcggaagcggagctacccaggagcagcaaaaaggagaagaagagcaagaaggacaagaagcggaagctcgctgccgaggccgaggtcgaggcggcggcggcggcggcggcgacggaggaggcggtcgcgaagagcagcaagaagaagcgggcggaggatgggcccggcggcggcggcggaggggaggcggagaacggcgccgagaaggccgtcgcggtgaccgggaagggctccgaggagcccaagtacgcggcgctgcggtcgttctccgccgctgagctgccgtcccaggtgctcgactgctgcaaagcgttcgcgcggccgtcgcccatccaggcgcactcctggccgttcctcctcgacggccgcgatctcatcggcatcgccgccaccggatccgggaagacaattgccttcggtgtgccggcgctgatgcacatcaggaagaaggtaggagggaaaacggggaagaaggccgtgccgcggtgcctcgtgctgtcgccgacgagggagctcgctcagcagattgcagatgtacttagtgaggctggtacaccttgtgggataaattcagtttgcctttatggtggaactt

SEQ ID NO: 20704 - protein, 207 aa, Panicum virgatum
  misc_feature: Ceres CLONE 1812622
  misc_feature (118)..(207): Pfam Name: DEAD Pfam Description: DEAD/DEAH box helicase
MGRKLPAEQAEAELPRSSKKEKKSKKDKKRKLAAEAEVEAAAAAAATEEAVAKSSKKKRAEDGPGGGGGGEAENGAEKAVAVTGKGSEEPKYAALRSFSAAELPSQVLDCCKAFARPSPIQAHSWPFLLDGRDLIGIAATGSGKTIAFGVPALMHIRKKVGGKTGKKAVPRCLVLSPTRELAQQIADVLSEAGTPCGINSVCLYGGT

SEQ ID NO: 20705 - DNA, 129 bp, Panicum virgatum
  misc_feature: Ceres CLONE 1812622-R
caagggaacaccaagcggggacaccacacagaagccgaagagccccgcccaccggagcgccccagcagcgcccggcccggcgccccccgcgggcaggccccggggacccggcggggcaagcccgaccgc

SEQ ID NO: 20706 - DNA, 333 bp, Panicum virgatum
  misc_feature: Ceres CLONE 1812643
  misc_feature: Encodes the peptide sequence at SEQ ID NO. 20707
accattacagtacgcactccggctgacgcgccccgcactctctcacaaagctcaagcctttcgctcgctcgctcgctcacggctacatctacaatggcgcgattccagctcgcggccctggccatggccatgctcttcgccgcggcggcggcgcaggccccggccgccaccccgacgccggcgcccagggcgacccccccgcaggcgactcctccgacgaccccggtgccggagtctacgaccacgcaggccccgggcattccacgcccggtccctgcgcccgtgaatggcgcaccccccacttacgtccgcttgctagagacagatcagacg

SEQ ID NO: 20707 - protein, 79 aa, Panicum virgatum
  misc_feature: Ceres CLONE 1812643
  misc_feature: Useful for making plants with altered carbohydrate content
MARFQLAALAMAMLFAAAAAQAPAATPTPAPRATPPQATPPTTPVPESTTTQAPGIPRPVPAPVNGAPPTYVRLLETDQ

SEQ ID NO: 20708 - DNA, 3162 bp, Panicum virgatum
  misc_feature: Ceres CLONE 1812657
  misc_feature: Encodes the peptide sequence at SEQ ID NO. 20709
ctgttccgccccagactccagaaacgcacgcgcgccgcagagcagagctgagcactcgactgactgactgaggcggcggcggccgccgcgcggcaggagcgagcgatcccgccccccatggcgcggtccaagaacggctgcctcaagatcctcgtctgcgccggctccggatccgacccctccgccggctccgacgccgacgccgacgaccaccccgacgagaacaaggccatatcagataaaagcaggtggagctttcgtaggaggtctacaaggcatcgagttttgaagaactctgatatctcagaacctgaaactcttagttcgagcaaagcaaaggctgacattacaccaagtaacaatgtttatacttcaacatactcttatgcctcggagaagcctctccagcaagacaagccagatgagaagattctacatgaagagaagccagaggagaagcctctgcatcaagagatgtctgatgaaaagctgatggagaagccagaggagaagcccctgcatcaagagatatctgatgaaaagctgatggagaagccaattgaaaagccggtccacaaacttatggaagaaccagttgaccagataattgaaaagtcgattgaacatccagctgaggagacaactgaaacagcaactgaagagccagccccaaaaattactgatgcaccaactgaagtgccagctgaaaaaacaagtgaggcagcatctgaagatccaactgaaagaataatggaaaatccaattgaagagacaactgagagggaagttgaagaactgattgaaaagccaactgtaaatatttctgtcgcatcaactgggccagagcaggaggaaacaacttcacctgttgaaggaatcggtgcagaccgtgaggatgatcacctggagtctgcagctagtgatcttcagcctgacagtgggacatccattgcaagacaagaactattgaatcagaaggatctggtgaaactgcaagctattgtacgtggacatctagttagaaaacaggcttcagaatctttgcattgcttgcttgcaattgttaaaattcaaggattaatcagggctcgtcaagcacagcaatcaggagagaaggttcaggagactattgtgcattcttcaggtgagaaattgcttcgcaatggttttgctctcaagctcatggacaccatgccgactccaaaatccattcacataaaatgtgatccttcagaatctgatatcacatggaaatggatggagaggtggacatccttaattccaccaatcactggggagcagttgccagggtacagagaaaatgtcgagttgatgggtgagaatgtgaaagaagatgctcagcatgatgacgagattgttcctttgggctcagatctatctttccccaagttggtgcctgaatatgtgaaagagtcactagggacatctgattctgttgatttgaaggctcctgcaagtatcccagatgaaacctctgaggtggaaatcagacgtgaccctgaatcagagttgattgaaaatattgatatagatgctgagcatgtgaccgaccaaaagtctgaaaatgctgtggacgagtttttgacgtcatcggatcaacagtctacccaagcggatgcatcaagtgaacccaaccctcttcctgaaaaacctgaatcatccattgaggacattgttgatgcatatagttctgagcagacactggagatcgaaggtaaaaggtctgtggtgagaaagtcatgcaatccagcgtttgccgctgcacagttgaaatttgaagagctgagtacaaattcaacagtcagcaggtccaacagttcatcgtatctggatggggcaagcaagtcaagggtgcatactcctcgttcacaagaagattacttgtcaaagcaagataacgacacggtcctatcagaaagctcagttggtcatgatgctaaaatggtaattgccgcttcagaatgtgagactgagatttcaatttcctctaccctggactcaccagatagatcagaaggtgatggtggggagattgtattggagattggatctctggaaaatagaaactatgtttctgacaaagctaataaggacgccagtatgatgcattctgaagtaaaaaattctcctgaagtagaagctgagctgcaaaaggaggaacaacagaatggccatgttgctgaccctgaagtagaagcccagccaaaagaagagcttgttcaggaaccacatgttgaaccagaaaaatcagatttgcaggactatgctgaaaaacctgtagagtgttatgccacacctgaaggaactccgatgagccgagccaccgttccagaatctcacggaacaccatcaagtgaggtatctgttaataccaaaaagagcaggagcaaaaagcccaagtcccatgcaagcaagaggtcactggctagtcccaacagtgattcagtaggacggagcagcaccgaaaatttctcaaaggaatcaaggcgtgccaagagagagaactcaagcaaggctgctaaatccgaccacgccgaccaagaacctcggataagcaacagcaacccggtgccaagctacatgcagtttacagaatctgcaagggcaaaggcgtctgctagtgcatccccaaagatgagcccggatgttcaggacagcaaccctaggaaaaggcattcgttgcccatgacaaatggcaagcacgattcatctccccgcatgcaacggtcatcgtcccaggctcagcaaaacgtgaaaagcaatggtgctgttcctcacaactcatctgacaagaggtggcatatctgatgtgttctccgagcagcatacccgcgtggtgccatcgaatatccagatgggtttctcgtgatgactcttgccttctccgcgtgttccatctaattcgtcggttctttttctttttcttgattcgttgttggaatacagagtatggttggaagaagggcagcagctgccgcttgatatgtgtacatttgttggttgttattggttgtgttatttgactgatgatagtggtttctgtgtgtaatatatatccttgacatgtaacgcagcagcaggctgaagagtgtggattggtctgttacatttggtaatattgaagttactgttggtgtggat

SEQ ID NO: 20709 - protein, 903 aa, Panicum virgatum
  misc_feature: Ceres CLONE 1812657
  misc_feature: SWISSPROT Homolog: EC 3.1.1.3 Triacylglycerol lipase
MARSKNGCLKILVCAGSGSDPSAGSDADADDHPDENKAISDKSRWSFRRRSTRHRVLKNSDISEPETLSSSKAKADITPSNNVYTSTYSYASEKPLQQDKPDEKILHEEKPEEKPLHQEMSDEKLMEKPEEKPLHQEISDEKLMEKPIEKPVHKLMEEPVDQIIEKSIEHPAEETTETATEEPAPKITDAPTEVPAEKTSEAASEDPTERIMENPIEETTEREVEELIEKPTVNISVASTGPEQEETTSPVEGIGADREDDHLESAASDLQPDSGTSIARQELLNQKDLVKLQAIVRGHLVRKQASESLHCLLAIVKIQGLIRARQAQQSGEKVQETIVHSSGEKLLRNGFALKLMDTMPTPKSIHIKCDPSESDITWKWMERWTSLIPPITGEQLPGYRENVELMGENVKEDAQHDDEIVPLGSDLSFPKLVPEYVKESLGTSDSVDLKAPASIPDETSEVEIRRDPESELIENIDIDAEHVTDQKSENAVDEFLTSSDQQSTQADASSEPNPLPEKPESSIEDIVDAYSSEQTLEIEGKRSVVRKSCNPAFAAAQLKFEELSTNSTVSRSNSSSYLDGASKSRVHTPRSQEDYLSKQDNDTVLSESSVGHDAKMVIAASECETEISISSTLDSPDRSEGDGGEIVLEIGSLENRNYVSDKANKDASMMHSEVKNSPEVEAELQKEEQQNGHVADPEVEAQPKEELVQEPHVEPEKSDLQDYAEKPVECYATPEGTPMSRATVPESHGTPSSEVSVNTKKSRSKKPKSHASKRSLASPNSDSVGRSSTENFSKESRRAKRENSSKAAKSDHADQEPRISNSNPVPSYMQFTESARAKASASASPKMSPDVQDSNPRKRHSLPMTNGKHDSSPRMQRSSSQAQQNVKSNGAVPHNSSDKRWHI

SEQ ID NO: 20710 - DNA, 649 bp, Panicum virgatum
  misc_feature: Ceres CLONE 1812658
  misc_feature: Encodes the peptide sequence at SEQ ID NO. 20711
atcgcagccatcctgactcgcgaggcacgggcgacaatcccaaagccacatctacgccgccgccgccgcctcctgctgacccgcctcgccgctgtccccagcgtcgtggactgctctccgccgccgcggctagcagccatggccaccaccgctcgctctctccacctcccgacacctcctaaaccctctaacccctcccaccaccgcatccctgtccccttccacatccgcccccgcccccagcgcctcggccgccgcctggccgcctcgtcctccgacctcacctcgttccccgacccggccccgaccccgaacggcgtctacgtcccgtgggcggcggcccaccccgcggccgccgcggccatcgacgtggacgccgccacggaggcggagctgcgggagaacgggttccggagcacgcgccgcaccaagctggtctgcaccattgggcccgccacctgcggcgccgccgagctcgaagcgctcgccgtcggcggcatgaacgtcgcgcgggtcaacatgtgccacggcgaccgcgagtggcaccgcggggtcatccgcgccgtgcggaggctcaacgacgagaaggggttcgccgtcgcggtcatgatggacaccgaggggagcgagatccacatgggcgacctcg

SEQ ID NO: 20711 - protein, 170 aa, Panicum virgatum
  misc_feature: Ceres CLONE 1812658
  misc_feature: SWISSPROT Homolog: EC 2.7.1.40 Pyruvate kinase
MATTARSLHLPTPPKPSNPSHHRIPVPFHIRPRPQRLGRRLAASSSDLTSFPDPAPTPNGVYVPWAAAHPAAAAAIDVDAATEAELRENGFRSTRRTKLVCTIGPATCGAAELEALAVGGMNVARVNMCHGDREWHRGVIRAVRRLNDEKGFAVAVMMDTEGSEIHMGDL

SEQ ID NO: 20712 - DNA, 1911 bp, Panicum virgatum
  misc_feature: Ceres CLONE 1812666
  misc_feature: Encodes the peptide sequence at SEQ ID NO. 20713
cccaattcaacatcaactcctcctttcccctcctttctcagcaaaccagcctcatcctctcataccactcacagttccacatcaagaacaaataagaagaggaaaagaactagaagaggggaccaaggatctgatcaccatggcgtcctacgacaaggccttcgagtcctacaagaaggccctcaccaccgcagcgtccgtcgcggcatctctgatgctggtgcgcagcgtggtgaacgaggtggtgccgtacgaggtgcgcgagatactcttctccagcttcggctacctgcgctcgcacatgtcatcgcagcacaccatcatcgttgagaagaagaacgatggattcaccaacaaccacatctacaacgccgtgagaatgtacctcgctacacgcatcaacaccgacctgcagcagcgtctgcgggtcagcagcatggacgaaaatgacaagatgatgatcagcatggcggagggagaggagatgctggatgtttatgaaggaacagaattcaaatggtgcctcatctgtcaagacaactcaagtgactccagcaatggcaatggcagtccaaacgaggtctccttcgaggttagcttccacaagaatcacaaggaaaaagccctcaaatcatacttcccattcattttggccacagccaaggacattaaagctcaggagagaactctcaggatatacatgactgaatactcaagcgagtggtccccaattgacctccaccacccatctacatttgacacacttgccatggaccagaagctgaagcagtccatcatcgatgaccttaacaggttcatcaagagaaaggattactataagaagatcggcagggcatggaagcgggggtacctgctgtatggtccacctgggaccggcaagtccagcctgattgcagccatggccaaccatctcaggtttgacatatatgatctcgagctaactggggtcaattccaactcagaccttagaaggcttcttgttggcatgagcaaccgatccattctagttgttgaagatattgactgcaccatcgatctgaaacaaagggaggaaggtgaggggcatgacaagtcgaattctacagaagaaaacaagggagacgacaaggtaacgctgtctggcctgctcaactttgttgatgggctatggtcaacaagcggggaagaaaggatcattgtcttcacaaccaattacaaggagcggctcgacccagcactattgcggcctggaaggatggacatgcacatccacatggggtattgcacccaagagtctttccgaatccttgccaacaactatcactccatcgactaccatgacacatatccagagattgagaaactgatcaaggaggtgacagtgacaccagcagaggttgctgaggttctgatgaggaatgatgacactgattctgcgctccatgatcttgtcgattatctgaagtcaaaaatgatagaaaccaatgagatcaagactgaacacaaggaagcaaataaacaactgaatgagaaggaagacaacagagatagtgaccaaaaatagaaccccagtgcaattccctccaaaatgtggaaaaaactggaattctggaaatgaagagaaagcattttgccgtctgtgtggaagctaacaactatcaaaaggtgtgagtatcatatagcatagatagatcctacaggagacctattggggtttgcatattgtagatcaatcaggtgcattggtactagcagtgtgtctgcagagttctgttagtactgccacaatagcatgtatatagaattacagatatgcagaatccatatggcttcttatatgaaactacaaacatggcattgccttgtaaatgccaatgttggaaagtgaataccagtactatattgttattc

SEQ ID NO: 20713 - protein, 474 aa, Panicum virgatum
  misc_feature: Ceres CLONE 1812666
  misc_feature (243)..(419): Pfam Name: AAA Pfam Description: ATPase family associated with various cellular activities (AAA)
  misc_feature: SWISSPROT Homolog: EC 3.6.4.3 Microtubule-severing ATPase
MASYDKAFESYKKALTTAASVAASLMLVRSVVNEVVPYEVREILFSSFGYLRSHMSSQHTIIVEKKNDGFTNNHIYNAVRMYLATRINTDLQQRLRVSSMDENDKMMISMAEGEEMLDVYEGTEFKWCLICQDNSSDSSNGNGSPNEVSFEVSFHKNHKEKALKSYFPFILATAKDIKAQERTLRIYMTEYSSEWSPIDLHHPSTFDTLAMDQKLKQSIIDDLNRFIKRKDYYKKIGRAWKRGYLLYGPPGTGKSSLIAAMANHLRFDIYDLELTGVNSNSDLRRLLVGMSNRSILVVEDIDCTIDLKQREEGEGHDKSNSTEENKGDDKVTLSGLLNFVDGLWSTSGEERIIVFTTNYKERLDPALLRPGRMDMHIHMGYCTQESFRILANNYHSIDYHDTYPEIEKLIKEVTVTPAEVAEVLMRNDDTDSALHDLVDYLKSKMIETNEIKTEHKEANKQLNEKEDNRDSDQK

SEQ ID NO: 20714 - DNA, 1757 bp, Panicum virgatum
  misc_feature: Ceres CLONE 1812688
  misc_feature: Encodes the peptide sequence at SEQ ID NO. 20715
ccacaccatcgttcaggagcagggttcacttgacagttccaaagccgagttgaaagtaatattgtcaaggaacgtgaagggaagaggcctcttttgacgggtgacctgcaagtgactcttaaagaaggtgttggaaccataggggagcttaccttcactgacaactccagctggataagaagcaggaaattcagacttgggctgaggattgctcctggcttttgtgaaggtattcgtgtccgagaggccaagacagaagctttccccgttaaggatcacagaggagaattgtacaaaaagcactacccacctgcgttgaaggatgatgtttggagattagaaaagattggcaaagatggtgcattccacaagaagttaaatgccagtggaatctacatggttgaagatttcctccagcttcttgttagggatcagcagagattgcgtagcattctgggcagcggcatgtcaaataagatgtgggagagccttgttgagcatgcaaagacttgtgtcttaagtggaaagcattatgtatattatgctagtgacacaagaaacgttggtgcaatattcaataacatctacgagtttactaggttgattgctgatgatcagttcatttcagcagaaaatctcacagacaatcagaaggtctatgcagacgcattggtaaagaaggcatatgaggactggatccatgctgtagagtatgatggcaaggcactcttgagcttcaagcagaaaaagaaatctgtcacaacaagaagtgacactgcagctgcttcaacaagcgatcctgcttcatatggttcggccaattcacagaaacaatcgtccctgccagcgaaatctggacaaccttcctcggcagcagatggaactagaagtgcatacaatggaaaccagtcaacaagacaggcagccaacactgagaacattcccacaaacatcaccatgcaatatgacaggagtgcactgttgccagaaagccaatttagtggttcatcccttcaggctcaagcttcaagagggtccaatatgctagcattgggacctctgcagcaacagaaccaaagttttgaattcccagcacttggtcagtccatgcagtcagggatgaatccttttgatgaatggccgcaaccacagaagaaccgtggtggggttgatgactacttgatggaggagattaggatgaggagccatgagatactagaaaatgaagaaatgcagcaaatgttgcggattctgagcatgggtggcgcaggaaccaacctaactgaagatggcttcaacttcccttcttacatgcctacaccttccccgaacttgagcgttgaggatgaccgcacccgtgcgcctgggaaagctgttgtcgggtggctcaagatcaaggctgcgatgcggtgggggatctttgtgaggaagaaggctgccgagagaagagctcagcttgttgagcttgacgactagagaaagtattaacagctggaagcatgcgctctcgagctggtcttgtaccaaggtttcatcgatgttgtttgtgtacgggtgggctcagctcagctatgacccttaggcggacagttctggccctgagcttaattatggacaaaactcatttccatttttccttttgtatagctcttcctgccattttccatgcttttgtttgtttagtgtgatgctagtcctgttatgaaccttaacctgaactctgtacatttatttgttacagaatccaaacaggcatt

SEQ ID NO: 20715 - protein, 359 aa, Panicum virgatum
  misc_feature: Ceres CLONE 1812688
  misc_feature (1)..(115): Pfam Name: Calmodulin_bind Pfam Description: Calmodulin binding protein-like
MVEDFLQLLVRDQQRLRSILGSGMSNKMWESLVEHAKTCVLSGKHYVYYASDTRNVGAIFNNIYEFTRLIADDQFISAENLTDNQKVYADALVKKAYEDWIHAVEYDGKALLSFKQKKKSVTTRSDTAAASTSDPASYGSANSQKQSSLPAKSGQPSSAADGTRSAYNGNQSTRQAANTENIPTNITMQYDRSALLPESQFSGSSLQAQASRGSNMLALGPLQQQNQSFEFPALGQSMQSGMNPFDEWPQPQKNRGGVDDYLMEEIRMRSHEILENEEMQQMLRILSMGGAGTNLTEDGFNFPSYMPTPSPNLSVEDDRTRAPGKAVVGWLKIKAAMRWGIFVRKKAAERRAQLVELDD

SEQ ID NO: 20716 - DNA, 1160 bp, Panicum virgatum
  misc_feature: Ceres CLONE 1812692
  misc_feature: Encodes the peptide sequence at SEQ ID NO. 20717
caggcaggccgcgggggccaacatcgagcagccgcagccgcgccaaacctccgcgagctcgctaatggcgctcgcactgtccacgctcccgctcgtgccctccaatccctctccatcctccggcgccacccctgccgccgccgcgttccctcctcgtcgggtccacctcgctgccgccggtaggagcggcgccggcgtcctcccgcgcgcttgtgccgcgccgcggcatcgcgggcgggttccgaggcggcgccgtggagggagcctggtggtctgggcgtcggcagactactacgcgacactgggcgtgaagcgctctgcgaccaacaaggacatcaaggccgcctaccggaagcttgcgcgccaggtgttgtcagatgaaaagaagagggcattatatgaccaatatggtgaagctggggttaagagtgcggttggaggctcgggtggagcatacacaactaatccattcgatctgtttgagacattctttggagcaagcatgggtggcttttctggcatggaccagagcacatttaggacacgcaggcgaggcactgctgttcagggtgaagacatcagatatgatgtgattctgggattcacagaaacaatatttggaacagagaaagacattatattatcgcatttggaaacatgtgatacatgtggtggttctggatcaaaggctggctccaagctgagaatatgttccacatgtggtgggcgaggacaagtaatgcgaactgagcaaacaccatttggtctattctcccaggtttctatttgccccacttgtgctggagagggcgaagtcatttcagagtattgcagaaaatgttctggagaggggcgtattcgtgtcaggaaggagatcaaagtgaaaatccctccaggagtgagtaaaggtagcactcttcgtgtacgtggggaaggtgatgcaggaccaaaaggtgggccaccaggagatctttatgtttgcctcgatatagaggagccatcagatatcaaaagggatggtataaacttgtattcaactctgtcgataagctaccttgaagctattttgggcaccactaagatggtcagaactgtggatggaaccaatgaacttcgaatacctccaggtacccaacctggtgatgtaattgtcttggcga

SEQ ID NO: 20717 - protein, 365 aa, Panicum virgatum
  misc_feature: Ceres CLONE 1812692
  misc_feature (186)..(270): Pfam Name: DnaJ_CXXCXGXG Pfam Description: DnaJ central domain (4 repeats)
  misc_feature (283)..(365): Pfam Name: DnaJ_C Pfam Description: DnaJ C terminal region
  misc_feature (75)..(113): Pfam Name: DnaJ Pfam Description: DnaJ domain
MALALSTLPLVPSNPSPSSGATPAAAAFPPRRVHLAAAGRSGAGVLPRACAAPRHRGRVPRRRRGGSLVVWASADYYATLGVKRSATNKDIKAAYRKLARQVLSDEKKRALYDQYGEAGVKSAVGGSGGAYTTNPFDLFETFFGASMGGFSGMDQSTFRTRRRGTAVQGEDIRYDVILGFTETIFGTEKDIILSHLETCDTCGGSGSKAGSKLRICSTCGGRGQVMRTEQTPFGLFSQVSICPTCAGEGEVISEYCRKCSGEGRIRVRKEIKVKIPPGVSKGSTLRVRGEGDAGPKGGPPGDLYVCLDIEEPSDIKRDGINLYSTLSISYLEAILGTTKMVRTVDGTNELRIPPGTQPGDVIVLA

SEQ ID NO: 20718 - DNA, 514 bp, Panicum virgatum
  misc_feature: Ceres CLONE 1812692-R
ggcacaagtcaagaagatacagataaatccaatgaaggagaggatgattggttgaagaaacttacagattttgcagggtctgttgtcaatggtgctgcgaagtggctgaaagacaacctgtaggctgtaaatatttaccatagtccgatctgcaatttttcaattcatcggggttcccacgagctcttacattcattttgttggagggcttaaagattttcaggctggcagccgagagggtgagacgtgtcaactaatatagttgacacatcgatatgttctgtcttggaaaggaatgattattacgatgtagttgcagttatttcaattttccaagcacatgtagatgtagcagcctgaaattgcgggatgctgatctgaaacccagagattcagcaatgttgtaaatatatgtttaattccccctgaagtagggttgcatgaaatctcaggttctgtacttgaggttttaagttaataaaattcaggaccaacggatacgcgtattctgatt

SEQ ID NO: 20719 - DNA, 1869 bp, Panicum virgatum
  misc_feature: Ceres CLONE 1812727
  misc_feature: Encodes the peptide sequence at SEQ ID NO. 20720
aatttccctcgcttctcccaccccacttttccctcgttttcttccctcctctcccttccgccgcgcaaaccctcgcccgccgcctcctcagatcccagctcccgaatcctgccgccctcccgcgcgccgtccctccgatccgcggctccgcgcgtgccccgatccccatggcggcggcagcggccggcggcggggccggcgaggccggcgcgcgggcgctgctgcagcggcaccagcccttcgcgccgccgcccggcgagtaccacaacttcggcgcgcccgcggccggcggcgacgagatggtggaggccgtcgtcctcaggacgccattgaaacggaaacagaatagagaaggaaatggagctgccgaatcaaatgactggatgatgagccctggatatgttaatgcaggcagcagtccggttcctacacccccttcagggaaaggtttaaaatcttctgccaagcctaaggctaccaagagccagaaaccttgccctcagacccctttgagttttggttctccaggcaatccttctactcctgtcggtggctgccgctatgatagctctctagggctcttgacaaagaagttcctgaacttgctaaaaggtgcacctggtggcatagttgatctgaacaatgctgcggaaactctagaggtacagaaaaggcgtatatatgacattactaatgttctcgaagggatagggcttatagaaaagaagctgaagaacaatatctgttggaaaggaattgatgactcgctgcctggagaagttagtgatgatatgtcaattttacaggcagatattgaagctctcacaatgcaagagcaaaatttggatgaacgaataaatgacatgcgggacaggttaagggagcttactgaagatgaaaataatcaaaagtggctttatgttacagaagatgatatcaaatctttgccttgctttcagaatcaaactctaattgctataaaagcaccgcatggtacaactttggaagtcccagatcctgatgaggttaatgattatcctcaaagaagatacaggattgtgctaaggagtaccatgggtccgattgatgtgtacttagttagtcaatttgaggagatgagtggcatggaaactcctccgaggcctacgccgacaatatgcatggattctctagagaatcctaggacgcctttggctgcagaatgcagcaaagcttcagggtcagaacctaacattcaacaagggcttacactacctcctgatgctcctagtagttcgcaggacattggcgggatgatgaagattgtcccttcagagcttgatactgatgcagactactggctgttatcagacacaggagttagcatcacggacatgtggaagacagcaccagatgtggagtgggacgggattgagaaattcaacgcggaggatttcctggaagtcagcacgcccaatcagcaggataaaccggccgacgtcgtggatggcccctcctgtataagctgaaaacggatgaatcgtggcagggaacaccattcatattttagcggccgatggatcaacttggtcagtagactgctgagtgatgtacagatggtagcccagaaataactcaaatgatctttcggatcatgccgatcatagaatcgagcgtggaatgtggacggctcaggctgtctttcacaggtcgaccttgaaaccatgtgccgggtctggaagttgcatgctgtgctgggcatcgcacagcattaggagtgtacaattaggaatatgttgtgtgtactgatggtgctcgctaagacccatttgtaaaatagtagttactattagttatttattatttgtgtgatactgattcatctctctt

SEQ ID NO: 20720 - protein, 446 aa, Panicum virgatum
  misc_feature: Ceres CLONE 1812727
  misc_feature (131)..(196): Pfam Name: E2F_TDP Pfam Description: E2F/DP family winged-helix DNA-binding domain
MAAAAAGGGAGEAGARALLQRHQPFAPPPGEYHNFGAPAAGGDEMVEAVVLRTPLKRKQNREGNGAAESNDWMMSPGYVNAGSSPVPTPPSGKGLKSSAKPKATKSQKPCPQTPLSFGSPGNPSTPVGGCRYDSSLGLLTKKFLNLLKGAPGGIVDLNNAAETLEVQKRRIYDITNVLEGIGLIEKKLKNNICWKGIDDSLPGEVSDDMSILQADIEALTMQEQNLDERINDMRDRLRELTEDENNQKWLYVTEDDIKSLPCFQNQTLIAIKAPHGTTLEVPDPDEVNDYPQRRYRIVLRSTMGPIDVYLVSQFEEMSGMETPPRPTPTICMDSLENPRTPLAAECSKASGSEPNIQQGLTLPPDAPSSSQDIGGMMKIVPSELDTDADYWLLSDTGVSITDMWKTAPDVEWDGIEKFNAEDFLEVSTPNQQDKPADVVDGPSCIS

SEQ ID NO: 20721 - DNA, 519 bp, Panicum virgatum
  misc_feature: Ceres CLONE 1812730
  misc_feature: Encodes the peptide sequence at SEQ ID NO. 20722
tcgtacatgtagtctaggggatcagcaggggagcggaggcggaggcctgtggagagagaggggctagatggacgtgaagtcggtcgcggtagcccgcgggctccggccgagggcgaggaccacaaaaaacgcgccggctggcggagccgccgcggcatccgccccgagatggtgctggtcggcttccgcctcgcgctgcccctcctcttcctcgccttcggcgggcgctggggcagctgctccttcccctcatcctccccgtctacgccctccggcgccccccccaacttcttcctcagcagccgcggcccctccccgcagatcagaacaaaaccctaagctatgactcctaagaacgatctcccgccaaccacttcatctgctaccgctgaccaccttcggggaggattgctctccaccgctttcgacgaagcctcctaccatatccgctacaaatccaacctctaccgtaagccgtacccgatcccgctctccccctagctcgtgcagaagctgctc

SEQ ID NO: 20722 - protein, 52 aa, Panicum virgatum
  misc_feature: Ceres CLONE 1812730
  misc_feature: SWISSPROT Homolog: EC 2.4.1.69 Galactoside 2-alpha-L-fucosyltransferase
MTPKNDLPPTTSSATADHLRGGLLSTAFDEASYHIRYKSNLYRKPYPIPLSP

SEQ ID NO: 20723 - DNA, 695 bp, Panicum virgatum
  misc_feature: Ceres CLONE 1812740
  misc_feature: Encodes the peptide sequence at SEQ ID NO. 20724
accgcccgcccgccgcgatggcgatgcgccagctcgccaggctccaccagcgcctccccccttctctcccccgccggcacgccacgcgccacgcgtggccgcccgccgccgacgcggcgttcctctgccgcgggctcgcctcctcgtcgtcgtcctccgcggccgccgcctcggcggcgggtcgggagaagagctcgaggcggacgctggggtacctgctcggcgtggcggtcgctatggtcggcgcttcctacgcggctgtcccgctataccgtcgcttctgccaggctaccggctacggcggcaccgtccaacgacgcgagagtgtggaggagaaaatctcacgacatgctcgagatggaactacaacgtcacgggagatcattgtccaatttaacgctgatgttgctgatggaatgccatggaagttcattcctacacagagagaggttagggttaaacctggtgaaagtgctctggcgttttatactgctgaaaatcgcagttcagctccaattactggtgtgtccacatacaatgttgctccaatgaaggctgccatttactttaataagatacaatgcttttgctttgaggagcaaacacttcttcctggggagcagatagacatgccagtattcttctacatcgatcctgagtttgagacagaccccaaaatggagggggtgaacaat

SEQ ID NO: 20724 - protein, 225 aa, Panicum virgatum
  misc_feature: Ceres CLONE 1812740
  misc_feature (81)..(225): Pfam Name: CtaG_Cox11 Pfam Description: Cytochrome c oxidase assembly protein  CtaG / Cox11
MAMRQLARLHQRLPPSLPRRHATRHAWPPAADAAFLCRGLASSSSSSAAAASAAGREKSSRRTLGYLLGVAVAMVGASYAAVPLYRRFCQATGYGGTVQRRESVEEKISRHARDGTTTSREIIVQFNADVADGMPWKFIPTQREVRVKPGESALAFYTAENRSSAPITGVSTYNVAPMKAAIYFNKIQCFCFEEQTLLPGEQIDMPVFFYIDPEFETDPKMEGVN

SEQ ID NO: 20725 - DNA, 1639 bp, Panicum virgatum
  misc_feature: Ceres CLONE 1812741
  misc_feature: Encodes the peptide sequence at SEQ ID NO. 20726
aaaaaaaaccacaaaaaaacttggtgggcagagaaaaaaaaggttcttttttattttcctcgtcctcctcgtctcgactcgccgcccactgcgcccgtccccctccccctcggccccgatccaatccccccaaaccctaggcaatccgccaccagagtgccgggtcgtcgccccccgtccctcacccgcggcggcgcggcacatggcccacggcggcggcgggagggcgaaggttacgccgaacctcgcggtggacggcgagggcacgcggacgctcaacctcaccgtgctgcagcgcctcgaccccgccgtcgaggacatcctcatcaccgccgcccacgtcacgctctacgacttcgacaccgacgtcaaccagtggagccggaaggatgtcgaggggtcgctcttcgtcgtcaagaggaatgcccaacccagattccagttcattgttatgaatcgccggaatacagataatctagttgaagatctcttgggagatttcgaataccaactccaagttccttatataatgtaccgcaattctgctcaagaagttattggaatttggttttacaactcccaggagtgtcaagaagttgcgaatctttttagcaggatactaaatgcattctcgaaggtgcctccaaagccaaagattccctccgttcaaagtgaatttgaagagcttgaagcagcacctgcattggttgaaggtcctctggaactgcaaacatcaaatatcatatcaactgctacccacgttcaagaggaccccttatctgcattcttcagtgcagctgcgaacgctggtggcaccgcctctgttgctgttgcaggacagccaaatcaatcttttggtgctattcctttgtcacatgcacctcctagcacaattacatcgcaatcaccgggcttgcatcatttgcttccttcacaggcctcatcagtttctggcatacctgctgatgttcatggtggcactggtcctatagtgaggtccacaagccttgtaaatccatcacatttctcaccattgacatcagcgcagacagcaatggtgcgcagtaattctgcagtaccaactgctccacctcaacatcctcgtaatgctcagcagccgcaaagtgctcccttgcttcagccttttccattacctacagcttcaccttctccaccgtatgggactccattgcttcaaccgtttccaccaccaaatccatcgccgtctcttgcatcagctccagtctacaacccagcactgtccagagacaaagttagagatgcgttactgagacttgtggagaacgaagaatttatcgatttggtgtaccgggagatcgtgaacagacaataatgaatattgaatgaacagacctctccaacaagttggttgtgtttggacttttgttatctgttgtgaagcctgtaattcaagttatgatgtaaattcatttgtgaagttcatggcttggtgaagtttgtattaatgtactttcgacatatctgtaaatgcttatgaaatctatctgctccgtcgaatgtcatctgctgtattcgtggtgcagaaaagttttgttctgaacatatatcttaactttgggatctaataatgattctcgtgggcaagaacatatatctt

SEQ ID NO: 20726 - protein, 383 aa, Panicum virgatum
  misc_feature: Ceres CLONE 1812741
  misc_feature (18)..(140): Pfam Name: DCP1 Pfam Description: Dcp1-like decapping family
MAHGGGGRAKVTPNLAVDGEGTRTLNLTVLQRLDPAVEDILITAAHVTLYDFDTDVNQWSRKDVEGSLFVVKRNAQPRFQFIVMNRRNTDNLVEDLLGDFEYQLQVPYIMYRNSAQEVIGIWFYNSQECQEVANLFSRILNAFSKVPPKPKIPSVQSEFEELEAAPALVEGPLELQTSNIISTATHVQEDPLSAFFSAAANAGGTASVAVAGQPNQSFGAIPLSHAPPSTITSQSPGLHHLLPSQASSVSGIPADVHGGTGPIVRSTSLVNPSHFSPLTSAQTAMVRSNSAVPTAPPQHPRNAQQPQSAPLLQPFPLPTASPSPPYGTPLLQPFPPPNPSPSLASAPVYNPALSRDKVRDALLRLVENEEFIDLVYREIVNRQ

SEQ ID NO: 20727 - DNA, 698 bp, Panicum virgatum
  misc_feature: Ceres CLONE 1812746
  misc_feature: Encodes the peptide sequence at SEQ ID NO. 20728
acacacgcggacacgccactagcctcctctcggtctgagcagctcatcaacgccgccggcaagaattcccctcgagcttgcccccggcagccagccagcccaggcatcagccatgggctcgaccgccgccgacgtggccgcggccgcggccgcggacgaggaggcgtgcatgtacgcgctgcagctggcgtcgtcgtccatcctgccgatgacgctcaagaacgccatcgagctgggcctgctggaggtgctccagaaggaccccgcggcggcgctggcgccggaggaggtggtggcgcggctgcccgtggcgccggccaacccggacgcggcggccatggtcgaccgcatgctgcgcctgctcgcctcctacgacgtcgtcaggtgccggatggaggagggcaaggacggccggtactcgcgccggtacgccgccgcgccggtgtgcaagtggctcacccccaacgaggacggcgtctccatggccgcgctcgcgctcatgaaccaggacaaggtcctcatggagagctggtactacctcaaggacgcggtgctggagggcggcatcccgttcaacaaggcgtacggcatgacggcgttcgagtaccacggcacggacccgcgcttcaaccgcgtgttcaacgagggcatgaagtggatcctccacgactggagcgacgcccactgcgcggcgatcc

SEQ ID NO: 20728 - protein, 195 aa, Panicum virgatum
  misc_feature: Ceres CLONE 1812746
  misc_feature (33)..(85): Pfam Name: Dimerisation Pfam Description: Dimerisation domain
  misc_feature (94)..(195): Pfam Name: Methyltransf_2 Pfam Description: O-methyltransferase
  misc_feature: SWISSPROT Homolog: EC 2.1.1.68 Caffeate O-methyltransferase
  misc_feature: Useful for making plants with altered carbohydrate content
  misc_feature: Useful for making plants with altered cell wall content and/or composition
MGSTAADVAAAAAADEEACMYALQLASSSILPMTLKNAIELGLLEVLQKDPAAALAPEEVVARLPVAPANPDAAAMVDRMLRLLASYDVVRCRMEEGKDGRYSRRYAAAPVCKWLTPNEDGVSMAALALMNQDKVLMESWYYLKDAVLEGGIPFNKAYGMTAFEYHGTDPRFNRVFNEGMKWILHDWSDAHCAAI

SEQ ID NO: 20729 - DNA, 1540 bp, Panicum virgatum
  misc_feature: Ceres CLONE 1812750
  misc_feature: Encodes the peptide sequence at SEQ ID NO. 20730
atgccagcctggttcccccaacaggccaacacccacagccatcatctcctctccccaatccggcaatcacccactatgaatctgctcccccaagaagccaccgctcccaatccctcgtaaccaccccgcacatctccgccaacaatggaaacaggccgagatgggttctttggtgcagcggaaagggcatcgccgccgccgccgccgccttcttgctcgtttcttggatccgccgccgccgccgccggctccggcggagcgcggatgctgagcttctcctccagtggcgcagcagggttgggcctgagctcaggggctagcaagatgcagggggtgttgtcgagggtgagggggccattcactccgacgcagtggatggagctggagcaccaggccctgatctacaagcactttgctgcgaatgctccggtgccatccagcttgctccttcccatcaaaagaagtatcaatccatggagtggtcttggctccagctcattagggtggacagtatttcctcctggttctggtgatgttgaaccaggaagatgccgtcgtactgatggcaagaagtggcgttgctcgagagatgctattggtgaccaaaagtactgcgagcgacacataaaacgcaattgccaccgttcaagaaagcatgtggaaagccgaaaggcgacacccaccattgcagaaccatccctggctgtttctggtggaccatcattgccaagttatgctgtgccttggcagcagcaggtgaaaagctcagctgctaatgtgactgatcctttctcaagagaatccaacaggaagttgctggagaaacagaatgtacacagccagttatcagtatcaactcccatggattctttcaatttttcaacctcaggttcttcccagaaccgtgacatagtagcattatcaccagtggagtttcagcatgatcatgatcaggcataccttgtgcacggagttggcagttcagcagaaaatgataatgagttgcaggaaagtcttttactagtctccaaggaaactcttgatgatgggcctctaggtgaggtttttaaaagcaaaagttgccaatcagcatatgcggacatcttaactgaccaatggactgcaacccgtgatatgcattccccaactggaatcctacaactgtctaatagcaacacaatgccactagagaaccacataaatagcaatgactatcttatggcaacaatggtgaatgctcagactgtcccaacattcctttaattgttcatcaggcctgtcttgtcggaaccataaataactgaaactgtgttcatggcatcagtctgctgatactaggtttctagtcttgtcatctagtactccggttttagttgttacatgttcaagctatgccgccttttccttttcagtttaggtgaattagtcttcttttgccctgtaaagaatttgaattccaatctgagattgggattcatgttggttgcctaacatggaggcattatgcaatcctggtttccaatggagcaagattcctttc

SEQ ID NO: 20730 - protein, 372 aa, Panicum virgatum
  misc_feature: Ceres CLONE 1812750
  misc_feature (130)..(175): Pfam Name: WRC Pfam Description: WRC
  misc_feature (70)..(106): Pfam Name: QLQ Pfam Description: QLQ
METGRDGFFGAAERASPPPPPPSCSFLGSAAAAAGSGGARMLSFSSSGAAGLGLSSGASKMQGVLSRVRGPFTPTQWMELEHQALIYKHFAANAPVPSSLLLPIKRSINPWSGLGSSSLGWTVFPPGSGDVEPGRCRRTDGKKWRCSRDAIGDQKYCERHIKRNCHRSRKHVESRKATPTIAEPSLAVSGGPSLPSYAVPWQQQVKSSAANVTDPFSRESNRKLLEKQNVHSQLSVSTPMDSFNFSTSGSSQNRDIVALSPVEFQHDHDQAYLVHGVGSSAENDNELQESLLLVSKETLDDGPLGEVFKSKSCQSAYADILTDQWTATRDMHSPTGILQLSNSNTMPLENHINSNDYLMATMVNAQTVPTFL

SEQ ID NO: 20731 - DNA, 658 bp, Panicum virgatum
  misc_feature: Ceres CLONE 1812752
  misc_feature: Encodes the peptide sequence at SEQ ID NO. 20732
gcgagcccccgaatcgctccccccaaggcaccccaatcccaacctccccaccgcaaatccttcctccgcctctccctcctcctcctcctccaccgcctccaggcgcggccgcagttggttgctcgagctcgtgtggcccaggatcgctggacaggaaggggctaatcggtgctctgcataggactttctggatttgagtcgtttcatattctcagactcacagcttgatccagtgatcctaaccacgccagcttgatcagagtctcacactgagtatggcgcctcctgctgccgcaccgggtggctctgaggctgagggggcaccacgcatggccaaattcctctgcatctttggaggcagtatccttccccgcccacttgatggctgtcttcgatatgtaggcggtgatactcggatcgtcatgctgccacgtgatatatcatatgctgacctagcagcgcggatgagagagctttacaaggatgctgatatcatcaaatatcagcaacctgatgaggatctagatgcgctggtctcggttgtgaacgatgacgatgtgctgaacatgatggaggagtatgacaaggtcattgcctcacggcatgttttcacccggctcatgatcttcttattttctcagaatttggatgatgatgc

SEQ ID NO: 20732 - protein, 127 aa, Panicum virgatum
  misc_feature: Ceres CLONE 1812752
  misc_feature (34)..(122): Pfam Name: PB1 Pfam Description: PB1 domain
MAPPAAAPGGSEAEGAPRMAKFLCIFGGSILPRPLDGCLRYVGGDTRIVMLPRDISYADLAARMRELYKDADIIKYQQPDEDLDALVSVVNDDDVLNMMEEYDKVIASRHVFTRLMIFLFSQNLDDD

SEQ ID NO: 20733 - DNA, 684 bp, Panicum virgatum
  misc_feature: Ceres CLONE 1812760
  misc_feature: Encodes the peptide sequence at SEQ ID NO. 20734
acaccactcggccctcggggacacacacatccttgtcgtgtcctctgctcccactcgaagagtccggcaccacgcggctcctccgccggccgctcgcttacacgcaccaatgggggaggccgcggacccggcgccggcgcccgccaggggccgcgtggccgtggcgccgccgatgccgtggcggacgcggctcgcggtgctggccgcggggtacgtcaccgacgccacccgccgcgccgacggcaccgtcaaccgccgcctgctcggcgtgctcgacaagggcgtcgcggcgtcggcggccccgcggcacggcgtcgcgtcccgggacgtcgtcctcgacgcggccgtgcccctccgcgcgcgcctcttccaccccgccgccgcccgccgcccgctccccgtggtcgtcttcttccacggcggcggcttcgcgtacctctccgcggcgtccccggcctacgacgccgcctgccgccgcatcgcgcgccacgccgccgccgcggtgctgtccgtcgactaccgccgcgcgcccgagcaccgctgcccggccgcctacgacgacggcctcgccgcgctccgcttcctcgacgaccccgccaacgccgccgccgccgacccgccgctcgaccccgcgcgctgcttcctcgccggcgacagcgcgggcggcaacatcgcgcaccacgt

SEQ ID NO: 20734 - protein, 191 aa, Panicum virgatum
  misc_feature: Ceres CLONE 1812760
  misc_feature (99)..(191): Pfam Name: Abhydrolase_3 Pfam Description: alpha/beta hydrolase fold
  misc_feature: SWISSPROT Homolog: EC 3.1.1.3 Triacylglycerol lipase
MGEAADPAPAPARGRVAVAPPMPWRTRLAVLAAGYVTDATRRADGTVNRRLLGVLDKGVAASAAPRHGVASRDVVLDAAVPLRARLFHPAAARRPLPVVVFFHGGGFAYLSAASPAYDAACRRIARHAAAAVLSVDYRRAPEHRCPAAYDDGLAALRFLDDPANAAAADPPLDPARCFLAGDSAGGNIAHH

SEQ ID NO: 20735 - DNA, 1368 bp, Panicum virgatum
  misc_feature: Ceres CLONE 1812770
  misc_feature: Encodes the peptide sequence at SEQ ID NO. 20736
aaggaatccctgctttcctcggattgactgttctaggggccaattttgctctgcaactaatgaattaactcttctgtgctgcggccaatcaaaccccaaatccttgtgctcggacgtatatcccaatccgccagtttgttgcgtggtggactgctaatatctatttgctttccaagacaactgatgcggttgtagcttactaggtccgaagtccgatgggaagcagggacggcagcggcgtcagcacaggaggccagggttatgccgctgacatcgattccatcagggaggcgcaggcccgcattgcgccgcacgtgcacaggacgcccgttctgtcctcgacatcaatcgatgccgtagcggggaagcagctgttcttcaagtgcgagtgcttccagaaggctggcgcattcaagatccgtggtgcttcgaattcgatatttgcgcttgatgatgagcaggcatcaaagggtgtggtgacacatagcagtgggaaccatgccgctgccgtggctttagctgcaaagctgcgtggcatacccgcacacattgtcataccaaagaatgcaccagcatgtaaggtcgacaacgttaggcggtatggtggtaatattatctggagtgatgtcagcattgagtcgagagaatctgtttgtaaaagagtccaggaggagactggtgctgttctagttcatcccttcaataataagtacactatcagtggtcagggtacagtatctcttgagcttctagagcaagtccctgaaattgacacaataattgttcccattagtggtggtggtttaatttctggtgtggcccttgctgcaaaggccataaacccttccatacgtattctggcagcagagccaaaaggtgctgatgattctgcccagtccaaggctgctggaaagatcatcacactgccttccacaaacaccattgctgatggactacgagcttttcttggtgacttgacatggcctgtggtgcgtgacttggtggatgatatcatcgtagtggatgacaatgccattgtggatgccatgaaaatgtgctacgagatcctgaaggtagctgttgagcccagtggtgcaattggccttgccgctgttatgtctgacgagttcaagcaaagctctgcttggcatgagagcagcaagatagggatcatcgtttctggaggtaatgtcgacctcggtgttctttgggagtcgctgtacaaacgatgattggagttggaccaaaaatgtacaaggcgagacgctgtaacatatacattgatttaaaacaggattctttcttgtcggttaagttattacttgtacaaaacattatgccgtacaatttatatgtttgttagcgtgg

SEQ ID NO: 20736 - protein, 338 aa, Panicum virgatum
  misc_feature: Ceres CLONE 1812770
  misc_feature (30)..(323): Pfam Name: PALP Pfam Description: Pyridoxal-phosphate dependent enzyme
  misc_feature: SWISSPROT Homolog: EC 5.1.1.18
MGSRDGSGVSTGGQGYAADIDSIREAQARIAPHVHRTPVLSSTSIDAVAGKQLFFKCECFQKAGAFKIRGASNSIFALDDEQASKGVVTHSSGNHAAAVALAAKLRGIPAHIVIPKNAPACKVDNVRRYGGNIIWSDVSIESRESVCKRVQEETGAVLVHPFNNKYTISGQGTVSLELLEQVPEIDTIIVPISGGGLISGVALAAKAINPSIRILAAEPKGADDSAQSKAAGKIITLPSTNTIADGLRAFLGDLTWPVVRDLVDDIIVVDDNAIVDAMKMCYEILKVAVEPSGAIGLAAVMSDEFKQSSAWHESSKIGIIVSGGNVDLGVLWESLYKR

SEQ ID NO: 20737 - DNA, 1999 bp, Panicum virgatum
  misc_feature: Ceres CLONE 1812784
  misc_feature: Encodes the peptide sequence at SEQ ID NO. 20738
acgtctccctccctcgtgtcccccacccatttcgtcggcctcctcttcttccccccgcccgcctcgccacccccgaattagcagaagccacgaatccgccgcgcctcgaggtcggccgccggcctccccgagggcgttaccctagcggctctcgctccgccgttgacagggagcgcaaccccgccgccgcccggctgcggcgggctggcgtgaccggagctcctcgccgccgctgataagatccgacgtgttcctagtttttttttttcaggggcggggggacgccggtcccgtcggggtgatccggagagcatggcggggcccaagtttgggtcgttcaagggagaaaagggggagtcggcggcagctgccggcgccgcggcgcagaggagggacccttacgaggtgctcggggtggggcgtaatgctactgagcaggagatcaagagcgccttccgccgcatggcactcaagtaccatccagataagaatgcagacgaccctatagcctcagagaagttccaagaagctacattctcttacaacatcctgtcagatccagataagaggcgccaatttgattcatctggttttgaggccatcgaagcggatagtcaggaactggagctggacctatcaagtctcaatactgtaaatacagtgtttgctgctctgtttagcaaattaggtgttccaatcaagaccactgtctcggcaacagttttagaggaggcattgaatgggtcagtagagatttctcagcttcagttgggcaagtctgtatgtaggaaggtagaaaagcagacagctcacttctattctgtagacataacagacaaagaagccaaaatgggcttagtgtgtagagtccattcaactgctaaaagtaaatttaagctgctgtattttgagcctgaggacaatggtggattgagccttgctttacaggaagatagtacaaagactgggaaagttacttctacagggatgttctttctaggttttcctgtgtatcgatttgaacagaacaatccggctgctgctgcaaaggatcctgacagcgcattctttaaaagattggatggctttcaaccatgtgaagtaaatgaactgaaagcaggaactcactatttcgctgtctatggtgataatttcttcaaaagtgcgagttatactatagaggttgtatgtgctgaacccttttctgctgaaaaggagaggctacgaagtgtggaggcaaagataattgcaaaacgatctgagctgtctaaatttgagtccgagtatagggaggttttggcaaagttcactgagatgaccagtagatatgctcaggaaatgcaaacgatcgatgatcttctaaaggaaaggaatgcaattcatgcatcctacaccaacaacccaactcttcaacggagttcaagtagcagcaaaggaaaatcaccatctaaaggatccaaaaatgaggatgatcaaacagtaaagaaggagaagaaaacgaagagccagcccatggatggatccagaagtgatgatgaggctacaaaaaataagaaggaaaagaaacctaaagatcggattcgaaggaagaagtggttcaacattcatttgaaagtggataagagaaggccctgctgagaactgaaacatgaaggaatcagcatagctttttgtcaactattcccgtgatcgtaccatcttgtttcctgaaaagtcaggaacctagccagtttcagaaatgatataaagaaatgtactacgtagtttggggacccttactgttagtggacactgttctctgtcaatctcaagttagcgttgctgatgaatgtacacaagaggtcttagtagtgcgtgatgttgtacactggccagagtccagttcagattcattcgatttgtttgatgatgtatgtgttgacatcactgtccagcttgactgtggaccatcctgtaccccatgagacaatctgaacgacgtacctccatatggtggagc

SEQ ID NO: 20738 - protein, 441 aa, Panicum virgatum
  misc_feature: Ceres CLONE 1812784
  misc_feature (28)..(90): Pfam Name: DnaJ Pfam Description: DnaJ domain
MAGPKFGSFKGEKGESAAAAGAAAQRRDPYEVLGVGRNATEQEIKSAFRRMALKYHPDKNADDPIASEKFQEATFSYNILSDPDKRRQFDSSGFEAIEADSQELELDLSSLNTVNTVFAALFSKLGVPIKTTVSATVLEEALNGSVEISQLQLGKSVCRKVEKQTAHFYSVDITDKEAKMGLVCRVHSTAKSKFKLLYFEPEDNGGLSLALQEDSTKTGKVTSTGMFFLGFPVYRFEQNNPAAAAKDPDSAFFKRLDGFQPCEVNELKAGTHYFAVYGDNFFKSASYTIEVVCAEPFSAEKERLRSVEAKIIAKRSELSKFESEYREVLAKFTEMTSRYAQEMQTIDDLLKERNAIHASYTNNPTLQRSSSSSKGKSPSKGSKNEDDQTVKKEKKTKSQPMDGSRSDDEATKNKKEKKPKDRIRRKKWFNIHLKVDKRRPC

SEQ ID NO: 20739 - DNA, 1719 bp, Panicum virgatum
  misc_feature: Ceres CLONE 1812785
  misc_feature: Encodes the peptide sequence at SEQ ID NO. 20740
actgcgctgcgcccccaagacctggatcccctgcgctgcctttctctgctctgctgcatcattcgcaatctcagggcagtcactcgtcgccaccaagagcagcagctcgagcctttccgagaggcgcatgtgactcgcggcgaggctttgagctcctttgctccgagctctcctggcgtccgtgccagttcgatgctgagctgagaggctggtgaggaggagggagagaaggatggagttcatgaacggcgggtcgtcgaagcagcgccgcccggcgagggaggagggggcgccgctgccgaggcaggggtcggtctactcgctgacgttcgacgagttccagagcgcgctcagccgggccgccgccggaggcggcggcggcaccgggaaggacttcggctctatgaacatggacgagctgctccggaacatctggaacgcggaggagacccaggccatggcctccgcctccggcgcgggggtgccgcccacgatgctgcagcgccagggctcgtcgctcacgcttccccgcacgctcagcgccaagacggtcgacgaggtgtggcgcaacctcgtgcgcgacgagccgccgcagggggcggacggcaacggacaggagcaggcccaccgccagtcgacgctcggggagatgactctggaggagttcttggtcagagccggcgtggtcagggagaaccccgcccccgccccagcgccaccgcctatgctgccgccgcggccggtccctgttgcccctacaagctccgcccttttcgggaatttccagggtgccgacgatgccgccactgcggcagctctggggtttgcgccggtccgcatgggggatctggcccttggcaatgggctgatgccgccgagggcgacgggcggcatgggaggcagcgccgccatggctgttcaaacagcggtgaaccagctcgattctggcgggaaggggtacagcgacctgtcgtcgccgacggagcctctgccctattcgtttgaggggatgatccgggggagaaggaatggcgccggagtggagaaagtggtggagaggaggcagaggaggatgatcaagaacagggagtctgcggcgaggtctcgggcgcgcaaacaggcatatacaatggagttggaagctgaagttcagaaactcaaggagctaaatcaggaactggaaaggaaacaggcagagattatggaaatgcagaagaacgaggtaccggaaatgttgaaggatccattcggacggaagaaacgggcgtgcttgcgaagaacactgacaggcccctggtgatgcgtggttgccttgcctcgaacagtagatgatgactagctgcataccgacagtagtggtgcttgcattgcgatctgtacataatctctctccattagactagctagggatgagcattgtcagaatcggttgtactgcttgctccctccctgtagattatgtggtacttggtagagaagcaagtggagtgaagccggcagtaggaaccggctgcagccatccgtcagagcttgtgtagatttgcctaggtttgcgtcttgccggttcgtcgttgtagaagagatgtggatgatttcgaaagatcgatgcaagtagaagtaggttagtgggatccaactagggagagcagccgtctcgatgattatctgtatgtatatctgatggatttagtatgaactatctgttgctgcttgcgtgtg

SEQ ID NO: 20740 - protein, 355 aa, Panicum virgatum
  misc_feature: Ceres CLONE 1812785
  misc_feature (272)..(329): Pfam Name: bZIP_2 Pfam Description: Basic region leucine zipper
  misc_feature: Useful for making plants with modulated drought sensitivity
  misc_feature: Useful for making plants with modulated water use efficiency
MEFMNGGSSKQRRPAREEGAPLPRQGSVYSLTFDEFQSALSRAAAGGGGGTGKDFGSMNMDELLRNIWNAEETQAMASASGAGVPPTMLQRQGSSLTLPRTLSAKTVDEVWRNLVRDEPPQGADGNGQEQAHRQSTLGEMTLEEFLVRAGVVRENPAPAPAPPPMLPPRPVPVAPTSSALFGNFQGADDAATAAALGFAPVRMGDLALGNGLMPPRATGGMGGSAAMAVQTAVNQLDSGGKGYSDLSSPTEPLPYSFEGMIRGRRNGAGVEKVVERRQRRMIKNRESAARSRARKQAYTMELEAEVQKLKELNQELERKQAEIMEMQKNEVPEMLKDPFGRKKRACLRRTLTGPW

SEQ ID NO: 20741 - DNA, 1422 bp, Panicum virgatum
  misc_feature: Ceres CLONE 1812790
  misc_feature: Encodes the peptide sequence at SEQ ID NO. 20742
accaaccaacccggccagcccacgagcgaagccgcgagcccatccgccgaaacgcccggctgccgagctactactaccgagctgccgagacaaggcggcggcggcggcagcagcggctgcggcggaaggtctcgacctacccccggcgctcgcggaggcggccggccggcgaatgcgataggaggcggcggggatggggtccaagtacacgcgcgggtgctgcgggtggctgatcgtcgcgctcattgcggcgctggtggccacggcggcgatgttcgccatcatgaagcgcaagcccggggggagggggcgccacatgaagccgctccccgtgccggggccgccgggggccatcgactccaagtacggcgacgcgctcggggtcgcgctccagttcttccaggtccagaaggcggggaagctggaaaacaaccagatcccgtggcggggggactcggcactgactgatgggaaggaagcggggctggatctttccaagggaatgtatgatgctggggatcatatgaagttcaccttcccaatggcattcactgcgactgtgcttgcctggtcggttctagagtatggggatcagatgagcgcggcgaagcaactggacccagctctcgatgcgctcaagtggattacagatttccttatcgctgcacatccatctgacaatgtgttatatattcaggttggtgatcctgatctggaccacaattgctgggaaaggccggaaacaatgactgagaaaagaccactcacacagatcaacaagaagtctcctggatctgatgttgctgctgaggcagcagctgctatggcagcagcttcaatggtcttcaaatccagtgatactacgtattctgatgtgcttcttcaacatgcccagaagctatttacttttgctgatacttatagaggcctttcaagtgaaagttatccaaagctccaagacttctataattccactggttatgttgatgaacttctatgggcagcaagttggctctatcatgccacaggagaccagacgtatctcagttatgtaactgtacagaatggaaaaacttatgctgagtggggaaggccaacatggttcagttgggatgacaaaaatccaggcacacaggtccttctgtctagactaaatttctttggctccaaacagatatctaatgctgaaaatgaggggttaaaatcgtatagagatactgcagaagctgtcatttgtggtctgattccagattccccgcaagccactgctagcagaactggaggaggattgatctggataagcgggtggaattctctccagcatgccacgaattctgcatttctagctcttgtttacagcgactacatgctctcaacacggacagcggaagtgcagtgcagtggaaagtactacagccctac

SEQ ID NO: 20742 - protein, 409 aa, Panicum virgatum
  misc_feature: Ceres CLONE 1812790
  misc_feature (57)..(409): Pfam Name: Glyco_hydro_9 Pfam Description: Glycosyl hydrolase family 9
  misc_feature: SWISSPROT Homolog: EC 3.2.1.4 Cellulase
  misc_feature: Useful for making plants with altered cell wall content and/or composition
MGSKYTRGCCGWLIVALIAALVATAAMFAIMKRKPGGRGRHMKPLPVPGPPGAIDSKYGDALGVALQFFQVQKAGKLENNQIPWRGDSALTDGKEAGLDLSKGMYDAGDHMKFTFPMAFTATVLAWSVLEYGDQMSAAKQLDPALDALKWITDFLIAAHPSDNVLYIQVGDPDLDHNCWERPETMTEKRPLTQINKKSPGSDVAAEAAAAMAAASMVFKSSDTTYSDVLLQHAQKLFTFADTYRGLSSESYPKLQDFYNSTGYVDELLWAASWLYHATGDQTYLSYVTVQNGKTYAEWGRPTWFSWDDKNPGTQVLLSRLNFFGSKQISNAENEGLKSYRDTAEAVICGLIPDSPQATASRTGGGLIWISGWNSLQHATNSAFLALVYSDYMLSTRTAEVQCSGKYYSP

SEQ ID NO: 20743 - DNA, 665 bp, Panicum virgatum
  misc_feature: Ceres CLONE 1812790-R
tcacatatatatcttttggcaagggctttgatcgacatggaggtatgcatgtaaaattgcagttttttggcgaggccgatggtaattcacgattagtgacagaagcttggtctgccattgtttagatggatggttagcacttagcagcagtagttagtaccacatttcttctgtttgtataatcgatggtactgctcctgcagattttttgctgtgtgctcctatctggtttgctggtgtacctctaatgctgttactacaagtaatgtatttttctaggacagatttcatttgttgattcggtggtgaggtggttcttcaaggcttttgtacgatcaatggttgtgaactcctctgccctctcacctgaaatgtgcgttgagtatgtgaattcacagttgtagatgaagggtacctgttcgtgctgtttttacaacctgttcactccgttctaataaacgagtacacgaaatagggggaagaagcatctctagcaatggcctgccaattcatgattgctagcatgtgtttttatggttgctggtgaaaaagtagtatggcccatggtgggttataatgagaagtttcttcccttttgtgtcccaaagaaagaagaagaaatggatcagggaagctggtggacatgattacagttgttcatgctt

SEQ ID NO: 20744 - DNA, 1967 bp, Panicum virgatum
  misc_feature: Ceres CLONE 1812805
  misc_feature: Encodes the peptide sequence at SEQ ID NO. 20745
gaggactggagtgactgaaacgcaaaacatccacacgctaacgaaggaacccaggaagccaggagaaacggagcagaaagcaccggtccacctgttgctcctacctcgccgggcgccgccgccgcctcacgagtccgatcgagctcccgcccgcaacctcgccatgagcgcagccgcttctgcggcggcacctagccgccgcacccgcagccggccgccctcggcctcctcccgcaagtccgacgacccctcggccgccgccgccgccgccaacgggaatgggaacgggaaggtcgcctccaagcccgcctctccccaccaactcacaggggagaggacggtgaagaagctgcgtctgtccaaggcgttgacgattccggaggggacgacggtgtcggaagcgtgccggcggatggcggcgaggcgggtcgatgccgtgctgctcaccgacgcccaaggcctcctctcaggaatagtcaccgacaaggacatagctacaagggtgattgctgaggggcttagggtggaccaaaccataatgtccaagatcatgacacacaatccaacttatgtgatgtccgacacgcttgcaattgaggcattgcagaagatggttcaaggcaaatttagacacctccctgtagtagaaaatggtgaggttattgctatgctggacattgcaagatgcctatatgacgcaatagcaagactggaaaaggctgcagaacaaggaagtgcgatagcagctgctgttgaaggggttgaacgtcaattaggaggcaacttttcagctccttctgctctaattgaaactctaagagaaaggatgttcaaaccatctttgtcaaccatcatcacagagaacacaaaggtagcaattgtttcgcctacagatcctgtgtgcgtagcagcacaaaaaatgcgagagtttcgagttaattcggtggttgtcgctacaggaaacacattgcaggggatctttacctcaaaagatgtacttatgcgtgttgtcgcacaaaatatttcccctgagttgaccctagtagaaaaggtgatgactgccaacccagattgtgccacattagatacaacaattcttgatgcattacatataatgcatgatggcaaatttttgcatattcctgttattgacagagatggacaaattgctgcttgcctggatgtcctacagcttacccatgcaaccattcaattggttgaaggagggaatggaactgtaaatgatgtagcaaactcagtaatgcagaggttctgggactctgctcttgctttggagcctccagatgaggaattcgatagccatagtgaggtatctttactcctgccgtcagaggccggagatggaaagggtagtgtttacccccctgggattggcaattcatttgcctttaagcttcaagataggaagggtcgtgtgcatagattcacttgtggctctgagagcttggatgagcttgtgtcttctgtaagacaaagattaagtattacagatgaaaaggaaacagtacaactcttatatgaagatgatgaaggtgaccgagtgctgctgacaacagactccgatctggctggtgctgtgctctatgccaaatcatctggattgaaggtgctgaagttgcacatcgaagacccgggtttgtatactgaagtgacaaaaccgtcacaggagctggctccacctcccagcaggagtgggatatcgccagttcatgttggattgatggccggtgcagttgctctcagtgctgcagcagtgatgatttacttgaaacgatctcagctgtgatttccgaaacccagagggaatcatcgctttctttttctttttctttttttccatttttctgaagaacggggatcggtggcattccaaattagtactgccatcagctaatgctccctcggtaccaagctaaggaatgaaggaaagtacggaaatgaatatc

SEQ ID NO: 20745 - protein, 547 aa, Panicum virgatum
  misc_feature: Ceres CLONE 1812805
  misc_feature (62)..(180): Pfam Name: CBS Pfam Description: CBS domain pair
  misc_feature (231)..(349): Pfam Name: CBS Pfam Description: CBS domain pair
  misc_feature (413)..(497): Pfam Name: PB1 Pfam Description: PB1 domain
MSAAASAAAPSRRTRSRPPSASSRKSDDPSAAAAAANGNGNGKVASKPASPHQLTGERTVKKLRLSKALTIPEGTTVSEACRRMAARRVDAVLLTDAQGLLSGIVTDKDIATRVIAEGLRVDQTIMSKIMTHNPTYVMSDTLAIEALQKMVQGKFRHLPVVENGEVIAMLDIARCLYDAIARLEKAAEQGSAIAAAVEGVERQLGGNFSAPSALIETLRERMFKPSLSTIITENTKVAIVSPTDPVCVAAQKMREFRVNSVVVATGNTLQGIFTSKDVLMRVVAQNISPELTLVEKVMTANPDCATLDTTILDALHIMHDGKFLHIPVIDRDGQIAACLDVLQLTHATIQLVEGGNGTVNDVANSVMQRFWDSALALEPPDEEFDSHSEVSLLLPSEAGDGKGSVYPPGIGNSFAFKLQDRKGRVHRFTCGSESLDELVSSVRQRLSITDEKETVQLLYEDDEGDRVLLTTDSDLAGAVLYAKSSGLKVLKLHIEDPGLYTEVTKPSQELAPPPSRSGISPVHVGLMAGAVALSAAAVMIYLKRSQL

SEQ ID NO: 20746 - DNA, 1610 bp, Panicum virgatum
  misc_feature: Ceres CLONE 1812816
  misc_feature: Encodes the peptide sequence at SEQ ID NO. 20747
agcagctgcgaggctggtctccgctgttacgtctcggctcggctctgctctgctctgcccgcctctccctctccctctccctccatcccttcctctagtccaagccccccaccccacgtccccacccccaccggccaccaccactccttccgttccgacttccgagtcgtcgagtccaagtccccccccccctccctgctccacctccgctcgcacacgcgggaacgggaacgcgcgccgccggcggggaggggagggcgatgcacccgaagctgtcgcgggccgcccgcaggctcctctgctgcggcgggcccgcctccggggaggacctgtctgacgaagggactggatcgttaaggtgggtgttctcattgagggagcttcgatcggcaacaaacagcttcaactacgataacaagattggagaagggccatttgggagtgtgtattggggacaagtttgggatggctctcagattgctgtcaagaggttaaagaattcaaagaatggcacagaagtggaatttgcttcagaagttgagatcttgggaagaataagacataaaaatctcctgagtttccgtggatattgtgcggatggacctgaacgcattctggtgtatgactatatggcaaactcaagtctctatgcacatcttcatggaccactttctgcggagtgtctccttgactggcgcaggagagcatctattgccattggtgctgctcgggctctcttgtatcttcatcaccatgcaacacctcagataatccatgggagcatcaaggccaccaatgtgttactggattcggacttccaggctcatgttggtgatttcggtctgatacagcttattcctgatggaatagatcatgaaaagataaccagtgaaaatcaacgaggctatcttgctcctgagtacattatgtttggcaaaccaacagcaggttgtgatgtatacagctttggaataatattattggagcttgcgagcggcaaaaggccaatagaaaagtcgggctctgtcaagacatttggaattcgaaactgggtgctcccgttggcgaaggagggtagatacgatgaaattgcggactcaaagctcagtgacaagttttcagaatctgagctgaaaagaatggtgttggtcgggcttgcatgcacacattcagaacccgaaaagagaccggcaatgcttgacgttgtgccattgctgaaaggcgaatcgaaagagatgcttctgaagctcgaaagagatgagctgtttgggccagacttgaccgtgagttcccagggaacatcgactccagaagggagcacagactctgcgccaaggaaagatcaagaactgggtggggagtgaattgtgatagattgctgccttaggcggtgttagagtgcatatttgtggtattgataattggtttgtgtggttttacatggatggaaattgtacagcattgttaattgtaaggtgttctttttttttccttttccccttttcctgctgagagagagtaagaaagagtgaggggtttgcagaatggagataggttgttatgcgaagtgctttttgcatgcaccgcatagaaagatgcatatgtttccc

SEQ ID NO: 20747 - protein, 367 aa, Panicum virgatum
  misc_feature: Ceres CLONE 1812816
  misc_feature (48)..(319): Pfam Name: Pkinase Pfam Description: Protein kinase domain
  misc_feature: SWISSPROT Homolog: EC 2.7.11.1 Non-specific serine/threonine protein kinase
MHPKLSRAARRLLCCGGPASGEDLSDEGTGSLRWVFSLRELRSATNSFNYDNKIGEGPFGSVYWGQVWDGSQIAVKRLKNSKNGTEVEFASEVEILGRIRHKNLLSFRGYCADGPERILVYDYMANSSLYAHLHGPLSAECLLDWRRRASIAIGAARALLYLHHHATPQIIHGSIKATNVLLDSDFQAHVGDFGLIQLIPDGIDHEKITSENQRGYLAPEYIMFGKPTAGCDVYSFGIILLELASGKRPIEKSGSVKTFGIRNWVLPLAKEGRYDEIADSKLSDKFSESELKRMVLVGLACTHSEPEKRPAMLDVVPLLKGESKEMLLKLERDELFGPDLTVSSQGTSTPEGSTDSAPRKDQELGGE

SEQ ID NO: 20748 - DNA, 2969 bp, Panicum virgatum
  misc_feature: Ceres CLONE 1812818
  misc_feature: Encodes the peptide sequence at SEQ ID NO. 20749
aaaaataaaaatacgcgcgacgaacagagcagcagagcacaaacacccgcaccgatccaagccaagccagccccctcggggacagcccacgctagatccaaccccgagtcccgacgccgcgggcgaggccgaccagatccacctcgccaggcggcgcggatggcggcagcatcggcggcggtgaggatgctccccgacggcggcgccgacgacgaggagcggtggctcgccgagggcatcgccggcgtccagcagaacgccttctacatgcaccgcgccctcgactccaacaacctcaaggacgcgctcaagtactcggcgcagatgctctccgagctgcgcacctcgcgactctcaccgcacaagtactacgagctctacatgagggcgtttgatgagatgcggaagctggagatgttcttcagggaggagacccggcggggtagctgctccgtcgttgatctgtacgagcttgttcaacatgctggcaacgtcttaccgagactctatctcctgtgcacagtgggatctgtgtacatcaagtcgaaagaggctcctgctaaagatgttcttaaagacctcgttgaaatgtgtcggggcattcaacatcctcttcgtggtcttttcctgagaagctacctttctcagataagcagagacaaattgccagatattggttccgagtatgaaggggatgctgaaagcattaatgatgcagttgaatttgttcttcagaatttcatagaaatgaacaaactctgggtccggatgcagcatcaggggcctgtcagggaaaaagaaaagcgggggaaggaaagaaatgaactgcgtgatctggtaggcaaaaaccttcatgtacttagccagattgagggtgttgaccttgatatgtacaaagaaactgtgcttccgaggatattagaacaggtggtcaattgtaaggatgaccttgcacagttctacctgatggactgcataatccaagtctttccagacgaatatcatttacagacattggaaacactattgagtgcatttccccagctacagccaagtgttgatatcaaaacagtactgtcgcaacttatggacagattgtctaactacgctgcctcaagtcctgaagtattgccagagttcttgcaagttgaggcttttgcgaagttcagtaatgctattgggaaggtgatagaagcccaacctgacatgccggttgttggagcagtaactctatatgtgtcgcttctgacatttactctccgtgtacatccggatcggcttgattatgttgaccaagtgctgggtgcatgcgtcaagaaactttcaggcaaggcaaaacttgaagatagcagggcaacaaagcaaattattgcacttcttagtgctcccctggaaaaatatagcaacattgttactgcattggaactttcaaactatcctcgagttatggattatctcgataatgctacaaccaaagtgatggctgtggtaataattcagagcataatgaagaacacaacttgcatatctacttctgacaagatcgaggcactgttcgatttaattaaggggcttataaaagatatggatggggctcaagatgataagcttgatgaagaggactttaaagaggaacagaattccgtagcacgccttattcacatgttgcacaatgatgatcatgaggagatgctgaagatcttatgtaccgttcagaagcatatacttctcggaggacccaagcggctaactttcactgtaccttcattagtattctccgctctcaagttggttaggcgattacaaggtcaagatggagatgtcactggggaggacgtgcctgcaactccaaaaaaaatcttccagatcttgcatcagactattgaagcgctttcatgtgttccttctcccgagttagctctgagactgtatttgcagtgcgcagaggctgccaatgactgtgatttggaaccagttgcttatgaattctttacacaagcattcattttatatgaagaagaaattgcggattcaaaggctcaaataacagcaattcacctaatcattggaacccttcagcgaatgaatatattcgaggtggaaaacagagacaccctcacccataagacaacagggtactcagcaaaacttctcaagaagcctgatcaatgccgagcagtctatgcgtgttcgcatcttttctggactgatgaccaagatggaataatggatggtgaaagggtcctcctttgtttaaagcgtgccttgagaatcgcaaatgctgcgcaacagatggctaatgcaacaaggggaagcagtggatctgtgactctatttatcgaaattttgaacaagtacttgtacttctttgagaaaggaatcccacagatcacaaatactgtgattcaagatttgatcgaattgattaggactgagcagcaaagtgacaacgctgtagctgatccatctacggaggccttcttttctagcactttacggtacattgaatttcaaaagcagaaaggtggaaacataggtgaaaaatatgaacaaataaagacaagctcatgagtcagaacaagcacggcaccatgacaggtttcgattttgtcgagagaattgagtctcttttttttggcatggttcagtgaagtaggaaccatcggtttcagctgctttggaccaaaaaatgtttatacgagctgttatttgcaagtctcacggtccgagtgggtctgctcatccattggcaacactgtcgggtttagtcaggtggcaataagctcgtgctttggggagcacaggtctgtacaggataactcatgtttatggtccggttctacttcgacaagtgtgtcgtatatttccccaccttctgcaaagcgtattgattttaggttcctgtaacattcgaggacaactcttttctgactggactattgattggttaatagcgatcagttgcgagc

SEQ ID NO: 20749 - protein, 803 aa, Panicum virgatum
  misc_feature: Ceres CLONE 1812818
  misc_feature (21)..(760): Pfam Name: Vps35 Pfam Description: Vacuolar protein sorting-associated protein 35
MAAASAAVRMLPDGGADDEERWLAEGIAGVQQNAFYMHRALDSNNLKDALKYSAQMLSELRTSRLSPHKYYELYMRAFDEMRKLEMFFREETRRGSCSVVDLYELVQHAGNVLPRLYLLCTVGSVYIKSKEAPAKDVLKDLVEMCRGIQHPLRGLFLRSYLSQISRDKLPDIGSEYEGDAESINDAVEFVLQNFIEMNKLWVRMQHQGPVREKEKRGKERNELRDLVGKNLHVLSQIEGVDLDMYKETVLPRILEQVVNCKDDLAQFYLMDCIIQVFPDEYHLQTLETLLSAFPQLQPSVDIKTVLSQLMDRLSNYAASSPEVLPEFLQVEAFAKFSNAIGKVIEAQPDMPVVGAVTLYVSLLTFTLRVHPDRLDYVDQVLGACVKKLSGKAKLEDSRATKQIIALLSAPLEKYSNIVTALELSNYPRVMDYLDNATTKVMAVVIIQSIMKNTTCISTSDKIEALFDLIKGLIKDMDGAQDDKLDEEDFKEEQNSVARLIHMLHNDDHEEMLKILCTVQKHILLGGPKRLTFTVPSLVFSALKLVRRLQGQDGDVTGEDVPATPKKIFQILHQTIEALSCVPSPELALRLYLQCAEAANDCDLEPVAYEFFTQAFILYEEEIADSKAQITAIHLIIGTLQRMNIFEVENRDTLTHKTTGYSAKLLKKPDQCRAVYACSHLFWTDDQDGIMDGERVLLCLKRALRIANAAQQMANATRGSSGSVTLFIEILNKYLYFFEKGIPQITNTVIQDLIELIRTEQQSDNAVADPSTEAFFSSTLRYIEFQKQKGGNIGEKYEQIKTSS

SEQ ID NO: 20750 - DNA, 2025 bp, Panicum virgatum
  misc_feature: Ceres CLONE 1812858
  misc_feature: Encodes the peptide sequence at SEQ ID NO. 20751
atctccccaaccccttccatttatttcctcgtttccatttccttggcccccgtctcgccgcgcgccaactcgggtttaatcatcaagcggaaaaggaaggaggtttatcccaagacccggcggaatcagcgggggatatactcctcccctgtcggccgtcggagcgcgccggctccggtggtggtggtggcggcggttagccatggagacgggaggagatatctgagagcggaacaagtgctcgtgtttggttcgtggttcttaagctcgtcatctagaggggagcagcgctctctccgctgggatcgagtggggtggtttcgctctcgagtgaaagctactggttggcttgtgctgacctgtgtaaagagggctactacttgggaggcaatcaggtgtttggtttggttaaagaaagctcggctcccttcttttgtcttgcccgtgggatgcttgctgcaagcctctgtgttggtccttggagcaaataataccatgcttgaggagctttggttcatgtgattactcttgtatagtcttcttgccgattgtgattgggagagaaacagctctcttctggcctgggcttggctatgtccgtctcagagaaggtggcgccatcatcatcagtttcgtcatcatcagatttggatccgttgttgaaggatcttacagagaagaagttgagctttaggagaaatgtggtgtcgttggcagcagaactcaaagatgtgagacataaacttgcttcccaggagcagctgtttgtgagggaatcccaaactaggaaggttgcagagactaaggcaatgagcatggaagaggaagtaagcaagctgcagaaatgcttacaggagaaggatgagcaattgcgttcatccacaagtagcacagaacagtacctccatgagttggatgatcttagaacacaactttcatttacccgcgctacagcagaagctagtgctgcatcagccaagtcagctcaggtgcagtgcttgtcattgctgaaagagctgaatgagaaggactgctcgctgaaagagcacgaacttcgagtgaacaaactaggtgagcagcttgatcttctccagaaggatctgcaagaaagggagctctcacagaggcaactcaaagatgaagttatacgaattgagaccgacatcatggatgcagttgccaaagctggttccaagtctgagaaagataacgagcttctaaagatcctatctgatgtttcaccaagaaatgttcagaatctcaacaaccttttgaatgctaaggatacagagattgcgaggttgagagaagaaatcaggatattatctgctcattggacaaacaagaccaaggaattagaatcacaattggaaaagcaccggaggactgatcaggaactgaagaagagggttctgaagcttgaattttgtcttcaagaatcacaatctcagatgcgaaaactcaagaggatgggggagaaaagggacaaggcactcaaggagctcatggaccaggtggccatgaagcagcccaacagctcgttccacggcatcaaggagaatttctgggagaacccgggcttcaagttcatcgcctccatgtcgatgctagccctagtgatccttacgaaacgatgaaaacagcaggcatcctgaacccaatgatgtgtaaagaagttaagattccagtgttaggtgagcagctagctcatagtttatagtttaaggagctgttgatgcagcggcttacattagtttgtagagtagggcagttgagcatgctgcacgatcagatgtccagactgaaatttgctgacatctgatcctagtcctgttagatgtagtctgtactctgtagtgcagtttctgccagttcatgtaagctcataagttgtcttttagtggcacctaattacctagttcgtgtaagcccatgagcagtcatgtagtcatggatctacatcatataatctcagagtagttactgcagtggtcgctgcggtttaatgttattcttctgtacttc

SEQ ID NO: 20751 - protein, 347 aa, Panicum virgatum
  misc_feature: Ceres CLONE 1812858
  misc_feature: SWISSPROT Homolog: EC 2.7.11.1 Non-specific serine/threonine protein kinase
MSVSEKVAPSSSVSSSSDLDPLLKDLTEKKLSFRRNVVSLAAELKDVRHKLASQEQLFVRESQTRKVAETKAMSMEEEVSKLQKCLQEKDEQLRSSTSSTEQYLHELDDLRTQLSFTRATAEASAASAKSAQVQCLSLLKELNEKDCSLKEHELRVNKLGEQLDLLQKDLQERELSQRQLKDEVIRIETDIMDAVAKAGSKSEKDNELLKILSDVSPRNVQNLNNLLNAKDTEIARLREEIRILSAHWTNKTKELESQLEKHRRTDQELKKRVLKLEFCLQESQSQMRKLKRMGEKRDKALKELMDQVAMKQPNSSFHGIKENFWENPGFKFIASMSMLALVILTKR

SEQ ID NO: 20752 - DNA, 673 bp, Panicum virgatum
  misc_feature: Ceres CLONE 1812870
  misc_feature: Encodes the peptide sequence at SEQ ID NO. 20753
gtaccctcctgctcgtcaccccgcctcactttactccacttcagtgcttcactgcactgcacccactgctgcggcgcggcgcgcgccaagaaggatgccgacgccgccgctgtgcctgctcgcggcggtgctgctgctgctggcgccggccggggcgcaggagacgtgctcgggggcggcgccggccccgccgcggcgcggggcgtggatgtccgtggcgggcttcggcgccgtcggggacgggcggacgctcaacacggcggcgttcgcgcgagccgtggcgcgcatcgagcgccgccgcggcgcgcgcggaggcacgctgctgtacgtgccgcccggggtgtggctgacggggcctttcaacctcacctcgcacatgacgctcttcctcgcccgcggcgccgtcatccgcgccacccaggacacgtcgagctggccgttggtcgacccgctgccgtcgtacggaagagggcgcgagctgcctggtggaagatacatgagcttgatccatggcaatggtctccaagacgtcttcatcacaggtgagaatggcaccattgatgggcaaggtagcgtgtggtgggacatgtggaagaagcgcacgctgcccttcacaaggccgcacttgctggagctcatgtactccaccgacgtgatcgtctcccatgtcgtc

SEQ ID NO: 20753 - protein, 192 aa, Panicum virgatum
  misc_feature: Ceres CLONE 1812870
  misc_feature: Useful for making plants with altered carbohydrate content
  misc_feature: Useful for making plants with altered cell wall content and/or composition
MPTPPLCLLAAVLLLLAPAGAQETCSGAAPAPPRRGAWMSVAGFGAVGDGRTLNTAAFARAVARIERRRGARGGTLLYVPPGVWLTGPFNLTSHMTLFLARGAVIRATQDTSSWPLVDPLPSYGRGRELPGGRYMSLIHGNGLQDVFITGENGTIDGQGSVWWDMWKKRTLPFTRPHLLELMYSTDVIVSHV

SEQ ID NO: 20754 - DNA, 1683 bp, Panicum virgatum
  misc_feature: Ceres CLONE 1812872
  misc_feature: Encodes the peptide sequence at SEQ ID NO. 20755
ggcaggatctctcccctgagccgactccgccttggctccttcctcgtcccgctcccgagaccgcgctcccatccatcgacattcccccggtcgccgcccaagtcaaaaagagggaagcttcttccaccgggtaccctctcccaccagtctccccagcccatcaacgactagacgctgctggtcaggaagcaccaaccctagcccccttcccctccccttcccctcctctcccttcgcgagcggcggcgaggaagccatggattcctccagcggcggcggcggcggcggcggcggtggcgcgcagatcaggggggtggcgacgcacggcgggcggtacgtgctgtacaacgtgtacgggaacctcttcgaggtctcctccaagtacgcgccgcccatccgccccatcggccgcggcgcctacggcattgtctgtgcggctatgaactcggagacaaacgaggaggttgcgatcaagaaggttggcaatgccttcgacaaccacatcgacgccaagcggacgctgagggaaatcaagctgctccgccacatggaccacgagaacatccttgccttaaaggatgtaatacgcccaccaagtaaagagaactttaatgatgtctacattgttactgagttaatggataccgatctccatcagatcatacggtcaaatcagacattgactgatgatcattgccagtacttcttgtatcagttgctacgagggctaaaatatgtgcactcagcaaatatattgcaccgtgatctgaagccaagcaatttgttcctaaatgcaaattgtgacctcaagatcgcagactttgggcttgcaagaaccacttcggagacagatctcatgacagagtatgtggtcactcgttgataccgggcaccagagttgctgttgaactgttcacagtatactgctgcgattgatgtctggtcagttggatgcatactaggtgaaattgttactcgccaacccctgtttcctggacgggactacatccagcaattaaaactgatcactgagctcataggctcaccagatgatgcaagcctgggatttcttcgaagtgataacgcaaaaagatacatgaaacaactaccacagtttccaaggcaggacttccgcttgcgtttccgcaacatgtctgctggtgcagttgatttgttggagagaatgctcgtgttcgatccaagcagacggatcacagttgatgaggctctgcatcacccatacttggcttctcttcatgacatcaatgaagaacctacctgccctgcacctttcagctttgattttgagcaaccatcatttacagaagcacatataaaagaactcatctggagggaatctttggccttcaacccggatcctccctactaagagcaaaggatacgttatctgctgaaggcatctgaagatctctagctccagcggatgctaaaacttatgtctgtgtgcatagattattttcacgctggggttgctgctgcaatagcaattcttgtgagaacaaacgatgtttgtttgtattccctttcagatgcctgaacccaaggcttgtattataccggttaatttcacaaactattcttatgtatctaagattgtaattttgtagacgattacttgaacgatctcctgtatatctaatatctgagttgacaattgacatc

SEQ ID NO: 20755 - protein, 208 aa, Panicum virgatum
  misc_feature: Ceres CLONE 1812872
  misc_feature (44)..(208): Pfam Name: Pkinase Pfam Description: Protein kinase domain
  misc_feature: SWISSPROT Homolog: EC 2.7.11.24 Mitogen-activated protein kinase
  misc_feature: Useful for making plants with altered cell wall content and/or composition
MDSSSGGGGGGGGGAQIRGVATHGGRYVLYNVYGNLFEVSSKYAPPIRPIGRGAYGIVCAAMNSETNEEVAIKKVGNAFDNHIDAKRTLREIKLLRHMDHENILALKDVIRPPSKENFNDVYIVTELMDTDLHQIIRSNQTLTDDHCQYFLYQLLRGLKYVHSANILHRDLKPSNLFLNANCDLKIADFGLARTTSETDLMTEYVVTR

SEQ ID NO: 20756 - DNA, 1416 bp, Panicum virgatum
  misc_feature: Ceres CLONE 1812876
  misc_feature: Encodes the peptide sequence at SEQ ID NO. 20757
ggctctgcgttgtggccgcgttgcagagagagaacacagaggccagagggggaggcgcgtgaggtggcggagcccgaggagcggaggccacaagtctaatccgcccgtatctaatccgctcgagcgccgcgggcaggaggaggaggagggagcggcggggcgaggcctgattcgggcgggctccttctcttgcgattcgcggttagcacttttcaagtgtgtgatctcggcggcttctttgcatcctgaagcacggttgaatcatggctgggtcctttgctgcctcagccttcttccctggtccaggggcttccccggcagcgtccgccaaaacatccaagaacatggctggcgaattaccggacaatttgagtgtccgtggtattgttgcaaagcctggcgccccttctgggaagatgcaagtgaaggctcaagcgcaagcccttcccaaagttaatggcaccaagcttaaccacaagaatgcgagtgcagacacggaggaggcgataccttacagtgctcccaagacattctacaaccagctgcccgattggagcatgcttcttgcggctgtcaccaccatcttcctggcagcagagaagcagtggacactgcttgactggaagccaaagaaacctgacatgcttgttgatacatttggctttggtaggatcatccaggatggcctggtgtttaggcagaacttcttgattcggtcctacgagattggtgccgatcgtacagcttctatagagacattaatgaatcatttacaggaaaccgctcttaaccatgtgaagacagctggacttcttggagatggttttggcgccacgccagagatgagcaagcggaacttgatctgggttgtcagcaaaattcagcttcttgttgagcaatacccctcgtggggagatatggttcaagtggacacatgggtagctgctgctggcaaaaatggcatgcgtcgagactggcatgtccgtgactacaattctggccgtacaattttgagagctacaagtgtttgggtgatgatgaataagaacactaggaggctttcgaaaatgccagatgaagttagggctgagataggcccatattttaatggtcgctctgccataacaggtgagcaaagtgagaagctggctaagccggggagcactgttgatggtgatgcggcgaagcagttcataaggaaggggctcactcctaggtggggagaccttgatgtcaaccagcatgtgaacaacgtcaagtatattgggtggattcttgagagtgccccaatttcaatcctggagaagcatgagcttgcaagcatgacactggattacaggaaggagtgtggccgcgacagcgtgctacagtcactcaccactgtcgcaggtgaatgtgtggatggccacccggact

SEQ ID NO: 20757 - protein, 384 aa, Panicum virgatum
  misc_feature: Ceres CLONE 1812876
  misc_feature (141)..(383): Pfam Name: Acyl-ACP_TE Pfam Description: Acyl-ACP thioesterase
MAGSFAASAFFPGPGASPAASAKTSKNMAGELPDNLSVRGIVAKPGAPSGKMQVKAQAQALPKVNGTKLNHKNASADTEEAIPYSAPKTFYNQLPDWSMLLAAVTTIFLAAEKQWTLLDWKPKKPDMLVDTFGFGRIIQDGLVFRQNFLIRSYEIGADRTASIETLMNHLQETALNHVKTAGLLGDGFGATPEMSKRNLIWVVSKIQLLVEQYPSWGDMVQVDTWVAAAGKNGMRRDWHVRDYNSGRTILRATSVWVMMNKNTRRLSKMPDEVRAEIGPYFNGRSAITGEQSEKLAKPGSTVDGDAAKQFIRKGLTPRWGDLDVNQHVNNVKYIGWILESAPISILEKHELASMTLDYRKECGRDSVLQSLTTVAGECVDGHPD

SEQ ID NO: 20758 - DNA, 3798 bp, Panicum virgatum
  misc_feature: Ceres CLONE 1812911
  misc_feature: Encodes the peptide sequence at SEQ ID NO. 20759
gtcaaagaaaacctcctcttctacgctacgctaacaccggtctccacaaccacaagccgacgcctccgcccccttccgcccttcgcggcatctgccggcaggccaccttcccgccgttgggaggctcccgctctccgctcaggccgccgcccggccgttggcttgcggctgcgctcgcctcctggggcgccggctcgtcctgccccgcacctcgccggtccgatggcgagcgccttgacaggggtgatgacatctgtcatcagcaagcttacagtgctgcttggacaggagtacacaaagctgacaggtgtccacagagaggtgaactttatgaaggatgagctgagcagcataaacgccctccttcagaggctagcagaggtggacagtgaccttgatgtgcagacaaaggagtggaggcggcaagtgcaggagatgtcttatgacatagaggattgtatcgacgactttatgcatcgcattggccacaatggcatggctgattctgcagggctagtcagtaaggtggttcaacagcttaagtcactgagagcgcgccatcaaatcgccagccgaatccaggatctcaaggcacgtgttgaagatgctaacaagcgccgcatgaggtacaagcttgatgagtgtgccttccaatctaggaccacgacttccatcgatcctcgtttgccttcactctatgctgagccggaagggcttgtcggtattgacaagccgagggatgatcttgtaaggctgctaatgcagggggaggaagcatcagtgcagaaactgaaggtgatatctgttgtggggcctgggggtcttggtaaaaccacactcgcaaatgaggtttaccataaactggaaggccagttccagtgtcgagcttttgtttctctgtcacagcaacctgatgtaaagaagatattgagaaacatactctatcaagtcagccagatggagtatgataacatgaaaatatgggatgaggagaaattcattaatgcaatccgagatttcctacggagaaaaaggtacttaattgttattgatgatatatggagtactcaagcttggaaggctattaaatgtgctttgtatgagaacaattgtggaagcagaattatgacgacaacccgcattgtttctatagccaagtcatgttgctttccccaccatgaccatgtctatgaaataatgcctctcagtgcacataactctaaaagtctacttgccaagcgcatctttggctcagaagatacatgccctcctcaattggaagaaatttccatcaaaattttgggaaaatgtaagggtgtgccattggccattgttacaatagctagcgtattagctaataaagccagcacgaaagaagaatgggacagcgtgcataactcaattggttcaacactggaaaaggatcctgatgtggaagaaatgagaaagatattatcccttagctacgatgagctcccccatcatttgaagacatgtttattatatctaagtatatttccagaagattatgagattgacatggatcaggttgtgggaaggtggatcgctgaaggattcattaatacaggtggtggacaagatttggaggaaattggaaagtgccattttaatgatcttattaacagaagcatgattctgccagtaaagattaaatatgatggtcaagttgtttcatgccgggtccatgatatgattcttgatctccttatatccaagtcaattgaagaaaactttgccacttttattggtggaaaaaatcagaaactagtgcttcaaggtaaggcccgccgtctgtctctcaactattatttctatgaggacgccttggttccgtcaacaacgatcatttcccaatgccgatcactcagtatgttcgggtattctgaacagatgccttctctttcaaaatttcgagctcttcgtgtacttggtatagaaaatggtgaggagatggaacagaagtattttgagcaaataggggcgcttcatcagttgaaatacttgcggctcaatctaagaagcatcacttcactacctgaacagctaggagaactacaacatttgcggacattggaccttggagagactaagattaaaaaattgcctaaaagtattgttcaactgcaaaatttaacatgcttgcgcatcaataatctggaattacctgaagaaattgggaatttgcatgctctgcaggagctatcggttatcaaaatcaaccaaaatagcttagcctcttctttgctggggcttggaagtctaattaatctaaggatccttgggctatgctggtgcattgtcaacacacaccctgatagcaaagcttttgttgacaacttgctctcatcactccgcaaacttgtcagagtcaaccttcgctgtctgtacattcagagttattatggctattccatagaatttttgttggattcttggttccccatccctcatctcctccaaacgtttgccatgggcatggagtactactttcccaggattccattttggattgcatcacttgataacctcacctacctagacatcaatattgatccactaggacaaaaggcactggatgttctaggaaatttgccttctttgctgtatctcagggtgacatcaaaagcaacagcctgcaaggaaaagctcatcataagcaccagcatgttcttatgcctgaaggagttccacttcacctgctggagcagtggggttcatctgatgtttgaagcaggggccatgatgaagcttgagaagctgaggattccatatgcaagtgctgatctttatttcgggttccagcacctctcttcccttaagcatcttgtagctgagatcaattgcagtggcatgacggctcaggaagtgcaggcattggaggaatctatcagaagtgccattgatcttccaaaccgtcccacccttgaagttcaaacatggtaaactatacagctgaacacaagcttgattagtattctcatcatatatacaatgggttctgttttatgaaggcctacatcagagatttgacattctaggtcaaggttctttccgtagatcacaatcaataagaaaaatatcacaataccaattggggaacaatgaataagccaaaacaatttggagatctgtgaatgaagatgagagtatgtgcatcaagttactcgcaatgaaatacgttgatggagttggcttctttcagtttgaatactaggaatcatcacaactattgcagtggcagggagaacaatgtggattggtaccagatgaatagaacattagaacttgccaggtgattagtgggagagagcatagggtttggcatgatgcctggagagttgattgccccttgaaaattgatatccagatttatttttgctgaatgctagttggagttagtgtttgtgcagaagttatagccatggctttacttctaggtgcataagcattgctgcgcagactgttgcaagaactagaatgcaagctggccgctgcagcaagttacagtgctttcaaaatcaggaccagatgcctttgatctaaaaggagtgggatgaagaaaagctcgcaaaggaggaaagctgggctgaagagacacacgcaaacggccgaaattcatgtgtacgcaaacattccgtttggtggttgtctaagttctttttttatttctctttggattcatagctttcaattttcttttcttacatatattggttacaatacaaagctgaactatgtctggtcagtgttgtccagcaggggaattatgcattgccc

SEQ ID NO: 20759 - protein, 913 aa, Panicum virgatum
  misc_feature: Ceres CLONE 1812911
  misc_feature (150)..(458): Pfam Name: NB-ARC Pfam Description: NB-ARC domain
  misc_feature: SWISSPROT Homolog: EC 3.1.3.16 Phosphoprotein phosphatase
MASALTGVMTSVISKLTVLLGQEYTKLTGVHREVNFMKDELSSINALLQRLAEVDSDLDVQTKEWRRQVQEMSYDIEDCIDDFMHRIGHNGMADSAGLVSKVVQQLKSLRARHQIASRIQDLKARVEDANKRRMRYKLDECAFQSRTTTSIDPRLPSLYAEPEGLVGIDKPRDDLVRLLMQGEEASVQKLKVISVVGPGGLGKTTLANEVYHKLEGQFQCRAFVSLSQQPDVKKILRNILYQVSQMEYDNMKIWDEEKFINAIRDFLRRKRYLIVIDDIWSTQAWKAIKCALYENNCGSRIMTTTRIVSIAKSCCFPHHDHVYEIMPLSAHNSKSLLAKRIFGSEDTCPPQLEEISIKILGKCKGVPLAIVTIASVLANKASTKEEWDSVHNSIGSTLEKDPDVEEMRKILSLSYDELPHHLKTCLLYLSIFPEDYEIDMDQVVGRWIAEGFINTGGGQDLEEIGKCHFNDLINRSMILPVKIKYDGQVVSCRVHDMILDLLISKSIEENFATFIGGKNQKLVLQGKARRLSLNYYFYEDALVPSTTIISQCRSLSMFGYSEQMPSLSKFRALRVLGIENGEEMEQKYFEQIGALHQLKYLRLNLRSITSLPEQLGELQHLRTLDLGETKIKKLPKSIVQLQNLTCLRINNLELPEEIGNLHALQELSVIKINQNSLASSLLGLGSLINLRILGLCWCIVNTHPDSKAFVDNLLSSLRKLVRVNLRCLYIQSYYGYSIEFLLDSWFPIPHLLQTFAMGMEYYFPRIPFWIASLDNLTYLDINIDPLGQKALDVLGNLPSLLYLRVTSKATACKEKLIISTSMFLCLKEFHFTCWSSGVHLMFEAGAMMKLEKLRIPYASADLYFGFQHLSSLKHLVAEINCSGMTAQEVQALEESIRSAIDLPNRPTLEVQTW

SEQ ID NO: 20760 - DNA, 420 bp, Panicum virgatum
  misc_feature: Ceres CLONE 1812916
  misc_feature: Encodes the peptide sequence at SEQ ID NO. 20761
aaggtgaggcgatacaaggagaagcagcggaaccggttgttcgcgaggcggatccggtacgaggttcgccgggtcaatgccgtcaagcggccgcggttcaagggccgtttcatcaaggaacacgaggaaagcgagctccagcctacatagctccctttggcttctttcatcactgcaaggatagcccgtgtatatatacggttagttgccttgttgtcttctccccattattccaattgatgtatcctctaccctgggcaagttgcaagcttcaggcgtagatcagtaggtgcaaagttatgtttcgtaggatgaaaataacagaacttagggtgaagtggggaaccatgagatcagttatccaagacctttgacggtgaatccgtttagccttttcacgatctattcatttggagttcg

SEQ ID NO: 20761 - protein, 49 aa, Panicum virgatum
  misc_feature: Ceres CLONE 1812916
  misc_feature (1)..(42): Pfam Name: CCT Pfam Description: CCT motif
  misc_feature: The sequence is a functional homolog of SEQ ID NO 1522 in the 10/374,780 US patent application
  misc_feature: The sequence is a functional homolog of SEQ ID NO 1593 in the 10/412,699 US patent application
  misc_feature: Useful for making plants with modulated low light sensitivity
  misc_feature: Useful for making plants with modulated nitrogen use efficiency
  misc_feature: The sequence is a functional homolog of SEQ ID NO 172 in the 10/225,068 US patent application
  misc_feature: The sequence is a functional homolog of SEQ ID NO 250 in the 10/374,780 US patent application
  misc_feature: The sequence is a functional homolog of SEQ ID NO 274 in the 10/225,066 US patent application
  misc_feature: The sequence is a functional homolog of SEQ ID NO 530 in the 11/435,388 US patent application
  misc_feature: The sequence is a functional homolog of SEQ ID NO 794 in the 10/412,699 US patent application
  misc_feature: Useful for making plants with altered alkaloid content
  misc_feature: Useful for making plants with altered lignin content
  misc_feature: The sequence is a functional homolog of SEQ ID NO 1932 in the 11/479,226 US patent application
  misc_feature: The sequence is a functional homolog of SEQ ID NO 936 in the 10/412,699 US patent application
  misc_feature: The sequence is a functional homolog of SEQ ID NO 338 in the 10/666,642 US patent application
  misc_feature: Useful for making plants with modulated cold sensitivity
  misc_feature: The sequence is a functional homolog of SEQ ID NO 1628 in the 11/479,226 US patent application
  misc_feature: The sequence is a functional homolog of SEQ ID NO 798 in the 10/412,699 US patent application
  misc_feature: The sequence is a functional homolog of SEQ ID NO 226 in the 10/412,699 US patent application
  misc_feature: The sequence is a functional homolog of SEQ ID NO 458 in the 11/479,226 US patent application
  misc_feature: The sequence is a functional homolog of SEQ ID NO 486 in the 11/435,388 US patent application
KVRRYKEKQRNRLFARRIRYEVRRVNAVKRPRFKGRFIKEHEESELQPT

SEQ ID NO: 20762 - DNA, 628 bp, Panicum virgatum
  misc_feature: Ceres CLONE 1812947
  misc_feature: Encodes the peptide sequence at SEQ ID NO. 20763
actctccccaacatctccgtcgcacctgataccttccctctccttgccttcgcctggtgagttcccctcaccgccgtggacgcgaaaaccgtcgcttcgcttcccaacagataacaccgcccggcagcggccgggcccgccgccgcaggtccggcgccagccgagctctaggcccgggcccgcggccccaaccctagctccctcccgcagccccggaggcggcgcgggcggcgggggcagccgcgatgctgttccaggtgggagggcagggcacgcggcccaccttcttcgagatgtcggccgcgcagcagcttcccgccagcctccgcgccgcgctcacctactcgctcggggtttttgcactaagaaggccaatactacacaaagttttagattatgaagatgaattctttgctttgttaatgggtgtccttgagtctcatagtctacggacaacagatggttctttttcacagtcattatatggtctcaggaggagacctgttaaggttttagtgaagagaaagagccctggtacagaatccagtgacaatgtctatgattctgcactaaagaatcgtcagataatcctctcgatggttttcttggttgttttgccatattttaa

SEQ ID NO: 20763 - protein, 127 aa, Panicum virgatum
  misc_feature: Ceres CLONE 1812947
  misc_feature (16)..(127): Pfam Name: Pex2_Pex12 Pfam Description: Pex2 / Pex12 amino terminal region
MLFQVGGQGTRPTFFEMSAAQQLPASLRAALTYSLGVFALRRPILHKVLDYEDEFFALLMGVLESHSLRTTDGSFSQSLYGLRRRPVKVLVKRKSPGTESSDNVYDSALKNRQIILSMVFLVVLPYF

SEQ ID NO: 20764 - DNA, 708 bp, Panicum virgatum
  misc_feature: Ceres CLONE 1812970
  misc_feature: Encodes the peptide sequence at SEQ ID NO. 20765
acagcgccgcctcccctcggcccccgctctgtctctcgcccgccgggccggatcggcgaatccagcttccgccgccgccgccgcgcgcgcgcggccccgctcctcctcctcctccgtgctcgcctcgccgcgagcagcagcagcagcagcagcagcagtgcgcggggtcctcgcgcaccgagtagcagcaacctaggaacttgaattatctacgaacgtcaagatgttctctgctccaggcaacaattctttggctcttgcagcccctcgaccagggatggagctggctaatgttcaacagcatccgaatcaggctcttgggcctggtggaaaacaacgcacatccagtctggaggcaccgataatgctgcttacaggtcaccagagtgctgtctactgcatgaagttcaaccctgctggaactgtgatagcatcaggctcccatgacaaggatatcttcttatggtatgttcatggtgagtgcaagaacttcatggtgctgagagggcacaagaatgctgtccttgaccttcagtggactactgatgggacccagctaatctccgcaagtccggacaagactgtgagggtgtgggatgtcgagactggcaagcaagttaagaagatggctgagcactcgtcgtttgtcaactcgtgttgcccagcccgcaagtggccgccacttgttgtgagtggttcagatgacgg

SEQ ID NO: 20765 - protein, 143 aa, Panicum virgatum
  misc_feature: Ceres CLONE 1812970
  misc_feature (69)..(107): Pfam Name: WD40 Pfam Description: WD domain, G-beta repeat
  misc_feature (26)..(64): Pfam Name: WD40 Pfam Description: WD domain, G-beta repeat
  misc_feature: SWISSPROT Homolog: EC 2.3.1.48 Histone acetyltransferase
MELANVQQHPNQALGPGGKQRTSSLEAPIMLLTGHQSAVYCMKFNPAGTVIASGSHDKDIFLWYVHGECKNFMVLRGHKNAVLDLQWTTDGTQLISASPDKTVRVWDVETGKQVKKMAEHSSFVNSCCPARKWPPLVVSGSDD

SEQ ID NO: 20766 - DNA, 2294 bp, Panicum virgatum
  misc_feature: Ceres CLONE 1812989
  misc_feature: Encodes the peptide sequence at SEQ ID NO. 20767
gagctgcgcccccggccgcgggaaatggtccagtcgcggcggcgcgtcggcagctaccggtgcccgcgccgcgccgcgctgccggcggcggcgctcctgctcttcctcctcgccgccgtcgcgctgctctacgtctccccgccgccggtctcggaccaccccgtggtcgcctcctcccgccgccgccgctcggcacatgctttgctaaacagctccggtggcagcagcatggacgagtccgagcgccgcgaaattttccgtgttccaacgaatgattcgaccgtcagggatgacctttggggttcaaagcttgctagcaaattttatgggtgcagcaactcaagcagcaagttccttgattcaaatattactacacaaacagaccgctatttgatgattgttacaagcggaggcctgaatcagcagagaacagggataattgatgctgtcgttgctgcacgcattttaaatgccacacttgttgttcccaaactggaccaagcatccttctggaaagattcaagcaatttttctgaaattttttatgccgactggttcatctcatccctatcaaaggatgtaaagattgtgaaagagcttcctgagataggaggtaaacttcgggctcctcacagaatgcgtgttcctcgaaaatgtactgagcggtgttacttgaaccgcgtgttacctgcacttcttaagaaacatgttatacgattgacgaaatttgattatagattagcaaacaggttgcaaactgacttgcaaaagctgagatgcagagtcaactatcatgcattgagatttactgctccagtacaggagatgggtgaaaagctgatacaaagaatgagggagaggagcaaatattttattgctcttcatttaagattcaaacctgatatgcttgccttttcggggtgctattacggtggtggagaaaaagagaggagagaacttggtgctataaggaagaggtggaaaggcttgcatcctaacccaaagaaaggaagaaggcaaggtagatgcccgctaactcctgaagaggtgggtctgatgttgagagcactgggctacagtaaggatgtccacatttatgtggcttctggagagatatatagaggtgcaaggactctgacaccgcttaaagctctcttccccaatctccacacaaaagaaacaatatctagcaaagaggagctggctccattctctaagtattcgtctcgcatggctgcacttgatttcattgtctgtgatgaaagtgatgcttttgtggctaacaacaatggcaacatggctaaaattttggctgggcgaaggagatattttgggcataaaagaacaatccgaccaaatgccaaaaggctctatcccttgtttttgagcagaggaaacatgtcatgggatgcattctcgtcaaaagtacgcatgtttcagaaagggtttatgggagagcccaaagagcttaggccagggaggggggagtttcatgagaacccctctagctgtatctgtgaaaggactgatggcaaagccatatctcgcgatgatcaagtcttggatagtagtagtgaccgaggcaaagccatggatgagccagcagttcctaattatattggtgaagagctgggcgaatttgatgatgatgatgatgaagatgctcctgcagagaaagggatggttgacttggaaatggacgatgatgtgttggtcagaccagaggatcctgagctggaacagattctttcagactagccaagttacaaaaacggcatcaaagaaatttcccaaccaattttgggccgagtgattaacgaattttgaccccttgaaattgtacatatatatatatatatatatatatatatatatatatatatatatatatatatatatatatatatatatatatatatatatatatatatatatatatatatatatatatatatatatatatatatatatcctatatacagagagattgtggctttttgcgtgttgtgtgtgggtgtgtgtgtgtgtgtgtgtgtgagagagagagagagagagagcgcgagggggggcgcgcgcgcgcgcgcgcgcgcgcgtgagtgctctcgcgcgcgctctctggctgtctttttatctctctgtgtctgtgaaaccctctgtctcactcagattgatagacatacagcgagtccccctgtgtctgtgtgtctgtgtctctgtgtgtctctctctgtgtgtctgtgagagagtgtgcgagggctgagtggcagatagagagagagagagagagagagaga

SEQ ID NO: 20767 - protein, 577 aa, Panicum virgatum
  misc_feature: Ceres CLONE 1812989
  misc_feature: Useful for making plants with modulated nitrogen use efficiency
MVQSRRRVGSYRCPRRAALPAAALLLFLLAAVALLYVSPPPVSDHPVVASSRRRRSAHALLNSSGGSSMDESERREIFRVPTNDSTVRDDLWGSKLASKFYGCSNSSSKFLDSNITTQTDRYLMIVTSGGLNQQRTGIIDAVVAARILNATLVVPKLDQASFWKDSSNFSEIFYADWFISSLSKDVKIVKELPEIGGKLRAPHRMRVPRKCTERCYLNRVLPALLKKHVIRLTKFDYRLANRLQTDLQKLRCRVNYHALRFTAPVQEMGEKLIQRMRERSKYFIALHLRFKPDMLAFSGCYYGGGEKERRELGAIRKRWKGLHPNPKKGRRQGRCPLTPEEVGLMLRALGYSKDVHIYVASGEIYRGARTLTPLKALFPNLHTKETISSKEELAPFSKYSSRMAALDFIVCDESDAFVANNNGNMAKILAGRRRYFGHKRTIRPNAKRLYPLFLSRGNMSWDAFSSKVRMFQKGFMGEPKELRPGRGEFHENPSSCICERTDGKAISRDDQVLDSSSDRGKAMDEPAVPNYIGEELGEFDDDDDEDAPAEKGMVDLEMDDDVLVRPEDPELEQILSD

SEQ ID NO: 20768 - DNA, 249 bp, Panicum virgatum
  misc_feature: Ceres CLONE 1812989-R
atatatacatatatacatacatatatatatatatatatatatatatatatatatatatatatatatatatatatatatatatatatatatatatatatatatatatatatatatattttgcaatgtaaatgtacatcctccaaccagggtttgcctaccatctcagtagtgcagtctctaattcctcagtttgtagcaattgtggctttttgcctgttttagattgtagcatgcattttgcttctgatc

SEQ ID NO: 20769 - DNA, 667 bp, Panicum virgatum
  misc_feature: Ceres CLONE 1812993
  misc_feature: Encodes the peptide sequence at SEQ ID NO. 20770
gtaagtcaacactccgcgctagcttaatgctccctccattataaccacccaaccctcccccctccccccaccctctcttctccgcttccggctccgctcccgtcccgccatgggcaactcgctcgcctgcttctgctgctccggcggcggcgccggccgccgccgccacgtggcgcccgccgcgctcccctccgacccggcctacgacgagggcctgggccactccttctgctacgtcaggccggataaggtgctcgtgcccttctccgcggacgacctggtcgccgacgccaaggcggccgccgcggcagaggaggccaccacgttccgggccatctcgggggcggcgctcagcaccaacgtctccacgccgctctccacgtccgtgctcctcctgctgccagacgaatccgccgcgtcctcggccgccgccgcctcctccgggttcgagagctccgagtccttcgccgccgtgccgctgcagcccgtcccgaggttcccgtcggggccgatctgcgcgcccgccggcggcgggttcctctccggcccaatcgagagggggttcctctccgggccccttgacgccgcactcatgtccgggcccctcccgggcgccgccgcctccggtcgcatgggaggcgccgagcccgcgctccgccagagcctc

SEQ ID NO: 20770 - protein, 185 aa, Panicum virgatum
  misc_feature: Ceres CLONE 1812993
  misc_feature: SWISSPROT Homolog: EC 3.1.3.16 Phosphoprotein phosphatase
MGNSLACFCCSGGGAGRRRHVAPAALPSDPAYDEGLGHSFCYVRPDKVLVPFSADDLVADAKAAAAAEEATTFRAISGAALSTNVSTPLSTSVLLLLPDESAASSAAAASSGFESSESFAAVPLQPVPRFPSGPICAPAGGGFLSGPIERGFLSGPLDAALMSGPLPGAAASGRMGGAEPALRQS

SEQ ID NO: 20771 - DNA, 645 bp, Panicum virgatum
  misc_feature: Ceres CLONE 1812997
  misc_feature: Encodes the peptide sequence at SEQ ID NO. 20772
accgccgcaatctccatcccacacaccatctcctttcaccggaggatttctttctttccccacagatattcccaaagaatcttccgtgttgctctcctcatcggattcctcttccccctcctcccctcacgctccaattattcttctccctactgactcgctttgcttctctcttctccctgtcctctcctcccgccccctcgtgtttcttcctcctaccagcggagcaccagctgcgcgcttgtgcctcgttccctcgtgccaagaagaacgccggtggtgaggctgtccggccgccggcgtcatgtgcgcggaggagccggaggacacggaaaggctcggtttcggagaggaaggggtcgaggaggccgccgaatcccccctgggtcagatggagagagtttgtgaaaacacaacttctgctgatttcaggcagaataagttaagcaattttgttccaatgctccgatcaggagattggtctgatattggaggtcgccaatacatggaagatgcccatgtgtgcattccggacctagctaagaacttcggtttcccatcattgaatagtgaagttgtttccttctatggggtatttgatggtcatggtggaaaagatgctgcccatttcgttcgcgataattt

SEQ ID NO: 20772 - protein, 113 aa, Panicum virgatum
  misc_feature: Ceres CLONE 1812997
  misc_feature: SWISSPROT Homolog: EC 3.1.3.16 Phosphoprotein phosphatase
MCAEEPEDTERLGFGEEGVEEAAESPLGQMERVCENTTSADFRQNKLSNFVPMLRSGDWSDIGGRQYMEDAHVCIPDLAKNFGFPSLNSEVVSFYGVFDGHGGKDAAHFVRDN

SEQ ID NO: 20773 - DNA, 666 bp, Panicum virgatum
  misc_feature: Ceres CLONE 1813020
  misc_feature: Encodes the peptide sequence at SEQ ID NO. 20774
accaagcgcagcaggaccaccagcaggcagcagcagctcgccaccacctcagctcagctcagtgagcactgcgtcgtcgtgctgcgcatcaccaaggaaatggcggcggcgtcgctcaagttcacggtgcggaggaagccggcggtgctggtggcgccggcggcgccgacgccgcgggagctgaagcggctctcggacatcgacgaccaggacggcctgcggttccacatccccgtcatccagttctaccgccggagcgcgctggcgggggcgcgggaccccgcgccggtgatccgggccgccgtcgccggggcgctcgtgcactactacccgttcgccgggaggctccgggagctcgaggggcgcaagctcgccgtggagtgcaccggggagggcgtgctgttcatcgaggccgacgcggacgtccgcctcgaccacttcggggacgcgctccagccgccgttcccgtgcctcgacgagctcatcttcgacgtccccggctcgtccgaggtcctcggctcgccgctcctcctcttccaggtgacgcggctggcgtgcgggggcttcatcctgggggtgcgcctgcaccacaccatggcggacgcgcagggcctggtgcagttcctgggcgcggtggcggagctggcgcggggcacggcggcgccg

SEQ ID NO: 20774 - protein, 188 aa, Panicum virgatum
  misc_feature: Ceres CLONE 1813020
  misc_feature (8)..(188): Pfam Name: Transferase Pfam Description: Transferase family
  misc_feature: SWISSPROT Homolog: EC 2.3.1.162 Taxadien-5-alpha-ol O-acetyltransferase
MAAASLKFTVRRKPAVLVAPAAPTPRELKRLSDIDDQDGLRFHIPVIQFYRRSALAGARDPAPVIRAAVAGALVHYYPFAGRLRELEGRKLAVECTGEGVLFIEADADVRLDHFGDALQPPFPCLDELIFDVPGSSEVLGSPLLLFQVTRLACGGFILGVRLHHTMADAQGLVQFLGAVAELARGTAA

SEQ ID NO: 20775 - DNA, 2412 bp, Panicum virgatum
  misc_feature: Ceres CLONE 1813024
  misc_feature: Encodes the peptide sequence at SEQ ID NO. 20776
cccgccttgttcgccgatcagcgccgcctccgccgcgtcctctcctcctcctccagccccacgctcgcgacgctcactcgcctccacgccctcctcatcgtctcctcctccaaccatctcctcgcgtcgctcgccgccgcctacgcccgcgccggcgcgctcgacgcctcggagtccaccctcgcgacctcccccgcctccccctcctcaatagccgcctggaacgcgctcctcgccgcgcactctcggggcggctcccatcgcaccgcgctccgcgtcttccgcgccctcccgcccgccgcgcgccccgacagcaccaccttcacgctcgcgctctccgcgtgcgcgcgcctcggggatctcgccgccgcggaaagcatcaagggccgcgcgttcgaggccggttacagcaaggacgtgttcgtctgctcggcgctgctccacctctactcgagatgcggtgccatgggggacgctgtcagggtgttcgacggaatgccgaggagggaccgtgttgcgtggagcacgatggttgctgggttcgtgagcgccggaaggccggtggatgcgcttggtatgtacaggaggatgcgggaggacggcgtggagggggacggggtggtcatggttggggttatacaagcttgcgcagcaacaggggatgcccaaacgggggcctcagttcatgggtacatactgcggcatggtatgaggatggatgttgttgcgacgacgagccttgtggacatgtacgccaagaatgggaagtttgatgtggcacgccgagtgtttagaatgatgccgtacaggaatgctgtttcatggagcgcgctgatttctgggtttgtgcagaacagtcatgcagatgaggcacttgatttgtacagagagttgtcaacttccgggcttcagcctgattcaggggcacatgttagtgcactcctagcttgcgctgatatggaactcctgaagctagggaagtctatacatggcttcatcttgaggaggcttgagcttcactgtattttgggtacttcaattcttgacatgtactccaaatgtggctccctggaaagtgctgaaaagcttttcgatagggtttcctcgagagacttggttttgtggaatgccatgattgcatgctgtggcactcatggacgtggtcatgatgcccttgctctcttccaagaactgaacaaaaatggaataaatcctgatcatgccacatttgcttctcttctgtcagctctaagccactctggtcttgtggaggaagggaaattctggtttgatcgcatgagtaaggagtttggcattgaacctgcagaaaagcattatgtatgtatagttgatctcttagcacgttcgggtcttgtggaagaagccaatgacctgctggcatcaatgcaaactgaaccgaccattgcaatttgggttgctctgctttcaggttgcttgaataacaagaagctagagcttggagaaaacatagcagaaaagatccttgagtcgcgacctgaggacataggtgtccttgcactggtatcaaatctctatgccgctgcaaagaagtgggacaaggtcagggaagccagaaagctaatgaaggatagcggcagcaagaaagtacctggctatagcttggtagaggtccatggaatgcgccacatgttcgtgatggaagaccagagccatcctcagcatcaggagatcctaaaaatggtcgcgaagcttgattctgagatgaggaagatgggttatgttccgagaacagaatttgtgtaccatgacctcgaggaaggagtgaaggagcagcttctcagctaccatagcgagcggctggccatcgcctttggtttgttgaacaccagccctggaacgaggctcgtgatcatcaagaacctcagggtctgtggcaattgccatgatgcgatcaagtatatctcaaagattgtcgaccgggagattgttgtccgagatgcgaagcgtttccaccatttcaaagacggggcctgttcttgtagagattactggtgattatgtctgactgttgaggcacgcctgtgtgtagcttgggcagttcagtcacctagtgttgatatttggtccagttggctgcagagaactggcagaatgcataccggttgtgttcaagtaaatttgacctcaaaatcctttgatgcaaaaaacaatagttcaccgcatcatcgtagaagaaaaaaaatgacgctgagaatattccagtgcttcaaagtgcaaccggagtgcaaatggagcggcttataaattagggcagactagtaggggagagctctcttctggttttgtttctaaaggtgttcctgcctggcagcttcagatcttaatcgtgaacatgatctgttaatttaatataagctctcccttttctcg

SEQ ID NO: 20776 - protein, 678 aa, Panicum virgatum
  misc_feature: Ceres CLONE 1813024
  misc_feature (273)..(307): Pfam Name: PPR Pfam Description: PPR repeat
  misc_feature (373)..(407): Pfam Name: PPR Pfam Description: PPR repeat
  misc_feature (172)..(206): Pfam Name: PPR Pfam Description: PPR repeat
PALFADQRRLRRVLSSSSSPTLATLTRLHALLIVSSSNHLLASLAAAYARAGALDASESTLATSPASPSSIAAWNALLAAHSRGGSHRTALRVFRALPPAARPDSTTFTLALSACARLGDLAAAESIKGRAFEAGYSKDVFVCSALLHLYSRCGAMGDAVRVFDGMPRRDRVAWSTMVAGFVSAGRPVDALGMYRRMREDGVEGDGVVMVGVIQACAATGDAQTGASVHGYILRHGMRMDVVATTSLVDMYAKNGKFDVARRVFRMMPYRNAVSWSALISGFVQNSHADEALDLYRELSTSGLQPDSGAHVSALLACADMELLKLGKSIHGFILRRLELHCILGTSILDMYSKCGSLESAEKLFDRVSSRDLVLWNAMIACCGTHGRGHDALALFQELNKNGINPDHATFASLLSALSHSGLVEEGKFWFDRMSKEFGIEPAEKHYVCIVDLLARSGLVEEANDLLASMQTEPTIAIWVALLSGCLNNKKLELGENIAEKILESRPEDIGVLALVSNLYAAAKKWDKVREARKLMKDSGSKKVPGYSLVEVHGMRHMFVMEDQSHPQHQEILKMVAKLDSEMRKMGYVPRTEFVYHDLEEGVKEQLLSYHSERLAIAFGLLNTSPGTRLVIIKNLRVCGNCHDAIKYISKIVDREIVVRDAKRFHHFKDGACSCRDYW

SEQ ID NO: 20777 - DNA, 674 bp, Panicum virgatum
  misc_feature: Ceres CLONE 1813037
  misc_feature: Encodes the peptide sequence at SEQ ID NO. 20778
atccggcgagctgcttcccctgtcaggaatccccctccgccgctcccgaatcttgctccggcgacggcaccccatcgcttgccagaatggcgctcaacaaggagtacacgtacgcagagctggagaaggagccctactggccatttgagaagctgcggatctccatcacgggcgctggtgggttcatcgcgtcccacatcgcgaggcgcctcaagagcgagggccactacatcatcgcctctgactggaagaagaatgagcacatgaccgaggacatgttctgccatgagttccatcttgtcgacctgagggtcatggacaactgcctcaaggtgaccacgggggttgaccatgtgttcaaccttgctgctgatatgggtgggatggggttcatccagtccaaccactctgtgatcatgtacaacaacaccatgatcagctttaacatgcttgaggctgctagaattaacggcgtcaagaggttcttttatgcatcaagcgcctgtatttatcctgaatttaagcagttggagactgtagttagcttgaaggagtcagatgcctggcctgcagaggtttctaagcatttgcattgattcatgctcctgtgttaattgttagtccctttagctattagggtaaaaatgctaacttaaatgatgtataatccttaa

SEQ ID NO: 20778 - protein, 169 aa, Panicum virgatum
  misc_feature: Ceres CLONE 1813037
  misc_feature (25)..(169): Pfam Name: Epimerase Pfam Description: NAD dependent epimerase/dehydratase family
  misc_feature: SWISSPROT Homolog: EC 5.1.3.18 GDP-mannose 3,5-epimerase
MALNKEYTYAELEKEPYWPFEKLRISITGAGGFIASHIARRLKSEGHYIIASDWKKNEHMTEDMFCHEFHLVDLRVMDNCLKVTTGVDHVFNLAADMGGMGFIQSNHSVIMYNNTMISFNMLEAARINGVKRFFYASSACIYPEFKQLETVVSLKESDAWPAEVSKHLH

SEQ ID NO: 20779 - DNA, 1882 bp, Panicum virgatum
  misc_feature: Ceres CLONE 1813057
  misc_feature: Encodes the peptide sequence at SEQ ID NO. 20780
tacaagtaacgaagagaaaaccaaagggagaagaagaaaaaaaaggaagaggctggcgaatctggagcaccgaccaatccagacagcacccgcaccgccacggcggcggctgtccgtttctttcccggcgccagcttcctcttcgttgcccctcaccttccctacctcgtgcgcccaacgctggcacgaatccagaatccaatttcgccacgtgaagctcagtgctcagcgctcactgctcactgctcgcctcgccggcctccctcccgagcccgcgtgttcccccggccgcgccggggatggcggcggcggcggcgccgctgctgctggcgcaggaggacgggagggcgagacgcggcggggcgacgtcggcgcagacgctggggaacgtggtggtatccatcgtcggcaccggcgtgctcggcctcccctacgccttccgcgccgccgggtggctcgcgggctccgtcggcgtcgccgccgccggctccgccacgctctactgcatgctcctactcgtggactgcagggataaactcgaagaggaccaacctgaagagtgctgtcagggtcactatacatatggggatttgggtgaaaggtgctttgggactataggtcgatgcttgacagaaatcctcatccttgtttcgcaggccggtggttctgtagcgtacctaatattcattggccaaaatcttcactccatattcagccagttgatgtccccagctggcttcatctttgccatccttctgcctgtgcagatcgcactctccttcatccgttcactgccttctctttctccattcagtatatttgcagatgtgtgcaacttccttgccatggcaattgtgatcaaagaggatcttcaactctttgatcatccctttgcaagtagaactgcttttaatgggctttgggcagtgccattcacctttggggttgcagtcttctgttttgaaggattcagcatgacccttgcactggaagcttcaatggctgagcggagaaagttccgccgggtactttctcaagcacttgctgccattataaccgtgtatgtgtgttttggagtgtgtgggtacttggcctatggtgatgccaccaaagacatcataacactcaatcttccaaacaattggacatcagttgcagttaaggttggcctatgcgtcgcgctggcgttcacgttcccagttatgatgcacccgatccatgagattgtggagacaagattcagatcaagtggatgctttcagaagctctcccacaatgtacctggagcggagtggctaggcctgcactcaagccgcatcctcgtggtggccatcctgactgttgtggcatccttcatccctgcttttggggcgttcatctcattcgtcggaagcacgatgtgcgcgcttctctccttcgtcctgcctgctctcttccatctcagcattgtaggctcgtcaatgtccttatggaggcgggcgatggactatgtcattcttctctttggtctggcttttgccgggtacggtcttgtctctgctctgtcctcacattagacaatggtccaaatggccaagatgtgcagatcaggatttgaaccctagacactaaaggaagtcatcagcaactgacaaatctggatcttgggatggcatgagacaaatggagatggctccgaaattcatagcattttatataatatacagatgatgctgggatcaaggctatgatgggttgtattgtagcttagatgtatcttatgtcttttctgcatgtggccccctttagccaatctccatatgtttaactggcaagtgcacatgggttgtaaatggtttataaacaagagcatatttgaattgatttcgacttgatttgctac

SEQ ID NO: 20780 - protein, 418 aa, Panicum virgatum
  misc_feature: Ceres CLONE 1813057
  misc_feature (20)..(416): Pfam Name: Aa_trans Pfam Description: Transmembrane amino acid transporter protein
MAAAAAPLLLAQEDGRARRGGATSAQTLGNVVVSIVGTGVLGLPYAFRAAGWLAGSVGVAAAGSATLYCMLLLVDCRDKLEEDQPEECCQGHYTYGDLGERCFGTIGRCLTEILILVSQAGGSVAYLIFIGQNLHSIFSQLMSPAGFIFAILLPVQIALSFIRSLPSLSPFSIFADVCNFLAMAIVIKEDLQLFDHPFASRTAFNGLWAVPFTFGVAVFCFEGFSMTLALEASMAERRKFRRVLSQALAAIITVYVCFGVCGYLAYGDATKDIITLNLPNNWTSVAVKVGLCVALAFTFPVMMHPIHEIVETRFRSSGCFQKLSHNVPGAEWLGLHSSRILVVAILTVVASFIPAFGAFISFVGSTMCALLSFVLPALFHLSIVGSSMSLWRRAMDYVILLFGLAFAGYGLVSALSSH

SEQ ID NO: 20781 - DNA, 705 bp, Panicum virgatum
  misc_feature: Ceres CLONE 1813078
  misc_feature: Encodes the peptide sequence at SEQ ID NO. 20782
ctcgccattccctcctctctagagctttgctcggtctacctcgcgcttcccgggctctcatagccgagagaggcggagggaggggctcgaggagccagcgggcggcggcaaatgacggaggcggcggcggcggcggcggggttcaaggcggcgaggcgggcggggctcgcggcggcgctgctgctgctcgtcctcgtcgtggtggtcgccggcggacccgtcggccgggtgctccacgggctccggccccggagcgcggcggcggcgggcggctcgaggcggtggctgcgggactcgtcatggccggcggcggcgacgccgagggccgacggtgacgacgacgggccagcgatggccgttcgcggcgcggtggaggacccggaagcagtggtcgacgacgtgcacatgtccatcaggaacagcacggcccggcggaatctcgggtacctgtcgtgtgggacgggcaaccccatcgacgactgctggcgctgcgacccggactggcacaagaaccgccagcgcctggctgactgcggcatcggcttcggccgcaacgccatcggtggccgcgacggcaagatctacgtcgtcactgacccgagcgacgacgacgccgtcaacccgcgcaagggcaccctccgctacgccgtgatccaggacgagccgctctggatcatcttcaagcgggatatggtgatcacgctc

SEQ ID NO: 20782 - protein, 197 aa, Panicum virgatum
  misc_feature: Ceres CLONE 1813078
  misc_feature: SWISSPROT Homolog: EC 4.2.2.2 Pectate lyase
MTEAAAAAAGFKAARRAGLAAALLLLVLVVVVAGGPVGRVLHGLRPRSAAAAGGSRRWLRDSSWPAAATPRADGDDDGPAMAVRGAVEDPEAVVDDVHMSIRNSTARRNLGYLSCGTGNPIDDCWRCDPDWHKNRQRLADCGIGFGRNAIGGRDGKIYVVTDPSDDDAVNPRKGTLRYAVIQDEPLWIIFKRDMVIT

SEQ ID NO: 20783 - DNA, 693 bp, Panicum virgatum
  misc_feature: Ceres CLONE 1813088
  misc_feature: Encodes the peptide sequence at SEQ ID NO. 20784
gttctgctttgctgcttgtgttgggagagcgagtggaaggctggcgatggggctggaggccggggactacggcgccttcatggagaaattcgagctgctccctccgcaatctcagcagcagctcccgctgcacggcctcaccttcgccatcaaggacatcttcgacatcagcggccgcgtcgccgggttcggcaacccggactgggcgaggacgcacgcccccgccgccgccacctcccccgtcgtcctggccacgctggccgccggcgccaccagcgtcggcaagaccgtcatggatgagatggcctacagcataaatggggagaacgcgcactacggcacgccgacgaatccgtgcgctcccgatagagtccccggaggatcctccagtggatcagctgttgcagttggcgcgaaactcgtggacttcgctctgggaactgacaccggcggcagtgtgagggtacctgctgcctattgtggcatatttggactcaggccttcccatggattggtttcgactgaaaatgtcattccgatgtcgcagatgttcgatactgttgggtggtttgctagagacctctctacattttctcgtgtaagcaacgtgttgttgccgctgcctgctgacaacattatcaagcaaccaactcaattttcgattcctaaggactgttttgaaatcttaggttc

SEQ ID NO: 20784 - protein, 230 aa, Panicum virgatum
  misc_feature: Ceres CLONE 1813088
  misc_feature (9)..(229): Pfam Name: Amidase Pfam Description: Amidase
  misc_feature: SWISSPROT Homolog: EC 3.5.1.4 Amidase
FCFAACVGRASGRLAMGLEAGDYGAFMEKFELLPPQSQQQLPLHGLTFAIKDIFDISGRVAGFGNPDWARTHAPAAATSPVVLATLAAGATSVGKTVMDEMAYSINGENAHYGTPTNPCAPDRVPGGSSSGSAVAVGAKLVDFALGTDTGGSVRVPAAYCGIFGLRPSHGLVSTENVIPMSQMFDTVGWFARDLSTFSRVSNVLLPLPADNIIKQPTQFSIPKDCFEILG

SEQ ID NO: 20785 - DNA, 679 bp, Panicum virgatum
  misc_feature: Ceres CLONE 1813090
  misc_feature: Encodes the peptide sequence at SEQ ID NO. 20786
atcccatcccgctgcgctgctccccagcacacgcctcctcgccttcgcctcccccgatctccagggcgctccgcggcggcggcggcggcggcggcagagatggcggctccggtggtggacgccgagtacctgcgccaggtcgacagggcgcgccgccagctccgcgccctcatctccaacaagggatgcgccccaatcatgctccgtctcgcatggcatgatgctggaacttatgatgtgaaaacaaaaactggtggcgcaaatggttcgattagatttgaggaagagtacacccatggttctaatgctggtttaaagattgctatcgatcttcttggtatgcatttttaatgctcaatatgatagtggaaacctactaaagaatattcttccttgtgagaatatctgaacgacatcctttaaacctaacaagcatgagctactcacatcaatctgctcaacggcatcctttaatgctcaacatgaatgacgacttcgaagaaatcaatctgctgaaactcattttctttggccatgggtttcttcaatgttgtcaaggccaggctacaaaatattttattttcatgtctgtaatgttgggatgctaagttgggaaactgtagtgtgcgtttagctactcaagaaacaggtgcttcccataaatatctgctattctgct

SEQ ID NO: 20786 - protein, 83 aa, Panicum virgatum
  misc_feature: Ceres CLONE 1813090
  misc_feature: SWISSPROT Homolog: EC 1.11.1.11 L-ascorbate peroxidase
  misc_feature: Useful for making plants with altered carbohydrate content
  misc_feature: Useful for making plants with altered cell wall content and/or composition
  misc_feature: Useful for making plants with modulated heat sensitivity
  misc_feature: Useful for making plants with modulated water use efficiency
MAAPVVDAEYLRQVDRARRQLRALISNKGCAPIMLRLAWHDAGTYDVKTKTGGANGSIRFEEEYTHGSNAGLKIAIDLLGMHF

SEQ ID NO: 20787 - DNA, 536 bp, Panicum virgatum
  misc_feature: Ceres CLONE 1813090-R
  misc_feature: Encodes the peptide sequence at SEQ ID NO. 20788
aactacaacagaaatgcattccccaccataagcaatataactatcaagaatatcgtgggtgtcaatattggtgttgcgggaatgttgcaaggcatctcaggggataacttcagcaatatttgcttatcaaatgtttccctcagtgtcagatccacgaatccatggaattgttcacttgtcgaagggtattcgaactctgtgtcacctgagatatgtgagcaactgagaaccggtcctgggcctggacaagtatgctatgatggcaatagctatccagcagcagcagcacaaccccagtcaccacagaagtcaagtgcttgccgattggtaaatcctttcttttgcataaggtggtttctctgtaggtaaccattgagtatatctacttgatgcatttgtttccttgtttctccggcggttttgtagctgtattttatgggtcagtgtcttgtactcatgttattccaaaaccttcttgttggggcatgtaggtgctgattattactggaaatgaaataaatatgtttggcttgacg

SEQ ID NO: 20788 - protein, 122 aa, Panicum virgatum
  misc_feature: Ceres CLONE 1813090-R
  misc_feature: SWISSPROT Homolog: EC 3.2.1.15 Polygalacturonase
  misc_feature: Useful for making plants with altered carbohydrate content
NYNRNAFPTISNITIKNIVGVNIGVAGMLQGISGDNFSNICLSNVSLSVRSTNPWNCSLVEGYSNSVSPEICEQLRTGPGPGQVCYDGNSYPAAAAQPQSPQKSSACRLVNPFFCIRWFLCR

SEQ ID NO: 20789 - DNA, 481 bp, Panicum virgatum
  misc_feature: Ceres CLONE 1813102
  misc_feature: Encodes the peptide sequence at SEQ ID NO. 20790
tcccttcgcttcgcataccactctcctcctcgttcctgcggttcgcggggggaccgaagccttcgaggaaggaaggacccgtgaccctagcgctgtcggggtagcctccggcgatggccgcggcggcgatcctgccggagctggcgacgcaggtgctcatcccggtcgcggcggccgtgggcatcgcgttcgcggtgctgcagtgggtgctcgtctccaaggtgcggctcacccccgagcgccgcgccgacggcggggccgcccaggccgggcccgctgactacctcatcgaggaggaggaggggcctcacgaccacgacgccggcgtccggtgctccgatatcgatagcgccatctcttactgagcatcatctttccatttcactgaatccaagtatgttgaacgattcttggggctctgttctttccgcccattcctcttgcgcgggaccctccccgcattcgacacactgaggctcct

SEQ ID NO: 20790 - protein, 83 aa, Panicum virgatum
  misc_feature: Ceres CLONE 1813102
  misc_feature: SWISSPROT Homolog: EC 3.6.1.1 Inorganic diphosphatase
MAAAAILPELATQVLIPVAAAVGIAFAVLQWVLVSKVRLTPERRADGGAAQAGPADYLIEEEEGPHDHDAGVRCSDIDSAISY

SEQ ID NO: 20791 - DNA, 605 bp, Panicum virgatum
  misc_feature: Ceres CLONE 1813106
  misc_feature: Encodes the peptide sequence at SEQ ID NO. 20792
cttctatccacgagcgaaccggcagcgcaagcgcagggagaggggagccgaggccgagcacggagcacaagcaggatgccgacgctgatcctgagcaccaacgtgccagtggacgccgtcgtcgctgccgacatcctcaaggactgctccaaggcagtcgccaggatcatcggcaagcccgaatcctacgtcatggtgtcgataaacggctcggtgcccatgtcgttcgcggcgagcgaagaaccgacggcgtacggtgagctcgtctccatcggcgggatcggccccggcgtcaacgggaagctgagcgcggccgtggctgagatcctcgagaccaagctctcggtcagcaggtccagattctacatcaaattcgatgatgtgcagagattcaactttggcttcaatggatcgacattctaaagaaaactccatcagagaatgatgatcgctgcgtccaagcgatcacctcaacctgcccacacataccaccatcagttcttcatcaataaatggggatggtcaagtgcttcatttgtatctcctatacctccaatggatattccgctcatgtgtgagacagcactaaattatatgctttattt

SEQ ID NO: 20792 - protein, 115 aa, Panicum virgatum
  misc_feature: Ceres CLONE 1813106
  misc_feature (2)..(115): Pfam Name: MIF Pfam Description: Macrophage migration inhibitory factor (MIF)
  misc_feature: SWISSPROT Homolog: EC 5.3.2.1 Phenylpyruvate tautomerase
MPTLILSTNVPVDAVVAADILKDCSKAVARIIGKPESYVMVSINGSVPMSFAASEEPTAYGELVSIGGIGPGVNGKLSAAVAEILETKLSVSRSRFYIKFDDVQRFNFGFNGSTF

SEQ ID NO: 20793 - DNA, 699 bp, Panicum virgatum
  misc_feature: Ceres CLONE 1813116
  misc_feature: Encodes the peptide sequence at SEQ ID NO. 20794
actccgccgtgcctcccgtcgcttcctccgccgcgctccggccgcccgtgcgccgcgcgctgcgcgctctcgttcgtgctggtgggcggccggccccgtcgaggagatggactcggtcatgaccgcccccgacgcgccgccgccggccgtcgtgctcgtctccgccggtgccaaccactccgtcgcgctgctcacgggcaatgcgctgtgctcgtggggcaggggcgaggacgggcagctcgggcacggcgacgcggaggaccggctcgtgcccacggtgctgagcggcttcgacgcgcccgggatcacgtcggtcatctgcggcgccgaccacaccaccgcctactccgaggaggagctgcaggtctacagctgggggtggggagacttcgggaggctggggcatggcaactccaccgacgtcttcacgccccagccagtcaaggcgctgcaggggctcaagatcaagcagattgcctgcggggacagccattgtctcgccgtcaccatggccggagaagtgcagagttggggccgtaaccaaaatggacagctaggatttggaactactgaagactcgctgctcccacaaaagattcaggcttttgagggtgtttgtgtgaaaatgattgctgctggtgctgagcatactgctgcagtaactgaagatggtgacctctatggatggggctggggtcg

SEQ ID NO: 20794 - protein, 197 aa, Panicum virgatum
  misc_feature: Ceres CLONE 1813116
  misc_feature (136)..(185): Pfam Name: RCC1 Pfam Description: Regulator of chromosome condensation (RCC1)
  misc_feature (84)..(133): Pfam Name: RCC1 Pfam Description: Regulator of chromosome condensation (RCC1)
  misc_feature: SWISSPROT Homolog: EC 2.7.11.1 Non-specific serine/threonine protein kinase
MDSVMTAPDAPPPAVVLVSAGANHSVALLTGNALCSWGRGEDGQLGHGDAEDRLVPTVLSGFDAPGITSVICGADHTTAYSEEELQVYSWGWGDFGRLGHGNSTDVFTPQPVKALQGLKIKQIACGDSHCLAVTMAGEVQSWGRNQNGQLGFGTTEDSLLPQKIQAFEGVCVKMIAAGAEHTAAVTEDGDLYGWGWG

SEQ ID NO: 20795 - DNA, 646 bp, Panicum virgatum
  misc_feature: Ceres CLONE 1813143
  misc_feature: Encodes the peptide sequence at SEQ ID NO. 20796
aaccccaagcggccaagcctcctctcttcctctccggtcgctccagcctccacctgtctcctcctcctctgctctgcacgccacgcgcggctcggtcctcgataccaatcgcattcctcgagcaccaacgagcgataggcatggccggcgcccagtcctggaggtcgtacctgtgctgcgtcggcggcagcgccgcggtggaggacgacgactcgacgccgcggcggcggcggatcgggggcaaggacagcccgcggtcgtcgtcgcgcaagtcgttctcgagcctcagctcgtcggagacgctgtccccggaggacctctcgctcacgctctccggctccgacctgcacgccttcacgtacgccgagctccgcgccgccacgggcagcttctcccgcgccaactacctcggctgcggcgggttcggccccgtctaccggggcgccgtcggcgagggcctccgcccgggcctgcgcgcgcaggacgtcgccgtcaagtacctcgacctcgaaggcggcacgcaggggcacaaggagtggctggccgaggtgttcttcctcgggcagctgcggcacaagaacctggtgaagctgatcggctactgctacgaggcggagcaccggatgctggtgtacgagttcatgag

SEQ ID NO: 20796 - protein, 168 aa, Panicum virgatum
  misc_feature: Ceres CLONE 1813143
  misc_feature: SWISSPROT Homolog: EC 2.7.11.1 Non-specific serine/threonine protein kinase
MAGAQSWRSYLCCVGGSAAVEDDDSTPRRRRIGGKDSPRSSSRKSFSSLSSSETLSPEDLSLTLSGSDLHAFTYAELRAATGSFSRANYLGCGGFGPVYRGAVGEGLRPGLRAQDVAVKYLDLEGGTQGHKEWLAEVFFLGQLRHKNLVKLIGYCYEAEHRMLVYEFM

SEQ ID NO: 20797 - DNA, 621 bp, Panicum virgatum
  misc_feature: Ceres CLONE 1813153
  misc_feature: Encodes the peptide sequence at SEQ ID NO. 20798
atcaccgcactcttcttcttccttctcccgccttctccatcctcccagcagcagctgctgacacctcttcaaactccaatcctgctcccacacaccgctggtctagctagctccaacgcgagctagagcagcgatatccctctgttctccggttttgatcgaagacgatcagctgcaggatcagaagggagtggttgtgtgagagagggagagagaatctgatggatatggcgcacgagagagacgcgagcagcgaggaggaggtgatggccggcgagctccggcgcgggccgtggacggtggaggaggacctgctgctggtcaactacgtcgcctcgcacggcgagggccgctggaattcgctcgcccgatcagcagggctaaagcgcaccggcaagagctgccgcctccggtggctcaactacctgcgccccgacctccggcgcggcaacatcacgccggaggagcagctgctcatcctggagctgcactcgcgctggggcaaccgctggtccaagatcgcgcagcacctccccggccgcaccgacaacgagatcaagaactactggcgcacgcgcgtgcagaagcacgccaagcagctcaagtgcgacgtcaacagcc

SEQ ID NO: 20798 - protein, 133 aa, Panicum virgatum
  misc_feature: Ceres CLONE 1813153
  misc_feature (22)..(69): Pfam Name: Myb_DNA-binding Pfam Description: Myb-like DNA-binding domain
  misc_feature (75)..(120): Pfam Name: Myb_DNA-binding Pfam Description: Myb-like DNA-binding domain
  misc_feature: The sequence is a functional homolog of SEQ ID NO 1566 in the 10/374,780 US patent application
  misc_feature: The sequence is a functional homolog of SEQ ID NO 1563 in the 10/374,780 US patent application
  misc_feature: The sequence is a functional homolog of SEQ ID NO 1564 in the 10/374,780 US patent application
  misc_feature: Useful for making plants with modulated drought sensitivity
  misc_feature: The sequence is a functional homolog of SEQ ID NO 156 in the 10/225,068 US patent application
  misc_feature: The sequence is a functional homolog of SEQ ID NO 262 in the 10/374,780 US patent application
  misc_feature: The sequence is a functional homolog of SEQ ID NO 282 in the 10/225,066 US patent application
  misc_feature: The sequence is a functional homolog of SEQ ID NO 2178 in the 10/374,780 US patent application
  misc_feature: The sequence is a functional homolog of SEQ ID NO 196 in the 10/225,066 US patent application
  misc_feature: The sequence is a functional homolog of SEQ ID NO 2900 in the 10/374,780 US patent application
  misc_feature: The sequence is a functional homolog of SEQ ID NO 1565 in the 10/374,780 US patent application
  misc_feature: The sequence is a functional homolog of SEQ ID NO 36 in US patent 7193132
  misc_feature: The sequence is a functional homolog of SEQ ID NO 1672 in the 11/479,226 US patent application
  misc_feature: The sequence is a functional homolog of SEQ ID NO 846 in the 10/412,699 US patent application
  misc_feature: Useful for making plants with modulated biomass
  misc_feature: Useful for making plants with modulated flowering time
  misc_feature: The sequence is a functional homolog of SEQ ID NO 1746 in the 10/412,699 US patent application
  misc_feature: The sequence is a functional homolog of SEQ ID NO 1970 in the 10/374,780 US patent application
  misc_feature: The sequence is a functional homolog of SEQ ID NO 452 in the 10/225,066 US patent application
  misc_feature: The sequence is a functional homolog of SEQ ID NO 584 in the 11/435,388 US patent application
  misc_feature: The sequence is a functional homolog of SEQ ID NO 2 in the 10/225,068 US patent application
  misc_feature: The sequence is a functional homolog of SEQ ID NO 22 in the 10/225,068 US patent application
  misc_feature: The sequence is a functional homolog of SEQ ID NO 230 in the 10/225,066 US patent application
  misc_feature: The sequence is a functional homolog of SEQ ID NO 258 in the 10/374,780 US patent application
  misc_feature: The sequence is a functional homolog of SEQ ID NO 442 in the 11/435,388 US patent application
  misc_feature: The sequence is a functional homolog of SEQ ID NO 842 in the 10/412,699 US patent application
  misc_feature: The sequence is a functional homolog of SEQ ID NO 98 in the 11/375,241 US patent application
  misc_feature: The sequence is a functional homolog of SEQ ID NO 1540 in the 10/374,780 US patent application
  misc_feature: The sequence is a functional homolog of SEQ ID NO 1634 in the 10/412,699 US patent application
  misc_feature: The sequence is a functional homolog of SEQ ID NO 1541 in the 10/374,780 US patent application
  misc_feature: The sequence is a functional homolog of SEQ ID NO 1635 in the 10/412,699 US patent application
  misc_feature: The sequence is a functional homolog of SEQ ID NO 232 in the 10/225,066 US patent application
  misc_feature: The sequence is a functional homolog of SEQ ID NO 264 in the 10/374,780 US patent application
  misc_feature: The sequence is a functional homolog of SEQ ID NO 534 in the 11/435,388 US patent application
  misc_feature: The sequence is a functional homolog of SEQ ID NO 126 in the 10/412,699 US patent application
  misc_feature: The sequence is a functional homolog of SEQ ID NO 1408 in the 11/479,226 US patent application
  misc_feature: The sequence is a functional homolog of SEQ ID NO 664 in the 10/412,699 US patent application
  misc_feature: The sequence is a functional homolog of SEQ ID NO 1572 in the 10/374,780 US patent application
  misc_feature: The sequence is a functional homolog of SEQ ID NO 176 in the 10/412,699 US patent application
  misc_feature: The sequence is a functional homolog of SEQ ID NO 385 in the 11/479,226 US patent application
  misc_feature: The sequence is a functional homolog of SEQ ID NO 2696 in the 10/374,780 US patent application
  misc_feature: The sequence is a functional homolog of SEQ ID NO 344 in the 10/225,066 US patent application
  misc_feature: The sequence is a functional homolog of SEQ ID NO 148 in the 10/412,699 US patent application
  misc_feature: The sequence is a functional homolog of SEQ ID NO 2266 in the 10/374,780 US patent application
  misc_feature: The sequence is a functional homolog of SEQ ID NO 341 in the 11/479,226 US patent application
  misc_feature: The sequence is a functional homolog of SEQ ID NO 58 in the 11/375,241 US patent application
  misc_feature: The sequence is a functional homolog of SEQ ID NO 2394 in the 10/374,780 US patent application
  misc_feature: The sequence is a functional homolog of SEQ ID NO 544 in the 10/225,066 US patent application
  misc_feature: The sequence is a functional homolog of SEQ ID NO 999 in the 11/479,226 US patent application
  misc_feature: The sequence is a functional homolog of SEQ ID NO 1626 in the 10/412,699 US patent application
  misc_feature: The sequence is a functional homolog of SEQ ID NO 979 in the 10/666,642 US patent application
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: Useful for making plants with altered lignin content
  misc_feature: The sequence is a functional homolog of SEQ ID NO 186 in the 10/412,699 US patent application
  misc_feature: The sequence is a functional homolog of SEQ ID NO 122 in the 10/412,699 US patent application
  misc_feature: The sequence is a functional homolog of SEQ ID NO 126 in the 11/375,241 US patent application
  misc_feature: The sequence is a functional homolog of SEQ ID NO 148 in the 10/286,264 US patent application
  misc_feature: The sequence is a functional homolog of SEQ ID NO 34 in the 10/374,780 US patent application
  misc_feature: The sequence is a functional homolog of SEQ ID NO 438 in the 10/225,066 US patent application
  misc_feature: The sequence is a functional homolog of SEQ ID NO 168 in the 10/412,699 US patent application
  misc_feature: The sequence is a functional homolog of SEQ ID NO 377 in the 11/479,226 US patent application
  misc_feature: The sequence is a functional homolog of SEQ ID NO 2564 in the 10/374,780 US patent application
  misc_feature: The sequence is a functional homolog of SEQ ID NO 276 in the 10/225,066 US patent application
  misc_feature: The sequence is a functional homolog of SEQ ID NO 818 in the 10/412,699 US patent application
  misc_feature: The sequence is a functional homolog of SEQ ID NO 1917 in the 10/374,780 US patent application
  misc_feature: The sequence is a functional homolog of SEQ ID NO 168 in the 10/225,066 US patent application
  misc_feature: The sequence is a functional homolog of SEQ ID NO 2718 in the 10/374,780 US patent application
  misc_feature: The sequence is a functional homolog of SEQ ID NO 1010 in the 11/435,388 US patent application
  misc_feature: Useful for making plants with modulated nitrogen use efficiency
  misc_feature: The sequence is a functional homolog of SEQ ID NO 1901 in the 11/479,226 US patent application
  misc_feature: The sequence is a functional homolog of SEQ ID NO 310 in the 10/374,780 US patent application
  misc_feature: The sequence is a functional homolog of SEQ ID NO 842 in the 10/225,066 US patent application
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: Useful for making plants with altered alkaloid content
  misc_feature: The sequence is a functional homolog of SEQ ID NO 1652 in the 11/479,226 US patent application
  misc_feature: The sequence is a functional homolog of SEQ ID NO 2568 in the 10/374,780 US patent application
  misc_feature: The sequence is a functional homolog of SEQ ID NO 60 in the 10/225,066 US patent application
  misc_feature: The sequence is a functional homolog of SEQ ID NO 828 in the 10/412,699 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: The sequence is a functional homolog of SEQ ID NO 1056 in the 11/479,226 US patent application
  misc_feature: The sequence is a functional homolog of SEQ ID NO 144 in the 10/374,780 US patent application
  misc_feature: The sequence is a functional homolog of SEQ ID NO 458 in the 10/412,699 US patent application
  misc_feature: The sequence is a functional homolog of SEQ ID NO 756 in the 10/225,066 US patent application
  misc_feature: The sequence is a functional homolog of SEQ ID NO 1004 in the 11/435,388 US patent application
  misc_feature: The sequence is a functional homolog of SEQ ID NO 1011 in the 11/479,226 US patent application
  misc_feature: The sequence is a functional homolog of SEQ ID NO 434 in the 10/412,699 US patent application
  misc_feature: The sequence is a functional homolog of SEQ ID NO 170 in the 10/412,699 US patent application
  misc_feature: The sequence is a functional homolog of SEQ ID NO 1756 in the 10/412,699 US patent application
  misc_feature: The sequence is a functional homolog of SEQ ID NO 1980 in the 10/374,780 US patent application
  misc_feature: The sequence is a functional homolog of SEQ ID NO 750 in the 10/225,066 US patent application
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 1002 in the 11/435,388 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 1684 in the 11/479,226 US patent application
  misc_feature: The sequence is a functional homolog of SEQ ID NO 2582 in the 10/374,780 US patent application
  misc_feature: The sequence is a functional homolog of SEQ ID NO 30 in the 11/375,241 US patent application
  misc_feature: The sequence is a functional homolog of SEQ ID NO 854 in the 10/412,699 US patent application
  misc_feature: The sequence is a functional homolog of SEQ ID NO 1434 in the 10/666,642 US patent application
  misc_feature: The sequence is a functional homolog of SEQ ID NO 1850 in the 10/412,699 US patent application
  misc_feature: The sequence is a functional homolog of SEQ ID NO 848 in the 10/412,699 US patent application
  misc_feature: Useful for making plants with altered cell wall content and/or composition
  misc_feature: The sequence is a functional homolog of SEQ ID NO 836 in the 10/412,699 US patent application
  misc_feature: The sequence is a functional homolog of SEQ ID NO 569 in the 10/374,780 US patent application
  misc_feature: The sequence is a functional homolog of SEQ ID NO 116 in the 10/412,699 US patent application
  misc_feature: The sequence is a functional homolog of SEQ ID NO 280 in the 11/479,226 US patent application
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: The sequence is a functional homolog of SEQ ID NO 442 in the 10/412,699 US patent application
  misc_feature: The sequence is a functional homolog of SEQ ID NO 200 in the 10/666,642 US patent application
  misc_feature: The sequence is a functional homolog of SEQ ID NO 830 in the 10/412,699 US patent application
  misc_feature: The sequence is a functional homolog of SEQ ID NO 428 in the 10/374,780 US patent application
  misc_feature: The sequence is a functional homolog of SEQ ID NO 54 in the 11/375,241 US patent application
  misc_feature: The sequence is a functional homolog of SEQ ID NO 870 in the 10/225,066 US patent application
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: The sequence is a functional homolog of SEQ ID NO 446 in the 10/412,699 US patent application
  misc_feature: The sequence is a functional homolog of SEQ ID NO 266 in the 10/374,780 US patent application
  misc_feature: The sequence is a functional homolog of SEQ ID NO 536 in the 11/435,388 US patent application
  misc_feature: The sequence is a functional homolog of SEQ ID NO 640 in the 10/225,066 US patent application
  misc_feature: The sequence is a functional homolog of SEQ ID NO 856 in the 10/412,699 US patent application
  misc_feature: The sequence is a functional homolog of SEQ ID NO 822 in the 10/412,699 US patent application
  misc_feature: The sequence is a functional homolog of SEQ ID NO 124 in the 10/412,699 US patent application
  misc_feature: The sequence is a functional homolog of SEQ ID NO 1742 in the 10/412,699 US patent application
  misc_feature: The sequence is a functional homolog of SEQ ID NO 1966 in the 10/374,780 US patent application
  misc_feature: The sequence is a functional homolog of SEQ ID NO 299 in the 11/479,226 US patent application
  misc_feature: The sequence is a functional homolog of SEQ ID NO 271 in the 11/479,226 US patent application
  misc_feature: The sequence is a functional homolog of SEQ ID NO 156 in the 10/412,699 US patent application
  misc_feature: The sequence is a functional homolog of SEQ ID NO 164 in the 10/412,699 US patent application
  misc_feature: The sequence is a functional homolog of SEQ ID NO 1754 in the 10/412,699 US patent application
  misc_feature: The sequence is a functional homolog of SEQ ID NO 1978 in the 10/374,780 US patent application
  misc_feature: The sequence is a functional homolog of SEQ ID NO 353 in the 11/479,226 US patent application
  misc_feature: The sequence is a functional homolog of SEQ ID NO 369 in the 11/479,226 US patent application
  misc_feature: The sequence is a functional homolog of SEQ ID NO 40 in the 10/374,780 US patent application
  misc_feature: The sequence is a functional homolog of SEQ ID NO 776 in the 10/225,066 US patent application
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 2574 in the 10/374,780 US patent application
  misc_feature: The sequence is a functional homolog of SEQ ID NO 278 in the 10/225,066 US patent application
  misc_feature: The sequence is a functional homolog of SEQ ID NO 1073 in the 10/374,780 US patent application
  misc_feature: The sequence is a functional homolog of SEQ ID NO 296 in the 11/479,226 US patent application
  misc_feature: The sequence is a functional homolog of SEQ ID NO 136 in the 10/412,699 US patent application
  misc_feature: The sequence is a functional homolog of SEQ ID NO 325 in the 11/479,226 US patent application
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: The sequence is a functional homolog of SEQ ID NO 1094 in the 10/225,066 US patent application
  misc_feature: The sequence is a functional homolog of SEQ ID NO 386 in the 10/374,780 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 504 in the 10/666,642 US patent application
  misc_feature: The sequence is a functional homolog of SEQ ID NO 896 in the 11/435,388 US patent application
  misc_feature: The sequence is a functional homolog of SEQ ID NO 1052 in the 11/479,226 US patent application
  misc_feature: The sequence is a functional homolog of SEQ ID NO 456 in the 10/412,699 US patent application
  misc_feature: The sequence is a functional homolog of SEQ ID NO 2572 in the 10/374,780 US patent application
  misc_feature: The sequence is a functional homolog of SEQ ID NO 636 in the 10/225,066 US patent application
  misc_feature: The sequence is a functional homolog of SEQ ID NO 838 in the 10/412,699 US patent application
  misc_feature: The sequence is a functional homolog of SEQ ID NO 1041 in the 11/479,226 US patent application
  misc_feature: The sequence is a functional homolog of SEQ ID NO 112 in the 10/225,066 US patent application
  misc_feature: The sequence is a functional homolog of SEQ ID NO 20 in the 11/375,241 US patent application
  misc_feature: The sequence is a functional homolog of SEQ ID NO 2052 in the 10/374,780 US patent application
  misc_feature: The sequence is a functional homolog of SEQ ID NO 450 in the 10/412,699 US patent application
  misc_feature: The sequence is a functional homolog of SEQ ID NO 1033 in the 10/412,699 US patent application
  misc_feature: The sequence is a functional homolog of SEQ ID NO 540 in the 10/374,780 US patent application
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 134 in the 10/412,699 US patent application
  misc_feature: The sequence is a functional homolog of SEQ ID NO 321 in the 11/479,226 US patent application
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: The sequence is a functional homolog of SEQ ID NO 2556 in the 10/374,780 US patent application
  misc_feature: The sequence is a functional homolog of SEQ ID NO 272 in the 10/225,066 US patent application
  misc_feature: The sequence is a functional homolog of SEQ ID NO 528 in the 11/435,388 US patent application
  misc_feature: Useful for making plants with modulated low light sensitivity
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 593 in the 10/374,780 US patent application
  misc_feature: The sequence is a functional homolog of SEQ ID NO 782 in the 11/435,388 US patent application
  misc_feature: The sequence is a functional homolog of SEQ ID NO 110 in the 10/412,699 US patent application
  misc_feature: The sequence is a functional homolog of SEQ ID NO 259 in the 11/479,226 US patent application
  misc_feature: Useful for making plants with altered carbohydrate content
  misc_feature: The sequence is a functional homolog of SEQ ID NO 592 in the 10/374,780 US patent application
  misc_feature: The sequence is a functional homolog of SEQ ID NO 786 in the 11/435,388 US patent application
  misc_feature: The sequence is a functional homolog of SEQ ID NO 1681 in the 10/374,780 US patent application
  misc_feature: The sequence is a functional homolog of SEQ ID NO 794 in the 11/435,388 US patent application
  misc_feature: The sequence is a functional homolog of SEQ ID NO 1074 in the 10/412,699 US patent application
  misc_feature: The sequence is a functional homolog of SEQ ID NO 590 in the 10/374,780 US patent application
  misc_feature: The sequence is a functional homolog of SEQ ID NO 726 in the 11/435,388 US patent application
  misc_feature: The sequence is a functional homolog of SEQ ID NO 796 in the 11/435,388 US patent application
  misc_feature: The sequence is a functional homolog of SEQ ID NO 263 in the 11/479,226 US patent application
  misc_feature: The sequence is a functional homolog of SEQ ID NO 478 in the 11/435,388 US patent application
  misc_feature: The sequence is a functional homolog of SEQ ID NO 54 in the 10/666,642 US patent application
  misc_feature: The sequence is a functional homolog of SEQ ID NO 184 in the 10/412,699 US patent application
  misc_feature: The sequence is a functional homolog of SEQ ID NO 397 in the 11/479,226 US patent application
  misc_feature: The sequence is a functional homolog of SEQ ID NO 46 in the 10/374,780 US patent application
  misc_feature: The sequence is a functional homolog of SEQ ID NO 590 in the 11/435,388 US patent application
  misc_feature: The sequence is a functional homolog of SEQ ID NO 6 in the 10/225,068 US patent application
  misc_feature: The sequence is a functional homolog of SEQ ID NO 788 in the 11/435,388 US patent application
  misc_feature: The sequence is a functional homolog of SEQ ID NO 1118 in the 10/225,066 US patent application
  misc_feature: The sequence is a functional homolog of SEQ ID NO 1396 in the 11/479,226 US patent application
  misc_feature: The sequence is a functional homolog of SEQ ID NO 2488 in the 10/374,780 US patent application
  misc_feature: The sequence is a functional homolog of SEQ ID NO 658 in the 10/412,699 US patent application
  misc_feature: The sequence is a functional homolog of SEQ ID NO 1680 in the 11/479,226 US patent application
  misc_feature: The sequence is a functional homolog of SEQ ID NO 202 in the 10/666,642 US patent application
  misc_feature: The sequence is a functional homolog of SEQ ID NO 852 in the 10/412,699 US patent application
  misc_feature: The sequence is a functional homolog of SEQ ID NO 792 in the 11/435,388 US patent application
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: The sequence is a functional homolog of SEQ ID NO 824 in the 10/412,699 US patent application
  misc_feature: Useful for biocontainment applications
  misc_feature: The sequence is a functional homolog of SEQ ID NO 743 in the 10/666,642 US patent application
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: The sequence is a functional homolog of SEQ ID NO 18 in the 11/375,241 US patent application
  misc_feature: The sequence is a functional homolog of SEQ ID NO 426 in the 10/374,780 US patent application
  misc_feature: The sequence is a functional homolog of SEQ ID NO 458 in the 10/225,066 US patent application
  misc_feature: The sequence is a functional homolog of SEQ ID NO 594 in the 10/374,780 US patent application
  misc_feature: The sequence is a functional homolog of SEQ ID NO 784 in the 11/435,388 US patent application
  misc_feature: The sequence is a functional homolog of SEQ ID NO 790 in the 11/435,388 US patent application
  misc_feature: The sequence is a functional homolog of SEQ ID NO 1072 in the 10/412,699 US patent application
  misc_feature: The sequence is a functional homolog of SEQ ID NO 1073 in the 10/412,699 US patent application
  misc_feature: The sequence is a functional homolog of SEQ ID NO 588 in the 10/374,780 US patent application
  misc_feature: The sequence is a functional homolog of SEQ ID NO 589 in the 10/374,780 US patent application
  misc_feature: The sequence is a functional homolog of SEQ ID NO 730 in the 11/435,388 US patent application
  misc_feature: The sequence is a functional homolog of SEQ ID NO 58 in the 10/666,642 US patent application
  misc_feature: Useful for making plants with altered terpenoid content
  misc_feature: The sequence is a functional homolog of SEQ ID NO 1692 in the 11/479,226 US patent application
  misc_feature: The sequence is a functional homolog of SEQ ID NO 1031 in the 11/479,226 US patent application
  misc_feature: The sequence is a functional homolog of SEQ ID NO 1804 in the 10/412,699 US patent application
  misc_feature: The sequence is a functional homolog of SEQ ID NO 2050 in the 10/374,780 US patent application
  misc_feature: The sequence is a functional homolog of SEQ ID NO 444 in the 10/412,699 US patent application
  misc_feature: The sequence is a functional homolog of SEQ ID NO 598 in the 10/225,066 US patent application
  misc_feature: The sequence is a functional homolog of SEQ ID NO 620 in the 11/435,388 US patent application
  misc_feature: The sequence is a functional homolog of SEQ ID NO 1411 in the 11/479,226 US patent application
  misc_feature: The sequence is a functional homolog of SEQ ID NO 2492 in the 10/374,780 US patent application
  misc_feature: The sequence is a functional homolog of SEQ ID NO 52 in the 10/225,066 US patent application
  misc_feature: The sequence is a functional homolog of SEQ ID NO 2570 in the 10/374,780 US patent application
  misc_feature: The sequence is a functional homolog of SEQ ID NO 634 in the 10/225,066 US patent application
  misc_feature: The sequence is a functional homolog of SEQ ID NO 832 in the 10/412,699 US patent application
  misc_feature: The sequence is a functional homolog of SEQ ID NO 116 in the 11/375,241 US patent application
  misc_feature: The sequence is a functional homolog of SEQ ID NO 1648 in the 11/479,226 US patent application
  misc_feature: The sequence is a functional homolog of SEQ ID NO 2566 in the 10/374,780 US patent application
  misc_feature: The sequence is a functional homolog of SEQ ID NO 632 in the 10/225,066 US patent application
  misc_feature: The sequence is a functional homolog of SEQ ID NO 650 in the 11/435,388 US patent application
  misc_feature: The sequence is a functional homolog of SEQ ID NO 826 in the 10/412,699 US patent application
  misc_feature: The sequence is a functional homolog of SEQ ID NO 1071 in the 10/412,699 US patent application
  misc_feature: The sequence is a functional homolog of SEQ ID NO 587 in the 10/374,780 US patent application
  misc_feature: The sequence is a functional homolog of SEQ ID NO 728 in the 11/435,388 US patent application
  misc_feature: The sequence is a functional homolog of SEQ ID NO 178 in the 10/412,699 US patent application
  misc_feature: The sequence is a functional homolog of SEQ ID NO 389 in the 11/479,226 US patent application
  misc_feature: The sequence is a functional homolog of SEQ ID NO 1916 in the 10/412,699 US patent application
  misc_feature: The sequence is a functional homolog of SEQ ID NO 2176 in the 10/374,780 US patent application
  misc_feature: The sequence is a functional homolog of SEQ ID NO 1656 in the 11/479,226 US patent application
  misc_feature: The sequence is a functional homolog of SEQ ID NO 834 in the 10/412,699 US patent application
  misc_feature: The sequence is a functional homolog of SEQ ID NO 1914 in the 10/412,699 US patent application
  misc_feature: The sequence is a functional homolog of SEQ ID NO 2174 in the 10/374,780 US patent application
  misc_feature: The sequence is a functional homolog of SEQ ID NO 956 in the 10/225,066 US patent application
  misc_feature: Useful for making plants with enhanced nutritional value
  misc_feature: Useful for making plants with modulated heat sensitivity
  misc_feature: The sequence is a functional homolog of SEQ ID NO 1688 in the 11/479,226 US patent application
  misc_feature: The sequence is a functional homolog of SEQ ID NO 1852 in the 10/412,699 US patent application
  misc_feature: The sequence is a functional homolog of SEQ ID NO 2094 in the 10/374,780 US patent application
  misc_feature: The sequence is a functional homolog of SEQ ID NO 1015 in the 11/479,226 US patent application
  misc_feature: The sequence is a functional homolog of SEQ ID NO 138 in the 10/374,780 US patent application
  misc_feature: The sequence is a functional homolog of SEQ ID NO 436 in the 10/412,699 US patent application
  misc_feature: The sequence is a functional homolog of SEQ ID NO 60 in the 11/375,241 US patent application
  misc_feature: The sequence is a functional homolog of SEQ ID NO 1100 in the 10/225,066 US patent application
  misc_feature: The sequence is a functional homolog of SEQ ID NO 158 in the 10/412,699 US patent application
  misc_feature: The sequence is a functional homolog of SEQ ID NO 2268 in the 10/374,780 US patent application
  misc_feature: The sequence is a functional homolog of SEQ ID NO 357 in the 11/479,226 US patent application
  misc_feature: The sequence is a functional homolog of SEQ ID NO 480 in the 11/435,388 US patent application
  misc_feature: The sequence is a functional homolog of SEQ ID NO 160 in the 10/412,699 US patent application
  misc_feature: The sequence is a functional homolog of SEQ ID NO 214 in the 10/225,068 US patent application
  misc_feature: The sequence is a functional homolog of SEQ ID NO 2270 in the 10/374,780 US patent application
  misc_feature: The sequence is a functional homolog of SEQ ID NO 361 in the 11/479,226 US patent application
  misc_feature: The sequence is a functional homolog of SEQ ID NO 462 in the 10/225,066 US patent application
  misc_feature: The sequence is a functional homolog of SEQ ID NO 482 in the 11/435,388 US patent application
  misc_feature: The sequence is a functional homolog of SEQ ID NO 1075 in the 10/412,699 US patent application
  misc_feature: The sequence is a functional homolog of SEQ ID NO 591 in the 10/374,780 US patent application
MDMAHERDASSEEEVMAGELRRGPWTVEEDLLLVNYVASHGEGRWNSLARSAGLKRTGKSCRLRWLNYLRPDLRRGNITPEEQLLILELHSRWGNRWSKIAQHLPGRTDNEIKNYWRTRVQKHAKQLKCDVNS

SEQ ID NO: 20799 - DNA, 1701 bp, Panicum virgatum
  misc_feature: Ceres CLONE 1813174
  misc_feature: Encodes the peptide sequence at SEQ ID NO. 20800
acattttttgctgcgttcatttgaacacagcacaacgcgtcaacgccctcatcccggattcccggcagccacccaagcttccgtaccgccgccgctttcgtggtcgacgcaggcacccacggtggccgccggagctgcgagccggcgaccccgacacagctcgagattaaaaaaatccatcctcacctcttgtcccactcgccgatttcatctagctagcttagcccctcgatccgtaggtctccgtccatcccgtcgctgtaatttatctcaccatcactacccaggagtaatttctgtgtacatatcaaaccaaagatccgcatcatccaatcccgcgcggaccccaattccccccccccccccccttttttttttgctcggtgctaggtctagagcgccgcgctggtttaggttttgcgcggtggcagggaggccttgaagatagggttagtatccccgggcggcggagggatggacaagaagaaggtggcggtgccgctggtgtgccacggccactcccggccggtcgtggaccttttctacagccccgtcacgcccgacggctacttcctcatcagcgccagcaaggactcaaatccaatgcttcgcaatggtgagactggagattggattgggacatttcaaggccacaaaggtgctgtttggagcgcttgtcttgacaccaatgctctgcgtgctgcctctggttccgctgacttttcagcaaaaatttgggatgcactaacaggcgatgtgctccactccttcgaacacaagcacattgtccgtgcatgtgctttttctgaggatacccacatgttgcttactggaggttttgagaagattttgcgcatatatgatttgaaccgtccggatgcagctccaagagaaattgagaaatcacctggttctgtcagaactgtcacttggcttcatagtgaccaaactatactaagttcctgcacggatatgggtagtgtgagattatgggatgtaaggagtggaaaaattgttcaaacacttgaaaccaagtcacctgtgaccagtgcggaagtaagccaagatggtcagtttatcacgacaactgatggcttaagtgtgaagttctgggatgcaaatcactatggacttgttaagagctacaatatgccatgtgcagtagagtcggcttctcttgaaccaaagtatgggaacaaatttgtcactggtggagaagacatgtgggttcgtgtattcgatttcttcactggagaagaattagcatgtaacaagggacaccatggccctgtccactgcgtccgattctccccagttggtgaatcttatgcgtcagggtcggaagatggcaccatccgaatctggcagctgggcccagctagcagcgaagagcaggaggcggcaaacgcaaacgggaagatgaaggttgcggtaaatgacgtcacgctcaagattgagggcttccacattgccaagaacgggcaggcagaggggtcgtgatgcaccacttcgcgctggcgatgcttgctgggagactgctgttgtcgaatgctctgcggggggtggtctgttgtagtatggatgggtttcatgtagcagcaccgggacgaaatggtgaaattttgggtgggggtgttcggggttgtcccctaactccagttgcatgcagtacacagccgggacagttctctttctcttctc

SEQ ID NO: 20800 - protein, 341 aa, Panicum virgatum
  misc_feature: Ceres CLONE 1813174
  misc_feature (260)..(298): Pfam Name: WD40 Pfam Description: WD domain, G-beta repeat
  misc_feature (51)..(89): Pfam Name: WD40 Pfam Description: WD domain, G-beta repeat
  misc_feature (92)..(130): Pfam Name: WD40 Pfam Description: WD domain, G-beta repeat
  misc_feature: SWISSPROT Homolog: EC 2.7.11.7 [Myosin heavy-chain] kinase
MDKKKVAVPLVCHGHSRPVVDLFYSPVTPDGYFLISASKDSNPMLRNGETGDWIGTFQGHKGAVWSACLDTNALRAASGSADFSAKIWDALTGDVLHSFEHKHIVRACAFSEDTHMLLTGGFEKILRIYDLNRPDAAPREIEKSPGSVRTVTWLHSDQTILSSCTDMGSVRLWDVRSGKIVQTLETKSPVTSAEVSQDGQFITTTDGLSVKFWDANHYGLVKSYNMPCAVESASLEPKYGNKFVTGGEDMWVRVFDFFTGEELACNKGHHGPVHCVRFSPVGESYASGSEDGTIRIWQLGPASSEEQEAANANGKMKVAVNDVTLKIEGFHIAKNGQAEGS

SEQ ID NO: 20801 - DNA, 687 bp, Panicum virgatum
  misc_feature: Ceres CLONE 1813177
  misc_feature: Encodes the peptide sequence at SEQ ID NO. 20802
atccgccgccggaggaaaaccacctccaaaaccctagccccccacctccttcctctctgagaagtatcttcgacgtcgtaggcggcggctgaagtggcggggcggagatgggtaaggcgaaggggaagcagcggcaggacaagttctaccacctcgccaaggagcaagggtacaggagtcgtgcgtccttcaagctgctccagctcgacgcgcggttccgcttccttccaacggcgcgctcagtgctcgacctctgcgccgcgccgggagggtggatccaggtggccgtcaaccatgcccccgtcggagctttcgtcgtcggcgtcgacctcgtgcccatccgcccaatccgcggcgcccactcgctcaccgaggacatcaccaccaccaagtgccgcgccgcggtgcggaggctgatggacgccaacggcgtctccgcctttgacgtcgtgctccacgacgggtcacccaacgtcggtggtgcctgggcgcaggaggccacatcgcagtccgcgctcgttatcgacgccctgcgcctcgctacaatgttcctcgcccccaagggcgccttcatcacgaaggtttttaggtctcaagattacaatgctattatgtactgtcttaaacagttgtttgagaaggttgaggcaactaaacctacagcaagtaggtctacatcggctgaaa

SEQ ID NO: 20802 - protein, 193 aa, Panicum virgatum
  misc_feature: Ceres CLONE 1813177
  misc_feature (22)..(193): Pfam Name: FtsJ Pfam Description: FtsJ-like methyltransferase
MGKAKGKQRQDKFYHLAKEQGYRSRASFKLLQLDARFRFLPTARSVLDLCAAPGGWIQVAVNHAPVGAFVVGVDLVPIRPIRGAHSLTEDITTTKCRAAVRRLMDANGVSAFDVVLHDGSPNVGGAWAQEATSQSALVIDALRLATMFLAPKGAFITKVFRSQDYNAIMYCLKQLFEKVEATKPTASRSTSAE

SEQ ID NO: 20803 - DNA, 1135 bp, Panicum virgatum
  misc_feature: Ceres CLONE 1813177-R
atcggctgaaatttatatcatctgcctgaactataaggctcctgcaaagattcaaccagaacttcttgatataaggcacttgttcagtgtggttccagaacagaacaaacctagggatattatggataaatcgacgaagagacaccgtgatgggtatgaagaagggaatacaacattgtggaaagtcggtttggcatcagactttatatggtctgactcccagactccactggagtttttgggctcctacaatttgatttcatttgataatcaagaatctctgcccataaagaatcatgagcttactactgatgatataaaaaattactgtgaggatttacttctattggataaaaatagtttcaagcatatcttgaaatggcgaatccgcttacggaaagcactgtcgtcatcttcacaagttaccccgaaggttgaggatgacgcagagaccacaaaggtcaaggatgatgatcaacttctacaagaaatggaagaattgaccagtgtcattgatagaaagaacaagagagagaaaaagcgcctgacaaagcgtcgagcaaaggataaagcacgcaaggctacaggaatgcagattgacgctactggagatgattatggtgatcctgacttgttttctattagtgttatcaagggtggaaaagaacttcaagctgttgaatctgcagagctcgatgtggaagatgacattgatgacagtgaaaatgaggaaactcaagctcgagaagtctctgatgaggaaatggattcagatgaagaacagcagaggtatgatgcccagcttgaggagatgcttgatgaagcttatgagcgctttgtaacgaaaaagggtggggaagtaaaacaagaacgtaaacgcacaaagcgaatcaatcctgatgccgatgctgacttattaaaggctagtgaagatgatggtgatgatgttgaaatggatcaaggttttgatgaagatcaagatccggagaccaatccccttctgttatctctagatgaacacaagccaactaaagagcagattgtacagcagtggtacagccaggatgtgttcacagaagcaggaacgggggttactgagcagagtgacagtgaagatgaaagggagaatttgcag

SEQ ID NO: 20804 - DNA, 1327 bp, Panicum virgatum
  misc_feature: Ceres CLONE 1813178
  misc_feature: Encodes the peptide sequence at SEQ ID NO. 20805
gacgagaaaaccagcgaggcgagtcgagctttcgcttttgacctcggggcttaacggaatcgaggcgggttcgcgcgctgctgctcccctatataagaagaggcggcaaaggcaacggcgaagccatcgtcgtccgtcgaacttgccggcaaggaactttaacacgggtcgccgggtcggtggccggcggttggaggtgccgaggaggttggaggccggcttggagcagcagcagctggggggatcggtgcgcgcgcacggtggcaaactggcaatggagaagccccggcaggtggtgcgcaagttcctggcgcggccgcagcacgagggcgccggcgccgtcgtccgccgcagcatcggcaggtttgagctgaggtacttcgacccgttcctggtcctcgacgagttctccgtttctgctccggcggggttccccgaccacccgcacagaggattcgagaccgtcacctacatgctcgagggcgccgtgacgcacgaggacttcgagggccaccgcggcacgatcaaggccggcgacgtgcagtggatgacggccggccgcggcatcgtgcactccgagatgcccgccggccccggcacctccaagggcctgcagctctgggtcaacctctcctccgccaacaaaatggtcgagcccgggtaccaggagatccagagcaaggacatcgcgtgcacgtccgccgacggcgtcacggtgcgcgtgatcgccgggcacgccatgggggcgcggtcgccggtgtgcacgcggacgccgaccatgtacctcgacttcacggtgcgcccgcgcgccgcggtgcggcagcccgtgcccgcgtcgtggaacgccttcgcgtacgtgctcgagggcgagggcgtgttcggggccgagcggtgcgcgccggcgggcgcgcaccacctgctcctcctcgggcagggcgacggcgtcgaggtgtggaaccagtcggacaggccgctccggttcctgctcatcggcggcgagcccatcggggagcccgtggcgcagctgggcccgttcgtcatgaacactgaggaggagatcgacatgaccgtcgacgacttcgagcgctacgccaacgggttcgagaaggccaggcactggaaatcgcaggccatggtagcgcttggggtggagtagggcgaaacaaagagcagagtacaaagccaagtggaagaaaaaaaaatcaacagattattttcgttttttccccactatttcgtactacagttgctcggatttattatttttttcctttttccccaacaacggggtctctctgtgtacatatggcataaattaagtttcatc

SEQ ID NO: 20805 - protein, 293 aa, Panicum virgatum
  misc_feature: Ceres CLONE 1813178
  misc_feature (21)..(117): Pfam Name: Pirin Pfam Description: Pirin
  misc_feature (170)..(275): Pfam Name: Pirin_C Pfam Description: Pirin C-terminal cupin domain
MEKPRQVVRKFLARPQHEGAGAVVRRSIGRFELRYFDPFLVLDEFSVSAPAGFPDHPHRGFETVTYMLEGAVTHEDFEGHRGTIKAGDVQWMTAGRGIVHSEMPAGPGTSKGLQLWVNLSSANKMVEPGYQEIQSKDIACTSADGVTVRVIAGHAMGARSPVCTRTPTMYLDFTVRPRAAVRQPVPASWNAFAYVLEGEGVFGAERCAPAGAHHLLLLGQGDGVEVWNQSDRPLRFLLIGGEPIGEPVAQLGPFVMNTEEEIDMTVDDFERYANGFEKARHWKSQAMVALGVE

SEQ ID NO: 20806 - DNA, 1660 bp, Panicum virgatum
  misc_feature: Ceres CLONE 1813180
  misc_feature: Encodes the peptide sequence at SEQ ID NO. 20807
acatctcacccgccttctcttctcccagtgaccttcccacccctcctccccaattccaaatccaccaccacccgctggaaaccctaaatcacctgcctcgcttgtgcggttccgccctgcccggcacctcgcgggctcaaggggtgcgtctcgcacggccatcgctgtcgaccgccataaccacagccgccgccgccgccgccgccgccgccgccgccaccggcggcctcctacctcggctggaccggggacaggtggggatccatcgatttctccgtttcctggcttctgaagtattgttgctttattgctgcattatgctcatatgattgagtgcacaatggcatcaaccttacttgatggtctccctaatgaagttgctcgccattgccttgcacgggtcccgttcttgtatcatcccatgcttcagttggtttgccgttcttggagagcatcagttcgcagtggtgaacttctcaaaatacggaatcagattggtgtgacagaagaactgttatgtgtattggcatttgaaccagaaaacatgtggcaactttatgatccccttcgggacaaatggataactctccctgtcatgccgtctcagattaggaacatagcccgctttggagtggcctcagttactggcaagctctatgtaattggtggtggcagtgatcgagttgatccgcttactggagaccacgacacgatctttgcgagcaatgaggtttggtcttatgatccgctacaccgagtgtggtcccagaaggctccaatgcttgtggctcgagcaatgtttgcttgttatgcattggatggtaaaataattgtggcagggggattcacaaactgtcgcaaatcgatatcaaaggctgagatctatgaccctgaagctgacacgtgggagcctctccctgaccttcgtcaggcacacagctctgcatgttctggacttgtcatcaagggtaagatgcatgtattgcataaaggcctgtcaacagtgcagattctggaagatggtggcagtcagtgggctgttgaagatttctcttggctgcaaggcccaatggcaatggttggtggagagctgtatgtgctgagcaatagctgtatcatgaagcaacgtggggagaactttccttataagatggtgtcttgtgcatctgaattccaaaacaggatcggcttcgggatgattggtcttggcgacagcatatatttggttgggggagtgattggaccagggccaagaaaccagtgcatcaagccgctgtctgatgttgatatcttgaatgtcacaagcgagagaccaacctggcgaccagggtcaccaatgacacattgtcgagggagcatctgcggctgtgctttgttgaggatttagcccgtttccagtgtgtcgttgctgaattgattggagacggctttcattcgtcctaattttttgttaaaggagggctgtttattatgttttgcctttggatctcatgttgtagcgtagagggcgtgcattggtcatgacccagtatcagattggtatatactatatttaccttgaatgttgctacagacagtagattattgtgtgcatatgttcacttggaacagacatgtcttcgtgctgtactgaaccttttgtacagcgcggtgttttccc

SEQ ID NO: 20807 - protein, 353 aa, Panicum virgatum
  misc_feature: Ceres CLONE 1813180
  misc_feature (97)..(153): Pfam Name: Kelch_1 Pfam Description: Kelch motif
  misc_feature (155)..(201): Pfam Name: Kelch_1 Pfam Description: Kelch motif
  misc_feature (285)..(339): Pfam Name: Kelch_1 Pfam Description: Kelch motif
  misc_feature (9)..(56): Pfam Name: F-box Pfam Description: F-box domain
MIECTMASTLLDGLPNEVARHCLARVPFLYHPMLQLVCRSWRASVRSGELLKIRNQIGVTEELLCVLAFEPENMWQLYDPLRDKWITLPVMPSQIRNIARFGVASVTGKLYVIGGGSDRVDPLTGDHDTIFASNEVWSYDPLHRVWSQKAPMLVARAMFACYALDGKIIVAGGFTNCRKSISKAEIYDPEADTWEPLPDLRQAHSSACSGLVIKGKMHVLHKGLSTVQILEDGGSQWAVEDFSWLQGPMAMVGGELYVLSNSCIMKQRGENFPYKMVSCASEFQNRIGFGMIGLGDSIYLVGGVIGPGPRNQCIKPLSDVDILNVTSERPTWRPGSPMTHCRGSICGCALLRI

SEQ ID NO: 20808 - DNA, 709 bp, Panicum virgatum
  misc_feature: Ceres CLONE 1813189
  misc_feature: Encodes the peptide sequence at SEQ ID NO. 20809
attcagaaaagcagcagcaggacgaggagctctgtagtctgtagccatgactaagcgctgctgcctacgcttgggcacgctcctggcggcgctgctctcggccaccgcctgcctcgacttgggcttctacgacaggacgtgcccctccgccgagaccatcgtgcagcagaccgtcgccgccgcgttcaggaacgactccggcgtcgctccggcgatcatccgcatgcacttccacgactgcttcgtcaaaggctgcgatggctcgatcctgatcgactcgacgcccaacaacacggcggagaaggacgccatcgccaacaatcccagcctccggttcttcgaggtggtcgaccgcgccaaggcggccctggaggcgcggtgccccggcgtggtctcctgcgccgacatcctcgccttcgcggcccgggacagcgttgtgctcgccggcggcgccggctaccgggtgccggccgggcgccgcgacggcaggagatccctcgccaacgagacgggcgacctgccgccgccgttcttcaacgccacggagctggtggacagcttcgccaggaagaacctcaccctggaggacatggtcgtcctctccggcgcccactccatcggcgtctcccactgcagcagcttcgccggcatccccaacaaccccgccaaccggctctacaacttcagcggctcagctgacggtattgat

SEQ ID NO: 20809 - protein, 220 aa, Panicum virgatum
  misc_feature: Ceres CLONE 1813189
  misc_feature (39)..(220): Pfam Name: peroxidase Pfam Description: Peroxidase
  misc_feature: SWISSPROT Homolog: EC 1.11.1.7 Peroxidase
  misc_feature: Useful for making plants with altered carbohydrate content
  misc_feature: Useful for making plants with altered cell wall content and/or composition
  misc_feature: Useful for making plants with modulated phosphate use efficiency
MTKRCCLRLGTLLAALLSATACLDLGFYDRTCPSAETIVQQTVAAAFRNDSGVAPAIIRMHFHDCFVKGCDGSILIDSTPNNTAEKDAIANNPSLRFFEVVDRAKAALEARCPGVVSCADILAFAARDSVVLAGGAGYRVPAGRRDGRRSLANETGDLPPPFFNATELVDSFARKNLTLEDMVVLSGAHSIGVSHCSSFAGIPNNPANRLYNFSGSADGI

SEQ ID NO: 20810 - DNA, 1555 bp, Panicum virgatum
  misc_feature: Ceres CLONE 1813197
  misc_feature: Encodes the peptide sequence at SEQ ID NO. 20811
gacgcagacagggcccctgagaagactcgctcaccctctccccgctttgctctccttcctctcctcctctccgctgcggccgcgcgggcagtcgccggtggccggcgtcgaggggaggccgcggcgcggtcgggtgaggcgctcggaggagcttggggacgcggcggctcgtgcggatttggggggttttggaggcgatgcgaagtgtcggacgggtgatggggtgggcttcctgctgcaagcggtccgacgggggcgaaccaggtaggaggaagaagaagaagggcgcagcatggcgcatcttctcgctgaaggagcttcagttggcgacaaacaatttcaattacgacaacaagcttggtgagggtgggtttggcagcgtctactggggccagctctgggatggatcacagatagcagtgaaaaggctcaagagttggagcaacaaggctgaaaaagaatttgctgttgaggtggagattttggcacgagtgaggcacaaaagccttttgagcttgcgtggatattgtgctgaaggccaagaacgcttgatagtctatgattatatgccaaatctgagcatacactctcagcttcatggacagcacgcagcagaatgcaatctcggttgggaaagaagaatgaagatcgccatagattctgcagaagggatcgcttatcttcatcactacgcaacaccacatatcattcatagagatgtcaaggcgagcaatgtccttctggactcgaatttccaagctcgcattgctgattttgggttcgctaagctcattccagatggtgcaacacatgtcaccacaaaggtaaaaggcacactcgattaccttgcaccagagtatgcgatgcttgggaaggcctctgaaagctgtgacgtcttcagctttggaatcatgctcctagagcttgcaagcgggaagaggccagtcgagaaggtaaaccccaccacaaaacgaaccataaccgagtgggctcttcctctagcccgcgacaaaaagttcaaggaaatagctgatccaaagctcaatggtaacttcatcgaggatgagctgaagcaagtggtgcttgtcgggctcgcatgttctcagaacaagccagagcagagaccgataatgtctgaagttgttgagttgctcaaaggagaatctgctgagaagttgtccgacctggagaacgatgagctgttcaagcctgaacagaccagttcgttccagggctcatccggacctgatagctcggactgcatcactgaggagaagagctccaaaacaaacgtgaaagaggaggcagttgattcaagtgagacggttccctcagcaaggtagtgtgctgcacgtcagcagacagcaggtgcccagagctccttgcctgggagaaatgtgttttatatgttttttttattagtaggttaatttgggtgcttccttgcctagttcacagatatgcgtatctgtgtattgtcaatttgtattgctatggttctcctatggcttgtaaagttctgcagatctggggctgattccgacagtaacaagct

SEQ ID NO: 20811 - protein, 381 aa, Panicum virgatum
  misc_feature: Ceres CLONE 1813197
  misc_feature (48)..(319): Pfam Name: Pkinase Pfam Description: Protein kinase domain
  misc_feature: SWISSPROT Homolog: EC 2.7.11.1 Non-specific serine/threonine protein kinase
MRSVGRVMGWASCCKRSDGGEPGRRKKKKGAAWRIFSLKELQLATNNFNYDNKLGEGGFGSVYWGQLWDGSQIAVKRLKSWSNKAEKEFAVEVEILARVRHKSLLSLRGYCAEGQERLIVYDYMPNLSIHSQLHGQHAAECNLGWERRMKIAIDSAEGIAYLHHYATPHIIHRDVKASNVLLDSNFQARIADFGFAKLIPDGATHVTTKVKGTLDYLAPEYAMLGKASESCDVFSFGIMLLELASGKRPVEKVNPTTKRTITEWALPLARDKKFKEIADPKLNGNFIEDELKQVVLVGLACSQNKPEQRPIMSEVVELLKGESAEKLSDLENDELFKPEQTSSFQGSSGPDSSDCITEEKSSKTNVKEEAVDSSETVPSAR

SEQ ID NO: 20812 - DNA, 2403 bp, Panicum virgatum
  misc_feature: Ceres CLONE 1813255
  misc_feature: Encodes the peptide sequence at SEQ ID NO. 20813
tacacacatctcctcgccccctgtctcgtcgtctctctcactcctctctccttggtctcacacggtttgcctccccccacgaaaagacaaccaacccggggagcgagaggaaagggaaaagcgggagcgggtcgcgcgagtgccccccctcccccagcttttgctccaatcgcggcgccgccccgcgcgagatccgccacgcgtgccccgccaccagcgctgccgccgagatagaggtcccgtccccagcatcggattccacggagagttgttgatttagatacctgatccaattgaggtggattgagttacttgaccgtttcaactttcaacatcccccgtgcctgctgcctttggtcaggataagaggcttggccagttccagcgatgatgccattgtgagtggggatggattctgcaagaagttggttccacaagttccagctgagggacaaatcgaagtctcctgcagtggctgccagccatggaaaggattcaggaaagcccccgatggatgatgccccttctagtgcgacaaaacagagggttgctgctgcaaagcagtacatcgagaaccattacaagacccagatgaagtccctgcaagataggaaagagaggcgctggatgttggagagaaaattacaagatgctgaagttcctgtagaagagcaaaataatattttgaagcatttggaaaaaaaggagactgaatacatgcgtttgcagaggcacaagatgggagttgaagattttgaacttttgactattattgggagaggtgcatttggagaggtgcgtctttgtagagagaagacctccaagaatgtttacgcaatgaaaaagctcaagaaatctgaaatgcttcgtaggggccaggtagaacatgtcaaagctgaaaggaatcttcttgcagaagttgatagtgcttacatagttaggctctattattctttccaagatgaagagttcctatatctcatcatggaataccttcctggtggggacatgatgactttacttatgcgcaaggacacactaacagaagatgaagctagattttatattgcagaaactgtgcttgccattgaatctattcacaagcacaactacattcaccgggatatcaagccagacaatctattgttagatcgcagtggtcacctgaagctttctgacttcggtttgtgtaaacctttggacagcagtaattttccaaatttgaatgaaccagattatacacctggaaaaggcaccaaacctttgcctgataataccagtcggttaagcaacccttctgcaccgaggcgtacacagcaggagcaactatcacactggcaaaagaatcgccgaatgttggcatattcaacagttggtacacctgattatattgctccagaagttctactgaagaaaggatatggaatggagtgtgactggtggtcccttggtgctatcatgtatgaaatgcttgttggttaccctccattttattcagaggatccaatgtcaacttgcagaaagattgtgaactagagaagtcacttgaaattccctgaagaggcaaagctttctcccgaagctaaggatctcatcagcaagcttttgtgtaatgtcgagcagaggctaggcacaaaaggagcccatgaaataaaagcgcatccatggtttagaggtgttcaatgggatcagttgtatcagatgaaagctgctttcataccagaagttaatggcgagttagatactcaaaattttgagaaatttgaggagactggtgctcaaatgcaaagttcatctaagtctggcccatggagaaagatgcttccatcgaaggatgctaactttgttggatatacttacaagaactttgaaattgtaaatgatgatgaagtggcaggaattgcagagttgaagaaaaagacttcaaagccaaagcggccgaccatcaaaacattgtttgagagcatggacgaagaggagcctgttcaaggaagtttcttaagcatgttgcccccgaaggaggggcaaccttcgtctcactccagcattccatcagaacaataccaacctcgacgtaaataggataaggaggttcaaaaagtaaagcatagcaaagtaaaacaaggaaaaaaattctgctgtcttttgatcatcccgctccctgtctataaatcctaactatgctttctttagtcaaatgctttagaaagaacctctccgtccaaatagtatggcatctgatttgagcagctgcgttcgctgtatgttgtgttacggttccaaccgttctcaacctctcaggcatactggcttgcatctgtatactcgtatgtcatttacacccctactcgtaaccaggcacgagctgcagcgagcatgtgtatgacatggcattttggcatc

SEQ ID NO: 20813 - protein, 375 aa, Panicum virgatum
  misc_feature: Ceres CLONE 1813255
  misc_feature (116)..(375): Pfam Name: Pkinase Pfam Description: Protein kinase domain
  misc_feature: SWISSPROT Homolog: EC 2.7.11.1 Non-specific serine/threonine protein kinase
MDSARSWFHKFQLRDKSKSPAVAASHGKDSGKPPMDDAPSSATKQRVAAAKQYIENHYKTQMKSLQDRKERRWMLERKLQDAEVPVEEQNNILKHLEKKETEYMRLQRHKMGVEDFELLTIIGRGAFGEVRLCREKTSKNVYAMKKLKKSEMLRRGQVEHVKAERNLLAEVDSAYIVRLYYSFQDEEFLYLIMEYLPGGDMMTLLMRKDTLTEDEARFYIAETVLAIESIHKHNYIHRDIKPDNLLLDRSGHLKLSDFGLCKPLDSSNFPNLNEPDYTPGKGTKPLPDNTSRLSNPSAPRRTQQEQLSHWQKNRRMLAYSTVGTPDYIAPEVLLKKGYGMECDWWSLGAIMYEMLVGYPPFYSEDPMSTCRKIVN

SEQ ID NO: 20814 - DNA, 1927 bp, Panicum virgatum
  misc_feature: Ceres CLONE 1813256
  misc_feature: Encodes the peptide sequence at SEQ ID NO. 20815
gcgtcgggcatgtcttcttcttcttcttctcgtcgcccgcacccccgccgagcgcatttctccgtggccgccgcgagattcgatcaccaattcggacgcgcgcgtccgagtcccaacccaatcgcgctcctcttcctcctctcccagcgtttggcctcgcgagcctgatcgatccgccctcacccagcgctcgcgcgtcccttcgctcctgggagagggagcccgcggccggctctgcattgcgcggatccgccggcgcggtccttcgattcgggcggcggctcgccgatgatgggggcggagaagccgccgtctctcgggttcgcggaggcggacgagctggagctgtcgtcgccggcgggctcgccggcgccgccgccccggaagatgcactcgctcgacttcgagcacatcggctccctcgccgcggtggccgagtcgctcttgcccgggagcaggtgggggagggcgctcaccagcgtccgcgtcgtcatcttccaggccaggatcaacgtgctcctccccttcggcccgctcgccatcatgctccactacctcagcgggaaacaccaaggatgggttttccttttcagcttaattggtataacaccgttggccgagagattgggatatgcaactgagcaacttgcttgctacactggcccaacagttgggggcctccttaatgctacatttggaaatgcaacggaaatgattatatcaatctatgcactgaaaaatggaatgattcgagttgtccagcagtcactgctaggctcaatattgtcaaatatgctccttgttcttggttgtgctttctttgctggtggtcttgtccattctgacagggaccaggtcttcaataaggcatcagctgttgtaaactccgggctactattgatggctgtcttaggcctaatgtttccagcagtgcttcacttcacacattcagaagcgcagtatggaaaatctgaagtagctctttcaaggtttagtagctgcatcatgcttgtggcctatgctagctatctattttttcaactaaagagccaccgcagtgtgtacagccccattggtgatgaagaagaagccattgaagatgaggaagatgaaaaggagataacacaatgggaggccatctgctggctttttatattgactatttggatttcagtactctcagggtacctggtagatgccattcagggcgcgtctgactcattaaacttgccagtagcctttattagcgttattctgcttcctattgtggggaatgctgctgaacatgcgagtgccattatgtttgccatgaaaaacaaattggacattacattgggagttgcaatagggtcatcaacgcagatctccatgtttgtgattccattctgcgtggtaattggctggatgatggggcaggaaatggacttgaattttcaactgtttgagacagcaactctctttataacagtactggtggtggcatttatgctacaggaaggcacgtcaaattatttcaaaggccttatgctcatcttatgctacctcattgttggtgcaagcttcttcgtccatgttgatcctgatgcaaatgagaactaagtaacaagtctacatacaacggacctgtgttgaatggagaggctacgacttaactgcagatttagcaaaatagcattgcttgcagtagaggaggacctgccagagcctgaattggggagcaacttgtgggcagaatgccgcaccagcaccaagggtttaacctggggctcaagattgcaaggagctgatgcagcttttttaggatagcaacagcatcgccctttgaggaactgtaacttcatgtgatagttacaaaaattaccatcgcatttgttcaagctacatgtgtcacagttttttatgttttaatattaccattgttactacc

SEQ ID NO: 20815 - protein, 436 aa, Panicum virgatum
  misc_feature: Ceres CLONE 1813256
  misc_feature (292)..(425): Pfam Name: Na_Ca_ex Pfam Description: Sodium/calcium exchanger protein
  misc_feature (104)..(251): Pfam Name: Na_Ca_ex Pfam Description: Sodium/calcium exchanger protein
MMGAEKPPSLGFAEADELELSSPAGSPAPPPRKMHSLDFEHIGSLAAVAESLLPGSRWGRALTSVRVVIFQARINVLLPFGPLAIMLHYLSGKHQGWVFLFSLIGITPLAERLGYATEQLACYTGPTVGGLLNATFGNATEMIISIYALKNGMIRVVQQSLLGSILSNMLLVLGCAFFAGGLVHSDRDQVFNKASAVVNSGLLLMAVLGLMFPAVLHFTHSEAQYGKSEVALSRFSSCIMLVAYASYLFFQLKSHRSVYSPIGDEEEAIEDEEDEKEITQWEAICWLFILTIWISVLSGYLVDAIQGASDSLNLPVAFISVILLPIVGNAAEHASAIMFAMKNKLDITLGVAIGSSTQISMFVIPFCVVIGWMMGQEMDLNFQLFETATLFITVLVVAFMLQEGTSNYFKGLMLILCYLIVGASFFVHVDPDANEN

SEQ ID NO: 20816 - DNA, 1920 bp, Panicum virgatum
  misc_feature: Ceres CLONE 1813257
  misc_feature: Encodes the peptide sequence at SEQ ID NO. 20817
ggaggccgcgacggtgatgtccaagggcggcaatggcggcgggcgccggaggccgcggtaccgcatcgagaccagggcgctgtcgtacgtgctcccgccgcgcggggcctggccgtggggcggcgccaagggaaaggcggaggagcggctgcttctgcggggcgtcacgtgcgaggcgccgccgggggagctggtggcgatcgtggggccgagcggcgcgggcaagaccacgctgctgtcggtgctggccggatccgcggacccggcgcgggtcgcggccggggaggtgctggtgaacggcatccccatggacgccgcgcgcttccgccgggcgtccgggtacgtgccgcaggacgacgcgctgttcccggcgctcaccgtcgaggagtcgctcgtctacagcgcgcgcctgcgcctgcgcgcggccggggtcggcggcggcgcggagcgggcgcgggagctgatggcggagctcggcctgcggcacgtcgccgggtccagggtcgccgacgtctccggcggcgagcggaggcgggtgtccatcggggtggacctcgtgcacgacccggccgtgctgctgctggacgagcccacgtcggggctcgactccggctccgcgctccacattgtcaagatgctcagggacatggccgccgcgcacggcaagaccgtcgtgctcaccatccaccagcccgggttccgcatcctcgagctcatcaaccgcgtcgtgctcctggccgacggcgccgtccgccaccacgggtccctcgacttcctccaggcgcgcctcgccgccgccggccacgccatccccgcccacgtcaacgtcctcgagtacgccatggaggccatcgactccctcaagcccgacgtcgccgtggccgccgcgaccaccgcgccggcaggccacgacgtcgacgtcgcgccggtgggccgggtgcccgcgtccgcgaggcgcgccgggtacgccaactcgccggcggccgaggtgcgcatcctggccgggcggttcatgaagacggtgctgcggtcgccgcagctgttcacggcgcggatggtgcagtcggtgctggccggcgcgttcctcggcagcatcttcctgggcaccaccgacctgcagtcccggctggggttcttcgccttcaacctgacctacctgctctcctccaccaccgaggccctgcccgtgttcctccacgagcgccgcatcctggagcgcgagacctcccgcggcgcttaccgcgtgtcctcctacgtcgcctccaacgccgccgtcttcctcccgttcctcctcgccgccgcgaccctgtacgcggcgcccgtgtactggctcgtgggcctggcgcgcgagcccgccgccttcgcctacttcgcgctcgtcgtctggctcgccatgctcagcgccaactccttcgtggcgtgcctcagcgcgctggcgcccaactacatcgtcggcaactccgtcgtggcggggctcatcggctgcttcttcctcttctccggctacttcgtggcgagcagcaacatcccgcgctactgggtgttcatgcactacgccagcctgttcaagtacccgttcgaggcgctggtggtgaacgagtacggcggcgcgcgcggcgccagggagtgcctcgcctcggccggtggcgcggggggcctctgcgtgctcgacggcgcggggctgctgcggcagcaggggatgcgggagggcatgcggtggagcaacctgggcgtcatgctggggttcgtgatcggatacagggtgctctgcttcgtcttcctctggttcaggtgccaccgcatgaggaggtgatcaggacgacggggaaaggcgggaagcgatgccattgggcctggccccgttggcacgccagcaactgcaaatattgatcgctcgtttaagtttcatctcatcaccag

SEQ ID NO: 20817 - protein, 598 aa, Panicum virgatum
  misc_feature: Ceres CLONE 1813257
  misc_feature (323)..(529): Pfam Name: ABC2_membrane Pfam Description: ABC-2 type transporter
  misc_feature (57)..(243): Pfam Name: ABC_tran Pfam Description: ABC transporter
  misc_feature: SWISSPROT Homolog: EC 3.6.3.28 Phosphonate-transporting ATPase
MSKGGNGGGRRRPRYRIETRALSYVLPPRGAWPWGGAKGKAEERLLLRGVTCEAPPGELVAIVGPSGAGKTTLLSVLAGSADPARVAAGEVLVNGIPMDAARFRRASGYVPQDDALFPALTVEESLVYSARLRLRAAGVGGGAERARELMAELGLRHVAGSRVADVSGGERRRVSIGVDLVHDPAVLLLDEPTSGLDSGSALHIVKMLRDMAAAHGKTVVLTIHQPGFRILELINRVVLLADGAVRHHGSLDFLQARLAAAGHAIPAHVNVLEYAMEAIDSLKPDVAVAAATTAPAGHDVDVAPVGRVPASARRAGYANSPAAEVRILAGRFMKTVLRSPQLFTARMVQSVLAGAFLGSIFLGTTDLQSRLGFFAFNLTYLLSSTTEALPVFLHERRILERETSRGAYRVSSYVASNAAVFLPFLLAAATLYAAPVYWLVGLAREPAAFAYFALVVWLAMLSANSFVACLSALAPNYIVGNSVVAGLIGCFFLFSGYFVASSNIPRYWVFMHYASLFKYPFEALVVNEYGGARGARECLASAGGAGGLCVLDGAGLLRQQGMREGMRWSNLGVMLGFVIGYRVLCFVFLWFRCHRMRR

SEQ ID NO: 20818 - DNA, 1224 bp, Panicum virgatum
  misc_feature: Ceres CLONE 1813258
  misc_feature: Encodes the peptide sequence at SEQ ID NO. 20819
ataaagcgacggggcctgcagctcgagctgcggggaccggagacgggggggagagagaggtcccccgcaaattctgccagcttggctctggttcagtatcagtggctcattgtttggctacagatccggaaaggatctcataactcagagagctgaggtgtcgcaaggggagtgagagataaaaaatggggatcggagatggatcctcaaatgggagccaacaatcagcgcgtaaggaaataagagatgagaccacaccacttcttccagtcaaggtggaggaggatgacgggtttcatgagttcaacggtgcttcattctcaggggcagttttcaatctgtcgaccaccatagttggggctggaattatggccctgccagcaagtatcaagatgctgggaatcatcccaggaattctgatgatcatcattgtggcactgctcacagaggcatccatcgacatgcttgtcaggtgcagccaccagggcaagattacatcgtatgggtggctgatgggtgaggtttttggacagtggggaagaatagcactgcaggcatccgtcatcataaacaacgttggtgtgctaattgtttacatgattatcattggtgatgtattgtcgggaacgacatcagctggcgttcatcatcgtggtatattggagggctggtttggagctcatttgtggaattcccgtcctattgttcttcttgctacaactcttctggtgtttgctccactggtgagctttaagcgtttagattcattgaggtacacatctgcgctatcagttgccctggcagtggtttttgtcgtaattactgctggaattgctatcatcaagctcttcaatggaactgttgcaatgcctaaactttttccagaattagatggtcttaattctatatggaatctttttacagctgtccctgttcttgttactgcttacatctgccactataacgttcacagtattgacaatgaacttgaagacagaacacagatcaaaccgatcgtgcgaacatctctggtcctgtgctccagtgtttacattgccacaagcttctttgcatatctcctctttggtgagggcacactggatgacgtgcttgccaactttgatgcaaatcttggcatcccattcagctcagtctttgatgatatagtgcgagtgagctatgctgcacatgtcatgcttgtctttcccattgtcttcttttgcc

SEQ ID NO: 20819 - protein, 346 aa, Panicum virgatum
  misc_feature: Ceres CLONE 1813258
  misc_feature (41)..(345): Pfam Name: Aa_trans Pfam Description: Transmembrane amino acid transporter protein
MGIGDGSSNGSQQSARKEIRDETTPLLPVKVEEDDGFHEFNGASFSGAVFNLSTTIVGAGIMALPASIKMLGIIPGILMIIIVALLTEASIDMLVRCSHQGKITSYGWLMGEVFGQWGRIALQASVIINNVGVLIVYMIIIGDVLSGTTSAGVHHRGILEGWFGAHLWNSRPIVLLATTLLVFAPLVSFKRLDSLRYTSALSVALAVVFVVITAGIAIIKLFNGTVAMPKLFPELDGLNSIWNLFTAVPVLVTAYICHYNVHSIDNELEDRTQIKPIVRTSLVLCSSVYIATSFFAYLLFGEGTLDDVLANFDANLGIPFSSVFDDIVRVSYAAHVMLVFPIVFFC

SEQ ID NO: 20820 - DNA, 176 bp, Panicum virgatum
  misc_feature: Ceres CLONE 1813258-R
aagttgtgtggttttctgtacacaaatcggctcagcgtccagttgagtcacttgcaatatatgtgtattattcgatgtgcttgtattagcggagaagagagtatggcacggaaaaggctttcttccacgataatgtaaagttgtaccaatgtccgtgtttaattaaaatgtttcgg

SEQ ID NO: 20821 - DNA, 369 bp, Panicum virgatum
  misc_feature: Ceres CLONE 1813278
  misc_feature: Encodes the peptide sequence at SEQ ID NO. 20822
ggggtgagggggagcgggtggggttgtgggtgcctgtgggggattcgctgccgctcgctatccggcgcatgaacctcttgttgtcgggcctcttcgccgcttcgctctctgacctgatggggcgctggagggagaagatcggcgcctccgcgcctctgcacgtcgtctccctcgccgagatcttggtcctctgcggcctcggcgaatctctcgtctacctactgagtgtcgtcgggatcccgttcctcccgtacttcctctcctagaggaaagagcatgatgactatctcatggacaccggcctcaaggcgtaccaggccccggccccggccccgtgcgcgctggtggggaacgccgccgccgcgccgg

SEQ ID NO: 20822 - protein, 87 aa, Panicum virgatum
  misc_feature: Ceres CLONE 1813278
  misc_feature: SWISSPROT Homolog: EC 1.1.1.34 Hydroxymethylglutaryl-CoA reductase (NADPH)
GEGERVGLWVPVGDSLPLAIRRMNLLLSGLFAASLSDLMGRWREKIGASAPLHVVSLAEILVLCGLGESLVYLLSVVGIPFLPYFLS

SEQ ID NO: 20823 - DNA, 641 bp, Panicum virgatum
  misc_feature: Ceres CLONE 1813279
  misc_feature: Encodes the peptide sequence at SEQ ID NO. 20824
atctcgcagttcacgatccgatcccattcctcgccatggacgcggcggggggcgagcagctgagcctggccgcggtgcgggacgcgctggtccggctggaggactcggtggtgttcgcactcatcgagcgcgctaggcacccgcgcaacgcggcggcctacgcgcctggcgccggtggcggggcgggagggcgctctctcgtcgagttcttcgtccgggaagcagaagccctcaatgcaaaggcaagcctttttttttgtcgcgcctcgcttgttccatcagtttgctctattgagatttgcattagccagatggagaacccggtggagcagaggagggggcaaaattacttttttttcagataatgaaattttccggcctaacacagccttcaaatattatatcttcaaacgctggattaacaggagagtcaaaaagcaaaattaagcctgataaattctattatcatgcttccatccatagctcgcaaacagttctaaggctgccagtcttcaaagaagtgctggtcttcctgaacagatcttttgtcctctcctcgtgctataatattgaccaaaatcgaagccgggaggtccccttaaaaatagcatttataaaggatgaatgtttatcattatcca

SEQ ID NO: 20824 - protein, 109 aa, Panicum virgatum
  misc_feature: Ceres CLONE 1813279
  misc_feature: SWISSPROT Homolog: EC 5.4.99.5 Chorismate mutase
MDAAGGEQLSLAAVRDALVRLEDSVVFALIERARHPRNAAAYAPGAGGGAGGRSLVEFFVREAEALNAKASLFFCRASLVPSVCSIEICISQMENPVEQRRGQNYFFFR

SEQ ID NO: 20825 - DNA, 762 bp, Panicum virgatum
  misc_feature: Ceres CLONE 1813280-R
  misc_feature: Encodes the peptide sequence at SEQ ID NO. 20826
aggcatttatgcctgaaaacttcacgaagccaaggcaagattgttcagcagaggagcgcagcgattttattaggcgaaaatacgaggttcaacaatttttgtctagcccgcagctgtcataccctccacgacgcaacgacagacatagtcaccagcaccatagtggttcaggtcgacatggtttaggccattctttcaagaacagctggaggagaaaagcagaacacgagccgaaagcattaaagaaaacaacggacttgggtatggtagaattcattgggttgatgaaggtcgatgtcataagaggcacaaatctagctattcgtgatgtgatgtcaagcgatccttatgttattattaacctaggacaccagaccatgaaaacgaaggtgataaagagcagcttgaatcctgtatggaatgagaggcttatgctatcgatacctgacccaataccggtgcttaagctgcaagtcttggacaaggacacgttcaccaccgacgaccggatgggggaggctgagatcaacatcgagccactggttgctgcagccagagcctatgaggcctccaccatcacagatactgcccagcttaacaaatggatggcaaaagatggcatctggatcccgagggacagtgccatctccatcgtcaacggcaaggtgaagcaggtggtcactgtcaggcttcagaatgttgagcgtgggcaccttgagatggagctcgagtgcgtccctctcactcaatagctgtctgcag

SEQ ID NO: 20826 - protein, 249 aa, Panicum virgatum
  misc_feature: Ceres CLONE 1813280-R
  misc_feature (95)..(174): Pfam Name: C2 Pfam Description: C2 domain
  misc_feature: SWISSPROT Homolog: EC 3.1.4.4 Phospholipase D
AFMPENFTKPRQDCSAEERSDFIRRKYEVQQFLSSPQLSYPPRRNDRHSHQHHSGSGRHGLGHSFKNSWRRKAEHEPKALKKTTDLGMVEFIGLMKVDVIRGTNLAIRDVMSSDPYVIINLGHQTMKTKVIKSSLNPVWNERLMLSIPDPIPVLKLQVLDKDTFTTDDRMGEAEINIEPLVAAARAYEASTITDTAQLNKWMAKDGIWIPRDSAISIVNGKVKQVVTVRLQNVERGHLEMELECVPLTQ

SEQ ID NO: 20827 - DNA, 317 bp, Panicum virgatum
  misc_feature: Ceres CLONE 1813280
gttcttatccatttgctcccatccattcgtcctccatccctcctcacgagattgtccttcctctccctctcaacgagctctctctcttgcttgctgctccctcttctcggcgagctctttatcccctgctcctcttcctccctcgatgtggcgcaaattcttctcatggaagtgagccgggacggcagttgttggtgggggggggggggttcagaggggatcatggatgccaccaccatggggatgactgttagttccagcatgaggcggactgcatgacgatcatggcttacggcgacgcttgagagcgccatcat

SEQ ID NO: 20828 - DNA, 695 bp, Panicum virgatum
  misc_feature: Ceres CLONE 1813304
  misc_feature: Encodes the peptide sequence at SEQ ID NO. 20829
aggacagcgacaggccctcgcgccgagccagccgcggcgttgctggcgggcaatgggagctgggcggcggcggtgatgggcgcggcgagctccaggctggagaaggcgctgggcgagcagttccccgagggcgagcgctacttcggcctcgaaaacttcggcaacacatgctactgcaacagcgtcctgcaggcactttatttttgtgttcctttccgtgatcaattgctggagtactatgcaagcaataaaaacactggagatggtgaagagaacatgctaacctgcctgactgatctgttctctcagatcagtaatcagaagaagaaaactggagttattgctcctaagcgttttatacaacgattgaagaaacagaatgaaattttccgcagttatatgcatcaggatgctcacgagtttctgaactttttactgaatgagctcgttgacattctagagaaggaacataatgctgcaagagagtctcttcaaaatatttcgttgcaaaagaattctaatggccctattaatggccaagccaatggtagtcacaaagaattacctgctacatgggtccataaatgcttccagggaatattgactaatgaaacaagatgtctgagatgtgaaactgtgactgatagagatgaaacattttttgatctgagcctggacattgaacagaatagttc

SEQ ID NO: 20829 - protein, 206 aa, Panicum virgatum
  misc_feature: Ceres CLONE 1813304
  misc_feature (20)..(205): Pfam Name: UCH Pfam Description: Ubiquitin carboxyl-terminal hydrolase
  misc_feature: SWISSPROT Homolog: EC 3.1.2.15 Ubiquitin thiolesterase
MGAASSRLEKALGEQFPEGERYFGLENFGNTCYCNSVLQALYFCVPFRDQLLEYYASNKNTGDGEENMLTCLTDLFSQISNQKKKTGVIAPKRFIQRLKKQNEIFRSYMHQDAHEFLNFLLNELVDILEKEHNAARESLQNISLQKNSNGPINGQANGSHKELPATWVHKCFQGILTNETRCLRCETVTDRDETFFDLSLDIEQNS

SEQ ID NO: 20830 - DNA, 1980 bp, Panicum virgatum
  misc_feature: Ceres CLONE 1813316
  misc_feature: Encodes the peptide sequence at SEQ ID NO. 20831
atcccattcgctcgtctcctcctccggtcgccgtcacccctcgtcgccacgcgcaccccggccgccgccgtcgccgtcaccgcttccccccacaaagcctcccggacgccccacgcaatggatttttccaccgcgtcctcctccagcccccatggcgccgccgcccgcgtcgcgcgctgctgactcgccccctgctgatcccagcaggcccgccgccggcgcgcccgagccgatcaccgtcccgagcccgcgggaccacctccaccaccacctgatcgatcgccgggacacgccgcggggccgcgcgtgggagccggagcggagccggcgcggaggggcgatggacggggcggcggcggtcaagctggtgtccggcgaggccgggtacgtcctcgaggacgtgccgcacgtgtccgattacctcctcgatctcccgacctacccaaatccattgcaagataacccagcatactcggttgtgaagcagtacttcgtaaacccggacgacactgtctgtcagaagattgttgttcacaaggatggccccagagggaaccacttccgtcgtgccggacctcgccaaagggtctattttgaaccagatgaggtccatgcatgcattgttacctgtggaggattatgccctggacttaatactgtgattagggaaattgtatgcggtttatctgacatgtatggtgtcaccaagatacttgggattcagggtgggtatagaggcttctatgctcgcaacaccatcactttgactccaaagagtgtaaatgacattcacaaaaggggtgggactattctcggatcatcccgaggaggccatgacaccatgaagattgttgacagtattcaagatcgtggcataaatcaggtctatgtaattggtggtgatggtactcaaaggggagcaggagttatatttgaagaagttaaaaggcgtggtctgaaagtttctgttgctggcattccaaagactattgacaatgacatccctgtaattgacaagtcatttggtttcgacacagcagtcgaggaggctcaacgtgcaataaatgctgctcatgtggaagctgtaagtgctgagaacggtataggtcttgtcaagctaatgggtcgacacagtggttttattgcgcattatgctactctggctagcagggacgtggattgttgcttgattccagagtcacctttctatctggaaggtgaaggtggacttttcagatatatagaaaagcgtttgaaggataatggtcatatggttattgttgttgctgagggtgccggacagaaacttattgctgaaaccatgcagtcaattgggaaagatgcctcaggcaatgagctgcttcttgacgttggtctttggttatctcaaaagataaatgagtacttcaagagaaacaagatgaccattaatctgaagtacatagatccgacatacatgatccgtgccatccctagcaatgcatctgataacgtctattgcacactgttggctcacagtgtggtccatggtgccatggctggatatactggcttcaccattggtcaagtgaatggtcggcattgctatattcccttctataggataaccgagaagcagaacagagtttcgataaccgacaggatgtgggcaaggctgctctcctcgaccaaccagccaagcttcctgtgcaacaaagttgtcgaagaggcgaagaaggaacaggaaaggacggcccaacttatagatggctcgccttcccatcggtagcttgacgggaaggttgaaggtcccaactctggtgatacgaagtgagatcaacgtccgcttatgtggtgcagataaaccttttttttccagcctatttagttgctatggcaactgatgatgccatttttccagtccgcttatatatccctgaccaatttttccaggggaaaaccctatctctaactcggtgctaaataaatatatctttgtac

SEQ ID NO: 20831 - protein, 538 aa, Panicum virgatum
  misc_feature: Ceres CLONE 1813316
  misc_feature (157)..(406): Pfam Name: PFK Pfam Description: Phosphofructokinase
  misc_feature: SWISSPROT Homolog: EC 2.7.1.11 6-phosphofructokinase
MAPPPASRAADSPPADPSRPAAGAPEPITVPSPRDHLHHHLIDRRDTPRGRAWEPERSRRGGAMDGAAAVKLVSGEAGYVLEDVPHVSDYLLDLPTYPNPLQDNPAYSVVKQYFVNPDDTVCQKIVVHKDGPRGNHFRRAGPRQRVYFEPDEVHACIVTCGGLCPGLNTVIREIVCGLSDMYGVTKILGIQGGYRGFYARNTITLTPKSVNDIHKRGGTILGSSRGGHDTMKIVDSIQDRGINQVYVIGGDGTQRGAGVIFEEVKRRGLKVSVAGIPKTIDNDIPVIDKSFGFDTAVEEAQRAINAAHVEAVSAENGIGLVKLMGRHSGFIAHYATLASRDVDCCLIPESPFYLEGEGGLFRYIEKRLKDNGHMVIVVAEGAGQKLIAETMQSIGKDASGNELLLDVGLWLSQKINEYFKRNKMTINLKYIDPTYMIRAIPSNASDNVYCTLLAHSVVHGAMAGYTGFTIGQVNGRHCYIPFYRITEKQNRVSITDRMWARLLSSTNQPSFLCNKVVEEAKKEQERTAQLIDGSPSHR

SEQ ID NO: 20832 - DNA, 618 bp, Panicum virgatum
  misc_feature: Ceres CLONE 1813326
  misc_feature: Encodes the peptide sequence at SEQ ID NO. 20833
ggctggggattggagctctgcggcggcctgaggtttctgcatctaggcgccgctacgtgactggcggccagctttcgactctagcagcctgcaggctctgctccgatctagacctccgaaccaggagggaatgatggatctcggggacagccagcagcggctcatcgccggcgcggcgctgctgctggccaccgtcgccttcgtcaggctcctgctgggctcccgcgcccgcggcaagcgcctcccgcccaccatcccgggggcgccggtcgtcggcgggctcatcaagttcatgcgcgggcccatccccatgatccgggaggagtacgcccgcctcggcagcgtcttcaccgtccccatcctcagccgccggatcaccttcctcatcgggcccgaggtctccgcgcacttcttcaagggcaacgaggccgagatgagccagcaggaggtgtacaggttcaacgtgcccacctttgggccgggggtcgtcttcgacgtccactactccgtcaggcaggagcagttccggttcttcaccgaggccctgcgtgccagcaagctccccagctatgtcgaccagatggttgctgaggctgaggagtacttcttcaagtgggg

SEQ ID NO: 20833 - protein, 162 aa, Panicum virgatum
  misc_feature: Ceres CLONE 1813326
  misc_feature: SWISSPROT Homolog: EC 1.14.13.70 Sterol 14-demethylase
MMDLGDSQQRLIAGAALLLATVAFVRLLLGSRARGKRLPPTIPGAPVVGGLIKFMRGPIPMIREEYARLGSVFTVPILSRRITFLIGPEVSAHFFKGNEAEMSQQEVYRFNVPTFGPGVVFDVHYSVRQEQFRFFTEALRASKLPSYVDQMVAEAEEYFFKW

SEQ ID NO: 20834 - DNA, 1962 bp, Panicum virgatum
  misc_feature: Ceres CLONE 1813327
  misc_feature: Encodes the peptide sequence at SEQ ID NO. 20835
atcccaacccgtcaaggggttgggggcacagaggggtttatcccttccactcccggtgcggcgagggcgagcgagcgggcaagcaaacccccgcggcggaaatggacgccaagctcctgctccccttcccctccgcgccggccgccctccacccggcagcggcggtacccaagaccctcttcctcggggcctcgctcccgcttcacccgcgcgcgccgccgccgttcccgctgcacctccgcccgcggccggcggtggtggtggcgcaggccgcagtgaagcgccgcaaggagatccccttcgacaacgtgatccagcgggacaagaagctcaagctggtgctcaagctccgcaacatcctcgtcgctcagcccgaccgcgtgatgagcctccgcgacctcggccgcttccgccgcgacctcgggctcacccgcaagcgccgcctcatcgcgctcctcaagaaattcccgggtgtcttcgaggtcgtcgaggagggcgtctactccctcaagttccgcctcacccccgccgccgagcggctctacctcgacgagctccagctcaagaacgagtccgagggcctcgccgtcaccaagctccgcaagctcctcatgatgtcgcaggagaagcgcatcctcatcgagaagatcgcgcacctcaagcacgacctaggcctcccgccggagttccgcgacaccatctgcctcaggtacccgcagtacttccgtatcgtccggatgaaccgagggccggggctggagctcacccattgggaccccgagctggcggtgtctgcggcggagctcgcggaggaggagaatcgggcaagggcagctgaggagaggaatttgataattgacaggccactgaaatttaaccgggtgaagctaccaaaggggctgaaattgacgcggggagaggcacgcaggattgcgcaattcaatgaaatgccatatatttcaccatatgctgacttctcacacctacggtctgggtcggctgagaaggagaagcatgcttgtggagtggttcatgagattcttagcttaacggttgagaaacgcacattggtggatcacctgacgcacttcagggaggagttccggttctcgcaatccctgcggggcatgatcattcgtcacccagacatgttttatgtatcattcaaaggggatagggactcggtcttcctccgcgaagcatacaaggactcacagctggttgagaagaacaagctggtgctgcttaaggagaaaatgagggctctcgttgctgtgccgcgctttcctagaagaggtggggcttggaccagcggggaagctgagggagccaatggagcagcacaattgtcaactgaaagaagtgacgaagaatatgatgaagatgagggactctctgatatggaagatttgatcagtgaactttctggtggcaaatcggatgctgactaccaatggggtgatggttggtttggtgagaatgatgacgcgcctccagactttgcagacgatgactcaagtacacaagaagtcaaggttactatgaaaaatgatgatggttcagccaatggcaggggagctgttcctgtatttcctgatggcagaccaagagaacggtggtaaattgagtttttttaagcttttcgttgatagaattattagtctctaatgttagttctttataatatctagttgcaaagctcttgtcttttgaggtgtcctactgatttttgctaccaaaaaacatcagtagaacacaatttttgaggaatctacatgacagtgctagtgattctacaaacataatctgctggtgaatgttaaattgcacacatacttttaaaactagaactgatagaaatgtgtgtatagcgatcacgactggggttcagatcattgttctaagatttggattgtatgatcagtcaatcttgagatataaaatatacaccaagctatatgt

SEQ ID NO: 20835 - protein, 506 aa, Panicum virgatum
  misc_feature: Ceres CLONE 1813327
  misc_feature (66)..(389): Pfam Name: Peptidase_C12 Pfam Description: Ubiquitin carboxyl-terminal hydrolase, family 1
MDAKLLLPFPSAPAALHPAAAVPKTLFLGASLPLHPRAPPPFPLHLRPRPAVVVAQAAVKRRKEIPFDNVIQRDKKLKLVLKLRNILVAQPDRVMSLRDLGRFRRDLGLTRKRRLIALLKKFPGVFEVVEEGVYSLKFRLTPAAERLYLDELQLKNESEGLAVTKLRKLLMMSQEKRILIEKIAHLKHDLGLPPEFRDTICLRYPQYFRIVRMNRGPGLELTHWDPELAVSAAELAEEENRARAAEERNLIIDRPLKFNRVKLPKGLKLTRGEARRIAQFNEMPYISPYADFSHLRSGSAEKEKHACGVVHEILSLTVEKRTLVDHLTHFREEFRFSQSLRGMIIRHPDMFYVSFKGDRDSVFLREAYKDSQLVEKNKLVLLKEKMRALVAVPRFPRRGGAWTSGEAEGANGAAQLSTERSDEEYDEDEGLSDMEDLISELSGGKSDADYQWGDGWFGENDDAPPDFADDDSSTQEVKVTMKNDDGSANGRGAVPVFPDGRPRERW

SEQ ID NO: 20836 - DNA, 692 bp, Panicum virgatum
  misc_feature: Ceres CLONE 1813330
  misc_feature: Encodes the peptide sequence at SEQ ID NO. 20837
attgtgttcgaaaggctgaaggagtgtggcttcaaaccatcaataatatcttatggttgtcttattaacctgtatgtcaagattgggaaggttcccaaagccttaactgttagcaaagaaatggaatcaagtggtatcaaacataataacaaaacttactctatgctgatcaatggatttatccatttgcatgactttgcaaatgcttttggcatatttgagggcatgctaaaatcaggtttgcagcctgatcgtgccatatacaatttgctgatagaggcattttgtaagatgggaaatatggatcgtgctattcgcatattggaaaaaatgcagaaggaacgaatgcaagcatcaaatagaacattcaggcctatcatagaaggttttgcagttgctggagatatgaaaagggctctggatacccttgctctgatgcggcgaagtggctgtgctcctactgtaatgactttcaatgcccttatccatgggctaattagaaagcaccaggttgaaagaaccgtttctgtgcttgaaaagatgtctattgctggcattgcaccaaatgagcatacatacactatcattatgagaggttatgctgctgttggagatattggaaaggctttccagtatttcaccaaaatcaaagagaatggtctaaagcttgatgtgtacatttatgaaacatt

SEQ ID NO: 20837 - protein, 230 aa, Panicum virgatum
  misc_feature: Ceres CLONE 1813330
  misc_feature (86)..(120): Pfam Name: PPR Pfam Description: PPR repeat
  misc_feature (191)..(225): Pfam Name: PPR Pfam Description: PPR repeat
  misc_feature (16)..(50): Pfam Name: PPR Pfam Description: PPR repeat
  misc_feature (51)..(85): Pfam Name: PPR Pfam Description: PPR repeat
  misc_feature (156)..(190): Pfam Name: PPR Pfam Description: PPR repeat
  misc_feature (121)..(155): Pfam Name: PPR Pfam Description: PPR repeat
  misc_feature: Useful for making plants with modulated biomass
IVFERLKECGFKPSIISYGCLINLYVKIGKVPKALTVSKEMESSGIKHNNKTYSMLINGFIHLHDFANAFGIFEGMLKSGLQPDRAIYNLLIEAFCKMGNMDRAIRILEKMQKERMQASNRTFRPIIEGFAVAGDMKRALDTLALMRRSGCAPTVMTFNALIHGLIRKHQVERTVSVLEKMSIAGIAPNEHTYTIIMRGYAAVGDIGKAFQYFTKIKENGLKLDVYIYET

SEQ ID NO: 20838 - DNA, 2180 bp, Panicum virgatum
  misc_feature: Ceres CLONE 1813342
  misc_feature: Encodes the peptide sequence at SEQ ID NO. 20839
gtcctcgccgctgctagacgccgccgctgcccagcgtgcggaatcgctcccggccgccgttgctaaactttttcctccggccatttaacagatttcgtcctggtgctcgccagcaacgggcggcggtttcccgtggagacgtttcatctctatctccctgcttggctgcttcttctcgctttgccgagactctcaggcccggcagaggaaagccagcgcgcagggatcaccaaccggataggcgtgcggcgaggagaccgtgttctcgggagaccgagagacagagctcttcctgtcctatttccggcttcgtcgggtcgaagaggcgaagggaaatggcggaggcgaagccggaggagatcagccatccgcccatggagcagctccaggggttcgagtactgcatagactccaaccctccctggggcgaggcgatcatactggccttccagcactacatactggcgctcggcacggcggtgatgatcccggcggtgttggttcccatgatgggtggcgacgatggggacagggtgcgggtggtgcagacgctgctgttcgtgacggggataaacacgctgctgcagtccctcttcgggacgcggctgccgacggtgatcggcggctcctacgcgttcgtgatcccgattgtggccatcatccaggactcgtcgctcgcgccgatacccgatggccacgagaggttcctcgagaccatgagggcgatacagggggcactgattgtgtcctccagcattcagatcattctgggctacagccaactctggggtattttctccagattcttcagcccagtggggatggcgccagtggttgcgctgctcggatttggccttttcgaaagaggattccctgtggttgggagatgcgttgaggtcggcttgccaatgttgattctctttgttgtactctctcagtatctgaagaatgtgcaaataaaagatattcccatactggaaaggttctcccttttcatctgtattgctttggtatgggcatatgctcaaatcctcacttctggtggtgcctataagaacagcactgaggtcactcagatcaactgccgcactgaccgtgccaatctgatctcctctgccccatggattaagattccttacccactacaatggggggcaccaaccttcaacgctggccaatcatttggtatggtgtctgctgttttggtctcactaatagagtccacagcctcttacaaagcagctgctcgtctcgcaagtgcaactccacctccagctcatatcctgagtagaggcattggatggcagggaatcggcatcctccttgatggcctttttggaacggggactggctccactgtctcagtggagaacgttggtttgcttggatcaacgaggatcgggagccgacgggttatccagatctctgccggtttcatgatctttttctccatgctgggaaaattcggggcgctgtttgcttccatcccgttcaccatcttcgcagccgtgtactgcgtcttgtttgggctcgtcgctgcggtggggctgtccttcttgcagttcactaacatgaactccatgcgcaacctctttatcgtcggcgtctccatcttcctcggcctttcagtgccggagtactttttccggtacaccatggctgctcagcgtggtcctgcgcacaccaaagctggatggttcaacgactacatcaacaccatcttctcgtcgccgccgacggtggggctgatcgtggccgtgttcctggacaacacgctggagaccaagggcgcggccaacgaccggggcctgccgtggtgggcgcggttccggtcgttcaagggggacagcaggaacgaggagttctacagcctgccgttcaacctcaaccgcttcttccctccggcctgaacccccggccgatcttcctgcctaccattgccgagagataaactaaaagaggtggaagcggccgcctctcactggacgaactcagactgctgagcgcggcagaggcatagtagaagttactagctgtgtgcagtagctaggccattgtttgattcgttgatcttgtagctgttcatgtctgtagatcgtttgttgtggggggaggcacctagattagtattactgtccccaagccaacccagtaaaaatggtctcctaccgttttgcttc

SEQ ID NO: 20839 - protein, 524 aa, Panicum virgatum
  misc_feature: Ceres CLONE 1813342
  misc_feature (31)..(438): Pfam Name: Xan_ur_permease Pfam Description: Permease family
MAEAKPEEISHPPMEQLQGFEYCIDSNPPWGEAIILAFQHYILALGTAVMIPAVLVPMMGGDDGDRVRVVQTLLFVTGINTLLQSLFGTRLPTVIGGSYAFVIPIVAIIQDSSLAPIPDGHERFLETMRAIQGALIVSSSIQIILGYSQLWGIFSRFFSPVGMAPVVALLGFGLFERGFPVVGRCVEVGLPMLILFVVLSQYLKNVQIKDIPILERFSLFICIALVWAYAQILTSGGAYKNSTEVTQINCRTDRANLISSAPWIKIPYPLQWGAPTFNAGQSFGMVSAVLVSLIESTASYKAAARLASATPPPAHILSRGIGWQGIGILLDGLFGTGTGSTVSVENVGLLGSTRIGSRRVIQISAGFMIFFSMLGKFGALFASIPFTIFAAVYCVLFGLVAAVGLSFLQFTNMNSMRNLFIVGVSIFLGLSVPEYFFRYTMAAQRGPAHTKAGWFNDYINTIFSSPPTVGLIVAVFLDNTLETKGAANDRGLPWWARFRSFKGDSRNEEFYSLPFNLNRFFPPA

SEQ ID NO: 20840 - DNA, 1226 bp, Panicum virgatum
  misc_feature: Ceres CLONE 1813350
  misc_feature: Encodes the peptide sequence at SEQ ID NO. 20841
aaaattccaaagccaccgtagccaggcggccccctccttcctcctccgagatgtcctcgccgcagtccgtcctcctcctcccttcctgtctaccacccccatctccactcgctcgcgtcaccccgcgcccgctatcctcgccgcccctcatcgccctccgattcccccgcctcgccgccaagctttcgccgccgcccctcgcggcatcgccccctccacccggcggcttccgcggctgtggagacaccggcggcaacgatggaggaggaggaggtgaaggcagcggaggaacggaccctcccgaccccggcgacgggtggtggcgccggtggctccaggccctccaccccgagttcctcctctctgttctgctccttcaatccggcgccgcgtccgcgctcgccgaggctctcggcgccacaggagatgacgcggggggcgtgtgggaggtgaggggcggcgcgcgcacgcggctcgtgccggacccgacctggacctcctatctcatcgcgggggacgacgggtcgaagctggaggaaggggatgccaagggcgcaggttccagtgtggacgtggccgcattgcggaggcagctggagcgctcgtggcgccggtgcaccgatgttgctgtccagctgctgctccccgacgggtacccgcacagcgtcagcagcgactacctcaagtactcgctctggcgcgccgggcagagcgtggcgagccagatcagcggggtgctttccactcaggcgcttctctatgcggttgggttagggaaaggggtgatacccactgcagccgcggtgaattgggtgctgaaagatgggcttggatacttgagcaagatcatgttgtccaaatttggccggcatttcgatgttaaccccaaaggatggcggttgtttgctgatcttctggagaacacggcttatgggctggaaattctaactccaatgttccctcacctgtttgttccgataggggcggctgctggagctggtcgctcggctgctgctttgatacaggctgccaccagaagttgtttctatgctggatttgcagtccaaaggaactttgctgaggttattgcgaagggtgaagcgcaaggaatggttagcaagtttgttggcatagggcttggcattgtgttggctaatcacattggttcatctgtaccattagctcttatttcgtttgccggagttactgctgtccacatgtattgc

SEQ ID NO: 20841 - protein, 391 aa, Panicum virgatum
  misc_feature: Ceres CLONE 1813350
  misc_feature: Useful for making plants with altered terpenoid content
MSSPQSVLLLPSCLPPPSPLARVTPRPLSSPPLIALRFPRLAAKLSPPPLAASPPPPGGFRGCGDTGGNDGGGGGEGSGGTDPPDPGDGWWRRWLQALHPEFLLSVLLLQSGAASALAEALGATGDDAGGVWEVRGGARTRLVPDPTWTSYLIAGDDGSKLEEGDAKGAGSSVDVAALRRQLERSWRRCTDVAVQLLLPDGYPHSVSSDYLKYSLWRAGQSVASQISGVLSTQALLYAVGLGKGVIPTAAAVNWVLKDGLGYLSKIMLSKFGRHFDVNPKGWRLFADLLENTAYGLEILTPMFPHLFVPIGAAAGAGRSAAALIQAATRSCFYAGFAVQRNFAEVIAKGEAQGMVSKFVGIGLGIVLANHIGSSVPLALISFAGVTAVHMY

SEQ ID NO: 20842 - DNA, 690 bp, Panicum virgatum
  misc_feature: Ceres CLONE 1813350-R
  misc_feature: Encodes the peptide sequence at SEQ ID NO. 20843
atccgtaccgtgcaagtttggtgtttagtgaatatctataagtggacaagttccatcagtcaaagaggttaacgatgaggaacctctgttcttcaatctgtcacttggtggttcaagcaaagaatgcaagatattatcagcagaaacaaaagatgctgcagatagaatttgtcggcggttacaattgggttctaagctaagtgaaattattgagactaaagaagatgcgtgtgcattgtttgatctctacaaaaatgagcaatacctgcttatggattacaagggaaaattttgtattgtacttaaagagggatcttcacctgaagacatgctcaaatctttgttccatgttagttatctgtattggttggaaagatatatgggcttcaaaccaagcaaaattgcctcagattgtaggccaggtggaaggcttgaagtatcgctggattatgctcagagagaattcagccatgtcaaacatgatggttctgtcggtggctgggtgatggatggtctgattgcgaggcccttacctgtaagaatacaagtaggagatgttactccttaggacatggcacgattggctgtcctcagagctccgcccatggaaatgtgcagtgcgctcattatctgatacaactttttggaagagttctattttgtctaactggtagtgtgtttcaacacttt

SEQ ID NO: 20843 - protein, 98 aa, Panicum virgatum
  misc_feature: Ceres CLONE 1813350-R
  misc_feature: Useful for making plants with altered terpenoid content
MDYKGKFCIVLKEGSSPEDMLKSLFHVSYLYWLERYMGFKPSKIASDCRPGGRLEVSLDYAQREFSHVKHDGSVGGWVMDGLIARPLPVRIQVGDVTP

SEQ ID NO: 20844 - DNA, 1719 bp, Panicum virgatum
  misc_feature: Ceres CLONE 1813354
  misc_feature: Encodes the peptide sequence at SEQ ID NO. 20845
gtaacaagtgagagacccatactccatagacgcgcgcgcgcacacacacagagggacagccaaagaagacactcacaaatcacaatagcaagggacgaggaaagattgctcgcaaggcaccagggaggaagaagacaaccacgcactactactatttctactgcttgtgctttcccagtgtgcgcgcggggcgagaatcagacaagcacctgcgggagcaaaacggggcatggcttctcgcggtagcttctactttgttcccttgctcctcctgctgatactcttgctcgcgtctccttctactgctgcattgtactcatccaagcctgggagtggcgatgctggcaatgccactgctgctgctgcaaggctgaagccgggaaaggagctgctcaagtacaacaggatcagggctctgctcaggaagcttaacaagccgtctcttaagaccatcaagagccctgatggtgacatcatagactgtgtactctctcacctccagcctgcatttgaccacccaaagctcaagggacaaaagattctggatccaccggagaggccaaagaactaccacttcaccattaccggcagtggcagcggcagcagcgatgatgtggtggtgcaggcatggcatgccaccggcgaggcatgcccggaaggcaccgtgccaattcggcggacgatggagaaggatctgctcagggcaagctccctaaggagatatggcaggaagccagtgcgccggggtgttcgccgtgattccacaagcagtggccatgagcatgcagttgggtatgtgaactctgagcagtactatggggccaaggccagtgttaatgtgtggtcaccaagaataggtgacccatctgagttcagcctgtcacaaatctgggtcatatctggctcttttggcaacgatctcaataccatcgaagctggatggcaggtaagccctgagctatatggggacagtaacccaagattcttcacctactggacaactgatgcgtatcaagaaaccgggtgctacaatcacaactgccgtggattcgtgcagacgaccaacaagattgcaattggggcggctattaccccggaatcggtgtacaacggcaggcagtttgacattactctgatgctatggaaggatccgaagcacgggcactggtggctgcagctgggctcgggcctggtcgtcgggtactggccgtcctacctcttcacccacctggcgcgccacgccaacatggtgcagttcggcggggaggtcgtcaacacccggccgtcggggtcgcacacggcgacgcagatgggcagcggccacttcccaagcgagggcttcgaccgcgccgcctacttccggaacctccaggtggtggactgggacaacaacctcatcccggcggccagcctgaagctcctcgccgaccaccccggctgctacgacatccagggagggtccaacagctactgggggagctacttctactacggaggcccggggaggaacgtgaaatgcccctgagattaaaaaaaattatgatcttgttttcgttttgctgttttttttttttgctctcttgtttgttctcgtttgtttaatgcttttttctgtggggtccttttctgataggaagtatctgtttagccctttctaggataccttaggtcttagatctatcttttaactaaaaaatgcatcaaaacattaagactcct

SEQ ID NO: 20845 - protein, 431 aa, Panicum virgatum
  misc_feature: Ceres CLONE 1813354
  misc_feature: Useful for biocontainment applications
MASRGSFYFVPLLLLLILLLASPSTAALYSSKPGSGDAGNATAAAARLKPGKELLKYNRIRALLRKLNKPSLKTIKSPDGDIIDCVLSHLQPAFDHPKLKGQKILDPPERPKNYHFTITGSGSGSSDDVVVQAWHATGEACPEGTVPIRRTMEKDLLRASSLRRYGRKPVRRGVRRDSTSSGHEHAVGYVNSEQYYGAKASVNVWSPRIGDPSEFSLSQIWVISGSFGNDLNTIEAGWQVSPELYGDSNPRFFTYWTTDAYQETGCYNHNCRGFVQTTNKIAIGAAITPESVYNGRQFDITLMLWKDPKHGHWWLQLGSGLVVGYWPSYLFTHLARHANMVQFGGEVVNTRPSGSHTATQMGSGHFPSEGFDRAAYFRNLQVVDWDNNLIPAASLKLLADHPGCYDIQGGSNSYWGSYFYYGGPGRNVKCP

SEQ ID NO: 20846 - DNA, 1460 bp, Panicum virgatum
  misc_feature: Ceres CLONE 1813381
  misc_feature: Encodes the peptide sequence at SEQ ID NO. 20847
aaatccctagcttccagactctgtctctcccggccgcgttctccaccccccccccccccccacctgagatcactgcgcgtgctgcccgcgccatggccccgacacctccgccgccgccgccgccgccggctgcaatacactagcaacgcgtctccaggcagctttggccgatctaggaacgaggaatttcttcacgcctttcctcctcatcttgtgctgaggagtacgggcttggattcgctgagggattgggaggagagggacaatagagtggaggaggcaaggggagaagatggcgtcggaaatggtgaaggcggcgacgagcgacaagctaaaggagatggattgggcaaagaacatcgaaatctgcgagctcgtggcgcaggatcctggaaaagcgaaagatgtgatcaaatctataaagaagtgtatagggggaaggaacaagaacactcaactctatgctgttatgctattggagatgctcatgaataactgcggagagcctctccataggcaggtcattgataatggccttcttcctatacttgtgaagatagtgaagaaaaagacagaattaccagttcgagaaaaaatatttcttttgctagatgctacccaaacatcccttggtggagctaaagcaagattccctcagtactatgatgcatactatgagctggtgtctgcaggtgtgcaattttcaaatcgtccaaatgttgttgtcacacgagcagaagtgccagtcccggaaacgagaacattaccaaataaggaaactctatcgacccgattgaatgaagctcagcaggaagtgcatgctcaacctgctcctgatacaagtatagtccggaaagcctctagtgtgatggaacttttaagggatgtgctaaattctatggatcctagacaccctgagggcgcaactgatgaatttgtgttggatcttgttgagcaatgtacatttcagaagcaaagaataatgcaccttgttatgacgtcaagggacgaagcagtggtatcacaagctatagagctaaatgaagagctacataaggtccttgtgcggcacgatgcattgctttcagttcagccgactacaacagtagcttctaatctggaggttgaggaggaggaagatgccgaaagtctctatcggagactgaggaaggggaaagctctatctcaagattacacagatgattccgtgccgtcattccgatccatgccagatgacaagatgcggcgcccgctgaccatccagccgcctcaccccgacaagaaacttggcgcgctcaacatccgctctccagaccaggaggagcggagacccgagctcgctccactgatcccgccgccccccgcgaagcatgccgagagggagcgtttcttccgggagaagagcttagacagcttggctagcctgccgggccacctgaggggcacgtcgcagcactgcc

SEQ ID NO: 20847 - protein, 389 aa, Panicum virgatum
  misc_feature: Ceres CLONE 1813381
  misc_feature (1)..(134): Pfam Name: VHS Pfam Description: VHS domain
  misc_feature (177)..(274): Pfam Name: GAT Pfam Description: GAT domain
MASEMVKAATSDKLKEMDWAKNIEICELVAQDPGKAKDVIKSIKKCIGGRNKNTQLYAVMLLEMLMNNCGEPLHRQVIDNGLLPILVKIVKKKTELPVREKIFLLLDATQTSLGGAKARFPQYYDAYYELVSAGVQFSNRPNVVVTRAEVPVPETRTLPNKETLSTRLNEAQQEVHAQPAPDTSIVRKASSVMELLRDVLNSMDPRHPEGATDEFVLDLVEQCTFQKQRIMHLVMTSRDEAVVSQAIELNEELHKVLVRHDALLSVQPTTTVASNLEVEEEEDAESLYRRLRKGKALSQDYTDDSVPSFRSMPDDKMRRPLTIQPPHPDKKLGALNIRSPDQEERRPELAPLIPPPPAKHAERERFFREKSLDSLASLPGHLRGTSQHC

SEQ ID NO: 20848 - DNA, 663 bp, Panicum virgatum
  misc_feature: Ceres CLONE 1813381-R
ggcacgttgcagcactgccgggatggcagcagctcgtgtagcggcagcaccgattatggcgactgaggggggagcagcagcagtacatataggtttccctcctgggtttgtaggtctcctctccccctggcaaggcgatacattgttgtccggctgaggccggtcggcctcagcctcggcctctgcctcttcttcttcttcctgctgacctgtgtggctgtgtacactttggcttggtagctgagccttttctcctcttcttgtcctttcgctgatgacattattgggaggccgttgggttggttggtgtggtgttgcgggctacttttctcagatctatagagatgattgtgatctatctatctgcatggggtatgcttctgtctgaagcattctcgcgctttccccttttggctttctgctcttgtatgtggtgtagcacttggtcgtgtccgaggcgtgcgtgctgctcgctgtgtgtcgttcagctaaggttgaggctgtgtttagatccgtaaaattgtgataaaaatggtcatatcggacactgtagcacttttcgtttgtttgtggtaattgttgtcctatcatgacttaactagactcaaaagatttgtctcgtcgtgtacatcaaaactatgcaattagtttttttatttacct

SEQ ID NO: 20849 - DNA, 703 bp, Panicum virgatum
  misc_feature: Ceres CLONE 1813404
  misc_feature: Encodes the peptide sequence at SEQ ID NO. 20850
agctactgacctccgctcctccagctccgggcggcgcttgccgcccccggcggcagcgcctcctcctccacttgcccgctcccccggccccgattcctcccggctgcaagactgtagatcgatacatctagcaccaggtgcggcctctgctcgtcctttgctgtggcaagggtggagcggcggaatcgatccccgcatcgcggaagagctcgcagcctcttatccactccacctctgtccagtgaccgccgccgccttctatctgggtggaagaaacatgtcaagaatggcgcctccgtcctctcccctatccatgaagcccccgacgctgcccttctcccctcccaagaagccggcgccgatgccggtgtacaaggacctgcatttcaaccgcgacctctccgctaccaagaagctccaggccggggtggacctggtggcgcggttggtgggggtcaccctggggcccaaggggaggaacgtggtgcttggcaacaagtatggccctcccaagattgtcaacgatggggagaccgtccttaaggagatcgaattggaggatccattagaaaatcttggagtgaagctggtcaggcaggctggtgcaaggaccaatgatattgcaggagatggttgtaccacttccctaatccttgctcgaggcctgattgctgaaggaatgaaggttcttgcagctggaatc

SEQ ID NO: 20850 - protein, 138 aa, Panicum virgatum
  misc_feature: Ceres CLONE 1813404
  misc_feature: Useful for making plants with modulated nitrogen use efficiency
MAPPSSPLSMKPPTLPFSPPKKPAPMPVYKDLHFNRDLSATKKLQAGVDLVARLVGVTLGPKGRNVVLGNKYGPPKIVNDGETVLKEIELEDPLENLGVKLVRQAGARTNDIAGDGCTTSLILARGLIAEGMKVLAAG

SEQ ID NO: 20851 - DNA, 632 bp, Panicum virgatum
  misc_feature: Ceres CLONE 1813412
  misc_feature: Encodes the peptide sequence at SEQ ID NO. 20852
atcaccacacgaaacacacaggagaaacatgtccgcttccgctgcggccgcctcccccgtcctccgcctctcctccgccactcccccacttgctcctctccaccggccgttccgccggcggctcccgtccgtccggtgctccctcgccgctgcccccggtgtccgggcgcccccagagctcgtcgactccatcctctccaaggatcaagttcctccatttccttcagagacagctgtaaaaatcgtcgaagaagagctgggggcatctgtcaatgagctatttgatagatttgattttgaaccaatagctgctgctagcctcggccaggttcatcgggcacgtctgaatggccaagaggttgtcatcaaagtgcaaagacctggtctgaaggagctgtttgatattgatctgaagaatttaagggtaatagctgaataccttcagaaagtggatccaaagtcagatggtgccaagagagactgggttgctatttatgatgaatgtgcatctgttttatatcaggaaattgactatacgaaggaagcatttaacgctgaaaagtttgctgagaacttcaaaaaatttgattatgtgaaggttcctgaaatttactggaagtatactacacctc

SEQ ID NO: 20852 - protein, 201 aa, Panicum virgatum
  misc_feature: Ceres CLONE 1813412
  misc_feature (75)..(195): Pfam Name: ABC1 Pfam Description: ABC1 family
MSASAAAASPVLRLSSATPPLAPLHRPFRRRLPSVRCSLAAAPGVRAPPELVDSILSKDQVPPFPSETAVKIVEEELGASVNELFDRFDFEPIAAASLGQVHRARLNGQEVVIKVQRPGLKELFDIDLKNLRVIAEYLQKVDPKSDGAKRDWVAIYDECASVLYQEIDYTKEAFNAEKFAENFKKFDYVKVPEIYWKYTTP

SEQ ID NO: 20853 - DNA, 648 bp, Panicum virgatum
  misc_feature: Ceres CLONE 1813415
  misc_feature: Encodes the peptide sequence at SEQ ID NO. 20854
acatattggcatttgatttcgcagcccaccaattccggtctcttccaactcccaaagttccaagtggcgagcgcgaagagggagagaagtggttgtcggaatccactccggcgaggagcgaggaggcgggaatgggggaaggagcgggtgaggcggtgaaggtggtggatttggaggacggggagtgggaggaggaggctgcggcggcggggtcgagcagggagacgcggatgctgcccaggatgccggtgcgggttctgctcgccgagggcgacgactccacgcgccacgtcatctccgcgctgctccgcaagtgcggctaccgagttgctgcggcctctgacggtgtgaaggcgtgggacatactgcaggaaaaatcgttcaacatagaccttgttttaactgaagttgaactgcctttgatgtcggggttcctcctgttatccacaatcatggagcatgatgcgtccaagaacatccccgttataatgatgtcttcgcatgattcagtaagcatggttttcaaatgcatgctcaagggtgcagcagatttccttgttaagccgataagaaagaatgagttaaagaacttatggcagcacgtttggagaaaacaactggggaaacggtgggcctgatgtgcagcat

SEQ ID NO: 20854 - protein, 168 aa, Panicum virgatum
  misc_feature: Ceres CLONE 1813415
  misc_feature (40)..(156): Pfam Name: Response_reg Pfam Description: Response regulator receiver domain
  misc_feature: SWISSPROT Homolog: EC 3.1.4.17 3',5'-cyclic-nucleotide phosphodiesterase
MGEGAGEAVKVVDLEDGEWEEEAAAAGSSRETRMLPRMPVRVLLAEGDDSTRHVISALLRKCGYRVAAASDGVKAWDILQEKSFNIDLVLTEVELPLMSGFLLLSTIMEHDASKNIPVIMMSSHDSVSMVFKCMLKGAADFLVKPIRKNELKNLWQHVWRKQLGKRWA

SEQ ID NO: 20855 - DNA, 1161 bp, Panicum virgatum
  misc_feature: Ceres CLONE 1813420
  misc_feature: Encodes the peptide sequence at SEQ ID NO. 20856
ccctccccaccctactactgccgctgctgcatcttgattgatcttcccacttcttttttttttttgaaataaaattgatcctcccacctctctcctcctcattgcccccatctttctacagactactccatctccattccccatacacattcctcctcctgtcctgactacagctcggtgatgatccactgagctcggcgagttcttggcattaatggccgcttggtagccagcgctcttcaatccccctttaactcccccacctcttatctcccttcaccttgagctgagctccggctcccctccgcattgaccatcacccttcgtcgggttggttcttgccgcgtccgatcctgatctggaagcttcgcgtgctgtgatctgagagcgtccggggccatggggaccggggcggtggcggtggtggcgccggaccgggccaagcagcgccggggcggccacctatggaagaaggcgctgctccacttctcgctctgcttcgtcatgggcttcttcacggggttcgcgccctcctcctcgtcgtcctggaaggccgccacccaacacccgccgcgggccggggaccacctcgccgcctcccgcgtcgccgtcgacgcgcgcgtcaacctggtgccgtcgccgcccgacacggctggcgaggtggggctcggcggggcgacggttgacgtgggtgacgacgacgaggaggccggcccgcggcggctgctgattgtggtcaccaccacgcggtcgggcgccggcgagcggcggcggcgcagggccgtgctgctgcgcctggcgcacaccctgcggctcgtgcgcccgcccgtcgtgtgggtggtcgtggagccggtcgccgacgcacccgccacggccgaggtgctgcagggtaccggcgtgatgtacaggcacatcgcgttcaagcccgaggagaacttcaccacggccgccgccgaggcacacgcgcagcggaacgccgcgctcgcccacgtcgagaagcaccgcctcgccggcgtcctccacttcgccgacgccgccggcgtctatgacaccggcttcttcgaccagatccgccagatcgaggcgtttggcacatggcctgtggcaacaatgtcggcaggcgagaagaaagtggtagtggaaagtccactatgcagtgcc

SEQ ID NO: 20856 - protein, 253 aa, Panicum virgatum
  misc_feature: Ceres CLONE 1813420
  misc_feature (133)..(253): Pfam Name: Glyco_transf_43 Pfam Description: Glycosyltransferase family 43
  misc_feature: Useful for making plants with altered carbohydrate content
MGTGAVAVVAPDRAKQRRGGHLWKKALLHFSLCFVMGFFTGFAPSSSSSWKAATQHPPRAGDHLAASRVAVDARVNLVPSPPDTAGEVGLGGATVDVGDDDEEAGPRRLLIVVTTTRSGAGERRRRRAVLLRLAHTLRLVRPPVVWVVVEPVADAPATAEVLQGTGVMYRHIAFKPEENFTTAAAEAHAQRNAALAHVEKHRLAGVLHFADAAGVYDTGFFDQIRQIEAFGTWPVATMSAGEKKVVVESPLCS

SEQ ID NO: 20857 - DNA, 425 bp, Panicum virgatum
  misc_feature: Ceres CLONE 1813420-R
  misc_feature: Encodes the peptide sequence at SEQ ID NO. 20858
ggatcctgagcggtggggacggccaacgtcattaccagatacttcacaggattcaatcaagtttgtgcaagaagtggtgctggaagaccgagctaagctgaaggggatcccctctgattgctcccagatcatggtgtggcagtatggcatgcccagctcacaatagaaggtagtaagatgggtggcattgcaggaagggaaaattggcggggattggagttgatgtaaatgtggcgataacaaaaaggaaaggaagaaggtcgattactaagttctcttgtttctttttttggggttcccgttttctttctctcatttttgggttttcaagtttggggggccatgatgaattgttcgcgggaaatctgccccccgacctggaaaaaaaagcgatagtatttgttcagatttatttgtgattcttt

SEQ ID NO: 20858 - protein, 54 aa, Panicum virgatum
  misc_feature: Ceres CLONE 1813420-R
  misc_feature: Useful for making plants with altered carbohydrate content
DPERWGRPTSLPDTSQDSIKFVQEVVLEDRAKLKGIPSDCSQIMVWQYGMPSSQ

SEQ ID NO: 20859 - DNA, 628 bp, Panicum virgatum
  misc_feature: Ceres CLONE 1813435
  misc_feature: Encodes the peptide sequence at SEQ ID NO. 20860
ttctgtttctttctccaggcgcccgtctccagccgcgccgggagagaccgacgacgagtccagaggagggcaaggccatgggttcctctccttccggcgggggcggagcacggctgttgttcccgatggtggtgctggcagcggcggccgcgctggctggggcggcggcgccggcgtccgcgtgctacgcgcgcgtgttcagcttcgggaactcgctagcggacacgggcaaccgccgcttcgtctaccccaacggctccgaccccgtgctccggctcccctacggcgagaacttcttccaccgcgccaccggccgcttcagtgacggccgcatcgccctcgacttcgtcgcggacgcgctgggcctcccgttcgtgcggccctacctgagcgggcggcgcgccgaggacttcgcgcgcggggccaacttcgcggtgggcggcgccaccgcgctcgccccggaattcttccgggacaggggcataaacacgagcaacccggtggacctcgacgtggagatgaagtggttccgggacatgatcgggctcctctgccccggcggcatcgccggtgcgtatgctactttcccttctccttagatctctgggcctgctaccttctgttcatg

SEQ ID NO: 20860 - protein, 173 aa, Panicum virgatum
  misc_feature: Ceres CLONE 1813435
  misc_feature: SWISSPROT Homolog: EC 3.2.1.51 Alpha-L-fucosidase
MGSSPSGGGGARLLFPMVVLAAAAALAGAAAPASACYARVFSFGNSLADTGNRRFVYPNGSDPVLRLPYGENFFHRATGRFSDGRIALDFVADALGLPFVRPYLSGRRAEDFARGANFAVGGATALAPEFFRDRGINTSNPVDLDVEMKWFRDMIGLLCPGGIAGAYATFPSP

SEQ ID NO: 20861 - DNA, 1247 bp, Panicum virgatum
  misc_feature: Ceres CLONE 1813441
  misc_feature: Encodes the peptide sequence at SEQ ID NO. 20862
acactggaccagaccacgcgtccacgccagttccgcggttccgctccgcggttccgccatggccacctccaccaccgcgctccacccgcaattccggccaccgctgcgcgctcccgcccgtcgccgcccgctcccacactcctcgtattcctcgttcgcccgcgctcgccctcgcactaccatccgagcctcagcggcgtccgcttccgcgcccgcgcagcaggaggccgtcgcgggcgtcccgtggggctgcgagatcgagtccctggagagcgcggcgtcgctggagcggtggctcatagactcgggcctcccagagcaacgcctggctatccagcgcgtggatgtcggcaagcgcggccttgccgctctcaagaacatccgcaagggggagaagctgctcttcatgccgcctgccctcgtcatcactgccgattcggagtggagccgcccagaggtgggggaggtgatgaagaggaacgccgtgcctgactggccgcttattgccacttatctcataagcgaagccagtttagagggatcgtcgaggtggagcagctacatagcagctttgccaaggcagccttactcgcttttgtactggactcgtgcagagctagatgcatacctggtggcttcgccaatcagggaacgtgcagttcagaggataactgatgtgattgggacatacaacgaccttcgagatcgtatattttctaaacattcagatttattccctgaagaggtatataacatagagacatttctatggtcctttggcattctcttctcacgcctggttcgtttgccatcaatggatggaagggttgcactagttccttgggcagatatgcttaaccatagccctgaggtggaaacattcttggacttcgataagtcatcgcaaggaatagttttcaccactgaccgtgcatatcaaccaggtgagcaggtttttatatcttacgggaagaaatccagtggtgagctattgctttcatacggttttgttccaaaagaggggacaaacccaaatgattcagttgagttactggtgtctattgataaatctgacaagtgctacaaagagaagctaaaagcactaaagcggaatggtttgtcagcatctgaaagtttcccattgcgggttactgggtggccagttgagctgatggcttatgccttccttgtggtcagtcctcctgacatgagtcaacgctttgaggagatggctgttgctgcatcga

SEQ ID NO: 20862 - protein, 396 aa, Panicum virgatum
  misc_feature: Ceres CLONE 1813441
  misc_feature (82)..(310): Pfam Name: SET Pfam Description: SET domain
  misc_feature: SWISSPROT Homolog: EC 2.1.1.127 [Ribulose-bisphosphate carboxylase]-lysine N-methyltransferase
MATSTTALHPQFRPPLRAPARRRPLPHSSYSSFARARPRTTIRASAASASAPAQQEAVAGVPWGCEIESLESAASLERWLIDSGLPEQRLAIQRVDVGKRGLAALKNIRKGEKLLFMPPALVITADSEWSRPEVGEVMKRNAVPDWPLIATYLISEASLEGSSRWSSYIAALPRQPYSLLYWTRAELDAYLVASPIRERAVQRITDVIGTYNDLRDRIFSKHSDLFPEEVYNIETFLWSFGILFSRLVRLPSMDGRVALVPWADMLNHSPEVETFLDFDKSSQGIVFTTDRAYQPGEQVFISYGKKSSGELLLSYGFVPKEGTNPNDSVELLVSIDKSDKCYKEKLKALKRNGLSASESFPLRVTGWPVELMAYAFLVVSPPDMSQRFEEMAVAAS

SEQ ID NO: 20863 - DNA, 530 bp, Panicum virgatum
  misc_feature: Ceres CLONE 1813441-R
ttccaagtacctagagggtggcaatggctctccacaaggttcaataaatgcaaagcaagccaacaggaccttactgctaaaacagctagcaaaagatctgtgcatcagtgaacggagaatcttgtatcgtacacaatatatactgcgtagaagattgagggacatgagaggtggtgaacttagagctttgtcattgttcaatgggctcagaaagctcttcaaataaatgcatcggctacatttctaggtggattggatcttattggataaatttggtttccctgattcaggtgcattgaccttgcagctggagcctccgatgtttcattaccagatcagattgcagtctcagccacaaatttcttatctggagaagcatcaaaatgctagaaaggagctacggttcaacaaaggatagttgtgaattgtaattgaacagcccatagcttggcatatatgtaagagtaaattctacatgtagcctgtaaagacagattttacgagaggagctggccggtcgttctgatgtg

SEQ ID NO: 20864 - DNA, 1060 bp, Panicum virgatum
  misc_feature: Ceres CLONE 1813444
  misc_feature: Encodes the peptide sequence at SEQ ID NO. 20865
ggatgcagagctagctacacactaccggagtcagtgcacagtgcttcccttccgtctcgctgatgtatcaagcttgacgatctggtagtcttgtccgagagagccgcagccgcgccgagatctgacgcggctacagtggcgtctggtcctgggactggaagaggggaggagtgtcttttagggcagtgaggggagcagagcacagcctccccccgtcccccgtgcctgcctctctgcttcctaaatttggccgcctgcactgccgagctccatctctgctctacagtttttgctccggcttcagggaatcagggtttgttgcaaaagaaaaaaggagccgtttccgcgaggtgcccagccctggccatggagtccgtccgggggaagcggagatggaggtggagtggcggatccatgctaaagctggcggggctgtgcctcgccgcggccatctgcctgtgcggcgttcggtccctggcttgcgccggcggcagcggctgcaggccgcgtactgtgctgctccgttcagacttttggagacgagctgcagcttcttgcggtaatcaggtgtgctcttgtggcgggcggcaatggcttcggcggcggcggctgctggcggaggggccggggtcctacccgccgcggtgcgcgtccaagtgcggcgactgcagcccgtgctacccggtgcacgtggccgtgccgccgggcgtgccggtgaccaccgagtactacccggaggcgtggcggtgcaagtgcggcaaccgactctacatgccgtgaacgcccggtccgccgcagccggagccaaggagggcgggcgggcggcccgaccggccggtgagcccgtgtcgactccagcgcagcctgccgctctgcgctcgtgcgcagcgccggtcgggcgccgcattattgcgccgggccggtgtggctcgcctgcggcgcgcgcgcaccagcagcgcatgggcgggatctgcagcgcgcgtagtggcgacctaccacaggcccggcccggctgcgatactgaagactgtgcctgtcctttctccgtggggtggggatt

SEQ ID NO: 20865 - protein, 137 aa, Panicum virgatum
  misc_feature: Ceres CLONE 1813444
  misc_feature: SWISSPROT Homolog: EC 3.2.1.15 Polygalacturonase
MESVRGKRRWRWSGGSMLKLAGLCLAAAICLCGVRSLACAGGSGCRPRTVLLRSDFWRRAAASCGNQVCSCGGRQWLRRRRLLAEGPGSYPPRCASKCGDCSPCYPVHVAVPPGVPVTTEYYPEAWRCKCGNRLYMP

SEQ ID NO: 20866 - DNA, 321 bp, Panicum virgatum
  misc_feature: Ceres CLONE 1813444-R
gcgtccaggcatggcgggcgtacggcgcgtcagcgcgtgctggatcgagccgaggagggagacggcgagctgcgacggggagatgctgctctgctgcgggcgggcgggcgggcgggcgggcggcggcccactcctgcacgtgtccggaaactctgttgaagtgttggtgcaccatgtttacaatctcttgttgagctgttttcggacctgagcttgttacaacattttatggtccattttgtagctgaaagtaaatgactcgtactactatctcgtggtactccttccgttcttaaatatatgacaccattgacttttttt

SEQ ID NO: 20867 - DNA, 669 bp, Panicum virgatum
  misc_feature: Ceres CLONE 1813449
  misc_feature: Encodes the peptide sequence at SEQ ID NO. 20868
cagagagagagagcgaaaccctagctcgcggctcgccggatggaccctcagcagccggaaccggtcagctacctctgcggagattgtggagccgagaacacgctgaagccgggcgatgtgatccagtcatctaaacctgttctcagattcgcagctgttcgcacacttaataaggttgcatcaactcatcctttggctgtcacaaattgtaacatagacatggaaagcttaatctctgatcagaacagaagcattgcaacccttgcgattacaacactgttgaagactggcaacgagtcaagtgttgatcgtttaatgaaacagatgaccaactttatgtcagacatagctgatgaattcaagatcgttgttgtcgaagcaataagatccctatgcttgaaattccctctgaaatatcgctcactcatgaacttcttgagtaatattctacgagaagagggtggattcgagtacaagaaagccatagttgattcaatcatcatactcattagagatattcctgatgcaaaagaaagtggtttatttcacttatgtgaattcatagaagactgtgaattcacctatttatccacccagatacttcactttttgggaaatgaaggcccaaaaacatcagatcccagtaaatacatacgatatatatacaat

SEQ ID NO: 20868 - protein, 209 aa, Panicum virgatum
  misc_feature: Ceres CLONE 1813449
  misc_feature (11)..(47): Pfam Name: DNA_RNApol_7kD Pfam Description: DNA directed RNA polymerase, 7 kDa subunit
MDPQQPEPVSYLCGDCGAENTLKPGDVIQSSKPVLRFAAVRTLNKVASTHPLAVTNCNIDMESLISDQNRSIATLAITTLLKTGNESSVDRLMKQMTNFMSDIADEFKIVVVEAIRSLCLKFPLKYRSLMNFLSNILREEGGFEYKKAIVDSIIILIRDIPDAKESGLFHLCEFIEDCEFTYLSTQILHFLGNEGPKTSDPSKYIRYIY

SEQ ID NO: 20869 - DNA, 689 bp, Panicum virgatum
  misc_feature: Ceres CLONE 1813464
  misc_feature: Encodes the peptide sequence at SEQ ID NO. 20870
aaccaactcgggcagtgctcgatcgtcgaccacctcgtcggggcctcgcgcatttatttatccccacgtccgtgtccatgcaacagccgacgagccgcgccaccaccgccgccggccagcttcttcacgccgccgcgatggaggaagcggcctcgttgctctccgtcctgcagctcgccttcacggcggcggtggcgactgccgcgctggccgtcgccgtcgccgccgcgaggtacaaccggcggtaccggggcctcaggctgccccccggcccccccgggtggcccgtcgtcggcaacctcctccaggtggccttctctggcaagctcttcatccaccacatccgcgacctccggcgggagtacgggcccatcctgacgctgcgcatgggggagcgcacgctggtgatcatcagcagcgcggagctggcgcacgaggcgctggtcgagaagggccaggagttcgcgagccggccccgggagaacacgacgcgcaacatcttctcctccaacaagttcaccgtcaactcggcggtgtacgggcccgagtggcggtcgctgcggcggaacatggtgtccgggatgctgagcacgtcgcggctccgggagttccggcccgcgcgggcgcgcgccatggaccggatcgtggcgcggatgcgcgccgaggccgcggcgtcacccgacggcgcg

SEQ ID NO: 20870 - protein, 183 aa, Panicum virgatum
  misc_feature: Ceres CLONE 1813464
  misc_feature: SWISSPROT Homolog: EC 1.14.13.11 Trans-cinnamate 4-monooxygenase
MEEAASLLSVLQLAFTAAVATAALAVAVAAARYNRRYRGLRLPPGPPGWPVVGNLLQVAFSGKLFIHHIRDLRREYGPILTLRMGERTLVIISSAELAHEALVEKGQEFASRPRENTTRNIFSSNKFTVNSAVYGPEWRSLRRNMVSGMLSTSRLREFRPARARAMDRIVARMRAEAAASPDG

SEQ ID NO: 20871 - DNA, 1915 bp, Panicum virgatum
  misc_feature: Ceres CLONE 1813479
  misc_feature: Encodes the peptide sequence at SEQ ID NO. 20872
agttccggcggggcccaccggccagcgagagaaaggagaggagagatcaatggtgttcgtcccctccggccagcagcaagcgagcaatcccatcccatcccatcgaatcgacgacgacgagcgagcaaggtagcagcatcagctaggtaggacttgggaggagggggtgattcgactgcttgcctggcttccctcccctcaaatcgaaatccccatgctgattgatggttgctagcctaggagcccgattccccaatcatcaatttcagttatcttccgccggggtgcgcgcgacaaggttcccttctccttcccttcacacatccaaccaggtacagtacagtacattcccttacctgatttccagtctcagctccagatgtaagtatcatcaacgccagcctcctggaacctggattacagccagccaatgcacactcgtttagagtagaccacaccgcacagccccccctcatcattttgtgatctgtgttgggtactcagatttcacaaggacatgcatcactttgtgatttttgcaaatttctctgttctgctgcccgatacgcattcccttcttcagttttgaacaccgtgaaatgatccttcgatccgacatgggcctcaagggaacagcatcccgcaacccaacaccactgatcaaactgatgccgtcaactcgcctactgctgatgaccaccacaacccggccatcccccgtgtatcaagctgcagcaccgataaggattctggcctttcactttgccgggtctgtcattgtgtcgagcctgatttcagaggtgagtctgccctaggtttcttgggcattgtgccgccttccgccccaaggaccaacaatgacgctaccaagacttccaccagcaaggatgccatcactgggccaaaggatggaaccaatgctcccaggtttgttgagtttataagccccgagggcgagatattcgtacgtgctactgacgtcgaatcaggccccctgcaccaacaagatcatcttgtggatctaggctgttcctgcaagaacgagcttgcccttgcgcattatgcctgtgcattgaagtggttcatcagccatggatccactgtgtgcgagatatgtggaagtatttctgcaaatgtaaggcccgacgacttcaacaaggtcctcgcgtccttgaaggattatgaagctctcagggaaaggacatctacaggggaactctcatacttgcagcatgtggcagacacaggtgttgacccagatgctgttgcagcaatacgaaggcagcggcttagtgagatatcatcttggttcaatcctcataactctcacatggctgtctctcaagggcacgttgatcagccaccacttagtccaagcaataattctgtactggagcaaagtattgtggcagcgaggcgggtacatacaagatggagtttggagagtactggagttcttgttgctattggcctagctgtcattgttcttgcgtggctggttgctccacatgttggcaagaaaactgctgtaattggtcttcacttgcttcttggaggtttatgcgcgttgactctagtgatatccctgagatttgttttcccaagaatccagtatgggtctatgcaatattgggcaatcttgtttgtgtcctggtttcttgtgtttggtgtttgggcctcacgaactcgcagcatacgcacctcatgagcatgtagaatagcgcgagtcactgttgcagagccagattgagttcgccatggcagtgttaggtgctgcattcctgtgtatattcaccatactatccatatcggttgcccgtttaggaagttgttaatttgagatgtatatgcttgacctaagaaaatatggaaaatcatgttatgtttgagatatgctggacctaagaaaagatgg

SEQ ID NO: 20872 - protein, 125 aa, Panicum virgatum
  misc_feature: Ceres CLONE 1813479
  misc_feature: Useful for making plants with modulated nitrogen use efficiency
MAVSQGHVDQPPLSPSNNSVLEQSIVAARRVHTRWSLESTGVLVAIGLAVIVLAWLVAPHVGKKTAVIGLHLLLGGLCALTLVISLRFVFPRIQYGSMQYWAILFVSWFLVFGVWASRTRSIRTS

SEQ ID NO: 20873 - DNA, 668 bp, Panicum virgatum
  misc_feature: Ceres CLONE 1813488
  misc_feature: Encodes the peptide sequence at SEQ ID NO. 20874
gttcttctctctcagcactctaccacctcgctaccctacaatctaaaacctcacacggaaaggaaaaaacgaaaccacaggtgttgcccatcctggtggtcgtgcccaaggtcgcgatggactggctccgacaccctctgagctgggtgttgctggcgtctctggtcttattcctcctgcacctgcggcggtggggcaaggcgccgctgccaccgggccctaagccgctgccgatcatcgggaacatgacgatgatggaccagctgacccaccgcgggctggcggcgctggccgagcagaacggcgggctgctgcacctccgcctgggccagctgcacgtgttcgcggtgtccacccccgacttcgcgcgcgaggtgctgcaggcgcaagacgccgccttctcgaaccgccccgccaccatcgccgtctcgtacctgacctatgatcgcgccgacatggcgttcgcgcactacgggcccttctggcggcagatgcgcaagctgtgcgtgatgaagctcttctgcccgcggcgcgcggagacgtgggtggcggtgcgcgacgagtccgcggcgctggtccgcgccgtggcgtccagcgccggcgagggcgtgaacctgggcgatctcatctttcacctgaccatgaacgtcaccttccgcgccgcgttc

SEQ ID NO: 20874 - protein, 183 aa, Panicum virgatum
  misc_feature: Ceres CLONE 1813488
  misc_feature: SWISSPROT Homolog: EC 1.14.13.88 Flavonoid 3',5'-hydroxylase
  misc_feature: Useful for making plants with altered lignin content
  misc_feature: Useful for making plants with altered cell wall content and/or composition
MDWLRHPLSWVLLASLVLFLLHLRRWGKAPLPPGPKPLPIIGNMTMMDQLTHRGLAALAEQNGGLLHLRLGQLHVFAVSTPDFAREVLQAQDAAFSNRPATIAVSYLTYDRADMAFAHYGPFWRQMRKLCVMKLFCPRRAETWVAVRDESAALVRAVASSAGEGVNLGDLIFHLTMNVTFRAA

SEQ ID NO: 20875 - DNA, 681 bp, Panicum virgatum
  misc_feature: Ceres CLONE 1813492
  misc_feature: Encodes the peptide sequence at SEQ ID NO. 20876
attccccatccacgcttcgcttcccaccctataaagcgctcctcgatccagacctttgctaaaaataacaaggcgcagaggcaacctcgattcgatcctcgctcgcggagatgtctgatgttgaggagtaccgttgcttcatcgggaacctgtcatggtcgacaactgatgagagcctcaaggatgcattcggcaaatttggaaacctcactgaggcaaaggtggttcttgacaaattttctggccgatctcgtggtttcggctttgtaacatttgatgagaagaaagctatggaggatgctattgaagggatgaatggcctggacttggacgggaggaacatcactgtcgataaagctcagccacaagggcctggtagagatcgtaatggtgatcgtgactatgatcgtgaccgtggatctcgttatgaccgtggccgtgactatggtggtggtggtggacgtgcaccacgtggcggcggcggcggcggtggggactgcttcaagtgcggaaaacctggtcattttgctagggagtgcccatctggggatggtgggagaggggatagatatggtggcagagatgacaggtatggtggcggtggtggtggtcgttatggatctgaccgtggtggtgaccgatactctggccgtagccgagatggtggcagctacgggggcg

SEQ ID NO: 20876 - protein, 190 aa, Panicum virgatum
  misc_feature: Ceres CLONE 1813492
  misc_feature (9)..(80): Pfam Name: RRM_1 Pfam Description: RNA recognition motif. (a.k.a. RRM, RBD, or RNP domain)
  misc_feature (128)..(145): Pfam Name: zf-CCHC Pfam Description: Zinc knuckle
  misc_feature: SWISSPROT Homolog: EC 5.2.1.8 Peptidylprolyl isomerase
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: Useful for making plants with altered alkaloid content
  misc_feature: Useful for making plants with altered lignin content
  misc_feature: Useful for making plants with modulated biomass
  misc_feature: Useful for making plants with modulated nitrogen use efficiency
  misc_feature: Useful for making plants with modulated flowering time
MSDVEEYRCFIGNLSWSTTDESLKDAFGKFGNLTEAKVVLDKFSGRSRGFGFVTFDEKKAMEDAIEGMNGLDLDGRNITVDKAQPQGPGRDRNGDRDYDRDRGSRYDRGRDYGGGGGRAPRGGGGGGGDCFKCGKPGHFARECPSGDGGRGDRYGGRDDRYGGGGGGRYGSDRGGDRYSGRSRDGGSYGG

SEQ ID NO: 20877 - DNA, 2104 bp, Panicum virgatum
  misc_feature: Ceres CLONE 1813495
  misc_feature: Encodes the peptide sequence at SEQ ID NO. 20878
ttccagcttcttctccgcctgctctttttccaggatttgtcttttccgcttctgtggcaaagagtgaggagtgagcactaatctgtcaggtgtgagtacttgcaggtcacgagctgaggtgttgtagctgccaagaaatgagccccgagagctgcccggccgcggccggcgacgcgacggcggaggagctgctcgcgcgggcgcgggtgctggtgccaccggcccttgccgcggcgcgcgcggcaaccggcttcggcgggcggtggaaggccatcgcggcgaggctggagcgtgtgccgccgtgcctgtcggacctgtccagccacccctgcttctccaagaactcgctctgccgggagctgctgcagtcggtggccgccacgcttgcagaggctgccgagcttggcgcgcgctgccgcgagcctcccaaggccgggaagctgcagatgcagagcgacctcgatgcacttgcggggaagctggacctcaacctccgggactgcgcccttcttgtcaagaccggtgtgctgtccgacgcgacggttccggcgacccaggctgaggccatggcggcagcgggcggcgcgcagacggatgtgcgggagctgcttgccaggctgcagattgggcacgcggaggcgaagcaccgggcggtggacgggctgcttgacgctctgcgcgagaacgaggagagcgtgctgtcagcgctcggccgtggcaacgtcgccgcgctggtgcagctgctcacggcgacggcgcccaaggtcagggagaaggcggcgactgtcctctgcttgctcgccgagtccggcagctgcgagggcaagcttatgtcagaaggtgcgctgccgccactcatccggctggccgagtccggcagccttgtcgggcgggagaaggccgtcatcacgctgcagcggctgtccatgtcgcccgacattgcccgtgcgatcgtcggccacagcggcgtccgcccgctcatcgacgtctgccagaccggggactccatctcgcagtccgccgcggccggagcactcaagaacatctccgcggtgccggaggtccggcaaacgctggccgaggaaggcgtggtgcgcgtcatgatcaacctgctcgactccggcgtcgcgcctgggtccaaggagtacgccgcggagtgcctgcagaacctgacgtcaagcaacgacagcctgcggcgcgccgtcgtgtccgagggcggcctgcgcagcctgctcgcctacatcgacgggccgctgccgcaggaatcccccgtggcggcgctccggaacctcgtcaccgccgtgtcgccggacagcctggtgtcgctgtgcgtgctcccgcgcctggtccacgcgctccgcgagggctccgtgggcgcgcagcaggcggccgcggcggccatctgcaaggtctccagctcgacggagatgaagcgggtggtgggcgagcacgggtgcatcccgctgctggtgcggctgctggaggtcaagtcgaacggcgcgcgcgaggccgcggcgcaggcggtggcgagcctgatggggtaccccgcgaacgcgcgggacatcaagaaggacgagaagagcgtgccgaacctggtgcagctgctggacccgagcccccagaacacggcgaagaagtacgccatctcgtgcctgctggcgctggcggcgagcaagcggtgcaggaagctgatgatctcgcacggcgccatcgggtacctgaagaagctctcggagaaggacgtcgccggcgccaagaagctgctggagaagctggaccgcggcaggctgcgcaccctcttcagcaggaagtaggcacgatccgaagcagccgcagctagtagtgagtgaagcgctccttcttttcgccgtaaacctgtataaaaatcccgtcctgtttcatagcctcgatgaagtggaagtgcggcagagcggtgaagagagggagagacggagagtagtcgtgttcatgtgaagtgaaacatatcgcgatgtaatttcgctggctaatacgtgtgtcaggcagttcgttcgttagctcctgctcctaagtcctaaccagggttgcagtcccttcctaagtctaataaaaaattcttcaggtg

SEQ ID NO: 20878 - protein, 558 aa, Panicum virgatum
  misc_feature: Ceres CLONE 1813495
  misc_feature (428)..(468): Pfam Name: Arm Pfam Description: Armadillo/beta-catenin-like repeat
  misc_feature (265)..(305): Pfam Name: Arm Pfam Description: Armadillo/beta-catenin-like repeat
  misc_feature (306)..(347): Pfam Name: Arm Pfam Description: Armadillo/beta-catenin-like repeat
MSPESCPAAAGDATAEELLARARVLVPPALAAARAATGFGGRWKAIAARLERVPPCLSDLSSHPCFSKNSLCRELLQSVAATLAEAAELGARCREPPKAGKLQMQSDLDALAGKLDLNLRDCALLVKTGVLSDATVPATQAEAMAAAGGAQTDVRELLARLQIGHAEAKHRAVDGLLDALRENEESVLSALGRGNVAALVQLLTATAPKVREKAATVLCLLAESGSCEGKLMSEGALPPLIRLAESGSLVGREKAVITLQRLSMSPDIARAIVGHSGVRPLIDVCQTGDSISQSAAAGALKNISAVPEVRQTLAEEGVVRVMINLLDSGVAPGSKEYAAECLQNLTSSNDSLRRAVVSEGGLRSLLAYIDGPLPQESPVAALRNLVTAVSPDSLVSLCVLPRLVHALREGSVGAQQAAAAAICKVSSSTEMKRVVGEHGCIPLLVRLLEVKSNGAREAAAQAVASLMGYPANARDIKKDEKSVPNLVQLLDPSPQNTAKKYAISCLLALAASKRCRKLMISHGAIGYLKKLSEKDVAGAKKLLEKLDRGRLRTLFSRK

SEQ ID NO: 20879 - DNA, 695 bp, Panicum virgatum
  misc_feature: Ceres CLONE 1813501
  misc_feature: Encodes the peptide sequence at SEQ ID NO. 20880
aagctgtcatgcactggcattgtgtgccgtttctcctcgctcgtcactagctgcaatggccaccgtcaccacttcttcgccggccactctgcagtcatgcaagcacgctagccacggcgtggtgcggtactgccctcctctcccgtggaggaggaggagctacagccaggtgtcgacaagagccacggcgagctcacatggtcagccctcggcgatgacaggcggccgggtagaggcgcccgttggcatcgccgcggaggcgggggaggagggcgacagtatccggaggctgcagaacgggccggacgtgcgggcagtggacctcacgcctctggcggtcgaggttgtcgcggagagcttcggggagtggctgcgtgaggagctccagcggccggagggcgaggagctgcgggtgtctgtcgggtgcgacccacggctgtcgggcgcaaggctcagcgccgcgctcttcgcggggctcgcgagggcggggtgctccgtgttcgacatgggcctcgccaccacgccagcgtgcttcatgagcaccatactgcctgggttcaactatgacgcgtctattatggtaactcttctgtctagtgtcatttcttgagatagtgtttcacttcttacatgttacgtgcattgatattctcgactagtgcggacgcgaaaaagccgtagagtttctgtcgttc

SEQ ID NO: 20880 - protein, 184 aa, Panicum virgatum
  misc_feature: Ceres CLONE 1813501
  misc_feature (77)..(184): Pfam Name: PGM_PMM_I Pfam Description: Phosphoglucomutase/phosphomannomutase, alpha/beta/alpha domain I
  misc_feature: SWISSPROT Homolog: EC 5.4.2.10 Phosphoglucosamine mutase
MATVTTSSPATLQSCKHASHGVVRYCPPLPWRRRSYSQVSTRATASSHGQPSAMTGGRVEAPVGIAAEAGEEGDSIRRLQNGPDVRAVDLTPLAVEVVAESFGEWLREELQRPEGEELRVSVGCDPRLSGARLSAALFAGLARAGCSVFDMGLATTPACFMSTILPGFNYDASIMVTLLSSVIS

SEQ ID NO: 20881 - DNA, 641 bp, Panicum virgatum
  misc_feature: Ceres CLONE 1813515
  misc_feature: Encodes the peptide sequence at SEQ ID NO. 20882
actcttcctctaaaaaaaaaaaccaccagggccggccaattcacgttccgttcccggtggtcattgtgcgtacatggccggctcgctgcttcgccgcggtgctgccggcacacggcggcggcggaggccggcggacgtgctgaggcgccagttctcctacgaggcgacgccgaagcgggcaacctggtgggcgccgcctgacatgccggagttccaccaccagcaccggccgtacgccgggatgggcggcgccgacatcttagagaagaggaaggccttcctcggtcagtccctcttccacgactacatcaacccgctcagcattgtggaggggaacatgcactatcggtatgacgagcatgagaacacatacctcgattgcttcggcggcatcgacacagtatgctgcgacaattgccctcaggacatcgacaatgatgtgatggaccagacaaagttggtccagcacaaaatcaccaaatacttgcatcttgccattgacgactttgtaaaggcactcatctccaaaatgcatgcgaatatcaacgctgtctattatgtcaattctgagactgaatcgaatgaactggcaatgttgatggaccggctgtataccggggaacctctgcatgattgcactc

SEQ ID NO: 20882 - protein, 189 aa, Panicum virgatum
  misc_feature: Ceres CLONE 1813515
  misc_feature: SWISSPROT Homolog: EC 2.6.1.44 Alanine--glyoxylate transaminase
MAGSLLRRGAAGTRRRRRPADVLRRQFSYEATPKRATWWAPPDMPEFHHQHRPYAGMGGADILEKRKAFLGQSLFHDYINPLSIVEGNMHYRYDEHENTYLDCFGGIDTVCCDNCPQDIDNDVMDQTKLVQHKITKYLHLAIDDFVKALISKMHANINAVYYVNSETESNELAMLMDRLYTGEPLHDCT

SEQ ID NO: 20883 - DNA, 1933 bp, Panicum virgatum
  misc_feature: Ceres CLONE 1813535
  misc_feature: Encodes the peptide sequence at SEQ ID NO. 20884
cttcggtgtggcactgtggcgttggcgcggttggtgactgcagctctgctctccgttctccggtccactccagccggtccttggacgaggaggaggagatcgagcagaggtcctagctgcgcggcggggagcgatggcgggcggcggggtggcggcgcttggggtgcacacggagcgcgccgcgcagtacaagggccgcatgacgctcgccgtcgccatgacctgcctcgtcgccgccgtcggcggcgccatcttcggctacgacatcggcatctccggaggagtgacctcgatggacccatttctggagaagttcttccccgcggtgttccataagaagaactccggcagcaagaacaactactgcaagtacgacaaccagggcctggcggcgttcacctcctcgctctacctcgccggcctcgtcgcctccctcgcggcgtcccccgtcaccaggaactacggccgcaaagccagcattgtctgcggcggcgtcagcttcctcgccggcgccacgctcaacgtcgccgccgtgaacctgcccatgctcatcctcgggcgcatcttgctcggcgtcggcatcggtttcggcaaccaggccgtgccgctgtacctgtcggagatggcgccggcgcacctccgcggcgggctgaacatgatgttccagctcgcgacgacgctgggcatcttcacggcgaacctgatcaactacggcacgcagaacatcaagccgtgggggtggcgcctgtcgctcgggctggccgcggtgccggcgctgctgatgaccctgggcgggctgctcctcccggagacgcccaacagcctcatcgagcgcgggcgcgccgaggagggccggcgcgtgctggagcgcatccgcggcaccgccgacgtggacgccgagtacacggacatggtggaggcgagcgagctggccaacaccatcgagcacccgttccggaacatcctggagcggcgcaaccggccgcagctggtgatggccgtgtgcatgccggcgttccagatcctgacgggcatcaactccatcctcttctacgcgccggtgctgttccagagcatgggcttcggcggtaacgcgtccctctactcctccgtgctcaccggcgccgtgctcttctcctccacgctcatctccatcggcaccgtcgaccgcctcggccgccggaagctcctcatcagcggcgggatccagatgatcgtctgccaggtgatcgtggcggtgatcctgggcgtcaagttcggggcggacaagcagctgtcccggagctactcgatcgcggtggtggtggtgatctgcctgttcgtgctggcgttcgggtggtcgtggggcccgctggggtggacggtgccgagcgagatcttcccgctggagacgcggtcggcggggcagagcatcacggtggccgtgaacctgctcttcaccttcgccgtcgcgcaggcgttcctgtcgctgctgtgcgccttcaagttcggcatcttcctcttcttcgccgggtggatcaccgtcatgaccgtcttcgtgtacatcttcctccccgagaccaagggcgtgcccatcgaggagatggtgctgctctggcgcaagcactggttctggaagaaggtcatgccggacctgccgctcgaggatggctggggcgcagctgagggcaacgctgcgcctgccgacaagaatcacaagtgacatagatagacttatgtgaaagctgagggggcagactgagcctgtagctgtaggaggatgtttactgtatccagcttatgtgtagttttcatcttcagttgttctttttctcctcacctatattatcatagttgcggggggcatacatatacttcatacacatatcatgctgccataggaaacaaggcagaaatgctcttcaagccttgatgattttgtcattttgaattg

SEQ ID NO: 20884 - protein, 522 aa, Panicum virgatum
  misc_feature: Ceres CLONE 1813535
  misc_feature (30)..(488): Pfam Name: Sugar_tr Pfam Description: Sugar (and other) transporter
MAGGGVAALGVHTERAAQYKGRMTLAVAMTCLVAAVGGAIFGYDIGISGGVTSMDPFLEKFFPAVFHKKNSGSKNNYCKYDNQGLAAFTSSLYLAGLVASLAASPVTRNYGRKASIVCGGVSFLAGATLNVAAVNLPMLILGRILLGVGIGFGNQAVPLYLSEMAPAHLRGGLNMMFQLATTLGIFTANLINYGTQNIKPWGWRLSLGLAAVPALLMTLGGLLLPETPNSLIERGRAEEGRRVLERIRGTADVDAEYTDMVEASELANTIEHPFRNILERRNRPQLVMAVCMPAFQILTGINSILFYAPVLFQSMGFGGNASLYSSVLTGAVLFSSTLISIGTVDRLGRRKLLISGGIQMIVCQVIVAVILGVKFGADKQLSRSYSIAVVVVICLFVLAFGWSWGPLGWTVPSEIFPLETRSAGQSITVAVNLLFTFAVAQAFLSLLCAFKFGIFLFFAGWITVMTVFVYIFLPETKGVPIEEMVLLWRKHWFWKKVMPDLPLEDGWGAAEGNAAPADKNHK

SEQ ID NO: 20885 - DNA, 2483 bp, Panicum virgatum
  misc_feature: Ceres CLONE 1813537
  misc_feature: Encodes the peptide sequence at SEQ ID NO. 20886
gccttacctcactttcctcagcctcctttcctggcggcggcgcgcacgtcttcgccggcaacgagcaccaccaggttcctgctgtttcaaggaaaggatcaatggaggcaaagttggcattctcccaggacagcccaccgatttctatcatctgtgcggctaaggttgcgggtatacccctaactgtcgatcctggtcttgctgctggctcggcacccacactacagtttggttctggagaatcactccatggtgtaaacccaatcctccacttcattgcccgtgctgcatcattttccagcttctctgggaagaatgccattgagttcgggcatgttgttgaatggcttgaatatgcccccatattcctttccggctctgaatttgagaatgcctgctcatttgttgatggatacttggcctccaggacctttctggttggtcatgagctgacaattgctgacattgcagtgtggtcgaatcttgctgggattggtcaacggtgggagagtctaaggaaatcaaagaaataccaaaatcttgtccggtggtttaacagcatagacgcagaatacaaggatacactgaatgaaattgtggcatcatatgttgggaaacgaggaattggaaaatctcctgcgccaagccttaaggagaaggtacatgattcaaaggacccatcagctccagaagttgatctcccaggtgcaaaagttgggcaagtttgtgttcgttttgccccagagcctagcgggtacctccatattggtcatgcaaaggctgcattattgaacaaatactttgctgaaagatatcaagggcgcctaatagttcgatttgatgacacaaacccttcaaaagaaagcaacgagtttgtcgagaaccttctgaaagatattgagacattggggatcaaatatgatgctgtcacatacacatctgactattttccaaagctaatggaaatggcagagagtttgattaagcaggggaaagcatatattgatgatacaccaaaggaacaaatgaggaaagagaggatggatggtattgaatcaaggtgcagaaataatactgtcgaggaaaatctgtcattatggaaagagatggttaacggaactgagaggggcatgcagtgctgtgtgcggggtaaacttgacatgcaggatcctaacaagtcactcagagatcctgtttactaccgctgtaatactgatcctcaccattgtgttggttcaaagtacaaggtctacccaacatatgactttgcttgcccatttgttgatgcattggaggaagtgacacatgctcttcgttccagtgaataccatgacaggaatgcacaatattatcgaattctacaagatatggggttgaggagagtagaaatttatgaattcagccgattgaatatggtttacactcttctcagcaagcggaagcttctttggtttgtacaaaacaagaaggttgaagattggaccgatccacggtttcccacagttcaaggtatagtccgtcgtggcttgaaggttgaggcgctgatacaatttatactccaacagggcgcttcaaaaaatctgaatctgatggagtgggataaactgtggacaatcaacaagaagataattgatccagtgtgcgcaaggcatactgctgtgctaaaagatcagagagtgatccttactcttactaatggtccagagaagccatttgttcgaattttgccaaggcacaagaaatgtgaggctgctggaaagaaggctacaacattcgcaaatagaatttggctagattattctgatgcatcagccattagcaagggtgaggaagtaaccctaatggactgggggaatgctatcattaaagagatcaagatggagactggaatgattactgaactagttggagaactacatcttgagggctctgtgaagacaacaaaattgaagaccacgtggctagcagatatagatgagctagtccccctctcattggtggaatttgattatctcatcagcaagaaaaaactggaggaggatgaagactttctcgacaatctcaatccttgcactaggcgtgagaccccagcccttggagacgcaaacatgaggaacctcaagctcggagaagtcatacagctcgagaggaaaggctactacaggtgtgatgccccgtttatcaggtcgtcgaaacctgtggtcctatttgcgatcccagatggtcgacagcaggcttcgctgaactaggtagcatgctactgatgagcacatggaattcctgagatgtcaagcttggcaatcaatattgttgtttacacttaatctggtactgtgattaggcttaccgccgtagattttgttcactactatatggccaggcccatcctgccaaccaagcagcacaggcattttgattttggttgattatacttgcctcagtttgaacatactggtacttttctagcaatactgtttgcatcc

SEQ ID NO: 20886 - protein, 715 aa, Panicum virgatum
  misc_feature: Ceres CLONE 1813537
  misc_feature (207)..(512): Pfam Name: tRNA-synt_1c Pfam Description: tRNA synthetases class I (E and Q), catalytic domain
  misc_feature (514)..(690): Pfam Name: tRNA-synt_1c_C Pfam Description: tRNA synthetases class I (E and Q), anti-codon binding domain
  misc_feature: SWISSPROT Homolog: EC 6.1.1.17 Glutamate--tRNA ligase
MEAKLAFSQDSPPISIICAAKVAGIPLTVDPGLAAGSAPTLQFGSGESLHGVNPILHFIARAASFSSFSGKNAIEFGHVVEWLEYAPIFLSGSEFENACSFVDGYLASRTFLVGHELTIADIAVWSNLAGIGQRWESLRKSKKYQNLVRWFNSIDAEYKDTLNEIVASYVGKRGIGKSPAPSLKEKVHDSKDPSAPEVDLPGAKVGQVCVRFAPEPSGYLHIGHAKAALLNKYFAERYQGRLIVRFDDTNPSKESNEFVENLLKDIETLGIKYDAVTYTSDYFPKLMEMAESLIKQGKAYIDDTPKEQMRKERMDGIESRCRNNTVEENLSLWKEMVNGTERGMQCCVRGKLDMQDPNKSLRDPVYYRCNTDPHHCVGSKYKVYPTYDFACPFVDALEEVTHALRSSEYHDRNAQYYRILQDMGLRRVEIYEFSRLNMVYTLLSKRKLLWFVQNKKVEDWTDPRFPTVQGIVRRGLKVEALIQFILQQGASKNLNLMEWDKLWTINKKIIDPVCARHTAVLKDQRVILTLTNGPEKPFVRILPRHKKCEAAGKKATTFANRIWLDYSDASAISKGEEVTLMDWGNAIIKEIKMETGMITELVGELHLEGSVKTTKLKTTWLADIDELVPLSLVEFDYLISKKKLEEDEDFLDNLNPCTRRETPALGDANMRNLKLGEVIQLERKGYYRCDAPFIRSSKPVVLFAIPDGRQQASLN

SEQ ID NO: 20887 - DNA, 1454 bp, Panicum virgatum
  misc_feature: Ceres CLONE 1813540
  misc_feature: Encodes the peptide sequence at SEQ ID NO. 20888
aaacataacagcaagcaaggcaagctgttctcctcgtctgcccacctgagaggctgagacagcttgctctgcctccgcctggctgcttcgccacctccctcgtccctccccggctccccctctctctacaaatctctccctccacacctctctctccatccgaatttccccgaactccgccccgcgcctttgtcacctttcctcacgcgccgtccgatttgatcgctttgatcgaccaggcatggccgacgagacgaagcaagaagccgcgcccgccgcggcggcggcggccgaggtggccgtgacggaggccgaggagaagcccgcgccggcggccgaggagacggccgtggcggcggtcgaggagaaggccgtggaggcggaggagaaggccgcggaggcggactccgaggaggagaagaaggcggaggaggccctggaggcggccgcgggcgacgaggcggcggtgatcgacggcgccgggtcgttcaaggaggagagcaacctcgtgtccgacctccccgacccggagcgcaccgcgcttgcgcagctcaaggagctcgtggccgccgcgctcgccaacggggagttcgacctgcccccgccgccgccgccggcggcggccaaggaggagcccaagaaggaggagccggccaaggaggaggcgaaggaagaggcggcgccggccaagggcgaggagcccaaggctgagacggcggccgccgaagagcccgccaaggaggaggccaagcctgcggccgaggagcccaaggcggaagctgcggccgaggaggtcaaggctgaggctcccgcgccagaggagcccaaggctgaggctgccccagcggaggagcccaaggccgaggagcctgccaaggaggaacccaaggccgaggcggcgtccgaggaggccaagccatccgagccggaggagaagaccgtcgtggtggccgaggaggaaggcaccaagacggtggaagccatcgaggagaccgtcgtccccgccgcgcccgagccagccgctgaggcggaggcggcgccggcaccggcggccgagccgaaggaggagctcatctggggcgtgcccctggacggcgacgacgagcgcacggacacggtgctgctcaaggtcctccgcgcgcgcgagtttaaggtgaaggaggccatggccatgctcaagtcggcggtgctgtggcgcaagcgcttcggcatcgacgagctcctgggcgccgacctcggcctgccggagctggagaacgtggtgttctaccgcggcgccgaccgcgagggccaccccgtctgctacaacgtctacggcgagttccaggacaaggagctctacgagaaggccttcggtgacgaggagaagcgggagcgcttcctcaagtggcgcatccagctcctcgagcgcggcatccgggagcagctcgacttctcgcccagcggcatctgct

SEQ ID NO: 20888 - protein, 404 aa, Panicum virgatum
  misc_feature: Ceres CLONE 1813540
  misc_feature (258)..(327): Pfam Name: CRAL_TRIO_N Pfam Description: CRAL/TRIO, N-terminus
MADETKQEAAPAAAAAAEVAVTEAEEKPAPAAEETAVAAVEEKAVEAEEKAAEADSEEEKKAEEALEAAAGDEAAVIDGAGSFKEESNLVSDLPDPERTALAQLKELVAAALANGEFDLPPPPPPAAAKEEPKKEEPAKEEAKEEAAPAKGEEPKAETAAAEEPAKEEAKPAAEEPKAEAAAEEVKAEAPAPEEPKAEAAPAEEPKAEEPAKEEPKAEAASEEAKPSEPEEKTVVVAEEEGTKTVEAIEETVVPAAPEPAAEAEAAPAPAAEPKEELIWGVPLDGDDERTDTVLLKVLRAREFKVKEAMAMLKSAVLWRKRFGIDELLGADLGLPELENVVFYRGADREGHPVCYNVYGEFQDKELYEKAFGDEEKRERFLKWRIQLLERGIREQLDFSPSGIC

SEQ ID NO: 20889 - DNA, 700 bp, Panicum virgatum
  misc_feature: Ceres CLONE 1813540-R
  misc_feature: Encodes the peptide sequence at SEQ ID NO. 20890
cggatgctgtcaccgagctcaccatcaagccatcatcaaaagaaaccatcgagatcccagccaccgagaactccacggtcgtgtgggaactccgcgtgctgggatgggaggtgagctacggcgccgagttcaccccagacgccgagggtggctacaccgtgatcgtgcagaagacgaggaaggtgcccgcccacgaggagccgatcatgaaggggagcttcaaggtgaacgagcccggcaaggtgttgctgaccgtgaacaacccggcgtcgaagaagaagaagctgctgtaccggttcaaggtgaagagcaccgccaaatccgcctgaatggtgaccctactacacataatttgatcgccagcccaggtccacaggtccataccgccaccatttgaacatgttgcatgatagtaggaggggagggcaataagagtttctacattctaggccccgttttgtgtcccggttctttgattatttattggcttgctgttctttttcgttttggggttcgcatttgtatgtgtttttacttgaaaaaaccaaagtgagctttgttcttgaggtcaggagagaagtgagagggggtcgctgtggggaggatgttgagggctgaagaacagttgctgctctgtacatctctcactgcttgtacattttttaatctctcttccatcaacatgttgattttagacagc

SEQ ID NO: 20890 - protein, 108 aa, Panicum virgatum
  misc_feature: Ceres CLONE 1813540-R
  misc_feature (20)..(101): Pfam Name: EMP24_GP25L Pfam Description: emp24/gp25L/p24 family/GOLD
  misc_feature: Useful for making plants with modulated nitrogen use efficiency
DAVTELTIKPSSKETIEIPATENSTVVWELRVLGWEVSYGAEFTPDAEGGYTVIVQKTRKVPAHEEPIMKGSFKVNEPGKVLLTVNNPASKKKKLLYRFKVKSTAKSA

SEQ ID NO: 20891 - DNA, 1466 bp, Panicum virgatum
  misc_feature: Ceres CLONE 1813543
  misc_feature: Encodes the peptide sequence at SEQ ID NO. 20892
ccccgcaccacacaggcacacccaccacgcgcagatccaaacgcgacccgagcccgaccaaaccctaagccccgcctccccctccaccccctccgcctccgcgcgagccatggccaagtacggcgagggcgacaagcggtggatcgtggaggagcgcgccgacggcaccaacgtccacaactggcactgggcggagcgcgactgcctcgagtggtcccgcgcgcggctctccgccctgctcgcgggcctcaccgtcctcgacggcgagggcggcctcacgctccgcaccgtcgcgctcgacaagctcgacggcgaggcctacgtcaacatccgcaagggcaaggtcatcccggggtacgagctctcgctcaccctctcctgggaggccgaggccgcctccgaggccggcgccgccaaggtcaccggcgccgccgaggtcccctacctcgccgacgagaacgccgacgaggaccccgacctccgcgtcaccgtccgcggcgacgagaccccgctcgcgcgccgcgcgagggacgccttcctcacccgcggcaagcccctcgtcctcgagaagatccgcgagttcgtcgccgccatggccaagggcggcccggccaaggacaagctcgagtccaagaagacctccgcgaagggcgccgcccccgccgccgcgcctggcgccgccccggctgccaagagggaggaggtccccgcccccgcgccggcggccaaggagaagaaggccaaggggaaggacaaggaggggttcaagacgattgagatgacggagaagttctactgccgcgccaaggacatatatgagatcctgatggacgagaacagatggaaggggttcacgcagagcaatgcgaggatcagcagagaggttggaggggaattcagcctctttgatggctccattaccggcgtcaatgaggagctgcaggaagggaagctgattgcccagaaatggcggtttgggagctggccggatggcctgtattcctcggtgaggttggtcttcaatgagcccgaatctggagttacaatcataaagctcaaacaaactgatgtgcctgaggaagacaagtatggtaattcaactgtggtggagaacacggagaggggctggagagaactcattttccagcggatacgtggagtgttcggttttgggatctaaagaagtgatacagcctgagctgggtctctaatttttacggagtcgggccttggatgccatagttatccatgttttactcacccagttattccatgttgttaaaaggcaaaactcagcataccatgggggttaaaaacatctgttattcatcatgcatgcgtactcttgtttggttggtcaacatgatcgtgttgtgattgtgttgtgtctgccagtgtcacaggatgacacgagtaaatggaccgtagataaagagtgccgtgaattgaagttaggtttacgacag

SEQ ID NO: 20892 - protein, 356 aa, Panicum virgatum
  misc_feature: Ceres CLONE 1813543
  misc_feature (29)..(164): Pfam Name: Aha1_N Pfam Description: Activator of Hsp90 ATPase, N-terminal
MAKYGEGDKRWIVEERADGTNVHNWHWAERDCLEWSRARLSALLAGLTVLDGEGGLTLRTVALDKLDGEAYVNIRKGKVIPGYELSLTLSWEAEAASEAGAAKVTGAAEVPYLADENADEDPDLRVTVRGDETPLARRARDAFLTRGKPLVLEKIREFVAAMAKGGPAKDKLESKKTSAKGAAPAAAPGAAPAAKREEVPAPAPAAKEKKAKGKDKEGFKTIEMTEKFYCRAKDIYEILMDENRWKGFTQSNARISREVGGEFSLFDGSITGVNEELQEGKLIAQKWRFGSWPDGLYSSVRLVFNEPESGVTIIKLKQTDVPEEDKYGNSTVVENTERGWRELIFQRIRGVFGFGI

SEQ ID NO: 20893 - DNA, 971 bp, Panicum virgatum
  misc_feature: Ceres CLONE 1813549
  misc_feature: Encodes the peptide sequence at SEQ ID NO. 20894
aggggcttctcttcccgcgcgcgccgcgccacgcacccggcgtcgctgcgtcactgtagcagcgtcagcgagcggcgactcttgttggttctcgggatcgccagcgctctggattcgacgatcgcagcagcagcggaattcgcctggggatcgtttgggttggttggcggcggccggtatagtggcacgatggacccgctgctgccgggggtggtgaccgtgaaggaggagtggccgccgagctcgccgccgccggaggaggaggtggaggacgtggacgcggcgggggcgccgcggccgatggaggggctgcacgaggtcggcccgccgccgttcctgaccaagacgttcgacctggtggccgacccggccaccgaccaggtcgtctcgtgggggcgcaccggcaacagcttcgtcgtgtgggatcctcatgtcttcgccgccgtgctgctcccgaggttcttcaagcacaacaacttctccagcttcgtccgccagctcaacacctatgtgagtctcctgtcctggcttgccaaatccttgggtttattcgctttgttcttgagtggtactacatttgtgtttgtgagcagtggcggaggctggaatcaccggcagaggctgcttactcctcttcctcccgccccctctttcttcttcttcttctctcccttctttcctcttcttctccctcctcctctcctctaatttccatggagctcatgggggtaggggggccttgagccccccttgcccccacgaaaaatccgcccctgcgtgagagctgctgacgttccaattacgttcataacttgcatcagggagtgcactagcatgagtgatcaatcatcgagtggactgttaaaccgcgtgatttcgcgtcaacatacagagactgaatttccccaacaagatcgcatttccaggagatgttaaattatctgggcaaagtgcaatggagaagaagtcga

SEQ ID NO: 20894 - protein, 172 aa, Panicum virgatum
  misc_feature: Ceres CLONE 1813549
  misc_feature (47)..(146): Pfam Name: HSF_DNA-bind Pfam Description: HSF-type DNA-binding
MDPLLPGVVTVKEEWPPSSPPPEEEVEDVDAAGAPRPMEGLHEVGPPPFLTKTFDLVADPATDQVVSWGRTGNSFVVWDPHVFAAVLLPRFFKHNNFSSFVRQLNTYVSLLSWLAKSLGLFALFLSGTTFVFVSSGGGWNHRQRLLTPLPPAPSFFFFFSPFFPLLLPPPLL

SEQ ID NO: 20895 - DNA, 662 bp, Panicum virgatum
  misc_feature: Ceres CLONE 1813550
  misc_feature: Encodes the peptide sequence at SEQ ID NO. 20896
acaagcgacctgcatcaccaatcctactccgccacaagaaccaccacgccccgatggagaacggcgccggcaacggggtggccgtggcggcggcggaggcctggaacttcgcgccgaacgaggccctcctgggcctgacggcgctctcggtgcgcggcgtgctgggcagggtgaaggccgggatggtggccggcggcggcggggcccggccggtggtcccgatgggccacggcgacccgtcggcgttccagtgcttccgcaccgcaccggaggccgtggacgccgtcgccggcgctctccggtccggggagcacaactcctaccccaccagcgttggccttgagcccgcacggaggtccatcgcgaagtacttatcccgtgatctgccatatgaattatcaccagatgacatctacctgacaagcggctgtactcaagcaattgagataatctgctctgttttagctcgtcctggtgccaacatcttgcttccaaggcctggctacctgttctatgaggcgcgtgctgctttcaatggcatggaagctcggtattttgatcttctacctgagaaggattgggaggttgatattgattgcgtccaagctcttgccgacaagaacaccattgccatggtcattgtcaacccaggaaacccttgt

SEQ ID NO: 20896 - protein, 202 aa, Panicum virgatum
  misc_feature: Ceres CLONE 1813550
  misc_feature: SWISSPROT Homolog: EC 2.6.1.5 Tyrosine transaminase
MENGAGNGVAVAAAEAWNFAPNEALLGLTALSVRGVLGRVKAGMVAGGGGARPVVPMGHGDPSAFQCFRTAPEAVDAVAGALRSGEHNSYPTSVGLEPARRSIAKYLSRDLPYELSPDDIYLTSGCTQAIEIICSVLARPGANILLPRPGYLFYEARAAFNGMEARYFDLLPEKDWEVDIDCVQALADKNTIAMVIVNPGNP

SEQ ID NO: 20897 - DNA, 2517 bp, Panicum virgatum
  misc_feature: Ceres CLONE 1813551
  misc_feature: Encodes the peptide sequence at SEQ ID NO. 20898
gttttcttctcccattcgctcacccaatgcaaaccacgtaccccaaacgagacctagcagctctcccttcttcgctctgatttgcgtggtccatggagctgagcaggtctagaagctcgccctcggcagcaagctgctgatggcggtgtggcgtgccgcgacgtttcgtgcgcgcgcgcaatgggtgcgtgacacgttcaagtaatcgagctgtttggatcggatctgcgtgctcatgggagacgaaggcggcggcggaagcgagctatatctgctcagccgcttcgcggcatcctcgtcgtcgtcggcggctcagctgagaggcagggaaagggccatggatcaccaccaggacctgtcggcggagctggacccggcgctgctcatgtccgcgtccacgtcctcctcgtcgccgccggactccgcctctccctccttctccttctcccacccgtcccctccacactacaccctcgccgtcagcaacctctcctgccccgcgcctcgccgccgcgcctccatcctgccgtccttcctgtcctcctgcttctccacctccccggccaccgacgccagcggcggcggcgagaggctgctcctcaagtccgtgtccttcaccgcctccagctccaacatcctcgccgtcgtgggccccagcggcgccggcaagtcgacgctgctccgcatcctgtccgggcgcggcacggggtccgagatcgccaggccggggacggtgtcgctcaacggccacgccgtcacctcccgcgcgcagctgcggcggctctgcgggttcgtcacgcaggacgacaacctgctgccgctgctcacggtccgcgagaccatcctcttcgccgcgcggttccggctccgcgccgccgccaccgcgcgggagcgcctcgaccgcgtggaggcgctgatgcaggagctgggcctgtccgaggtggccgacagctacgtcggcggcggcggcggggcgcgcggcgtgtccggcggcgagcggaagcgggtgtccatcgcggtggacatggtgcacgacccgccggtgctgctgctggacgagcccacgtcggggctggacagccggtcggccgtggacgtgctggcgctgctgcgcgaggtgtcccgcgcgcggcggcaggtggtggtgctcagcatccaccagcccagctaccgcatgctcggctacatctcctcgctgcttctcctctcccgcggcgccgtcgcgcactcgggcacgctcaagtcgctcgaggacgcgctggcgcggcttggccacaagatccccgtgcagctcaacccgctggagctcgccatggagatggaggtcaccggcgagctcgcggaggaccgccgccgccgcggcgccgggttcctcgacgacgaggacgcgatgagcagcctcctcgacagcagcagcaacgccggccggcgcctcgacgtccccgaccgcggctactgcagccgcgccacggaggtctcggcactgaccgtgcgctgctggcgcaccatggtccgcacgcgggagctcttcgcggcgcgcgccgcgcaggccgtggtgggcgggctcggcctcggcagcgtctacttccggctgcgccccgacggccccgacggcgtggcgctccggctggggctcttcgccttcaccctgtccttcctcctctcctccaccgtggaggcgctgcccatcctcctccacgagcgccgcgtgctgatgcgggaggcctcccgccgcgcgtaccggctctcctcctacgtggtcgccaacgcgctggtcttcgcgccgtgcctcctcgccgtggcgctcctcttctcggggcccctctactggctcgcggggctccgcgcggcgccgctcggggccttcgccctgttcgtgctcgccgtctggctcatcgtgctcatggccagctccctggtgctcttcctcagcgccgtgtcgccggacttcgtgctgggcaacgccctcatctgcgtgtgcctgggcgtcttcttcctcttctccggctacttcatccccaggggcagcatcccgaggtactgggccttcatgtactacgtgtccatgtacaggtacccgctggacctgctgctcatcaacgagtacgggggcagcgcgaggggcaggtgcgtggagtgggtgggggggaacgccgccatggccggcggcggcgtgtgcttgcggacgggagccgacgtgctcagggacaggggcatcgacgaggtgatgaagtgggccaacgtcggggtcatgctggggttcttcctgctctacagggtcatgtgctgggccgtgctcgtcaggagggcctccaagaccaccctgtgactgtgatcgatctctggcatcgcttctcttctcttcagggtttcgattgttcattcagtcaggggaagacctgtagtactctgtttcagcaggcatcgtcttctgtttcgaggtcactagttgattaagttatattggttcatgtaatatctctgtattgtattcctttttactattatctttgggtt

SEQ ID NO: 20898 - protein, 697 aa, Panicum virgatum
  misc_feature: Ceres CLONE 1813551
  misc_feature (412)..(624): Pfam Name: ABC2_membrane Pfam Description: ABC-2 type transporter
  misc_feature (132)..(327): Pfam Name: ABC_tran Pfam Description: ABC transporter
  misc_feature: SWISSPROT Homolog: EC 3.6.3.28 Phosphonate-transporting ATPase
MGDEGGGGSELYLLSRFAASSSSSAAQLRGRERAMDHHQDLSAELDPALLMSASTSSSSPPDSASPSFSFSHPSPPHYTLAVSNLSCPAPRRRASILPSFLSSCFSTSPATDASGGGERLLLKSVSFTASSSNILAVVGPSGAGKSTLLRILSGRGTGSEIARPGTVSLNGHAVTSRAQLRRLCGFVTQDDNLLPLLTVRETILFAARFRLRAAATARERLDRVEALMQELGLSEVADSYVGGGGGARGVSGGERKRVSIAVDMVHDPPVLLLDEPTSGLDSRSAVDVLALLREVSRARRQVVVLSIHQPSYRMLGYISSLLLLSRGAVAHSGTLKSLEDALARLGHKIPVQLNPLELAMEMEVTGELAEDRRRRGAGFLDDEDAMSSLLDSSSNAGRRLDVPDRGYCSRATEVSALTVRCWRTMVRTRELFAARAAQAVVGGLGLGSVYFRLRPDGPDGVALRLGLFAFTLSFLLSSTVEALPILLHERRVLMREASRRAYRLSSYVVANALVFAPCLLAVALLFSGPLYWLAGLRAAPLGAFALFVLAVWLIVLMASSLVLFLSAVSPDFVLGNALICVCLGVFFLFSGYFIPRGSIPRYWAFMYYVSMYRYPLDLLLINEYGGSARGRCVEWVGGNAAMAGGGVCLRTGADVLRDRGIDEVMKWANVGVMLGFFLLYRVMCWAVLVRRASKTTL

SEQ ID NO: 20899 - DNA, 1273 bp, Panicum virgatum
  misc_feature: Ceres CLONE 1813571
  misc_feature: Encodes the peptide sequence at SEQ ID NO. 20900
aacgcacacaagcaccctagctactagacatcacaagcaagcatcccacaaatatattcctgtgagagtggtggccatggctaacccttcctattaccagacctgtgcgcccgttaggtcacaggtgcagcagcaggagcatgtcttccacctctacgcgcaccagcagatgtgcagcaacgagtacaacatcgtgccggcgaagagcggactccccaaccattttggttccacaaacgttacggactgggatctgcgcggttctccagacaccgtttcaacggttgttgcgcggttgcagggcgtcggcatcgccgcaaggaagagcagcgaaagctggtatctctcttccatcatagcgttcaccgatcagaggttcaaggggtccaccctcagtgtgcaaggacttattggccccgcgagtagtggagatgaaggtgattgggcagttgtagggggcactggggagtttgtttatgcacaaggtacttgcaagtataaaaggattcagaccgttgccggagggcttatcaacgagcttcgcattcgtgttgtgtgcctcaccttaccaaagccgaagcccgtccagaagattgggccgtggggtgggaatggagggaaagcctacgaactccaagatggagaactacctcagcgccttgaaagcctaaccatctacgctgacgatttcatccaatccattgcgttttcctacatcgaccaagctggccagaagcggactgttggtccgtggggtggtagcaatggaaagtctgagtacccgaccatacagttcggtccttcggagagtgtgatggtgatctacggggcaactggtaattacggagggaacactactgtcgtgacatcgctgaccattgtcaccaatgtcagcacctacgggccatacgggaaacactccatgggcaatactccgttccatgtgcagcccccgagcaaccacagcattgtggggttctatggccgtgttggccaagttctccaccagattggagcatacgtgaccgagaactagtgccagcaagtgcttctcgtcacaagaatactcataatgaaggcttcatcaagcactccatgcatgcatgtcttccgcttttaatttttaatgttcaaatagtaatgagaagcaggacacgggctgtcctgatatgatcaatctccatgcatgtactagttggtttcgtcactgtgtcatgctacaggctccatgcatgtcgctagcctgagaaataaattaagtgtcggtgttatt

SEQ ID NO: 20900 - protein, 319 aa, Panicum virgatum
  misc_feature: Ceres CLONE 1813571
  misc_feature (183)..(318): Pfam Name: Jacalin Pfam Description: Jacalin-like lectin domain
  misc_feature (3)..(159): Pfam Name: Dirigent Pfam Description: Dirigent-like protein
MANPSYYQTCAPVRSQVQQQEHVFHLYAHQQMCSNEYNIVPAKSGLPNHFGSTNVTDWDLRGSPDTVSTVVARLQGVGIAARKSSESWYLSSIIAFTDQRFKGSTLSVQGLIGPASSGDEGDWAVVGGTGEFVYAQGTCKYKRIQTVAGGLINELRIRVVCLTLPKPKPVQKIGPWGGNGGKAYELQDGELPQRLESLTIYADDFIQSIAFSYIDQAGQKRTVGPWGGSNGKSEYPTIQFGPSESVMVIYGATGNYGGNTTVVTSLTIVTNVSTYGPYGKHSMGNTPFHVQPPSNHSIVGFYGRVGQVLHQIGAYVTEN

SEQ ID NO: 20901 - DNA, 1261 bp, Panicum virgatum
  misc_feature: Ceres CLONE 1813577
  misc_feature: Encodes the peptide sequence at SEQ ID NO. 20902
agccagcagcaagcgcctccctgtactggatttcacacccacctccctccgcctccgcgcaccaccaaaccctagatctcgcaccggcggcggcagcagcagcagccatggccaagccctggggcggcgtcggcgcgtgggcgctggacgccgagcgcgccgaggaggaggagcgcgagcgcgccgcggccgtcccggcgcccgtgcccgccggcggcgccgccagcttccccagcctcgcggaggcggccgccgcgggcggcgggggcaagtccaagaagaagagcaagggcaccaccctgtcgctctccgagttcaccacctacggcgcggcagcggcgcagcgccgcgccgctcccgtggagcccaggggcctcacccctaacgagatgatgatgctgcccacggggccccgggagcgctccgacgaggagctcgaccgctcccgcggcttccgctcctacggcggcctcgggggaggcgagcgccgcggcttcgacgacgagggccgccgcgggagcaggagctcggatctcgacatgccctcccgcgccgacgaggtggacgattggggggccactaagaagttcaccccggctgccaccgactccggccgccgcgacaggtycggcgggccgtccccgctcggccgcgcggatgacattgacgactggtcgcgcgacaagaagccgctcccgtcgcgctaccccagcctcggttccggtggcgccggcggcggattccgcagctcgtccggcttccgcgactcaccgggcttccgtgactcaccggcttcctctgattccgaccgttgggtccgtggagccacccctatgccccacaacggcgagggggcgggggagaggccgcgcatcgttctcaatcctccgaaacgtgatcctgcagctacatctacgccacctgccgaggtggcacgcaaccggccaagcccatttggggccgcaaggccccgggaggatgtgctggccgagaagggagttgattggaggaagttcgagagtgagattgaacagaagaccagtcggcctaccagctcgcactccagcaggccaaatagtgcgcattcctcccgccctgggagccctgggtcccaggtttcagcggttggaagtgagggagcgcccagggcaaggccaaaggttaaccctttcggtgatgccaagccaagggaagttgttttgcaggagaaaggggaagattggaggaagattgaccttgagctggagcatcgtgctgtaaa

SEQ ID NO: 20902 - protein, 384 aa, Panicum virgatum
  misc_feature: Ceres CLONE 1813577
  misc_feature (1)..(384): Pfam Name: eIF-4B Pfam Description: Plant specific eukaryotic initiation factor 4B
  misc_feature (174)..(174): Xaa is any aa, unknown, or other
MAKPWGGVGAWALDAERAEEEERERAAAVPAPVPAGGAASFPSLAEAAAAGGGGKSKKKSKGTTLSLSEFTTYGAAAAQRRAAPVEPRGLTPNEMMMLPTGPRERSDEELDRSRGFRSYGGLGGGERRGFDDEGRRGSRSSDLDMPSRADEVDDWGATKKFTPAATDSGRRDRXGGPSPLGRADDIDDWSRDKKPLPSRYPSLGSGGAGGGFRSSSGFRDSPGFRDSPASSDSDRWVRGATPMPHNGEGAGERPRIVLNPPKRDPAATSTPPAEVARNRPSPFGAARPREDVLAEKGVDWRKFESEIEQKTSRPTSSHSSRPNSAHSSRPGSPGSQVSAVGSEGAPRARPKVNPFGDAKPREVVLQEKGEDWRKIDLELEHRAV

SEQ ID NO: 20903 - DNA, 621 bp, Panicum virgatum
  misc_feature: Ceres CLONE 1813577-R
ctgaccagccctcgttagatgccaaaaatttgtctgagaagatatctcagttggaaaatcaactcgagcagcttacaagggagttggatgacaagattcgatttgggcaaagaccgcgttctggtgccggcagggttacagcgcatccaccaactggtttagtggaggaaccacaagctacagttgtggacagaccgcgttctcgtggtatggaaccaccacccccaagggcggaagaaagatggggatttcaagcaagcagagaaaggggctcttttggtggaagcagaagttcagataggccagtgacgaggcagcgatggtgaaattgggactccgggcatctgttaattgttagggaaactttttgattcccagtccctttttggttttgaaaaggatacgcagaataagtaattttgtgttcgtcatgcttgtttggtctagaagattggagaggatggagataactccacatgaagttattgattgtcacctctgtatgctgtagaatgtttttcatttcccttttttgcaatcgtccatgtcaaaacaagacctggcaacttgcgatactaactgttattcatgcctactgaattcaagttcagcttttgtcgc

SEQ ID NO: 20904 - DNA, 1790 bp, Panicum virgatum
  misc_feature: Ceres CLONE 1813578
  misc_feature: Encodes the peptide sequence at SEQ ID NO. 20905
gaagcgcctcttcctctccatggtccgtgcctcaatatccacttgccctctcgggctctcgcacacaccctcgctcaccatggcggcgctgtgctccgcctccccggccatctccacggtggcgtctctcggacttcccgcgggccgggtcgcctccctcctccgcctgcgcgccgcctcgcgttcctactccgccgccgcagcaccacgggctgctactgcgggggcgccgtcgtggcgagcgcgccggagattcgcggcgtcggcggcttccacgacagaggagtgttctggagtagatacgatgatcacacccgacaatcgcatccccgccaccatcatcaccggcttcctaggttccggcaagacaactttactgaatcacatcttgactgctcaccatggaaagcgaattgctgttataaaaaatgagtttggagaagtagacatcgatgggtcactagttgctgcacaaactgctggagctgaggacataatgatgctaaataatggctgcctttgctgcactgtgcgtggtgatttagtccgtatgattggtgaattggtcaacaagaagaaggggaagtttgatcatattgttattgaaacgacaggtttggctaatccagcgccaattatacagacattctatgcagaggatgtagtttttaatgatgtcaagctggatggtgtggtaactttagttgatgcaaagcatgctagattgcatttggatgaagtaaagcccaagggtatagtcaatgaagcagttcagcaaattgcctatgctgacaggattatagttaacaagattgatcttgtaaatgaacctgaagtttcttccttggttgagcgtataaggggtattaatcgcatggctaatttgaaacgagctgagtatggcaaagttgatttagattatgttcttggaattggaggatttgatcttgagaggattgagagtgctgtctctgaaaaatcacacgaagaccacaaggaacatgaccatcatcatgagcatgagcatgaccacgaccatcaccatcatgaccatgaccatggacacgaccatcatgcacatgatcatacccatgatcctggtgtttcttctgtgagcattgtttgtgaaggggagatggatcttgaaaaggctgacatgtggttggggaatctactgctggaacacagtgaagatatatacaggatgaaaggactgctttctgtcagtggaatgcctcaacgattcgtgtttcagggagtgcacgacattttccagggatcacctgagaggatgtgggagccaaatgagccacgcatcaacaagattgtcttcattggaaggaacctcaacaaagaagagctggagaagggcttcaaggattgcctgctgaagaaatagaccgagtctagcttctatgattttccaacatacgggatggatctccagcttcatgattttgagctttgcggctgcagaacttatccttgagaaaccaagtatcgaactgacgtgaagtgtgagattttatagaatggatagcttcattgcaaccctgcatccttctacaacaacacaacagcagtgcagtagccatttatatcacagtatcaatgcaccttcatctcagtgcacggtgttgaactgtaaactctagatctagagatagattaagactttcagtgtggcccgaggaaatcgcataagcgcatttgcgatacttcatggaatattactaatgtactatgtattattaactgggaggtgttcaaatttaaagcatctttacctc

SEQ ID NO: 20905 - protein, 439 aa, Panicum virgatum
  misc_feature: Ceres CLONE 1813578
  misc_feature (84)..(271): Pfam Name: cobW Pfam Description: CobW/HypB/UreG, nucleotide-binding domain
  misc_feature (342)..(436): Pfam Name: CobW_C Pfam Description: Cobalamin synthesis protein cobW C-terminal domain
MAALCSASPAISTVASLGLPAGRVASLLRLRAASRSYSAAAAPRAATAGAPSWRARRRFAASAASTTEECSGVDTMITPDNRIPATIITGFLGSGKTTLLNHILTAHHGKRIAVIKNEFGEVDIDGSLVAAQTAGAEDIMMLNNGCLCCTVRGDLVRMIGELVNKKKGKFDHIVIETTGLANPAPIIQTFYAEDVVFNDVKLDGVVTLVDAKHARLHLDEVKPKGIVNEAVQQIAYADRIIVNKIDLVNEPEVSSLVERIRGINRMANLKRAEYGKVDLDYVLGIGGFDLERIESAVSEKSHEDHKEHDHHHEHEHDHDHHHHDHDHGHDHHAHDHTHDPGVSSVSIVCEGEMDLEKADMWLGNLLLEHSEDIYRMKGLLSVSGMPQRFVFQGVHDIFQGSPERMWEPNEPRINKIVFIGRNLNKEELEKGFKDCLLKK

SEQ ID NO: 20906 - DNA, 2119 bp, Panicum virgatum
  misc_feature: Ceres CLONE 1813581
  misc_feature: Encodes the peptide sequence at SEQ ID NO. 20907
acacggcactgcaaccacgttcgctgagcgcggtaggcgccacctagcagacatacttgggttcgctagctgcaaggctgctgcctgctggccgagatcgattccacccgaccatcaggaggtccgtcatgatctgcggattgagatcgtctcgttaaattgtgccagggccgaggcgctgcttgagcgcaggtagcgtgtgaatgaagtgtggcaattcacatgcataatcacattcgcaatgcttctatcgcttgccctcctgctgttgctgtgccaaggaaccgggcacctctacggccacggccacagcagccgtgacatgctcgcgctactcgatttcaagaaggccatctccggcaataagccgaacagagccttgagctcctggaacacgagcacccctttctgccagtggaagggagtcttatgctcgagggagcaccccgggcgtgtcgtcaagctacaccttcaccaccaaggcctgtcggggcctatttccccgtacctcggaaacctgacgctgctcagggaactaaacctctcccgcaacaacttgtctggccggtttcctcctctcaaccgtcttcacgccttggaggtcattgatctggcagaaaactcgctgcgtggcacaatcccgggtgcgctcgcaaactgttccaacctgcgaaggctaaaccttaccgggaatcttctagctagcgaggttcctcgagagctgggtctcctcgccaacctcgaggaactagtgcttaaagggaacaatctcagaggagccatccccacaaccatcagcaacatcactggtctaaaactgatcgtcctgtcctacaatcagctcagggggagcatccccaatgagctagggacgaagctaccgggtttgtcggggctgtaccttacttataaccacctacgaggccatgtaccaccgtccctcttcaaccgttcctcccttcatgcgctaaccgcgtatggcaacaggctagcgggagtgctgccaaaaaacattggcaatgccctgccgaatcttgaagtacttcactttggttgcaacatgttcggaggccacatcccagcttcgctgggcaatgcttcgaagctaacgaggatagatttcatggacaacagtttcgctggtgcaattggcgaatggattggaaagttgactaacctagaatatatatatcttgaaggcaacagcttcagcggcccaatcccctactctattagcaatctaagccagttgaaagtattggagttgtcatctaacaatttctctggtacaattggcaaatggattggaaagttgactaacctagaatatatatatcttgaaggcaacagcttcagcggcccaatcccctactctattagcaatctaagccagttgaaagaattggagttgtcatctaacaatttctctggtacaattggagaagggattggatagctgacgaaactagattacttgaaactcgaagagaacaacttcatcgaccactgccatcctctattagcaatcttgtactcaaatgcagtcactatctctagccaacgacaactttcgtggtatcttgccttagcaaacaactacttccgaggtatcataccgtaagtcttttacaggttgagtccctttgggatgttactctgccgggacctccgatccattgcccatcgatgaaggtcaagtcgacagttcttactgcccttctttggaacttgtggaaatgtcgcaatgctctggtcatcatctaaacaaatgtcgcaatgctctggtattctctcatattcaagaatccaatgaggaggttttccgccgttgcgcgtctgatttgcgctgttgggaaggcagacttcgttctcctgatgataaagtttgtttagaggactggagtgtttttcttccttttaatcccatgtatgtaatttgtttttttttttgctcttccggtcccttgggcggtcagaactctcttgtacctctgcttggttaatatatggttcgggctggtccaatgggcccgccgtagttcgcctaaaaaaaatcatactgtaaatccaaacctacaatttttacacatgaaataaagtttctgccaaccttttcccg

SEQ ID NO: 20907 - protein, 404 aa, Panicum virgatum
  misc_feature: Ceres CLONE 1813581
  misc_feature (24)..(65): Pfam Name: LRRNT_2 Pfam Description: Leucine rich repeat N-terminal domain
  misc_feature: SWISSPROT Homolog: EC 2.7.11.1 Non-specific serine/threonine protein kinase
MLLSLALLLLLCQGTGHLYGHGHSSRDMLALLDFKKAISGNKPNRALSSWNTSTPFCQWKGVLCSREHPGRVVKLHLHHQGLSGPISPYLGNLTLLRELNLSRNNLSGRFPPLNRLHALEVIDLAENSLRGTIPGALANCSNLRRLNLTGNLLASEVPRELGLLANLEELVLKGNNLRGAIPTTISNITGLKLIVLSYNQLRGSIPNELGTKLPGLSGLYLTYNHLRGHVPPSLFNRSSLHALTAYGNRLAGVLPKNIGNALPNLEVLHFGCNMFGGHIPASLGNASKLTRIDFMDNSFAGAIGEWIGKLTNLEYIYLEGNSFSGPIPYSISNLSQLKVLELSSNNFSGTIGKWIGKLTNLEYIYLEGNSFSGPIPYSISNLSQLKELELSSNNFSGTIGEGIG

SEQ ID NO: 20908 - DNA, 1476 bp, Panicum virgatum
  misc_feature: Ceres CLONE 1813587
  misc_feature: Encodes the peptide sequence at SEQ ID NO. 20909
accgagaaccaggtccacggcggcacgccatctcttcttcctcctctcatcgtcatcgcgggggctgctcctcttcctcccggccttccaaacccaccgccccgccggagcccgcccgctagctcggcgccgcttcgaggctcccccgcggccgctgcatttgcgggtgacgtctgctacgagagccgcgggcggctgtgagacgggaggtgcgcggtccttggttcgctgcggctgcggcgagctgctccgcgcggccgggcctgggactggaaattcttgcatatattcatcccgttattggtactccggttgctgttgagtgattgggaaagctgattgaccagaagcattcttggtcatgggaagcaatgaccctagcacacaggctccaaaggcatcagaacaaattatgtagctgaagaactattttaagtcaatttggtgcctttgatgctactacattacaggatcaaccttcagccactacatccggggcaacagcttcagtttaccctgagtggcccagctttcaggcctactcagcaattccaccacatggattctttccccctaccgtcgctgcaaatccacaggctcatccatacatgtggggagctcagcccatggtgccaccgtatgggacgccgccatcaccttatgtgatgtatccacctggaacagtatatgcccatccctctacaccacctggtatgcatccatttagtcattatcctatgccaacaaatggacatgctgaaactcctggagctgcgccaagtgcttcacaaatgaacggaaaaaatgagcctggcagaatgtctgctccatctgccaatgggattacctcccacagtgagagtggaagtgagagtgagagtgaaggaagtgatgccaattcccaaaatgattcacactcaaaggacaatgatggaaaggaagacggcagttctcagaacagcatatcttattcagcatcacagggaatgttaaatcaaaccatgccgatgattccaatacaaccgggcgcgatggttggagttccaggctccacagctaacttgaatattggaattgactactgggccgctcctggttctgcaactgtccctgcaacacagggcaaagcaacttctggttcagcacgaggagatcaatgggacgaaagggaactcaagaagcagaaacgaaagcaatctaatcgagaatcagcacgcaggtcccggctgcgcaagcaggctgagtgcgaggagcttgggcaacgtgctgaatctttaaggtcagaaaactcctctcttagagctgagcttgaacggattagaaaggagtacgaacagttactttcgcagaatgcttccctcaaggaaaagctgggggcaaccagtgattctattcctgacatgaatgagcagaacgacagcggkggcagcggctacaagaagcagcctgattccgatgcccagcckgggaacgagc

SEQ ID NO: 20909 - protein, 283 aa, Panicum virgatum
  misc_feature: Ceres CLONE 1813587
  misc_feature (180)..(243): Pfam Name: bZIP_1 Pfam Description: bZIP transcription factor
  misc_feature (1)..(96): Pfam Name: MFMR Pfam Description: G-box binding protein MFMR
MVPPYGTPPSPYVMYPPGTVYAHPSTPPGMHPFSHYPMPTNGHAETPGAAPSASQMNGKNEPGRMSAPSANGITSHSESGSESESEGSDANSQNDSHSKDNDGKEDGSSQNSISYSASQGMLNQTMPMIPIQPGAMVGVPGSTANLNIGIDYWAAPGSATVPATQGKATSGSARGDQWDERELKKQKRKQSNRESARRSRLRKQAECEELGQRAESLRSENSSLRAELERIRKEYEQLLSQNASLKEKLGATSDSIPDMNEQNDSGGSGYKKQPDSDAQPGNE

SEQ ID NO: 20910 - DNA, 676 bp, Panicum virgatum
  misc_feature: Ceres CLONE 1813600
  misc_feature: Encodes the peptide sequence at SEQ ID NO. 20911
ttcgcagagactcgacaaacggagagatgaggcgtggctaccgcagcagcagcggtgtgctggtttggctggtgctcgtgcacacatgcttcgaagcacctcgggttcaggctcagcaagcagcaagaactgctccgatcgaagcggcggcgctcaacacaatcctggggagatggggatggaaggcgacgcggtcgccggcgtggaacatcaacggcgagccctgcaacggcgccgccgtcgacgacggcgtggggctcgacggcaacaacgagttcaacccgggcatcaagtgcgactgttccttcaacagcaacaccgtctgccacatcaccatgctgaaggtatacgcattgaatgttgtcggtcagataccttcagaactgcagaacctcacctacctaacttacctgaacctggatcaaaattacttgctgggtccaattccatcattcattgggcaattttctggaatgcaacacttgagcctgggattcaatccattctctgggccacttccaaaggaacttgggaatctcacgaatctcaatttgctaggtatcagtttggacaattttagcggtggacttcttgaagatctgggcaatctgtccaaacttgagcaattgtacattgatagtagtggctttagtggtcccttcccttcaacgttctc

SEQ ID NO: 20911 - protein, 216 aa, Panicum virgatum
  misc_feature: Ceres CLONE 1813600
  misc_feature: SWISSPROT Homolog: EC 2.7.11.1 Non-specific serine/threonine protein kinase
MRRGYRSSSGVLVWLVLVHTCFEAPRVQAQQAARTAPIEAAALNTILGRWGWKATRSPAWNINGEPCNGAAVDDGVGLDGNNEFNPGIKCDCSFNSNTVCHITMLKVYALNVVGQIPSELQNLTYLTYLNLDQNYLLGPIPSFIGQFSGMQHLSLGFNPFSGPLPKELGNLTNLNLLGISLDNFSGGLLEDLGNLSKLEQLYIDSSGFSGPFPSTF

SEQ ID NO: 20912 - DNA, 548 bp, Panicum virgatum
  misc_feature: Ceres CLONE 1813622
  misc_feature: Encodes the peptide sequence at SEQ ID NO. 20913
aatccccccaagcactctcctcggatcagatcccctccattggattggatctcctcttctccttcctgtcggagcaaggccaggtgctccggctctctctatcagtcgccatggacgatgaggaacttgttgatcaaaagaagtatcttgaggaacgatgcaagccacagtgtgtaaaatcactttatgagtatgataaatgtgtcaagagagtcgagaatgatgatactggacacaaacactgcaccgggcagtattttgattactggtcatgcatcgacaaatgtgtagcaccaaagctgtttaagaagctaaagtgatgtctgtggtggtgcttttggcaagtgactcagatgatgcatgatgctactttcggcgagcgacttatccatttgcgttaaccttggcgcctttggaacttggctgagctcccgaactgttatgtttgtgccttgattctgtgaacttgtaataaaccaacaattttccttcccaagcatgtgtgttcctttggacttagcatggataagttgatgtttgctgaatct

SEQ ID NO: 20913 - protein, 69 aa, Panicum virgatum; identical to SEQ ID NO: 14253
  misc_feature: Ceres CLONE 1813622
  misc_feature (7)..(69): Pfam Name: UCR_hinge Pfam Description: Ubiquinol-cytochrome C reductase hinge protein

SEQ ID NO: 20914 - DNA, 1494 bp, Panicum virgatum
  misc_feature: Ceres CLONE 1813630
  misc_feature: Encodes the peptide sequence at SEQ ID NO. 20915
gtccctcagaaaacccctaggccctagcccagtcgcacactcgggaagcggcggcggcgagcacgcgcgaggcagcggcggcgagaagctacccagcaaggcgcggcggcgttggaggcgatgagtatctcaggagagctccctggcgaaggctccgacggcgaggaggaggtcttcatcaacgaggaggacatcatccacgagataaccatcgacgaacaagatctccccgaccgcgacgacgaagatgaagacggcggcgaccggatggatgattcagaagacgtcgatgattctgcatacatatttcagggccacaaagatgaagtcttcactgttgcgtgcagtcctacagatgcatctcttgtggcttctggaggcaaagatgatagagggtttctgtggaggattggatcagcagagggtgctttggagttgactggacatagcgatactgtcagcacagtagcttttagttcagatgggaatttgttggcctgtggaagttttgatgggcagataaatgtgtggagtactgctacgcgttctcttcagggaacccttgagggttctgggtctggttttgagtggcttaaatggcatccacggggacatttgataatcgcaggatcagaggactgtaatgtgtggatgtggaatgctgaccataataccattttaaatacctttgctggacatagtagcacagtgacatgtggtgattttactccagatggtaaacttatgtgtactgggtcggatgatgcaactttgaggatatgggacccaagaagtgcacaaagcagacatgttgttcgaggccatggctatcatactgatggattgacatgcttatcaatcactttggactcacaaacagtagttagtggttccaaggataattctgtgcaccttgtgaatgtgaactcgggccaggtcgttggctcattagttggacacagtaattcaattgagtgtgttggcatctcatcaagctatggctgggcggctaccgggagcatggatcaaaagctcatcatctgggaccttgcacatcaatcaagccgatgcacttgcgagcatgacgagggcgtgacatcactggcatggctgggttcgtccaggtatgttgcatcaggatgcatcgacggcaaggtgcgtatctgggacagcctctccggggactgtgccagggagttcagcggacatgcagatgtggtgcagtcgctggctgtcaccaccgatggcaacgcactggtctctgtctcaacagatggctccgcccgtgtgttcgacatttccatgttcaagtgaaggaaactgtgatgttgtaaatggttgttgtgtgtgctatggctttgattgtggtgtacgatgatgacatggcatggtaatatggtattgttgaggcaaacttatgcaattatattctaaaactcaattctactcctatagttattattaatagatgaacaaagaatgtatttggagggc

SEQ ID NO: 20915 - protein, 397 aa, Panicum virgatum
  misc_feature: Ceres CLONE 1813630
  misc_feature (184)..(222): Pfam Name: WD40 Pfam Description: WD domain, G-beta repeat
  misc_feature (100)..(138): Pfam Name: WD40 Pfam Description: WD domain, G-beta repeat
  misc_feature (271)..(309): Pfam Name: WD40 Pfam Description: WD domain, G-beta repeat
  misc_feature (312)..(350): Pfam Name: WD40 Pfam Description: WD domain, G-beta repeat
  misc_feature (354)..(392): Pfam Name: WD40 Pfam Description: WD domain, G-beta repeat
  misc_feature (142)..(180): Pfam Name: WD40 Pfam Description: WD domain, G-beta repeat
  misc_feature: SWISSPROT Homolog: EC 2.7.11.7 [Myosin heavy-chain] kinase
MSISGELPGEGSDGEEEVFINEEDIIHEITIDEQDLPDRDDEDEDGGDRMDDSEDVDDSAYIFQGHKDEVFTVACSPTDASLVASGGKDDRGFLWRIGSAEGALELTGHSDTVSTVAFSSDGNLLACGSFDGQINVWSTATRSLQGTLEGSGSGFEWLKWHPRGHLIIAGSEDCNVWMWNADHNTILNTFAGHSSTVTCGDFTPDGKLMCTGSDDATLRIWDPRSAQSRHVVRGHGYHTDGLTCLSITLDSQTVVSGSKDNSVHLVNVNSGQVVGSLVGHSNSIECVGISSSYGWAATGSMDQKLIIWDLAHQSSRCTCEHDEGVTSLAWLGSSRYVASGCIDGKVRIWDSLSGDCAREFSGHADVVQSLAVTTDGNALVSVSTDGSARVFDISMFK

SEQ ID NO: 20916 - DNA, 652 bp, Panicum virgatum
  misc_feature: Ceres CLONE 1813636
  misc_feature: Encodes the peptide sequence at SEQ ID NO. 20917
atcaatctggagtattttatcggctcgcccgccgcaccacgctgccaccgctgcgctgctgcgtggtagcttctgcctcacctgacctgacctcacctccccaccccagcgagcatggcgcactccctcgccgccgccgcatccttctcgccggccgccgcccggcgccaggtgacgaatgtttccttccagagccacaggatgacttctgtgtccattcgttcaagaccaaattctcttcggcttaagatttgctgtttggctaaaaaagagacagtcgataaggtttgtagtatagtgaaggagcagctagctctccctgatgggactgcgctcagcggcgaatcaaaattcgctgaacttggtgctgattcactggatacggttgagattgtgatgggcctcgaggaggcattcaacatcactgtcgacgaaacgagcgcacaagacatcgcaactgtgcaggatgcggcggacctcattgagaagcttgtgctcgagaaggctgaataagcaccataagtggacgatccaactggacccttcgaccctgtgatcaatgactttgcattcgatctctgttgttcaagttacccatttgttgtttcttgatcgttcaagataagattttgtattgaattattgatgttgc

SEQ ID NO: 20917 - protein, 132 aa, Panicum virgatum
  misc_feature: Ceres CLONE 1813636
  misc_feature (56)..(123): Pfam Name: PP-binding Pfam Description: Phosphopantetheine attachment site
MAHSLAAAASFSPAAARRQVTNVSFQSHRMTSVSIRSRPNSLRLKICCLAKKETVDKVCSIVKEQLALPDGTALSGESKFAELGADSLDTVEIVMGLEEAFNITVDETSAQDIATVQDAADLIEKLVLEKAE

SEQ ID NO: 20918 - DNA, 1304 bp, Panicum virgatum
  misc_feature: Ceres CLONE 1813637
  misc_feature: Encodes the peptide sequence at SEQ ID NO. 20919
atgatataggcaagtgcgttcttctcgatacctcagcatcccccgtcgaagcatctttgatttgcctagctgcaagcctgcaaaatggctcgcaaaagcactcatcacgcctcatggttgcatttgcatctagctgtctgtctcagcttcctccttttggcaagcaaccagctcccacgttgctcccttgcgctgtcagcaaatagcagcagatcaagcggcggcggcacctcacgagtcccagcactatgccgctcgcaggaggctgcatcgctcctccagctgaaggggtccttcgcgctccccacagacggcagctgcgatgacaatacgacgttgccgtcgtggagatcgggctctgactgttgccgctgggagggcgtcagctgcgacggtatcacagggagagttactgccctccaccccaacaacctgaaggcctgcggcggccttcaccctgctctcttcaacctcacctccctccggaggctcaacctggggggcctcgacttttgcggctcacaacttccagagtcgggtcttgagagattgaccaatcttcgagtcctcgtgttagagagctgcaacctttctggttcgatcccaccttcctttacaggccttcattccctgcaaaagattcatctcagtgacaacactttaaacggcaatatttccaatctgttctctgctcatagcttcccgcatttgagagtccttgacctttcttataatatgttcgagggaacgtttccgcttgggatcactcaactaaaaaatctcagggttctgaatctcagatccacgaacctctctggtggtattccaaactccatagggaatctctcgttactgagggaattagaccttcatggaaacaggctctccggggacctgcctcgggagctcagcaatttgacatacttgaccgaactggattgttcaaattctagtttgtctggacaacttccgtctcttacaagtttaatacggctggaatatatcggggtttcctacaacagcctcatgggtaagctttcagcatgctggaacattttcgttccacttctacatattccaggtgtctgtttttttttcttttttttttctagcgataggcaattttgtcgttgtttgagtatagaaaaaaattgtggattgtttcttgcaagttgtcctttttaattgtactagttgattgtataagatggttatctaaaaatcatgttacaattcagacacctgattgagtacagcaaatctcgtaatattctatataaagcattgccaaagattgttatagc

SEQ ID NO: 20919 - protein, 366 aa, Panicum virgatum
  misc_feature: Ceres CLONE 1813637
  misc_feature (57)..(103): Pfam Name: LRRNT_2 Pfam Description: Leucine rich repeat N-terminal domain
  misc_feature: SWISSPROT Homolog: EC 2.7.11.1 Non-specific serine/threonine protein kinase
MARKSTHHASWLHLHLAVCLSFLLLASNQLPRCSLALSANSSRSSGGGTSRVPALCRSQEAASLLQLKGSFALPTDGSCDDNTTLPSWRSGSDCCRWEGVSCDGITGRVTALHPNNLKACGGLHPALFNLTSLRRLNLGGLDFCGSQLPESGLERLTNLRVLVLESCNLSGSIPPSFTGLHSLQKIHLSDNTLNGNISNLFSAHSFPHLRVLDLSYNMFEGTFPLGITQLKNLRVLNLRSTNLSGGIPNSIGNLSLLRELDLHGNRLSGDLPRELSNLTYLTELDCSNSSLSGQLPSLTSLIRLEYIGVSYNSLMGKLSACWNIFVPLLHIPGVCFFFFFFSSDRQFCRCLSIEKNCGLFLASCPF

SEQ ID NO: 20920 - DNA, 2372 bp, Panicum virgatum
  misc_feature: Ceres CLONE 1813639
  misc_feature: Encodes the peptide sequence at SEQ ID NO. 20921
aattaaccaaagcaaacccccttcccccaaaggcaggcaaaccctgataccttcgccttttccgcccgcgctgcgtcgccgtttgcgtcgatggcgatggagattccggcggaggtgcgccgctactggctgccgatcctactcttcaccgctggtttcctcttccagcttctcgtcctgccccgccacttcccgcgcacccactacgacgtgctgggaatcgagaggtttgcgccggtggagcgggtcgtcgaggcctacgagcggctatccaaggagtggctaactgaaacgaatcaccagccaactgttgatattataaagatccgttatgcatacgagctgttgacaaatccaattttaaagagggattatgatctttttggactggatgagcatatggatgtccttgagagagtcaaagagcaatatcaaaaggaacactttctgaaaatagatctcccattgttaaaagactctgcagttagtttgactgatgatgccttcaatgtactcacacatgagtcattcatgtctgctattgctgaagaatacccactaataataatggtatattcaaagggtagtcctcggtgtgctcaatttattgagtactggaagcaaattagcgctcgattagatggtatcgcgaaaactgctatggtagaagttggtgattcacaactggctggtcatttcgccgaaaaagggttctccaaacaaccatttttccgtaatggtgtaccagcaattgttgcataccctgcaaactgcagaagtccatcctgttacatgaggtacctaggtgggctctttgtggagtctgttgttgactgggttgcaacatcagttatagggttgcctcggatcttgtactattcaaaggaggcattggggccccaattcattgggaagagcggccatcataaggtcaaagttatctttttctcaagtactgaagaacgtgctgctccattccttcgacaagctgctcaagagtattcgagctatacatcatttgcatttgtcctatggagagaagatgagtcccagatttggtggaactcattaggggtggaatacgctcccccmcttgttttcttgaagggaccaggcacaaagcctgttgtacatcatggaacttttagcaagtcagagttcacagagatgatggaggagcacaaacaccatgagctgcgccagctaagaagtgacacatctttggaactgggttgtgatgctagaggccattcacgtgctggcaatgatgcagcaatttggtattgtgtaattgtcgctggtcgtcctggtgtagaattaagtaaaaaaagacaaattttgcataaggcccaagatcaactgataggtgatgttgacagaagtgctattgggaatgtggctaattcagtagagatgtcaagtgctgctactgccttgaaagatgaacggataacctttgtttggttagatggagaagtgcacaagcaaatttgagccttctaccttgccactgattataatggagcctgtggtcctaccgactttggagatgacaatgataaacctgaaattttcattgttcgattccaaagaaatgcaacatatgaggcactgaaagctgagaaaaggaacaatcttgtggaggctctccagggacaacaggctgatgcctcccarcttgtggcaaggtacaagggccsagatgaaattcaagagataaacaggtggatctctcagattatcaaagatrgagattctagagaaattccttactttacttcaaaggtgccagatcttgtacctgaggaaacaagcaaggaatggctaaggagtaccaaaagtatccgctctgcagggaaaagtctaagagagaaaattggcttccatttccaagattacctaactgatccaaggactggttcaactttgcttatgtgcggttgtatttcttttggaataatatggttcaggaacaacaaatcaactcagagtactcaacgggaaaaagctccgaaagacaagaccaagaggcctcgtccaaagcttagcacgtcgctctttggtcagcctgaatctatcgctgatgttgaaccaaaagatgcacgtcagtgggagatgtcggactcagattcagactaatgacttgatccttacattcggactcgatctacttcaactttactaaactctgtatagttgcgtggtaggcgctagccctagtttaggctaatgccggcagagtactcagttggatcactgaagtactcagttgccatctacctgatgtttcagctgccgtgtgacttcagggacacatttttttgtgacgtgttaactttctatattgtttcgtgtgactgacaagcctggta

SEQ ID NO: 20921 - protein, 467 aa, Panicum virgatum
  misc_feature: Ceres CLONE 1813639
  misc_feature (37)..(96): Pfam Name: DnaJ Pfam Description: DnaJ domain
MAMEIPAEVRRYWLPILLFTAGFLFQLLVLPRHFPRTHYDVLGIERFAPVERVVEAYERLSKEWLTETNHQPTVDIIKIRYAYELLTNPILKRDYDLFGLDEHMDVLERVKEQYQKEHFLKIDLPLLKDSAVSLTDDAFNVLTHESFMSAIAEEYPLIIMVYSKGSPRCAQFIEYWKQISARLDGIAKTAMVEVGDSQLAGHFAEKGFSKQPFFRNGVPAIVAYPANCRSPSCYMRYLGGLFVESVVDWVATSVIGLPRILYYSKEALGPQFIGKSGHHKVKVIFFSSTEERAAPFLRQAAQEYSSYTSFAFVLWREDESQIWWNSLGVEYAPPLVFLKGPGTKPVVHHGTFSKSEFTEMMEEHKHHELRQLRSDTSLELGCDARGHSRAGNDAAIWYCVIVAGRPGVELSKKRQILHKAQDQLIGDVDRSAIGNVANSVEMSSAATALKDERITFVWLDGEVHKQI

SEQ ID NO: 20922 - DNA, 115 bp, Panicum virgatum
  misc_feature: Ceres CLONE 1813639-R
ccgtgtgatttccaaacggagtagtggtggcaggggatgcatagtaagtgacttgttggcatccagtttgtgaccgaggacccttattatgatttatcccttaaactgatctggg

SEQ ID NO: 20923 - DNA, 1699 bp, Panicum virgatum
  misc_feature: Ceres CLONE 1813642
  misc_feature: Encodes the peptide sequence at SEQ ID NO. 20924
attcccatccccatccccatgcccgctggcagctcgccgccggcgcggcgccggcgccggagccgcaaggaaggtccgccgacaccctccccgcttcccccctcccataaaccgaacccgctgccgcccggcaccgagatcgaggtccgcatcgacgacgagggcttctacggctcctggtacgaggccaccgtcgtcggcttcgaccccgccaccggccgcaggtccccggcgaagtacaccgtcgcctactcccacctcgaagcccagtacgcccctgactccgtcgctccctcccacgtcctcccgcggcccccgccaccgtcgggcccgggatctccgtcgtcgaccccggcgccgccgcgcctcctcctacatgacttcgccgacgccttcggctgcaacgtcgcgcccgcgccctcccacgtccgcccgcggcccccgcatcccccgggcccggggtcaccgtcgtcgaccacggcgctgccgcgcttcctcctacatgacttcgttgaggtcttcgaccgcagcggctggtggtcgggcatcgtcgtcgcgcctgcgcccgccgaccccggctcccccgtcaccgtcgcattcctcatcacccgcgaggtcctccctttccccgcacacctcgtccgcccccatcgcgactacatcggtggcgagtgggccccatcgctgtccgtgatcgccgtccagccgaggcgtgccgtcagggtctacaaggccggggagaatgtcgaattgctgagggagcgggaggcgtacggcaactcctgattccccgcgacggtggtcaaggcggtcgacaggctgagctacgtcctggagtgcctggatgatcaagtggacggtgggaaggtggcggtgtaccggcattggaggtacatcaggccggctgaataccattgcccgcgggagagcaaggtgcgtctttatcctggcaccgcggtggaggtgtgctgcgacgaggcatggttgcaaggagtggtgcgcagggttgtcagggaggattttgagtatgaggtcagtgtcgatggtgagaaggcggagcagctgctaaccaagacggtgtaccagctgaggccactatacatgtggaacggcaagcgttggactcatggtcagcaagcttctctatcggcaacaccaccatcggcacagctcaccgatactttggctgtaaatgtcccggatactctgccagctggagaatctgccgaagacatgccaacatcccctccttcaaccagagacattgtctccggcgctgaagaaagtaaggacaagggcttcaccttctcaagtcttggtcttgctacagaaccttgggaggtagtactcccatgttgctaaagacattcgcaggtcccaagcatctggtagtttcgtgtacaggtccatactcttctgccagcatcatcagcttggtctccatgcttcttgtgcagcctggaggattactacaccagtgagaaacttgatgttaatattcgcacgtgccgaacaattaatgttcctaggacttcaaaattactttagcttaagggcatcctatttcacaatgttgtaaactatgctttggaactaccacttagctaaatatttgaggctaatgttgctcttctttgcaaccgagcttcataattgtactatcgcttgttaatgtgatacatttgatacaatagttcgc

SEQ ID NO: 20924 - protein, 255 aa, Panicum virgatum
  misc_feature: Ceres CLONE 1813642
  misc_feature (35)..(105): Pfam Name: Agenet Pfam Description: Agenet domain
MPAGSSPPARRRRRSRKEGPPTPSPLPPSHKPNPLPPGTEIEVRIDDEGFYGSWYEATVVGFDPATGRRSPAKYTVAYSHLEAQYAPDSVAPSHVLPRPPPPSGPGSPSSTPAPPRLLLHDFADAFGCNVAPAPSHVRPRPPHPPGPGSPSSTTALPRFLLHDFVEVFDRSGWWSGIVVAPAPADPGSPVTVAFLITREVLPFPAHLVRPHRDYIGGEWAPSLSVIAVQPRRAVRVYKAGENVELLREREAYGNS

SEQ ID NO: 20925 - DNA, 701 bp, Panicum virgatum
  misc_feature: Ceres CLONE 1813647
  misc_feature: Encodes the peptide sequence at SEQ ID NO. 20926
  misc_feature (616)..(616): n is a, c, t, g, unknown, or other
acaaagaaaagttgattgctggtacaagagttgttcttgacatgacaacgcttactatcatgcgcactttgccacgtgaggttgaccctgtggtttacaacatgctacatgaagatcctggcaatattagttactcagctgtaggtggcttgtcagatcaaataagggaactcagagaatccactgagttaccgcttatgaatccggaactgtttctccgtgtagggattaagccgccaaagggtgtgctactctatggtccacctggaactgggaagacgctcctagctagagccattgctagcaacatcgatgctaactttttgaagatagtttcaagtgctatcattgacaagtatattggtgaaagtgcacgcttgattcgtgaaatgtttaactatgcacgtgagcatcagccatgcatcattttcatggatgaaatcgatgccattggtggccgaagatttagtgagggcacaagtgctgatcgtgagattcaaaggacattgatggagcttttaaatcagctagatggattcgatgagcttgggaaggtgaaaatgatcatggcaacaaacagacctgacgttttggatcctgcgctccttcggcctgngcgattggacaggaagatcgagatcccgctcccgaatgagcaggggaggatggaggtccctcagattcacgcagctggcatcgcc

SEQ ID NO: 20926 - protein, 232 aa, Panicum virgatum
  misc_feature: Ceres CLONE 1813647
  misc_feature (81)..(232): Pfam Name: AAA Pfam Description: ATPase family associated with various cellular activities (AAA)
  misc_feature: SWISSPROT Homolog: EC 3.6.4.3 Microtubule-severing ATPase
  misc_feature (205)..(205): Xaa is any aa, unknown, or other
KEKLIAGTRVVLDMTTLTIMRTLPREVDPVVYNMLHEDPGNISYSAVGGLSDQIRELRESTELPLMNPELFLRVGIKPPKGVLLYGPPGTGKTLLARAIASNIDANFLKIVSSAIIDKYIGESARLIREMFNYAREHQPCIIFMDEIDAIGGRRFSEGTSADREIQRTLMELLNQLDGFDELGKVKMIMATNRPDVLDPALLRPXRLDRKIEIPLPNEQGRMEVPQIHAAGI

SEQ ID NO: 20927 - DNA, 1332 bp, Panicum virgatum
  misc_feature: Ceres CLONE 1813657
  misc_feature: Encodes the peptide sequence at SEQ ID NO. 20928
agtccagtagtccgtgaaagaacgaaagcccagccaaccgacccccggcggattgccgactggattcctctcgtcccccaccaaacctcagcagcggagcggccgccgccggcgagactgggggcatggcgacggcctcctccgctgctgtattcttcagcagcgccttcgccgcctgcctcgctgaggtgtgcaccattcctttggacacagccaaagtacgccttcagctgcaaaggaagacaccgtcactgccagcgccacttgcgtctgcagccataagtggaggaatgttggccacaatcttgtgcatcgccagggaggaaggtgtggctgcgctctggaagggcatcatccctggccttcaccgtcagttcctctacggcggcctccgcatcggcttgtatgagcctgtgaaagctttctttgtggggggtactgctgtgactgatgtcagtttactaagcaaaattcttgctgctcttaccactggtgtcatagcaattgttgtggcaaatccaactgatcttgtcaaagttagattgcaagctgatggaaaggctaacactgtcaagagaaactattctggagcccttaatgcatatgctacaataatcagacaggaaggcatcggagctttgtggactggccttggtccaaatgttgcacgcaatgccataattaatgctgctgagttggccagctacgaccaattcaagcagatgtttctaaaacttcctgggtttactgataacgtttttacccatcttttagctggacttggtgctgggttttttgctgtttgcattggctctccagtggatgtggtgaaatcaagaatgatgggtgattcaacgtacagaagtacacttgattgttttgccaagacattaaagaatgatggacctggtgctttctacaaggggttcattgcaaacttttgtcggattgggtcatggaatgtgataatgttcttaactctagagcaggttagaagattgtttctgtaaggttgacgccagcactgcgagcaggagctgcgcgggacaagcggatggtgacatgacatatatggtgggcttatgtacatgcatggttgcacatgatgattaagggaaaatctacaggttcccatgttggcaacatacagaaagcagtcatgccatactgccacatcttcctatcatttagattgcataggaatacgctctcatgtttattttgattactacaagttgtaatttcctatcacagatcgatcatggaaccggtcagtgttggtatattgtggagaacaacagatcgacaagtacttcgtgttgcgaagtttac

SEQ ID NO: 20928 - protein, 294 aa, Panicum virgatum
  misc_feature: Ceres CLONE 1813657
  misc_feature (111)..(205): Pfam Name: Mito_carr Pfam Description: Mitochondrial carrier protein
  misc_feature (210)..(294): Pfam Name: Mito_carr Pfam Description: Mitochondrial carrier protein
  misc_feature (5)..(105): Pfam Name: Mito_carr Pfam Description: Mitochondrial carrier protein
MATASSAAVFFSSAFAACLAEVCTIPLDTAKVRLQLQRKTPSLPAPLASAAISGGMLATILCIAREEGVAALWKGIIPGLHRQFLYGGLRIGLYEPVKAFFVGGTAVTDVSLLSKILAALTTGVIAIVVANPTDLVKVRLQADGKANTVKRNYSGALNAYATIIRQEGIGALWTGLGPNVARNAIINAAELASYDQFKQMFLKLPGFTDNVFTHLLAGLGAGFFAVCIGSPVDVVKSRMMGDSTYRSTLDCFAKTLKNDGPGAFYKGFIANFCRIGSWNVIMFLTLEQVRRLFL

SEQ ID NO: 20929 - DNA, 1747 bp, Panicum virgatum
  misc_feature: Ceres CLONE 1813670
  misc_feature: Encodes the peptide sequence at SEQ ID NO. 20930
aagcgaaggccggccgcaaggaggagacagtggcaccggacacagcaagtgtcgtgtgcccagagccactacaccgtactcctcgcttcatctccgtctcgcgagccatgtcgaagccggacgcctccgatggcatccctgccgccgaggcgccggcaaagcgccctcccctcaacaagtacgccctcgcctgcgccatcctcgcgtccatgaactccatcctcctcggctacgatatctcggtgatgagcggggcgcagctgttcatgaagaaggacctcaagatcacggacacggagatcgagatcctcgccggcatcatcaacatctactcgctggtcggctcgctcgcggcgggccggacgtcggactagatcgggcggcgctacaccatggtgctcgcggcggccatcttcttcgcgggcgcgctcatcatgggcctcgccccgagctacgcggtcatcatgctcggccgcttcgtggccggcgtcggcgtcggctacgcgctcatgatcgcgcccgtgtacacggccgaggtcgcgcccacgtccgcgcgcggcctgctcacgtccttcccggaggtgttcatcaacacgggggtcctcctcggctacgtctccaactacgccttccatggcctccccgcgcacctcagctggcgcgtcatgttcctcgtcggcgccgtcccgccggtcttcctcgccctcggggtcctcgccatgccggagtcgccgcggtggctcgtcatgcaggggcgcatcggtgacgcccgccgcgtgctcgccaagacctccgactcgcccgccgaggccgaggagcggctcgccgacatcaagaaggccatcggcatcccggagggcgtcggcgacggcgacgacgacgtggtagtcgtcgcccacaagaacaaggggacccatggcgagggggtgtggcgggacctgctgctccgcccgacgccgcccgtccgccgcatactgatcgcctgcctcggcctccagttcttccagcaggcgtccggcatcgactccgtcgtgctctacagcccgcgggtgttccagaaggccgggcttcagtcggacaacaactcgttgggcgccaccatggcggtgggcgcgtgcaagacgctgttcatcctggtagccaccttcttcctggaccgcgtggggcggaggccgctgctcctgacgagcgcgggcgggatggtggtctcgctggtgacgctggcctcggcgctgcacgccatcgaccagcggcccgtggggcaggcgacgccgctggcgagcgtgagcatcgcggcggtgctggcgttcgtggcgtccttctcgatcggcatgggcccgatcgcgtgggtgtacagctcggagatcttcccgctgcggctgcgcgcgcaggggtgcgcgctgggcacggggatgaaccggatcatgagcggcgccatcaccatgtccttcatctcgctctacaaggccatcaccttggccgggagcttctacctctacgccggcatcgccgccgcggggtgggtgttcatgttcttcttcctgccggagacgaggggcagcatcttggaggacaccgagaagctcttcggcggcggcggccaggacagcagcagggaagatgaacgtgatgcgccgaagaagtccacggagttgactagcagtcaacagtgaatagctacctgatgagtgacacgcacagcaaatatgtaccactccgtagtcatcaataacacgaaactgatggt

SEQ ID NO: 20930 - protein, 426 aa, Panicum virgatum
  misc_feature: Ceres CLONE 1813670
  misc_feature (1)..(399): Pfam Name: Sugar_tr Pfam Description: Sugar (and other) transporter
MVLAAAIFFAGALIMGLAPSYAVIMLGRFVAGVGVGYALMIAPVYTAEVAPTSARGLLTSFPEVFINTGVLLGYVSNYAFHGLPAHLSWRVMFLVGAVPPVFLALGVLAMPESPRWLVMQGRIGDARRVLAKTSDSPAEAEERLADIKKAIGIPEGVGDGDDDVVVVAHKNKGTHGEGVWRDLLLRPTPPVRRILIACLGLQFFQQASGIDSVVLYSPRVFQKAGLQSDNNSLGATMAVGACKTLFILVATFFLDRVGRRPLLLTSAGGMVVSLVTLASALHAIDQRPVGQATPLASVSIAAVLAFVASFSIGMGPIAWVYSSEIFPLRLRAQGCALGTGMNRIMSGAITMSFISLYKAITLAGSFYLYAGIAAAGWVFMFFFLPETRGSILEDTEKLFGGGGQDSSREDERDAPKKSTELTSSQQ

SEQ ID NO: 20931 - DNA, 2309 bp, Panicum virgatum
  misc_feature: Ceres CLONE 1813681
  misc_feature: Encodes the peptide sequence at SEQ ID NO. 20932
gcttcagtctcgtctcctcttcctccctccgctgcggcttcgtcgtcgcctcctcctcgcctgcgctccctctccgtccgtcgccgtgcggttgcccaattcccgccacggcaggaggccgctcctggtgaagcttgagtcgtgaagtggtgttacccatcaaggagaagttggactagccagcagcccgcacaagtgctcgatgacagatcattttgctctaagtgttctacttctactgctgctaagtactacttgtttcagttcagaactagatatccaatgcttgagagatgtaaagaaatcggtgagtgatcctaatggtatactcaaatcctcatggatttttgacaataacactgcgggtttcatatgccgatttaccggtgtggagtgctggcacccagatgagaatcgagttttttcgttgcacctcagcaaccttggtcttcagggtccattccctcaagatcttaagaattgcaccagtatgacggggttggatctgtcaagcaacaactttacgggccctattccttcagatatctctctgcaagtgccatttttgacatcgctggacctctcctataatggtttctcaggagaaattccactacttatctataacatgacgtacctaaacacccttaatcttcaacacaaccaattgaccggtcaaattccggggcagttcagtttattggctcggctattaacattcaatgttgctgacaaccaactatcagggactattccatctgctctacagaaattctcgccatcaagttttgctggtaatcaaagactctgtgggcctccattaggtgactgtcaagcttcatcaaagagcaagagcactgcagcaatcatcggggctgttgttggcgtggtagtagttgtcataattggtgcagtagttgtgttcttttgtctgcggagattaccagccaagaagaaggcaaaggatgaggatgataataagtaggcgaagagtatcaaaggaacaaaaaccatcaaggtctctatgtttgagaatccagtttcaaagatgaaactaagtgatctcatgaaggccacggaccaattcagcaaagagaacatcataggtactgggaggacgggaactatgtacaaggccgtgctacctgacggttccttcctagctgtcaaaagacttcaagattcacagcattctgagtcccagttcacatcggagatgaagacacttggccaggtaaggcaccggaacttggttccgctcctggggttttgcattgccaagaaggagaagttgctggtgtacaaacacatgcccaaaggttcactctatgatcagttaaaccaagaggaaggttgtaatatggattggccactgaggttaagaattggcatcggtgcagcgaaagggcttgcatatctccatcacacctgcaatcctagagttcttcaccgcaacatcagctccaaatgcatcctcttggatgaggactatgaaccaaagatgtcagacttcggacttgctaggcttatgaacccaatagacacccatctcagcacctttgtgaatggggaatttggtgacctcggttatgtagcaccggagtatgcacgcactctgatggccacaccgaagggtgatgtctacagctttggtgtggttctcctcgagctcatcaccggcgagaagcctacccacgtttccacagctccagagaatttcagagggagcctagtggaatggatcaattatctttcaaacaacggactcctccaagacgccatcgataagttgctgataggaaaggacactgatggcgagttgatgcagttcctgaaagtcgcgtgttcctgcacgcttgccaccccgaaggagagaccaaccatgtttgaggtttaccagctccttagagccattggcgaaaggtaccatttcactgccgatgatgacctggtgctttcacctcttaacacagatggcgaaaccctagacgaactcatcgttgccaagtaattgcacagccatatgtctccagaggacaaacaaggctgcgagtcccccccccccctccatgggagttagcatctgctgaagtgagtaagaaggcctataagatgtaccaattacttgcaggatactgcatcctctgtatagttcttgttgcttgattgttacccacctttgggaggtgctggtagcaatttgcatgtaaccaatttggtgacgaggtagttgttacttgtaagtttgttaccctggtggcatggggttttattggcattatgcagtggctctttggtaaagccatttc

SEQ ID NO: 20932 - protein, 260 aa, Panicum virgatum
  misc_feature: Ceres CLONE 1813681
  misc_feature (22)..(66): Pfam Name: LRRNT_2 Pfam Description: Leucine rich repeat N-terminal domain
  misc_feature: SWISSPROT Homolog: EC 2.7.11.1 Non-specific serine/threonine protein kinase
MTDHFALSVLLLLLLSTTCFSSELDIQCLRDVKKSVSDPNGILKSSWIFDNNTAGFICRFTGVECWHPDENRVFSLHLSNLGLQGPFPQDLKNCTSMTGLDLSSNNFTGPIPSDISLQVPFLTSLDLSYNGFSGEIPLLIYNMTYLNTLNLQHNQLTGQIPGQFSLLARLLTFNVADNQLSGTIPSALQKFSPSSFAGNQRLCGPPLGDCQASSKSKSTAAIIGAVVGVVVVVIIGAVVVFFCLRRLPAKKKAKDEDDNK

SEQ ID NO: 20933 - DNA, 578 bp, Panicum virgatum
  misc_feature: Ceres CLONE 1813682
  misc_feature: Encodes the peptide sequence at SEQ ID NO. 20934
aagaagcgcagcggtccccgccgctgttgccaaagactcttccttttcttctgttccgtccatcaccaccaccccggcgacgccatggagaagagcagtggcgccgccgctggaggcagcgccccgccttcgccgccgttccacatggaggatttccagctggaggggaagaagcccgtcaagaaccccttcgtccccatcggtgcattggtgactgctggagttctgactgctggtctgatcagcttccgatatgggaactctcaactgggccaaaaactgatgaggacgcgtgttgttgcccaaggggcaacagtcgctctaatgatcggcagcgcttactactatggtgatcaaatcaagctgttcaagaaagaatctagcccttgaacttcgctggagcggatgttgctccttttagtgtatggaataccatatgtacgctgaaattgcaactggatcctgctgtttgtccctcctaacattgggcttaaccctgtcattttggcctgacatgtaatagctaaccagaaatgggtattggttcaatcggcaggcttgataataaataatttatt

SEQ ID NO: 20934 - protein, 101 aa, Panicum virgatum
  misc_feature: Ceres CLONE 1813682
  misc_feature (18)..(86): Pfam Name: HIG_1_N Pfam Description: Hypoxia induced protein conserved region
MEKSSGAAAGGSAPPSPPFHMEDFQLEGKKPVKNPFVPIGALVTAGVLTAGLISFRYGNSQLGQKLMRTRVVAQGATVALMIGSAYYYGDQIKLFKKESSP

SEQ ID NO: 20935 - DNA, 660 bp, Panicum virgatum
  misc_feature: Ceres CLONE 1813688
  misc_feature: Encodes the peptide sequence at SEQ ID NO. 20936
cataacaacttgacgggagaaatcccaacagctctaagctgtctacagctcagcgagcttgatctttcatacaatgatctccagggagaaatcccaagagacggagtattcaataatgctacagcagtttcacttgagggtaatttgggactttgtggaggagctgcggatctccatatgccatcatgcgtaactgttccccgtaaagcagcaagtcagtactacatcattagagtactgatcccaatgtttggtttcatgtcggttatattatttctgttccactttacatttatcgataagaaggcgccgagcagaacatatttatcattgctttcttttggcaagcaattccctaaggtctcctacaaggatctagccgaagctacagggaatttttctgaatcaaacatacttggaagaggaagctatggatcagtttatagaggaaagtcagtagtccaaattaaatcacaagtagctattaaggtttttgaccttgagatgaggtgtgcagacaaaagtttcgtttcagaatgtgaggttttgagaagaattaagcatcaaaatttacttcctatcctaacagcatgttcaacaatagataacgcaggaaatgctttcaaagctctagtttacgaatgcatgccaaatgggaat

SEQ ID NO: 20936 - protein, 219 aa, Panicum virgatum
  misc_feature: Ceres CLONE 1813688
  misc_feature: SWISSPROT Homolog: EC 2.7.11.1 Non-specific serine/threonine protein kinase
HNNLTGEIPTALSCLQLSELDLSYNDLQGEIPRDGVFNNATAVSLEGNLGLCGGAADLHMPSCVTVPRKAASQYYIIRVLIPMFGFMSVILFLFHFTFIDKKAPSRTYLSLLSFGKQFPKVSYKDLAEATGNFSESNILGRGSYGSVYRGKSVVQIKSQVAIKVFDLEMRCADKSFVSECEVLRRIKHQNLLPILTACSTIDNAGNAFKALVYECMPNG

SEQ ID NO: 20937 - DNA, 1887 bp, Panicum virgatum
  misc_feature: Ceres CLONE 1813709
  misc_feature: Encodes the peptide sequence at SEQ ID NO. 20938
acagagactcttgcccgacgctgttccattggtacattcctctgcgagcactgcagcctgcaggcgcagggggatgcaggttcatgcctgagcaagccgaacagcagctacggtgtccacagtagattcagctagcttcgactccacgcaccacgctagtagttcccaagttcccaaccccagctagtagtatatctgtacgcccgttgccttcccttatctcccttgtgcacgcgcgcgccgtctcccgcgaccgcgcccgtcctgactggctacgtacccggcggtccgtctgtcctcgagggccgggatggcggacgcgtcctccccgccggcgctggcgccggcgcctttcgccgcggatgacctcgcggacgcgcgcctcgcgccgtggccggcgccccaccgccgggacggcggcggcgggcggacgaaccccctgttcaccatactgccggtctcggcgctggcgataggcctcgtgctgctcgtcgccgtggcggtcatcctggtggcgacccgccgcgcgaggccgcggaaggtggacgccggcgggagctgcagcggcgacggcaagccgggcgcgcccacgtccagctgcggcagccacaacaccaggtgcggctacgccgccgccgccgccgcaggcgtcgggtgcatctacgcggggcggctggggttcgcggcggcggcgccggcgcggcgccggggcgcgcaggtgttcacgtaccgggagctggagcgcgcgacggacgggttcagcgggggcaacgtggtggggcggggcgcctccggcgacgtcttccgcggccggctcgccgacggcacccccgccgccatcaagcggctgcggctggaccagcggcgccagggcgagcgcgagttccgcatcgaggtggacctgctcagccggatggactcgccgtacttggtggggctgctgggctactgcgccgaccagagccaccggctgctggtgttcgagctcatgcccaacggcagcctgaggagccacctccacccgccggccggcggcgccggcgccggcgcgcggcagccgccgctgggctgggcgacgcggctgggcatcgcgctggactgcgcgcgcgcgctcgagtacctgcacgagcacagcacccccgccgtgatccaccgcgacttcaactgcggcaacgtcctgctcgaccacgacctccgcgcccgcgtctccgacttcggcacggccaagctcggctccaacaaggccgacggccaggtcgtcacccgcgtgctcggcaccaccggctacctcgcgccggagtacgcgtccacggggaagctcaccaccaagtccgacgtgtacagctacggggtcgtgctcctggagctgctcaccggccgggtgccggtcgacacgcggcgcccgcccggccagcacgtcctcgtctcatgggccctcccgcggctcacgaaccgccagaagctcgtgcagatggtggaccctgccctgcaaggccagttcgccctcaaggatctcatccaggtggccgccatcgcggcgatgtgcgtccagacgaaggcggagtaccggccgctgatgacggacgtggtgcagtcgctgatcccgatcgccaagcccaccccggccatgtcctgctcctccacgccgatcagggcggccctggagcacgtcatcttcatgggctcatccaagtgcggcggcaagacctcctcctagatctggctgctgtcgcgttacagccttacagggttgttctcgttccttgattgatgtctagagctctcgcctcttcctcaggctcagggtgtattattgttttttttgtacgagctacgtacttttttacaagataagatgaaaatagaaataaaaaatgtttccctccc

SEQ ID NO: 20938 - protein, 468 aa, Panicum virgatum
  misc_feature: Ceres CLONE 1813709
  misc_feature (150)..(430): Pfam Name: Pkinase Pfam Description: Protein kinase domain
  misc_feature: SWISSPROT Homolog: EC 2.7.11.1 Non-specific serine/threonine protein kinase
MADASSPPALAPAPFAADDLADARLAPWPAPHRRDGGGGRTNPLFTILPVSALAIGLVLLVAVAVILVATRRARPRKVDAGGSCSGDGKPGAPTSSCGSHNTRCGYAAAAAAGVGCIYAGRLGFAAAAPARRRGAQVFTYRELERATDGFSGGNVVGRGASGDVFRGRLADGTPAAIKRLRLDQRRQGEREFRIEVDLLSRMDSPYLVGLLGYCADQSHRLLVFELMPNGSLRSHLHPPAGGAGAGARQPPLGWATRLGIALDCARALEYLHEHSTPAVIHRDFNCGNVLLDHDLRARVSDFGTAKLGSNKADGQVVTRVLGTTGYLAPEYASTGKLTTKSDVYSYGVVLLELLTGRVPVDTRRPPGQHVLVSWALPRLTNRQKLVQMVDPALQGQFALKDLIQVAAIAAMCVQTKAEYRPLMTDVVQSLIPIAKPTPAMSCSSTPIRAALEHVIFMGSSKCGGKTSS

SEQ ID NO: 20939 - DNA, 694 bp, Panicum virgatum
  misc_feature: Ceres CLONE 1813717
  misc_feature: Encodes the peptide sequence at SEQ ID NO. 20940
aaagaaagcgttcttgattcacccaacactcggtcagtccctctgcttgccagattcccacttcaccaggaaactgaatccgcgccaccgccgtcgcaagcatgcagccgaaggacgccgccgaggacatcgtcatcgcgggcgccggattggccggcctcgcggcggcgctcggactgcacaggaaaggggtgaggagcctggtgctggagtcgtcgccgtcgctgcgggcgtcgggattcgcgttcgcgacgtggaagaacgccttccgggcgctcgacgccctcggggtcggcgacaagatcagggagcagcatctgcaggtccaggcgttgcgcgtcgtggcttccgccaccggagaaatcgtgcgggaagcagacttcacgcagcaggggaaacgaggggcactggaaatccgttgcgtcaggcgcgacctgctgctgcaggccttggagggggagctgccaaaaggcaccatccgctactcctccaagattgtctccatcgaggaggatggcaacatcaagatccttcaacttgccgatggctcagttctgagagcaaaggtactgatcggatgcgacgggatcaactccgtggtggcgaaatggctgggcctcgcgaagccgtcctactcggggcgctcggcggcgagaggccttgcgcattacccggacggccacggcttcgagcc

SEQ ID NO: 20940 - protein, 197 aa, Panicum virgatum
  misc_feature: Ceres CLONE 1813717
  misc_feature: SWISSPROT Homolog: EC 1.14.13.1 Salicylate 1-monooxygenase
MQPKDAAEDIVIAGAGLAGLAAALGLHRKGVRSLVLESSPSLRASGFAFATWKNAFRALDALGVGDKIREQHLQVQALRVVASATGEIVREADFTQQGKRGALEIRCVRRDLLLQALEGELPKGTIRYSSKIVSIEEDGNIKILQLADGSVLRAKVLIGCDGINSVVAKWLGLAKPSYSGRSAARGLAHYPDGHGFE

SEQ ID NO: 20941 - DNA, 669 bp, Panicum virgatum
  misc_feature: Ceres CLONE 1813721
  misc_feature: Encodes the peptide sequence at SEQ ID NO. 20942
aaagttcaagtgtaggggaaaatggcatggtgtgaggcctgatattgctgctttcgatattttcagggagaggttttctgctgataatgatgacatgaggtatgatggaagcattccaggagttcgtattggtgacgtgttcaattctgtcatggaactttctgttgttggtatacaccgtgcacaatcgttgctagttgatcacatcaaaaagaaagacgggacgtgtctagctgtcagtgtcgtgtcgtatgcacaaccttctgcctttgatagtttggatttcctcttacatgttggatcggtggctgccacatgtgatcagaagctagaaggcgctgacatggcacttcaggagagtatggacactgatacgcctgtccgcgttattcatgcattagtaactgatgagttaggtgatgactgccgacctaaacagcttactacttatgtatatggtggtttatacttggttgagaaattccacagagaaaaagcagcaggaggtcagtatgttaatacctttcgtctaagaagaatggcagggcagaaacaaatcgacatacaagttctgaaaactaaaaagccggaatcatttgatggcactttcactgtagacatatctggaggtcttgagaaggttcctatttctgctattaactctatatc

SEQ ID NO: 20942 - protein, 222 aa, Panicum virgatum
  misc_feature: Ceres CLONE 1813721
  misc_feature (31)..(183): Pfam Name: YDG_SRA Pfam Description: YDG/SRA domain
  misc_feature: SWISSPROT Homolog: EC 2.1.1.43 Histone-lysine N-methyltransferase
KFKCRGKWHGVRPDIAAFDIFRERFSADNDDMRYDGSIPGVRIGDVFNSVMELSVVGIHRAQSLLVDHIKKKDGTCLAVSVVSYAQPSAFDSLDFLLHVGSVAATCDQKLEGADMALQESMDTDTPVRVIHALVTDELGDDCRPKQLTTYVYGGLYLVEKFHREKAAGGQYVNTFRLRRMAGQKQIDIQVLKTKKPESFDGTFTVDISGGLEKVPISAINSI

SEQ ID NO: 20943 - DNA, 1554 bp, Panicum virgatum
  misc_feature: Ceres CLONE 1813757
  misc_feature: Encodes the peptide sequence at SEQ ID NO. 20944
gaggtagagaggccgggaggttatggaaggggagaggtatagcagggagccaaaggggagggagcaggcgcaggaggtcaggtctctcggggaagcaatccggcccggccgaaaccactagcagagtccgtgtaggtttagtttcctctcccggcctttccttcgccccccgaggacccagaacaagatcgatcaggggggctagtagtagtcgagagcgagccgaggggaggagacgcgagacgcggacggctgtagatacttgcgagcgagcgtgcagcgtcaacgtaagatggcgtcccacgcgtcgtcctccggcgccggcgggtcccccggccacgcgccccccggcggcggaggcgcaggcggggggtccgggtccggcggcccgtaccaccaccaccggtcgcggttcggcgacacgacgctgaccaaggtgttcgtggggggcctggcgtgggagacgccgtccgaggggctgcgccagcacttcgaggcctacggcgagatactcgaggccgtcgtcatcaccgatcgcgagaccggccgctccaagggctacggcttcgtgatcttccgggacccggactcggcggcgcgggcggtgcagaacccgaacccggtgatcgccgggcggcgcgccaactgcaacattgcggcgttcggcccgccgcggcccgcgcaggcgagaggtagaggaggaggccgcgggacccccgcgcaggatcagccgccgcttgtcgcgccctacaggttgccgtcgcagatggccccgccgcacggccccgccccggtgttctaccacccccagtacgggtactggtacccacctgattatccataccaacaggcattgtacaatcctcaagtggtgcagcagtactatctgcagatgtatggttcaacctctccttcaggaccaccctaccaatacatggggatggggtacgtgcctggtgccccgagtccaaggactagcttctcgccgatgcagcaacctgctgcacggccaccattcattcagcagacaacagcacagatggagggttctttcccaccagggccttcacttccgcctaatttcagactccagcttcctcctcatgcagtatcaagggaatctgataatgcatccgttagctttggtgctgaaacgcagaggacaaagtcattctagtttaataattctaaaccgtccacatattcaacactcgaaagggtctcaaccagctccgccaacctcttctgatgcagctacaagcacaaacaaccaggaagcttcagggcctcaaacgtcaaattcagatccaaacacatcaaactgacttgctgaaaatcctggcaaaacgatctgatgtcaaactgctgcagactattggtggcctgacagagtccatgatacatcttgactgaaaaagcatccaaagatttgttctttcattgtttctgattcttttcgaattcttgcaatgcatttcttcgctgaatccattgtatggccaactgaatttaaagttcaaaattcagaaattcgccagaataagttccagtagc

SEQ ID NO: 20944 - protein, 294 aa, Panicum virgatum
  misc_feature: Ceres CLONE 1813757
  misc_feature (49)..(119): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MASHASSSGAGGSPGHAPPGGGGAGGGSGSGGPYHHHRSRFGDTTLTKVFVGGLAWETPSEGLRQHFEAYGEILEAVVITDRETGRSKGYGFVIFRDPDSAARAVQNPNPVIAGRRANCNIAAFGPPRPAQARGRGGGRGTPAQDQPPLVAPYRLPSQMAPPHGPAPVFYHPQYGYWYPPDYPYQQALYNPQVVQQYYLQMYGSTSPSGPPYQYMGMGYVPGAPSPRTSFSPMQQPAARPPFIQQTTAQMEGSFPPGPSLPPNFRLQLPPHAVSRESDNASVSFGAETQRTKSF

SEQ ID NO: 20945 - DNA, 1735 bp, Panicum virgatum
  misc_feature: Ceres CLONE 1813772
  misc_feature: Encodes the peptide sequence at SEQ ID NO. 20946
agtaggagtagtatgcttatctgattctctatctctggcaggcagacagcagcagcctaccccgatctgcccccgcccgccgccgccgattcaccgccagcatcagcaagcgacgactccggtcgagatggcggcgtcatttgtctcctcgctcacggcgcccctcatctccgccgtcctcggtggcgccatcgccctcgtcttcctcgccggctacctccgccgcaagcgcgccgccatcgcccacatccctccctccgccaccgccaccgccgccgccccggaccagcccaagcacgtccgcccctccaaccaggcccagcacaagaagggccacccccgcccgcatcacaacgccgccgataaggatgctgcgaagaagcaccaccatcttgatgttaacaccttgagggggcacactgactcagtcactgcactccacttctccaatgatggcgtcaacttatccaccgtgtgtgctgatggagctgtaagggtattcaggatcgatgatacatcaagcaagagctttaagattctgaggataaacttgcctgctggagcacatcctaccggtgttgctttctcggagggctcttcatctgttgttgtggcagcacaggctcttctgggctcatctctctatatgtatgcggatgtcagtgctcctccaacagcccaaaacaagcagcagggtaagctgtctccgcctgagatcaagtggagtcaccaaaagattcatggaaaggagtcagtgctcaaccttgcagcagcccaggcaactcatgggcctggagatgggagcactataattatttcgtgctcagaagcaaccgatatcaaagtttggcacgggaagagtggaaaggagttgggtactgttgacaccaatcagctaaaaaataatatggctgacatatccccaaatggtcgcttcatagctgctgcagcttttactgctgatgtcaaggtgtgggagatagtttactcaaaggatagttcagtgaaagaagttaataaagccatgcaactcaagggtcacaagagcgctgttacttgcttgtgctttgccccaaattctgagcaaattatcactgcatccaaagatggttccatccgagtatggaacattaatgtaaggtatcaacttgatgaggacccaaaaaccttaagagttttgccaattccactgcatgactcaaaaggttcggtttgccaatatgatcacatgagcatctctcctgatggtaaagttctggctgtaacaagcggatcaacattgcaatggttatgtgtggaaactggtgcagttttggatacagctgagaaagctcatgaaggtgatataactggcattgcttgggctccacggaaaattcccaatggtggcgtgcctgtatttattttggggactgctggtgtggacaagaaggtgaaactttggttagctccacagcttggttcaacatgagtaatggaggacggagcatttcctaaccacaaggtcacggaaagaaaggaaacaagaatagaagaaaacaggggaaggccttgatttgtactttatatgcactgaagcatacatagttgcggtcctttgagctcgagggacagcactgaggcaggcctgtgtgatgagagagtgaaacatggagactgcacgcgcacgtgcctagaggcagtagtttcgctatagattgtgccaggtttttgaaataaattgagtgttgtctgc

SEQ ID NO: 20946 - protein, 447 aa, Panicum virgatum
  misc_feature: Ceres CLONE 1813772
  misc_feature (296)..(334): Pfam Name: WD40 Pfam Description: WD domain, G-beta repeat
  misc_feature (88)..(126): Pfam Name: WD40 Pfam Description: WD domain, G-beta repeat
  misc_feature: SWISSPROT Homolog: EC 2.3.1.48 Histone acetyltransferase
MAASFVSSLTAPLISAVLGGAIALVFLAGYLRRKRAAIAHIPPSATATAAAPDQPKHVRPSNQAQHKKGHPRPHHNAADKDAAKKHHHLDVNTLRGHTDSVTALHFSNDGVNLSTVCADGAVRVFRIDDTSSKSFKILRINLPAGAHPTGVAFSEGSSSVVVAAQALLGSSLYMYADVSAPPTAQNKQQGKLSPPEIKWSHQKIHGKESVLNLAAAQATHGPGDGSTIIISCSEATDIKVWHGKSGKELGTVDTNQLKNNMADISPNGRFIAAAAFTADVKVWEIVYSKDSSVKEVNKAMQLKGHKSAVTCLCFAPNSEQIITASKDGSIRVWNINVRYQLDEDPKTLRVLPIPLHDSKGSVCQYDHMSISPDGKVLAVTSGSTLQWLCVETGAVLDTAEKAHEGDITGIAWAPRKIPNGGVPVFILGTAGVDKKVKLWLAPQLGST

SEQ ID NO: 20947 - DNA, 1727 bp, Panicum virgatum
  misc_feature: Ceres CLONE 1813805
  misc_feature: Encodes the peptide sequence at SEQ ID NO. 20948
gattttggttggttcacctccaacctcttcgccttcttcctcttccgactcactcctctcgcccccgcccgcgtcatcccagaaccgagggaaacctgggagctccgtccgcctccgatccggagctcccaaatcgatacccatcgctcgttcaaccgccacggcaatggaagcccaccacgcatcgcggggccgccgtaccctggaggagatccggcagaagagagccgccgagaggatgcagcacgccccgccgaccgcggcgtctcacgtcgacccttacgggaaccaaagagccggagctgagcttcttgctcgagttcaagaacttgaaaatggaaatgtggaattggagagggaaaacaaaatgctcttgtccaagattgctgagaatgaagttgagaaggatgcccttgtaaaccgtttgaatgatcttgagcggaatgtagtgccctctttgagaaaaactttgaatgacatttctttggagaaagatgctgcggtagttgctaaggaggatgctctagctcaactcaggagcatgaagaaacggctgaaggaagcagaagaggagcagtatagggcagaagaagactcggcctccttgagagcacagctaaataccctgcagcagcaagtaatgggcaactcttatagtggatttccaatggaaacatcgagtgaggaatctcatgccatggaaaaggagatacaagatttacaggcacagctaaagcaagagtcattgctaaggcagcaggagcagcaaaaattagctgaagagtcccagctgaggcaacgggagcaagaaaaactggctgaagagcaatcccacattgcttctctggaggctgaaaagcaacagttggaagaccgaattgctgttttgacaaagaaagctacagaggacgcttctgagtttgctgcgcgcaaggcattttcaatgcaagatagggaaaaacttgaaaaccagttgcatgatatggctttgatggttgagaggctagagggaagtcgtcaaaaactgttaatggagattgattctcaatcatcagaaatagaaaaactgtttgaggagaactcagccttgtctacttcttatcaagaagctatagctattacagtgcaatgggaaaaccaggttagagattgtttgaagcaaaatgaagagcttcgttctcacttggagaaactaaggcttgagcaagctagcctgttgaaagtaagcaatatcaatacccaatcagacaacagcatctcaaactcaccagaattggtcactgagaatctttctctaaaggatcagcttattaaagaacagagtagatctgaggggttgtcggcagagataatgaaactttcagctgagcttagaaaagcagtccaagcacagaataacctcacaagactatacaaacctgtattaagagagatagagagcaatctaatgaaaatgaaacaagaaacatatgcaacgatccagtaatacatattgtgaagcccaatctggccatatcactgaggtacggacacaagctcaatgataggcgttctgtatgtgtcggtctgatgccctcaatgatagttcgtttggtagctactgttcattcgtagagttcagtcgggatacaatttgttgtatacttgtattacttggttcccacactgattttatcttgtaaatttggagcgattacaatagaaaagaaaggatcagttccacagcc

SEQ ID NO: 20948 - protein, 439 aa, Panicum virgatum
  misc_feature: Ceres CLONE 1813805
  misc_feature: SWISSPROT Homolog: EC 2.7.11.1 Non-specific serine/threonine protein kinase
MEAHHASRGRRTLEEIRQKRAAERMQHAPPTAASHVDPYGNQRAGAELLARVQELENGNVELERENKMLLSKIAENEVEKDALVNRLNDLERNVVPSLRKTLNDISLEKDAAVVAKEDALAQLRSMKKRLKEAEEEQYRAEEDSASLRAQLNTLQQQVMGNSYSGFPMETSSEESHAMEKEIQDLQAQLKQESLLRQQEQQKLAEESQLRQREQEKLAEEQSHIASLEAEKQQLEDRIAVLTKKATEDASEFAARKAFSMQDREKLENQLHDMALMVERLEGSRQKLLMEIDSQSSEIEKLFEENSALSTSYQEAIAITVQWENQVRDCLKQNEELRSHLEKLRLEQASLLKVSNINTQSDNSISNSPELVTENLSLKDQLIKEQSRSEGLSAEIMKLSAELRKAVQAQNNLTRLYKPVLREIESNLMKMKQETYATIQ

SEQ ID NO: 20949 - DNA, 1820 bp, Panicum virgatum
  misc_feature: Ceres CLONE 1813809
  misc_feature: Encodes the peptide sequence at SEQ ID NO. 20950
acgtgacacggccgcccgcgcgcccctgccctgcttccttcccccagcgtcccttcgtgtaggctctcctctccgcgattcgcccagatcttgccgggatccgccgcgtcttgcctggatttgccttcggaacccgcggctccgtccaggcgggtgagccaggaagggtcgttctttcccggccgcggcggatcggtgtttttcggaggcggttctgcggggtcgcttcgcgtcacgttcgtggtgctggttgtggcgccgtcggcgaggtgtgattcggaggggatttgtggtctacggagctgagacacggcatgaactacgacggggctgtggacagcagcggaaccgatgatgatctcccaccaccatatcagaagaacagaagtatgaaaggcagtgggcctaccactggtaatggaagagatactgttggtgctggtccatatactagagttcaacaatctcagacagatatggaaacacaaatatgtcaccttgagcaagaagcatattgttccgttcttcgagcattcaaggctcagtctgaagctataacatgggaaaaggaaagtctcattactgagcttaggaaggagctacgagtatctgacaaaaaacacagggagttgctaaacagagttaatagtgatgatattatccgaaaaataagggaatggagagaattatcaggtgggcttcagatgaatttggttaataatgctcagcgtttgcatgaccccatgcccagtcctaccacctctgctcgcaagaggcaaaagacgtctcaacccattccctctgcatctgtacctgcgccatctgctatgcactcacagcctttacctgcaccaatgcaaccatcatcttcaggagctaaaaaggcagccccacctgtcacaaaagtgaaaaagaccaaaccaggccagaagatacctggtggccctgcagtcaaatctataccattttctgctggtcctagtggatggggaccagttactaatagaaatacttctgctggccttccttctgaaggaccacaattaaatccattaattggccgtaaagtcatgactcggtggcctgatgataatagtttttatgaagctgtaataactgattatgatgctgcaaaggatgtctatgcacttgtttatgacatgaatactgcacatgagacatgggagtgggttgattttaaggagatggcacctgaggatgtaagatgagaaggtgaggagcctgatttagaccttctaggtcgtgatgctcccattcatggtgttaagaagtcaaccagccgtggtggccccatgttaggtgccggaagaggtaggggcccccaaaagaattcatttaagaaagactatccaccttcgcaaaacggtattgggaagaagagttctgactacatagaaattcttcacacagagacactcataaaggaggtggaacgggttttcagtgctggcaaccctggcccccttgagatggagagggccaaaaaagtgctgaaggagcatgaacaatcattaatcgatgcaattgcaaggcttgctgaggcgtctgatgcagatgaccatgcaccatcttcggaatacaaccatggttggaggaaccaacatggaggatgatatgcaagatggcatggctatcgatggccttggtgtgcggagctgcagatgccatgtgaaccttcgccaaaatgtacacaactccattagatttttggcctgttgtaagatctggatgctgattttattctagatttgacatgttcgtttgagtcatagttttctgaaagctcaaagttggctttt

SEQ ID NO: 20950 - protein, 304 aa, Panicum virgatum
  misc_feature: Ceres CLONE 1813809
  misc_feature (55)..(128): Pfam Name: ENT Pfam Description: ENT domain
MNYDGAVDSSGTDDDLPPPYQKNRSMKGSGPTTGNGRDTVGAGPYTRVQQSQTDMETQICHLEQEAYCSVLRAFKAQSEAITWEKESLITELRKELRVSDKKHRELLNRVNSDDIIRKIREWRELSGGLQMNLVNNAQRLHDPMPSPTTSARKRQKTSQPIPSASVPAPSAMHSQPLPAPMQPSSSGAKKAAPPVTKVKKTKPGQKIPGGPAVKSIPFSAGPSGWGPVTNRNTSAGLPSEGPQLNPLIGRKVMTRWPDDNSFYEAVITDYDAAKDVYALVYDMNTAHETWEWVDFKEMAPEDVR

SEQ ID NO: 20951 - DNA, 1393 bp, Panicum virgatum
  misc_feature: Ceres CLONE 1813816
  misc_feature: Encodes the peptide sequence at SEQ ID NO. 20952
attccgccacgcttcgccttcctccgccttcgtcgccttcccctatcccttcccggagcagcagttcccactccccactccacctccttctacaacgcccaccaccaccgtccaccgatcccccactcccctccgtcgcgcttcccgacccccctcgcgccgtacggagctccccttccggaaggaacgccgacgacatggcgttcctcaacgagctcggcctcgcgccgcgcaacccgggatccttcgcctgcggggcctggggcggctcgggccccgtcgtcaccaccaccagcccgaccaacaaccaggttatcgcggaggtggtggaggcgtccgtgaacgactacgaggagggcatgcgcgcctgcttcgatgccgctaggacatggatggcgattccagctccgaagcggggagagattgttcggcaaattggcgacgcactgagagcaaagctccatcaccttagcaggcttgtgtcacttgagatggggaaaattcttccggaagggatcggggaggttcaggaaatcatcgacatgtgtgattatgctgtggggctaagtcgccaattaaatgggtccattataccatccgaacgtccaaaccatatgatgatggaggtgtggaatcctcttggagttgttggtgttataacagcatttaatttcccttgcgctgtgcttggttggaatgcttgcattgctctggtctgcggaaattgtgttgtctggaaaggtgccccgactactccactgatcactattgcaatgactaaaatagtggctagtgtattggagaagaacaacttgccaggcgcaattttcacagctttttgtggtggcgctgaaattggccaagcaatagctcttgacactaggatacctttggtttcgttcactggaagtacaagggctggtctaatggttcagcaacaagttaatgcaagatttggtaaatgccttctcgaacttagcgggaacaatgccataattgttatgcatgatgcagatattcagctagctgtgcgttctgtgttgtttgctgctgttggcacagcaggacaacgttgcacaacatgccgtaggctgattcttcatgaaagcatatatcatacttttcttgatcaacttgttgaggtatataaacaagtccgaatcggggacccattggagaagggcaccttattgggaccactgcacactcctgcgtcaaaggagaactttttgaaaggtatccagaccatcaaatctcagggagggaaaatcctttttggaggatctgccatcgaatcagaagggaacttcgtacagccaacgattgtggaaatttcagcttctgcgccagttgtgaaagaagaactctttggccctgtgctttatgtgatgaa

SEQ ID NO: 20952 - protein, 398 aa, Panicum virgatum
  misc_feature: Ceres CLONE 1813816
  misc_feature (22)..(397): Pfam Name: Aldedh Pfam Description: Aldehyde dehydrogenase family
  misc_feature: SWISSPROT Homolog: EC 1.2.1.3 Aldehyde dehydrogenase (NAD(+))
MAFLNELGLAPRNPGSFACGAWGGSGPVVTTTSPTNNQVIAEVVEASVNDYEEGMRACFDAARTWMAIPAPKRGEIVRQIGDALRAKLHHLSRLVSLEMGKILPEGIGEVQEIIDMCDYAVGLSRQLNGSIIPSERPNHMMMEVWNPLGVVGVITAFNFPCAVLGWNACIALVCGNCVVWKGAPTTPLITIAMTKIVASVLEKNNLPGAIFTAFCGGAEIGQAIALDTRIPLVSFTGSTRAGLMVQQQVNARFGKCLLELSGNNAIIVMHDADIQLAVRSVLFAAVGTAGQRCTTCRRLILHESIYHTFLDQLVEVYKQVRIGDPLEKGTLLGPLHTPASKENFLKGIQTIKSQGGKILFGGSAIESEGNFVQPTIVEISASAPVVKEELFGPVLYVM

SEQ ID NO: 20953 - DNA, 681 bp, Panicum virgatum
  misc_feature: Ceres CLONE 1813822
  misc_feature: Encodes the peptide sequence at SEQ ID NO. 20954
acagcgaaacagaaccctgatcactctgtgtcggtgtctgtctctcccaccttgtctgaaagggcaaggcctccgtactagctccacacgcttctcaggtggctatctcaccctctgtctcgctctcaactcccgtcgcgcgagctgtccgtggcgggcggagagcgccagccgcccccgtaaggacggaagagggggcggagggagaggtggaggaggaagaaggaggagaggctccgtcaggcagtccatggcgcagtcccagatctcggcgcccgccgcgctccggctcttcttccacgactgcgccatcacgggctgcgatgcgtcgatcatgatcgtgaactcgaacggagacgacgagtggcggcacagcgacaaccagtcgctgaagcgggaggggttccagacggtcctgagcgccaaggccgccgtcgacggcgacccgcaatgccgcaacaaggtgtcgtgtgccgacatcctggcgctcgccgccagggagtccgtcgtccagagtggcgggccgtactaccaggtggagctcggccggtacgacggccgcgtgtcgaccagaggcagcgtcgtgctcccgcacgtcaacttcaacctggaccagctcaacgccttcttctccggcctcggctacaaccagaccgagatggtcgccctcctatgtgccca

SEQ ID NO: 20954 - protein, 143 aa, Panicum virgatum
  misc_feature: Ceres CLONE 1813822
  misc_feature (2)..(143): Pfam Name: peroxidase Pfam Description: Peroxidase
  misc_feature: SWISSPROT Homolog: EC 1.11.1.7 Peroxidase
  misc_feature: Useful for making plants with altered carbohydrate content
  misc_feature: Useful for making plants with altered cell wall content and/or composition
MAQSQISAPAALRLFFHDCAITGCDASIMIVNSNGDDEWRHSDNQSLKREGFQTVLSAKAAVDGDPQCRNKVSCADILALAARESVVQSGGPYYQVELGRYDGRVSTRGSVVLPHVNFNLDQLNAFFSGLGYNQTEMVALLCA

SEQ ID NO: 20955 - DNA, 2355 bp, Panicum virgatum
  misc_feature: Ceres CLONE 1813825
  misc_feature: Encodes the peptide sequence at SEQ ID NO. 20956
actgtgtcgtacttttgttgtgacagtgcaatagtcatcgaaaacacatcccagtagcttccatggccgtgaaaaacttgtgcccgagctcaagcagcagagctcatcatcagctgcttctgctcttcttttccttggccgtgtcaccgcacgtccctcgtgccagttctctctccttcagctacaacgccttcaacccctatgacttcaagccggaggccggcgcgagggtcaaagacggcaggctggagctgctcggcgacgagtttgcggcgcgtgccaggggccgggcgtggcacaagcagccgatgcagctctgggacggcgccaccggcaagtctgccagcttcgccgcgaacttcaccttcagcatccagtccgtgccagccggcaagggcgctcccggcgtcgggcacggcatgacattcttcctcgcgccgtacccgccggacctgccgcaggagtcctacgacggctgcctcggcctcttcgacgagaaccagaaggacaactacgcgacggttaacgcgtccggcgacgcgaggttcgtcgccgtggagttcgacacccaccaggacccctgggacccgagcagccggcacatcggcgtcgacgtgaacagtatggactcccgcggcgactacaaggtcttgcctgacggcagcctcgtcgacgccggcgtgatatccgcgacggtcgagtacgacaacggcacgaggaggctggacgtcgccttgatcgtcgggagccacaattacaccgccgcagcgaccgtggacctgccaagcttgctgccggagcatgtcgccgtcggcttctcggcggcgaccggagacgcttacgccagcaaccacaccgtgctctcgttctcctttctctcgacgttgccaaccaagaacatcacctccttgtctgcttcctcctcctcctccaataagagaaccatagagctcggcgccggggtggccgcagcttctgccttgctggccctcctactcgccgccgccgttgcggtgctactagttcggcgaaggggcaagcagccgtacgacgaagagaagctgaccacggacggcgacgactccctcgacgccgtcgacgatggtgacttcgagtccagcacggggccccgccccatcccctacgcccaactcgcggcggccacgaaggacttcgcggcggaggggaagctgggtcagggcgggtctggggcagtgtaccgtggccacctgaaggagccgggccgtgacgtcgctatcaaggtgttctctcggggcgcgtccatggaagggcggaaggagtaccggtccgaggtcaccgtcatcagccggctgcgccaccggaacctggtgcagctcatcggctgatgccacggccggaggcggctgctgctggtctacgagctggtcagcaacggcagcctcgatgtccacctctacagcacggaggcgacgctgacatggccgacgagataccaaataattcttggattgtcctccgccgtgttgtacctccaccaagagtgggaccagtgcgtcgtccacggcgacatcaagccgagcaacatcatgctggacgagtccttcaacgccaagctcggcgacttcggcctggcgcggctcattgaccatggcatgagcctgcagacgatgaccgccgtcgctggcacgccgggctacctggacccggagtgcgtcatcaccggcaaggcgtccaccgagcccgacatgtacagcttcggcatcgtgctgctggagatcgtctgcgggcggcggcccatggtggcgcccagcgccgccgaggggaaggacgggcaggtgttccggctggtggaatgggcgtgggacatgcacggccgcggcgcagcgctcggcgccgccgacgagcggctcgggggagccttcgacccgtgggagatggagcgggtgatcgccgtcgggctctggtgcgcgcacccggaccccaagatgcggccggggatctgtcaggccgccgaggcgctgcggtcgaggaagttcaggatgccgctgctgccgcccaagatgccggtcgccgtgtatcttcagccattcggtgcttccaccatggagttcagcgacaccaccggctctgtcgagtccatgccgtacacctcgatgacgagccacgccacaggaacaggggcgtccagctccagctcgccggcggtggtcacagagcaattgagcccaagagcatagacaggctatgtacccgtatgcgtatagtgtaattttgttcaaagcataacgtttttgatgaagttacgtacaattgtgcacttgagattgctccgctggttttatacgagttacaaaaaatatggttgtttcggat

SEQ ID NO: 20956 - protein, 434 aa, Panicum virgatum
  misc_feature: Ceres CLONE 1813825
  misc_feature (35)..(272): Pfam Name: Lectin_legB Pfam Description: Legume lectin domain
  misc_feature: SWISSPROT Homolog: EC 2.7.11.1 Non-specific serine/threonine protein kinase
MAVKNLCPSSSSRAHHQLLLLFFSLAVSPHVPRASSLSFSYNAFNPYDFKPEAGARVKDGRLELLGDEFAARARGRAWHKQPMQLWDGATGKSASFAANFTFSIQSVPAGKGAPGVGHGMTFFLAPYPPDLPQESYDGCLGLFDENQKDNYATVNASGDARFVAVEFDTHQDPWDPSSRHIGVDVNSMDSRGDYKVLPDGSLVDAGVISATVEYDNGTRRLDVALIVGSHNYTAAATVDLPSLLPEHVAVGFSAATGDAYASNHTVLSFSFLSTLPTKNITSLSASSSSSNKRTIELGAGVAAASALLALLLAAAVAVLLVRRRGKQPYDEEKLTTDGDDSLDAVDDGDFESSTGPRPIPYAQLAAATKDFAAEGKLGQGGSGAVYRGHLKEPGRDVAIKVFSRGASMEGRKEYRSEVTVISRLRHRNLVQLIG

SEQ ID NO: 20957 - DNA, 1795 bp, Panicum virgatum
  misc_feature: Ceres CLONE 1813827
  misc_feature: Encodes the peptide sequence at SEQ ID NO. 20958
agaactccgaatcgaatcgctgctccctccccctagctccctctaccttcgccagcaagcaagcaagccgctagcatcaagctactaggtcttggcggggaagctcctcgcctcccctatcggcccgctccggcgggggggaggagagtcctcccgctgcggcaggccgggacgcccagttcgcgccgccagaccgggcggcggcttccgcgggggaccgcgacccctcggctcctggcgcggcgggggtcgtggctcccggcgagatgagcagccacgcggcagggaccagcaacggcggatccggggacgcggccgccgccgccgccgccgcgggcgcggccaggaggaacactcggatgcccaagtactccaagttcacacagcaggagctgccagcttgtaagccaattcttactccaaaatgggttgtctcggtgttctttatcgtcggtgtcatctttgttcccatcggtgttgtttcattgctagctgcacgagatgttgttgagattattgatcgctacgatgaggcgtgtgtgccagccaacatgactgataacaagcttgcttacatccagaatgaaaccatatccaaagaatgcataaggaatctaacggttatgaaggatatgaagcagccaatatttgtgtattatgaactcgataacttctaccagaaccacaggaggtatgttaagagccgaaatgatgcacagctaagagataagcgtaaagctaaccagacatctgcttgtgaacctgagaagaccacggctaatggacaaccaattgttccttgtggtctcattgcttggagcttgtttaatgatacatatagtttcactcgtggtattaagaacttgacagtggacaagaaagatatttcctggaagagtgatagggagcacaaattcggcaaagatgtttttccaagcaacttccagaatggtgcacttaaaggtggagcaacacttaacccattgatcccgttaagcgagcaagaggacctcatcgtttggatgaggactgcagcacttcctactttcagaaaattgtatgggaggatatactttgacctcaaggagaatgacacgataacagtgagattgagtaacaactacaatacatatagcttcggcggcaagaaaaagctggtcctatcgactgcaacttggctcggagggaagactgattttcttggctttgcataccttatagttggtgggctctgcattttcctggcattcgcattcaccttgctgtacttcataaaaccaaggaaactgggagaccacaactacttgtcctggaacagacaccctgcaggccgctaggtggtaatatgctttggaaccccacagcgcgtaaagtggcccaactactaggaaatgtaacttgtatgaaatgcgctacccaaaccagaaattgccgctgagcgtaagcaagtttttccaggctagaagttgatgtaaattgtttgcaaagggatctaggtgactacgttgttttttttcgttgtttcttgtgtacttagggctgcatgtagcagtgatcacgagaatacctattgatccctaatgccctgtttcgtggtatgagtgctcaaaacgattcctatgtaatatttcatataccgtgtgatgttcaaatgatgcatgatccggctactgaatgttaaccgtgtgtggtattcagattaatgatgtaggttgattgtaatattggtagtaccaagttctgtacaaattgatagctatgtgatggccaaatagattcaaccgttttgcgtctc

SEQ ID NO: 20958 - protein, 356 aa, Panicum virgatum
  misc_feature: Ceres CLONE 1813827
  misc_feature (73)..(345): Pfam Name: CDC50 Pfam Description: LEM3 (ligand-effect modulator 3) family / CDC50 family
  misc_feature: Useful for making plants with modulated nitrogen use efficiency
MSSHAAGTSNGGSGDAAAAAAAAGAARRNTRMPKYSKFTQQELPACKPILTPKWVVSVFFIVGVIFVPIGVVSLLAARDVVEIIDRYDEACVPANMTDNKLAYIQNETISKECIRNLTVMKDMKQPIFVYYELDNFYQNHRRYVKSRNDAQLRDKRKANQTSACEPEKTTANGQPIVPCGLIAWSLFNDTYSFTRGIKNLTVDKKDISWKSDREHKFGKDVFPSNFQNGALKGGATLNPLIPLSEQEDLIVWMRTAALPTFRKLYGRIYFDLKENDTITVRLSNNYNTYSFGGKKKLVLSTATWLGGKTDFLGFAYLIVGGLCIFLAFAFTLLYFIKPRKLGDHNYLSWNRHPAGR

SEQ ID NO: 20959 - DNA, 1565 bp, Panicum virgatum
  misc_feature: Ceres CLONE 1813851
  misc_feature: Encodes the peptide sequence at SEQ ID NO. 20960
acctaatgctgtcgccgtagcactaagccgtgcgccaaccttgcggtgctcctgcctcgctgttgctgtcgcgcccatggacgccatggacagcaagagcaaggggagcaagaagcaggccaagagcctgctcggcaagtacgagctgggccgcctgctggggcgcggcacgttcgccaaggtctacctcgcgcgcccggtcgccggcggcgagcccgtggcggtgaaggtgctcgacaaggccgaggtcatgggcacggctggcatggcgccgcgcgtgctccgcgaggtgaccgccatgcgccggctgcaccaccccaacgtgctccgcctccacgaggtgcttgccacgcgcgccaggatctacctcgtcatggagctcgcgccgggcggggacctgctctccaggctcgccgcgctcccgcggcgccgcctgcccgagcacgccgcgcgccgcgtgttcgtgcagctcgtctccgcgctctcctactgccacgcgcgcggcgtcgcgcaccgcgacgtcaagccgcagaacgtcctcctcgacggcgacggtaacctcaaggtctccgacttcggcctctccgcgctcccggactcgctccgcgacgacggccgtctccacaccgcctgcggcaccccggcctacgcggcgcccgaggtgctccgccgcaaggcctacgacggcgccaaggccgacgcgtggtcctgcggcgtcatcctcttcgtcctcctcgccgggcacctccccttcgacgactcgaacatcgcagacatgtgccggaaggcgcaccgccgggagtacgagttcccggagtgggtgtcgcagccagcgcgccggctggtgaatcgcttgctcgacccgaacccggccacccgcgtcgccgtcgaggcgctggtgacgcacccgtggttcaagcgctcgctcagcgtcgactcgcagctcggtgggctgctcaacggccagccggagcgcgcgctagcgttccaggcgccggcggtgaacgccttcgacatcatctccatgtcaccggggctcgacctgtccggcttgttcgacaagaggaaccgagagaagaggttcatgaccatggcgtcgccggagcagacgctggagcagctcgggcgcgccggcgggaagctcgggtacgtcgtggtggggaagaaaggactcgagtgcctgccgctagggggcctgtcaggctcagggctggccgcgatgacagttgagatgtccgaagtggcaccgcccctgatgctcgtcgagctgaggctcgaggtagccgacggcgacggcaaaacgttcgggtgggaggagctgaggcgtgagcttggagatgtagttagggcttggcatagctgccaagatttctgacaagaccagacaccagagggctgcttgtaaatcacaataaattcttttttgttcttttgcagcctggaggactgtactggaggtgtgtacccataatatgttagtgtggttagttaatatttgctgcttagaattatatatggtgctgtagagatgtttgttgttcttatgtatgtggagatatatgagc

SEQ ID NO: 20960 - protein, 432 aa, Panicum virgatum
  misc_feature: Ceres CLONE 1813851
  misc_feature (22)..(280): Pfam Name: Pkinase Pfam Description: Protein kinase domain
  misc_feature (305)..(364): Pfam Name: NAF Pfam Description: NAF domain
  misc_feature: SWISSPROT Homolog: EC 2.7.11.1 Non-specific serine/threonine protein kinase
MDAMDSKSKGSKKQAKSLLGKYELGRLLGRGTFAKVYLARPVAGGEPVAVKVLDKAEVMGTAGMAPRVLREVTAMRRLHHPNVLRLHEVLATRARIYLVMELAPGGDLLSRLAALPRRRLPEHAARRVFVQLVSALSYCHARGVAHRDVKPQNVLLDGDGNLKVSDFGLSALPDSLRDDGRLHTACGTPAYAAPEVLRRKAYDGAKADAWSCGVILFVLLAGHLPFDDSNIADMCRKAHRREYEFPEWVSQPARRLVNRLLDPNPATRVAVEALVTHPWFKRSLSVDSQLGGLLNGQPERALAFQAPAVNAFDIISMSPGLDLSGLFDKRNREKRFMTMASPEQTLEQLGRAGGKLGYVVVGKKGLECLPLGGLSGSGLAAMTVEMSEVAPPLMLVELRLEVADGDGKTFGWEELRRELGDVVRAWHSCQDF

SEQ ID NO: 20961 - DNA, 638 bp, Panicum virgatum
  misc_feature: Ceres CLONE 1813853
  misc_feature: Encodes the peptide sequence at SEQ ID NO. 20962
acctgcacttgcttgacattcccaagcaaactcattcatccaacagcggccacactcagctcgtcaagctaatttcacattcacacataatccaagcaatggcctcgcgctcatcacgtcgtggatatcatcgcctttgccgccgtcgcgcggctcgccgcccctgcaaccaccaccgaggcccccatgacctgcgggcacgcgagctccgccatcggcccctgcatctcctacccccgccccaccagctccggcccctccgcaccctgctgcagcggcttgaggagcctcaactccgccgccaccagcacctccaacaggcgcaccgcatgcaactgcctcatgtcctccgccggcagggtgagtggcctcaaacttgaaaacgccgcaagcataccctccaagtgcgtactcaccatcccctacaccaaaagcccaaacgttccactgctccagggtgagctaaacaacaaccagaaccgtcactaccaatatacttaattatcgtctatgatcgacttctatgatgatgaataaaaatctctccggcgtcgcgtgcactgtcgtcatgcgctaactcagctctcgtggtacgtcgtcactcaccatgtgatgagctatctacagactgagtcctc

SEQ ID NO: 20962 - protein, 104 aa, Panicum virgatum
  misc_feature: Ceres CLONE 1813853
  misc_feature (3)..(81): Pfam Name: Tryp_alpha_amyl Pfam Description: Protease inhibitor/seed storage/LTP family
MTCGHASSAIGPCISYPRPTSSGPSAPCCSGLRSLNSAATSTSNRRTACNCLMSSAGRVSGLKLENAASIPSKCVLTIPYTKSPNVPLLQGELNNNQNRHYQYT

SEQ ID NO: 20963 - DNA, 650 bp, Panicum virgatum
  misc_feature: Ceres CLONE 1813861
  misc_feature: Encodes the peptide sequence at SEQ ID NO. 20964
acaggagcccgcggagtgatcaaaaaagcaagtaacaagagaagatgaccgacgttgtgatgaccatcagtactaccacggatttggaaagagaactgaataaatccgacaagctgattgtgctggagttcatggcgccgtggagtgagccatgcaaggtcatgaaggaaccttataggcgaatcgccagagcaagaaaagacagagtcaacttctacacgctcaacgtcgacaagttcaaagatttggcggaggaagctggcgtggaggcgctaccgatgtacgttctactgaagaatgacgatgtgatcgacatggtcgttggcgtcaggaggcacgagctcgagaacgccataaaaaacaatatctaacgactgatccgatcagatcatccatgcgtcgagaacgaacgggaaatgaatgattcatagttaaataagcccactactgtacgtcccatgtgttgtatcacggatactgaaactcgtgtgtgcatgtacacatcctagctagctcagccgccgtagatccccatgttatacattgtacgtatggatctcgattatcgattgtcccatgtttgatttcctaaacttctgtggaagtagacccccatgttatgtatactctggtttgaaacagtttgcaat

SEQ ID NO: 20964 - protein, 108 aa, Panicum virgatum; identical to SEQ ID NO: 17896
  misc_feature: Ceres CLONE 1813861
  misc_feature (4)..(107): Pfam Name: Thioredoxin Pfam Description: Thioredoxin
  misc_feature: SWISSPROT Homolog: EC 1.8.1.8 Protein-disulfide reductase

SEQ ID NO: 20965 - DNA, 709 bp, Panicum virgatum
  misc_feature: Ceres CLONE 1813886
  misc_feature: Encodes the peptide sequence at SEQ ID NO. 20966
atccaaggccaagcagtgtggaggcagcaggaagaagctttatgctaccgtagcaggggtagtatatattagtaggatccgtagggtgttctttttggtaggttgattaggggacttgtgaggatgttggcggtgttcagcggcgaggttgtggaggtgccggcggacctggtggcggccggcagccggacgccgtcgcccaagacgagggcgtccgagctggtgagccgcttcctcgggagctcggagccggccgtgtccatccagctcgccgacctcgggcacctcgcctactcccacaccaaccaggccctcctccgcccaaggtcgttcgcggtaaaggacgagatattctgcctgttcgagggtgtgctggacaacctggggcggctgagccagcagtacgggctgtccaagggcaccaacgaggtggtcctcgtcatcgaggcttacaagacactgcgggaccgggcgccatacccggccagcttcatgctctcgcagctcaccggcagctatgccttcgtgctcttcgacaagtccaccaactccctgctcgtcgcatctgatcccaagggcaaggtgcggctcttctgggggatcactgcggatggctgcgtcgccttctctgacgacattgacatgctcaaaggatcctgtggcaagtcacttgcacctttcccacaaggttgcttctactcccatgctc

SEQ ID NO: 20966 - protein, 195 aa, Panicum virgatum
  misc_feature: Ceres CLONE 1813886
  misc_feature: SWISSPROT Homolog: EC 6.3.5.4 Asparagine synthase (glutamine-hydrolyzing)
MLAVFSGEVVEVPADLVAAGSRTPSPKTRASELVSRFLGSSEPAVSIQLADLGHLAYSHTNQALLRPRSFAVKDEIFCLFEGVLDNLGRLSQQYGLSKGTNEVVLVIEAYKTLRDRAPYPASFMLSQLTGSYAFVLFDKSTNSLLVASDPKGKVRLFWGITADGCVAFSDDIDMLKGSCGKSLAPFPQGCFYSHA

SEQ ID NO: 20967 - DNA, 1282 bp, Panicum virgatum
  misc_feature: Ceres CLONE 1813907
  misc_feature: Encodes the peptide sequence at SEQ ID NO. 20968
acagaaagggtgccattgccaagaaaaggaaaagaaaaccatttttcccctgcccaaatcgagggcgtgtcgaggtaaacaagagcgcgcggctcggtgccgaaggaaaggaatccggccccaggaattcgtgggagctgcggaaaggagtgagctttcgccgccgattccgtcgccggcgagcgccgaaatttgccatctcttctagatatcagaacttgaggcccaagatggagctctgcacggcatgtatctggacttcagcgcactggtctcaaacagtaaatcctaacagacaagcatcataccatggatttgtgaggtcaatctccgcatcaccccaaaggagaaggcgatcaaccctctgtgtcatgaatgctgcatcaactagtgctccagtctcatctcaaggcgtaacccaacttccacgcagcaacggcccaggtctcaaaagtatatccagcaacaaacccagcagtgcaatggagcaacttgatattgaacgtggtgtttgtatcccattccgaaagtacactccagaaatggtcaggaaaaaggttttggattcaagaggctccatactatccctcgctagtcggggagtggagataatttggaaactcggattttactggtcatctctaatgtatgacttcttggttggacgggatgaagaaattgttccatatcgcgcccgccagcttcgcaatcttttatgtgacctggggccatctttcatcaaagcaggacaggttctagcaaacagacctgatattattcgagaggattatatgaataaactctgcatcttgcaagatgatgttcctccagtccctaaccaggtggcttttgccataattgaggaggaacttggacagcctctagagagattattcagcaaaatttcatcggagacaatagcagcagctagtttgggtcaagtttaccgcgcgacactaagagaaactggcgaggatgttgctattaaggttcagagaccagggattgaaccaataatataccgagacctttttctgttccgcactttggcttcatttttgaatgggattagtcttcagaaattagggtgcaacgcagagcttattgttgatgaatttggtgaaaaacttttggaggaacttgattacactcttgaagctacaaatatcgaggatttcctagaaaattttaaggatgacccaactgttaagatacctcaagtgtacaagcaactctcaggttctcgtgttctggtgatggagtggatagatggaattagatg

SEQ ID NO: 20968 - protein, 350 aa, Panicum virgatum
  misc_feature: Ceres CLONE 1813907
  misc_feature (212)..(332): Pfam Name: ABC1 Pfam Description: ABC1 family
MELCTACIWTSAHWSQTVNPNRQASYHGFVRSISASPQRRRRSTLCVMNAASTSAPVSSQGVTQLPRSNGPGLKSISSNKPSSAMEQLDIERGVCIPFRKYTPEMVRKKVLDSRGSILSLASRGVEIIWKLGFYWSSLMYDFLVGRDEEIVPYRARQLRNLLCDLGPSFIKAGQVLANRPDIIREDYMNKLCILQDDVPPVPNQVAFAIIEEELGQPLERLFSKISSETIAAASLGQVYRATLRETGEDVAIKVQRPGIEPIIYRDLFLFRTLASFLNGISLQKLGCNAELIVDEFGEKLLEELDYTLEATNIEDFLENFKDDPTVKIPQVYKQLSGSRVLVMEWIDGIR

SEQ ID NO: 20969 - DNA, 571 bp, Panicum virgatum
  misc_feature: Ceres CLONE 1813907-R
gatctcactgaaacaataaaggatggagcacggatgttccttatcgatgctgggatcaggagacaacttatactggctttcactgaagactccaagttgcatgtagaagagcttgttgatgtgtacagactggttgaagatcaaatagatatgccttcagttgcccttgaggttctccaagatctgccatccgttgtgcgcgatttcatgctttcttggagtgactccatcctgtcggatcgccggtactaaatacttttaaatcacccttagagatagcacggaaagcagagcgaattttaggccccgcaagattatggtacctcaagacaatctacaaaaatagaaaaaagctagacaggcattcctactcgctgtatacaatttgtttctcctgttttgtatagcgaaatctgcaacgttcaatttcttcttttctagatcttctcagtttatatgttctgtatatcgcaagggaacttgtatatagaatgagcttgtaattttgaatacagtaggtgtacagaaccagcttactaatatatacatcaggatcaacgtctttctgtcg

SEQ ID NO: 20970 - DNA, 588 bp, Panicum virgatum
  misc_feature: Ceres CLONE 1813932
  misc_feature: Encodes the peptide sequence at SEQ ID NO. 20971
aacactgcgcgaccctcagccgcaccacatgatataaattaggaacaccaccaccagctcaatttcggctggctgggtggattgccatctcccatcaggacccgaaacgcggcgggaggcagcagcgcaggatggccacccactctgctctcgccgcggcgagcatccccacaagcacccacgctgcgcagcatggagacatccacgcagagggtgaacttcgcctacttctacgggctgaggccgggatcattctacgtcagcaacgccgccagggaggcgtcattctccgactggctcgatgcgcacctcgccgcccgcgccaccggagagaacacggtgagggcgcccgctgacgccaagctcaaggaggcgaacaacgagttcggccacatcaaccggaacttcctccggtgctggcacggccgcaacgactccacgctcgatgacctcgtcgcctacgacaccggaggcgtcaacaacacgactcaccacctcaagtactactcgatgctcggcaccttcaagggatacctcaagatcgtcaacgacaccaccatcatcgacgaccgcaatctcatcatcatc

SEQ ID NO: 20971 - protein, 131 aa, Panicum virgatum
  misc_feature: Ceres CLONE 1813932
  misc_feature: SWISSPROT Homolog: EC 1.2.1.13 Glyceraldehyde-3-phosphate dehydrogenase (NADP(+)) (phosphorylating)
METSTQRVNFAYFYGLRPGSFYVSNAAREASFSDWLDAHLAARATGENTVRAPADAKLKEANNEFGHINRNFLRCWHGRNDSTLDDLVAYDTGGVNNTTHHLKYYSMLGTFKGYLKIVNDTTIIDDRNLII

SEQ ID NO: 20972 - DNA, 1937 bp, Panicum virgatum
  misc_feature: Ceres CLONE 1813940
  misc_feature: Encodes the peptide sequence at SEQ ID NO. 20973
atacctttcttcttcttccatctcctggcgctctctgcgtggtgggttccagtgctgcagcctccgcccggcagccgcggcggcgatccgagagctgcatcgcgagagcgaggaaaccaccgccgcgccatccaacatgaacagggggcactcaggttccatgatcagcaactgcggcacctccgagctcaccgacgagaagaacaaggacagccagacctcggcttcccggcactgcccaagctgtggacacagcctcgactgcaatccggacatgattggtcttcctgctggtgtcaagtttgatccgtcagatcaggagctgatagagcaccttgagtccttggtggaggaaggaggctccagagctcaccctctcataaatgattttatacccaccatacaaggagatgatggcatttgctacactcatcctgagaatctcccaggtgtgacaagaaatggcctcagcaagcacttcttccacaggccatccaaagcctataccactggcacaaggaagaggagaaggatccagtcagagcatggatcgcatggcagtgaagatgttggcgaggcgcggtggcacaagactggcaagacacgcccggtgatcgtgggagggcggcagaaggggtgcaagaagatcctggtgttgtacagtagctacggaaaacaagggaaaccgaagaagaccaactgggtgatgcaccagtaccacctcggggaccaggaggagaaggatggagaactggtcgtgtccaaggtcttctaccagacgcagctgcgttctaccacggtaacggtggagcatcacacgagggatggtgatgaaaaggtggcagagacatcgaaggcaatgcagaatgtgcttcctggctttgtggctgataccacagcggtgactatcgccatggtgccacagcagcagcagcagcagaaacggcagaggcagcctgatggccaatgcagctttgctcctgccaagatgtctcatgaggttggtgtagtaggcggtcaggtagcagatgatcaaggagaaaagcgagacaaccaccatataccatcacaacataatgtcttatcagatctgcatgcaaaaccagtacccaccatgtctttccatgtcggtacaccattgaacacagtttcaacagcgatatcacctcaagcgcgagataggtcagtcgtcctggacagtaggttctgttatccagcaatccttcaccgaaatgaaaggaaccaggagcagcagcagaaggtgggccgcagatctgctgaaatggaaggattgataattgcctgccaatcagcaagcagtacagaagcaggagcatcacctgaacggccttatcaacacaactggcctcctgatcagccaagatcaacatcaattacaatgtagctagtagcaccagtggcggagccaggaatcctaccaagggggggcggacggacatagataaccttttacataagcgccaatgatcaaattgtcaattgctgacatgctgcttgccccgactgtgctttcgtagcctaagagctagagctttaataagagttttagtctgctaccgactgttttcctgagtgttgtgtgtctgtagagcatgcagtctaactgactctctactttagactactatttgctgcagtgctcactactgagcaactgtaaatggtactggatcctcagaaatcggcgcagagcaagggggggccactgcccaggttcctcgacacttggctccgccactgagtagcaccaaatgaagatgataagtagtattcaaccaaccgtagcagcatcaaatcgaaacttccacctatttcctggttttccatagagctagaattttttaaggctgcaagtatattattttagatatttccatttgtactaataaaagttgtatagatatgtcattgtttgt

SEQ ID NO: 20973 - protein, 422 aa, Panicum virgatum
  misc_feature: Ceres CLONE 1813940
  misc_feature (50)..(197): Pfam Name: NAM Pfam Description: No apical meristem (NAM) protein
  misc_feature: The sequence is a functional homolog of SEQ ID NO 1710 in the 10/374,780 US patent application
  misc_feature: The sequence is a functional homolog of SEQ ID NO 542 in the 10/666,642 US patent application
  misc_feature: Useful for making plants with altered carbohydrate content
  misc_feature: The sequence is a functional homolog of SEQ ID NO 210 in the 10/666,642 US patent application
MNRGHSGSMISNCGTSELTDEKNKDSQTSASRHCPSCGHSLDCNPDMIGLPAGVKFDPSDQELIEHLESLVEEGGSRAHPLINDFIPTIQGDDGICYTHPENLPGVTRNGLSKHFFHRPSKAYTTGTRKRRRIQSEHGSHGSEDVGEARWHKTGKTRPVIVGGRQKGCKKILVLYSSYGKQGKPKKTNWVMHQYHLGDQEEKDGELVVSKVFYQTQLRSTTVTVEHHTRDGDEKVAETSKAMQNVLPGFVADTTAVTIAMVPQQQQQQKRQRQPDGQCSFAPAKMSHEVGVVGGQVADDQGEKRDNHHIPSQHNVLSDLHAKPVPTMSFHVGTPLNTVSTAISPQARDRSVVLDSRFCYPAILHRNERNQEQQQKVGRRSAEMEGLIIACQSASSTEAGASPERPYQHNWPPDQPRSTSITM

SEQ ID NO: 20974 - DNA, 686 bp, Panicum virgatum
  misc_feature: Ceres CLONE 1813971
  misc_feature: Encodes the peptide sequence at SEQ ID NO. 20975
acctccgatcccccgcctcatccgttcccctcacctctcagctctagcgcggcggagagagctagctagagagaggaccgggccgggagattgccggcggccggcggttgtctagctgtggaacaaacgactatctcttgtgcgcgcgcgcgcggatcaagcggggagttttggtgttgtgaatggtgaacggcgaggcggaggcggagtgcacgcgggcgtcgctgctggggaggtatgagatcgggcgcacccttggggagggcaacttcggcaaggtgaagtacgcgcgccacaccgccaccggcgcccacttcgccatcaagatcctcgaccgcaacaagatcctctcgctccgcatcgatgaccagataaggagggagatcgggacactgaagctgctcaagcacccgaatgtcgtccgcttgcacgaggttgctgctagcaaaacgaagatttacatggtgcttgagttcgtcgacggcggcgagctctttgacaagattgctgtaaagaggaaactgtctgaacatgagggaaggaggcttttccagcagctaattgacggcgtcagctattgccatgataaaggtgtctaccacagggaccttaaggtaccccaaatattgtaaacgccaggattgttgaccagtttgtgctcttgcatcacatatgtatcatcatgg

SEQ ID NO: 20975 - protein, 149 aa, Panicum virgatum
  misc_feature: Ceres CLONE 1813971
  misc_feature (19)..(149): Pfam Name: Pkinase Pfam Description: Protein kinase domain
  misc_feature: SWISSPROT Homolog: EC 2.7.11.1 Non-specific serine/threonine protein kinase
  misc_feature: Useful for making plants with modulated salt sensitivity
MVNGEAEAECTRASLLGRYEIGRTLGEGNFGKVKYARHTATGAHFAIKILDRNKILSLRIDDQIRREIGTLKLLKHPNVVRLHEVAASKTKIYMVLEFVDGGELFDKIAVKRKLSEHEGRRLFQQLIDGVSYCHDKGVYHRDLKVPQIL

SEQ ID NO: 20976 - DNA, 684 bp, Panicum virgatum
  misc_feature: Ceres CLONE 1813988
  misc_feature: Encodes the peptide sequence at SEQ ID NO. 20977
gactccctctctctctctcccacaaaccaaggccacggttcctgaccaccaccacggcaccaccaccaccaccaccagcagccagtgcccggatctggcaagggtgcgccggagcagctagcgacgaggtgaactgatcgatcgaccggcagcagcagcagcatggggctgaggaagcgcctgctgctgtgcttcgggcgcggcggcgaggaggagcggcggcaggaggagaagcgggaggagaagcgggaggaggcggggggcaagcgccccggcggcggcggcggggggaagccgaagctgcggcggctgagcacggcgaacctgcggtcgctgtcgctgcaggacctgtcgcggaagctggagaccaccaggctgcacgccttcacgctggacgagctcaaggccgccaccaagaacttctccgccgccaacttcctcggcgagggcggcttcggccccgtctacaagggcttcgtcgacgcccgcctccgcccgggcctcctcgagccccagcacgtcgccgtcaagtacctcgacctcgagagcgacggcgtccaggggcaccgcgagtggctggcggagattgtgtacctcgggatgctgagccacccgcatctggtcaagctggtggggttctgcaaccaggacgaccaccggatgctggtctacgagtacatgccc

SEQ ID NO: 20977 - protein, 173 aa, Panicum virgatum
  misc_feature: Ceres CLONE 1813988
  misc_feature: SWISSPROT Homolog: EC 2.7.11.1 Non-specific serine/threonine protein kinase
MGLRKRLLLCFGRGGEEERRQEEKREEKREEAGGKRPGGGGGGKPKLRRLSTANLRSLSLQDLSRKLETTRLHAFTLDELKAATKNFSAANFLGEGGFGPVYKGFVDARLRPGLLEPQHVAVKYLDLESDGVQGHREWLAEIVYLGMLSHPHLVKLVGFCNQDDHRMLVYEYM

SEQ ID NO: 20978 - DNA, 691 bp, Panicum virgatum
  misc_feature: Ceres CLONE 1813996
  misc_feature: Encodes the peptide sequence at SEQ ID NO. 20979
aatgcagtagccagccgagccgcctcaccccacctcgccgctcgcgatggcggtcacgcgtgtcgcggtggccgtcgcactcccgtccgcgctgccctcctcccgccgccgccgggccgtgcccccctcctcctgccggcctctccccacctcccgcgcgtccaaggcgctgcacgccgccgccgcccccgccgtaggcgcggtcgacgaggagacccccgccgcgtcgccttcctcagattctagcaagggagtggagaacctggtgatcattggttccggcccggccgggtacactgctgcaatctacactgccagggcaaacctgaagcccatcgtgttcgaaggttaccaggtgggtggtgtccctggtgggcagctgatgaccacgaccgagggggagaatttccatgcgcaaggggaggggaggggagggcgacgggagggtttcgtggaggtcgagctgccgcgccgccttcgtgtccgatggttcgcgcggggggcgccgcgtcggaaggccactggacccacctcgccgccgctcccgttcccttctgagcctcggcggcgatggcgctccagacggctaggcggcgacggacgcttctgccaactccataagtctggcccaaagcccatcatcactactggggcgcggtgaggcgcgcggcccacctagtatgtacatagc

SEQ ID NO: 20979 - protein, 204 aa, Panicum virgatum
  misc_feature: Ceres CLONE 1813996
  misc_feature: SWISSPROT Homolog: EC 1.8.1.9 Thioredoxin-disulfide reductase
MAVTRVAVAVALPSALPSSRRRRAVPPSSCRPLPTSRASKALHAAAAPAVGAVDEETPAASPSSDSSKGVENLVIIGSGPAGYTAAIYTARANLKPIVFEGYQVGGVPGGQLMTTTEGENFHAQGEGRGGRREGFVEVELPRRLRVRWFARGAPRRKATGPTSPPLPFPSEPRRRWRSRRLGGDGRFCQLHKSGPKPIITTGAR

SEQ ID NO: 20980 - DNA, 684 bp, Panicum virgatum
  misc_feature: Ceres CLONE 1813997
  misc_feature: Encodes the peptide sequence at SEQ ID NO. 20981
acagtcacagtcccccggcgacctcctccccgccgcctcctcccctctccgcccttctaccgcggccgccgcctccatgggccccgtccgactcgccctcctcgccgtcgtcgcgctggccgccgcgggcgaggcggtgtacatcccctacaacacgtcggcgggggtggtggccgggaagctcaacgtgcacgtggtgccgcacacccacgacgacatcgggtggctcaagaccgtcgaccagtactacgtcggatccaacaactccatccagggggcatgtgtgcagaacgttctggattcgctcatcccggccctgctcaaagacgagaaccgcaagttcatctatgtcgagcaggcatttttccagagatggtggaggaaccagaacgacatgatcaaggataccgtgaaggggctcatcagctctggacggttggaattgatcaatggggacatgtgcatgcatgatgaggccactgtgcactacatcgacatgattgatcagactacgctcgggcacaagttcatcaaggaggagtttggtcagattccacggattggctggcagattgatccatttggccactctgcggttcaggcataccttcttggtgcagaagtaggatttgatgctttctatttcttccggattgattaccaagatcgtgatactcaaaagga

SEQ ID NO: 20981 - protein, 202 aa, Panicum virgatum
  misc_feature: Ceres CLONE 1813997
  misc_feature (37)..(202): Pfam Name: Glyco_hydro_38 Pfam Description: Glycosyl hydrolases family 38 N-terminal domain
  misc_feature: SWISSPROT Homolog: EC 3.2.1.24 Alpha-mannosidase
MGPVRLALLAVVALAAAGEAVYIPYNTSAGVVAGKLNVHVVPHTHDDIGWLKTVDQYYVGSNNSIQGACVQNVLDSLIPALLKDENRKFIYVEQAFFQRWWRNQNDMIKDTVKGLISSGRLELINGDMCMHDEATVHYIDMIDQTTLGHKFIKEEFGQIPRIGWQIDPFGHSAVQAYLLGAEVGFDAFYFFRIDYQDRDTQK

SEQ ID NO: 20982 - DNA, 1471 bp, Panicum virgatum
  misc_feature: Ceres CLONE 1814004
  misc_feature: Encodes the peptide sequence at SEQ ID NO. 20983
aactgcaacgcattccaaacccaccacccagcggccagcgcaagggagacccgtgctcgacttgccttcctctctctctctctctatctatctatacgtcgtgctgccccaactccgcctcctgggtgccggcgagcctcactaccccgaccgaatccgctctccctcctccgccttcgcgcgtgcggccgcaagagggagtgtctcggctcctccgcgtgcgcggacccgagcttgttgtgagttgtaaggtcaaatccattctcactagtcagcaccgatgtctccttcggctcttctacctgttctctccgtcctcctcctcctgtgctgctggcccccggctcttgctttcttcgctgagcctgcgctttcacgagctgcttgtggagacgaccaacttgtcgtcttggatgcctctgatgggctcgtcaacctgtcggtcaatggggttctggtgcaggacggcgttcttgcctgccagaagctccgcttctactttcggagtggttgcctccgctgtggcgaggtgtcagatgcgtggagggttgaggttaagcagtactgtggtggtgaagggagcaaatccagccacgcaacttcacatcaaaatgtcccaaggaagctgttgaggcagtccgcagataatagctcaagaaatgattatgacccatgtggaggtttgagcttgcatgaaaataatcaggacaccggtgattcttcagaaaatgatgatcacctccttgctgtgccgggtgtgattcttctatgctgtggtctcatgtttccatgcttccatgctgaaagaaaagaagccagtaggcatgatactgcaagtattcagcgcaatacaattgaatcagtttcatcttatgaagtaagcatgtcatctgagaaagtcccaccgactccgcatcgaatacctccaagcccttctagatttgcaccgtctccacatgtagctagagttggatctgtcaacttaagcatccagcagatcctcagggcaactcagaatttctcaccttcctttaagttaggtgaaggaggatttgggagggtctacagggctgtcttgccagatggcaccgttgttgcagtcaagagggctaaaaaggatcaatttgcaggtcctagggatgagtttagcaatgaagtagacttgcttgctaagatagaccaccgaaatttggtgaggttactgggctttactgacaaaggaaatgagcgtattatcatcactgagtatgttccaaatggcactctaagagaacatctagatggtcaacacggcagagtcctggattttaatcagcgcctagaaattgcaatcgatgttgctcatgcacttacttatctccatttgtatgcagagaagacgataattcaccgggatgtgaagtcatcaaatatcctactgacggatagctaccgggcaaaagtgtctgactttggatttgcaaggagtggc

SEQ ID NO: 20983 - protein, 396 aa, Panicum virgatum
  misc_feature: Ceres CLONE 1814004
  misc_feature (247)..(396): Pfam Name: Pkinase_Tyr Pfam Description: Protein tyrosine kinase
  misc_feature: SWISSPROT Homolog: EC 2.7.11.1 Non-specific serine/threonine protein kinase
MSPSALLPVLSVLLLLCCWPPALAFFAEPALSRAACGDDQLVVLDASDGLVNLSVNGVLVQDGVLACQKLRFYFRSGCLRCGEVSDAWRVEVKQYCGGEGSKSSHATSHQNVPRKLLRQSADNSSRNDYDPCGGLSLHENNQDTGDSSENDDHLLAVPGVILLCCGLMFPCFHAERKEASRHDTASIQRNTIESVSSYEVSMSSEKVPPTPHRIPPSPSRFAPSPHVARVGSVNLSIQQILRATQNFSPSFKLGEGGFGRVYRAVLPDGTVVAVKRAKKDQFAGPRDEFSNEVDLLAKIDHRNLVRLLGFTDKGNERIIITEYVPNGTLREHLDGQHGRVLDFNQRLEIAIDVAHALTYLHLYAEKTIIHRDVKSSNILLTDSYRAKVSDFGFARS

SEQ ID NO: 20984 - DNA, 710 bp, Panicum virgatum
  misc_feature: Ceres CLONE 1814005
  misc_feature: Encodes the peptide sequence at SEQ ID NO. 20985
ctcctcgtcgtcgtcgtcttcctccacctgcccatctccatctggattccttttccgctcctgctcgctgcagtacaagatgcgcgcctctttcccccggtaggtaggtggacgagaaacctgatgatgatgatggccgccgccgccaaatctcccccgttcactctcgcctcttcccgcccgcagccccgcgccgccttcctctcccccagcctcgccttcagaccccgccgcgcctcgctgctcgccacacccgccccggacgccacgcccgccccggacgccgccaccaaccccttcgccgcgctcctccaggtgccccgcacgctctggcgccgcaccctccagcccctcggggactacggcttcggcacccgcagcgtctgggagggcggcgtcggcctcttcatggtctccggggccgcgctcctcgccctcgccctcgcctggctcaggggcttccagctccgctccagattccgcaagtacaacaccgtctttgagttcacgcaggcatgtgggatctgcgtcggcacgcccgtccggatacgaggggtcaccgtcggatccgtcgtccgcgtcgactcatccctcaggagcatcgatgcgctcgtcgaggttgaagatgataaaatcatcataccacgtaattcagtggttgaggtgaaccagtctggtcttctaatggagacactcattgatatcacacc

SEQ ID NO: 20985 - protein, 195 aa, Panicum virgatum
  misc_feature: Ceres CLONE 1814005
  misc_feature (120)..(195): Pfam Name: MCE Pfam Description: mce related protein
MMMMAAAAKSPPFTLASSRPQPRAAFLSPSLAFRPRRASLLATPAPDATPAPDAATNPFAALLQVPRTLWRRTLQPLGDYGFGTRSVWEGGVGLFMVSGAALLALALAWLRGFQLRSRFRKYNTVFEFTQACGICVGTPVRIRGVTVGSVVRVDSSLRSIDALVEVEDDKIIIPRNSVVEVNQSGLLMETLIDIT

SEQ ID NO: 20986 - DNA, 1771 bp, Panicum virgatum
  misc_feature: Ceres CLONE 1814016
  misc_feature: Encodes the peptide sequence at SEQ ID NO. 20987
gcttaatcatctccctgtccgtgacgtcgttgctctctcctgcggcgcgctcgcctcgttcagatttgagcaggggcggcgtcaccaagtagcagaagcatcgccatgcactgcttccggttcccgagctgggagcggggggagcgggagggcgacaagcggcgggggccggcggcggcgacgacggggcggtcgctgtcggcgcggtccaacagcagcacgacgtcgacggaccccgacgtgcggcggtcggcgtccgagtgctgctccctgaacgcgtcggagctgagcagcgccggctccctggggcggtgccggcagctgtcgctgtcgcagcggccgcccaacgcgctccgcgtcttcaccttccaggagctcaggtccgccacccgcgggttcagccgctcgctcatgctcggcgagggcggcttcggctgcgtctaccggggcaccatccggagcgcgctcgagccgcgccggagcctcgacgtcgccatcaagcagctcggccgcaagggcctgcaggggcacaaggagtggatgacggaggtgaacgtgctcggggtcgtcgaccacgccaacctcgtcaagctcatcggctactgcgccgaggatgaagagcgcgggatgcagctgctgctcgtctacgagttcatgcccaacgggagcctggccgaccatctgtccgcgaggtcgccgcggccggcctcttgggcgatgaggctcagggtggcgctggacaccgctcgagggttgaagtatctccatgaagaatccgaattcaagataatatttagggatctgaagccatcgaacattcttctcgatgagaactggaacgcgaaactatcagacttcggcttggcgagattaggacctcaagaaggaagccatgtctccacagcggtggtggggacaattggatatgcagctcctgaatacatccacacaggacgcctcagcaccaagaatgacatatggagcttcggtgtggtgctttacgagctcctcacaggccggcgacctctcgaccgaaataggccgagaggcgagcagaatctcgtggactgggtgaagccctactcttctgacgctaagaagcttgagactgtgatcgatccgaggcttcaagggaactatagcataaaatcagcagcccagcttgcgtcagtggcaaacaagtgcctggtgcgccatgctaggtaccgccccaagatgagcgaggtgctcgagatggtccaaaagattgtcgagagcagcgaacttggaacaccggagcctcccctgatcagcaactcaaaagaattagtgagtgatgaaaagaaaaggaaaggccttgatttgaagagaagaatcgcagatattagagctggggaggggagatggtttgcatggcaaagatggacacccaagcttgtgagaacacaatgattcacagcaacagcagatgaggtgtttcttgcatggcttgacgcatagttagtagtgaaaacagcaagtgactgaaatatcacctggagttttcatttagcatacaagtcggagagcatcacaattgtaaacaaacgatttgatccagcccatggtggcaccacaaaataagggataagttcacactttctggaatcacacacaggcagtcttctccacctgctttggaggttccatgtttttttattagagcttaactaaagttctagtagtaatttttccaagcagattttattgtacagtttaacttggttttatggagtgatttttgagttttact

SEQ ID NO: 20987 - protein, 441 aa, Panicum virgatum
  misc_feature: Ceres CLONE 1814016
  misc_feature (98)..(378): Pfam Name: Pkinase Pfam Description: Protein kinase domain
  misc_feature: SWISSPROT Homolog: EC 2.7.11.1 Non-specific serine/threonine protein kinase
MHCFRFPSWERGEREGDKRRGPAAATTGRSLSARSNSSTTSTDPDVRRSASECCSLNASELSSAGSLGRCRQLSLSQRPPNALRVFTFQELRSATRGFSRSLMLGEGGFGCVYRGTIRSALEPRRSLDVAIKQLGRKGLQGHKEWMTEVNVLGVVDHANLVKLIGYCAEDEERGMQLLLVYEFMPNGSLADHLSARSPRPASWAMRLRVALDTARGLKYLHEESEFKIIFRDLKPSNILLDENWNAKLSDFGLARLGPQEGSHVSTAVVGTIGYAAPEYIHTGRLSTKNDIWSFGVVLYELLTGRRPLDRNRPRGEQNLVDWVKPYSSDAKKLETVIDPRLQGNYSIKSAAQLASVANKCLVRHARYRPKMSEVLEMVQKIVESSELGTPEPPLISNSKELVSDEKKRKGLDLKRRIADIRAGEGRWFAWQRWTPKLVRTQ

SEQ ID NO: 20988 - DNA, 546 bp, Panicum virgatum
  misc_feature: Ceres CLONE 1814022
  misc_feature: Encodes the peptide sequence at SEQ ID NO. 20989
actcgtcgttgcctgtccctccccctttcagcttcaaagacgtctaatgcaggacttgctcggtctgctgccaacttcttcccgatgtggccgggtctatcttgggcatccactgcgaactgtgctgataacactgccacctacaacctgtatatcttttcagtgaacggaatcgaacggagccttaactcgcttccttctgcctgcgtcggtgacatggttatcgccattgtgaggaagggaaagcctgacctcctgaagaaggtgatgccatctgtcattgtgaggtagcgcaggacatggcctccagaggatggtgtctacatgtgctttgaatactatgctggagtgattgtgaacccttacggagagatgatacgttctgccatcactggacctatcaaataggagtgtgctgatatgtggaccatgattgctactgcggcaaatgcaatcgtctactgaaatcagcttgttgactttgaatcaatagcattgccttgtgttcaagaggtgagccagagttcctatcgagactagcttttg

SEQ ID NO: 20989 - protein, 96 aa, Panicum virgatum
  misc_feature: Ceres CLONE 1814022
  misc_feature: Useful for making plants with modulated biomass
  misc_feature: Useful for making plants with modulated heat sensitivity
TRRCLSLPLSASKTSNAGLARSAANFFPMWPGLSWASTANCADNTATYNLYIFSVNGIERSLNSLPSACVGDMVIAIVRKGKPDLLKKVMPSVIVR

SEQ ID NO: 20990 - DNA, 491 bp, Panicum virgatum
  misc_feature: Ceres CLONE 1814025
  misc_feature: Encodes the peptide sequence at SEQ ID NO. 20991
aaacaaatcacacagaattctctgcggtgaatggaggtgccggccgagtgcgcgggcggcgggagggtcaagaaggacgcggacctcttcctcgtcgacgacctactcgacctgccgtgccacggcgacgaggaggaggtgcaggaggcggtggtggaggagggcgagggcgagggtagtacagcgagggattgtggcggcgccggcggcgaggacggtgccgccgggaacgcttccaacgattcgtctacggtgactgcgctggacagctgctgcaactccctctccggcctcgccgactgggacttctccggcgggctgtgcgagccgtgcgacctattggcggagctggaatggctgtcctagtacatgggcgaggactacttcccgacggaggacctcaagaagctgcagctcatcaccggcatcccgccggcctccacctcctctttcgctgttacggccttctctcccatccccgctcccgcgac

SEQ ID NO: 20991 - protein, 111 aa, Panicum virgatum
  misc_feature: Ceres CLONE 1814025
  misc_feature: The sequence is a functional homolog of SEQ ID NO 1655 in the 10/374,780 US patent application
  misc_feature: The sequence is a functional homolog of SEQ ID NO 1657 in the 10/374,780 US patent application
MEVPAECAGGGRVKKDADLFLVDDLLDLPCHGDEEEVQEAVVEEGEGEGSTARDCGGAGGEDGAAGNASNDSSTVTALDSCCNSLSGLADWDFSGGLCEPCDLLAELEWLS

SEQ ID NO: 20992 - DNA, 2981 bp, Panicum virgatum
  misc_feature: Ceres CLONE 1814027
  misc_feature: Encodes the peptide sequence at SEQ ID NO. 20993
atttcaattttcaaatctgctcctcctcctgctgctccgccgccgccgcacctccaaaccccacctcgtcgccctccctccccgaaccctaaatccgcgagccatcgccgcccgtgcccgatggggttcgtggatccggcggcgccgctgctggcgacgtgcggcggcgacacggtgaagctcttcgacgttagggtggagtccggcgacccctgcgtcctcgcctacacccccgcgcccggcaaccccgtcaacgccgtcaagtggaaccacaccaatctaattgtagcaagcgctggggatgataagaagatctcattgtggcataaaaaaggtcaaaatgtaggacagctaccaacagccactgttgatcgtggtgacgacatagaggagtgcatttattctatcagttttagcaacaaaggttctcgatatctttgctctggtgggagtggccatattgtcagaatatgggatttgcagcggaagagatgtatcaaatggctaagtggtcacactgacacaattactggtgtaatgtataactgcaaagatgaacatttggcatcgatcagcatgaagggtgatctcattcttcacaatcttgcttctggagcacgtgctgctgaacttagtgatccaaatggacaagtgttgagagtgcttgattattcacgaaacagtagacatttattggtgacagcaggagatgatggttctgtgcatctttgggatacaactgcaaagtctccgaaggtgtcatggctgaagcaacattctgcacccacaagtggtgtttgtatatcgccatcaagtgacaagataattgctacagttggcctggacaagaagttgtacacattagattcatcgtcaagaagaccaacacacaccattcctcatgtggccccattctcctcgttggcatataatgatgatggtactatattagctgcaggcacaaatagtggacgtgtgatattctatgatgtccggggaaaacctcagccattgaccattcttcgtgcctacaatagctctgaggctgtgacaggtttatgttggcaacggtcgaaacctgtcattgttaatgagaacagttcttctgaagttgctcttcttggaggaactagtgaagagtctgttcttatgccagatcccttgccttcggcgacacctacaagtttttcttctggaggggtcactgtaggtcttcgttcttctttgacaccaaacacaagtggctttctttcgacatcgaactcttctaccatggaggaaactccatatagagcacgtccgttatctggaggaccattatcaaagctacaggctcctcgtagtaactataatctaaaggatgatatggatgtcttttctccacttgttgatgtccagcctttcacaccatctagtggcagctggtgggatgagcatggaagtgatgatgccaaaaaagatgataaaccaggagaaaagaagttgtcatcaactaggaagttttcgtatatggaaggcaatgatgagcctcatccgatctcagattggaggtctactgtaaattcaagacaggacttctcatctgtgactactacatccatgccatcatggaagagtgaactgtctatatcttcgccagagacagccactggaaatgcattaccagataggctaactcaccgtcaccagctctcacgctttggggcttcagccttttcaacaggtggcttggcttttacagccttacaagattcatcttcagctggtcactcgctgaagggttctctaacaagtaacattttaatgaacctacaaaacaagggtatcttaagcaactcacactcttccctggacgcatcatctcccaatcttcagagttcacttccctcaccctatggttcaaaggctatttcatctgtgaatcctgatcaaccaggagcagcacaatccagttctatgtggagatcaacaacatatactgataaaatgagctcatcctctgtttttagtgatgggttagcttcagcgtttggctcaccaaaatcaaagaagatgggagcagaaacaaaagatgagttgctcagtagtcttttgtcaagacaagaggctgcaactgcctcttcatcctcaagccctctagcaagcaatgggttagggctgccacaattgtcaaacacaagttcttcaactgaccaacagggagcttcttccttctcacttcagtatgtgcagcgcatgcttgaagaatctcttgggtctgttcagaagtccatccatgaggatgtgagaaatctccacattgaacttttaagacagtttcacatgcaggagatggaaatgtccggtgtgctgaatttggtcctggagaaggtggaaggcttgacaaaggaggtgcagcaactaagaagggagaaccaacagctccggcagcagcttctataatctatgcttggcaggatgtgggtgttgggtgaggtgttcttagttcggcattgttatgcttcgggaagtggaaggccgcagcatgcatgggtttctgaggtaggcccagatgattgattgattcctatgttggtttgtctggttcatgacaaggagttcacgttcgacaccgttgtacatataagcctcttagtttagaagcatattgaattatcagtttctctatttcttgtgttgtgttggactgcttccatgtatgttgatagcacggtggcacatgggcggcctaattttcgatggcctatgtgaaaggctaacaacagaggttttaatgtagctttcgttactggccttctgtgataaacactcgtcctaaaatagcattatataccacattgcttttgttatagcagctgtgagtaactagtagttggagcaaagcatagcatagcatatgatgaaaccaagctggctgtgtttccgatgtaagatccaacattgtgtaaataactgcagaaaaggtgtccttaaacagtacc

SEQ ID NO: 20993 - protein, 773 aa, Panicum virgatum
  misc_feature: Ceres CLONE 1814027
  misc_feature (123)..(205): Pfam Name: WD40 Pfam Description: WD domain, G-beta repeat
  misc_feature (31)..(69): Pfam Name: WD40 Pfam Description: WD domain, G-beta repeat
  misc_feature: SWISSPROT Homolog: EC 2.3.1.48 Histone acetyltransferase
MGFVDPAAPLLATCGGDTVKLFDVRVESGDPCVLAYTPAPGNPVNAVKWNHTNLIVASAGDDKKISLWHKKGQNVGQLPTATVDRGDDIEECIYSISFSNKGSRYLCSGGSGHIVRIWDLQRKRCIKWLSGHTDTITGVMYNCKDEHLASISMKGDLILHNLASGARAAELSDPNGQVLRVLDYSRNSRHLLVTAGDDGSVHLWDTTAKSPKVSWLKQHSAPTSGVCISPSSDKIIATVGLDKKLYTLDSSSRRPTHTIPHVAPFSSLAYNDDGTILAAGTNSGRVIFYDVRGKPQPLTILRAYNSSEAVTGLCWQRSKPVIVNENSSSEVALLGGTSEESVLMPDPLPSATPTSFSSGGVTVGLRSSLTPNTSGFLSTSNSSTMEETPYRARPLSGGPLSKLQAPRSNYNLKDDMDVFSPLVDVQPFTPSSGSWWDEHGSDDAKKDDKPGEKKLSSTRKFSYMEGNDEPHPISDWRSTVNSRQDFSSVTTTSMPSWKSELSISSPETATGNALPDRLTHRHQLSRFGASAFSTGGLAFTALQDSSSAGHSLKGSLTSNILMNLQNKGILSNSHSSLDASSPNLQSSLPSPYGSKAISSVNPDQPGAAQSSSMWRSTTYTDKMSSSSVFSDGLASAFGSPKSKKMGAETKDELLSSLLSRQEAATASSSSSPLASNGLGLPQLSNTSSSTDQQGASSFSLQYVQRMLEESLGSVQKSIHEDVRNLHIELLRQFHMQEMEMSGVLNLVLEKVEGLTKEVQQLRRENQQLRQQLL

SEQ ID NO: 20994 - DNA, 1632 bp, Panicum virgatum
  misc_feature: Ceres CLONE 1814033
  misc_feature: Encodes the peptide sequence at SEQ ID NO. 20995
ccctccgcctctcgctccctttcgcatctggttcggagagctctcttgaagcctcgagcctgcctctcgcctgtgctctgctctgctccgcgcctccggctccgccgccgcgctagctgttgcattgcagcccgcgagccctgagctgatagctaggtacgctcgcgttcttggccgctgcaaatgtgggtcggttcggagctctgatgaactccgtgcccaggatggggaatggacgggggaactctggctttcagtagattcgaaatgatgatgatgatgtagtaatttttacagttctagacagagaaaaatgataaaatcttgaggggtggaaataatggcacaatcgaactgggattcgcaacacggttgccgaaattcttgggaaaagtaaccgatcgaacaccctgctaatattgattcctcctctctctgcagctcgttcgttcttcaccacacttccgagacatggagttcgaagaccactgccacaaggtccaggagcccaagttcgactgcctgctcttcgacctcgacgacactctgtacccgttgagttctgggatcgcaggccatgtcaagaagaacattgaagactacatggttgagaagctgggtattgatgagagcaagatcgagaaccttggcaacctgctgtacaagaactacggcaccacgatggccggcctcagggcgatcggctacagcttcgattacgatgagtaccacgccttcgtccacggaaggctaccctacgacaacatcaagcccgaccctgttctcaagcacattctcaagaacctgcgcatccgcaaactcatattcaccaacggcgacaaggtccacgccgtgcgcgccctcaagaggctgggcctggaggactgcttcgaggggatcatctgcttcgagaccctgaacccgccgtgcccgccgcggagcgaccaggcgcccgagatcttcgacatcgccggccacttcgccctgtccggcactgccgacgagctccccaagactcccgtcctgtgcaagcccaacgtcgacgccatgggggaggcgctcaggatcgccaacgtcaacccccacaaggcgatcttcttcgacgacagcgtgcgcaacatccaggccgggaagcagatcggcctccacacggtgctggtgggcaagtcgcagcgtgtgaagggcgcggaccacgcgctggagagcatccacaacatcagggaggcgctgccggagctgtgggagaaggccgagaaggcggaggacgtgctctacgccgaccgcgtggccatcgagacctccgtcacggcgtaaaaaccccccggcgcgccgtcagctagccgaagtttctcgacgtccagggccgctgcagcagcgagatcacgcatcacacgcgcccgggccagggactggtggtctctcacggtgggaactgaattccagcgatggccgggccgggaatttccgacaacagcaggggtgcagcatgtaacgggggggaacagatgacgagctcgtgatgggctggtcctaatatatatacatatatatatgtatgtatcggccagaccttttgcttgtaaattactactagtagaagaaataataagaagaacaacggagtttacttgt

SEQ ID NO: 20995 - protein, 280 aa, Panicum virgatum
  misc_feature: Ceres CLONE 1814033
  misc_feature (15)..(233): Pfam Name: Hydrolase Pfam Description: haloacid dehalogenase-like hydrolase
MEFEDHCHKVQEPKFDCLLFDLDDTLYPLSSGIAGHVKKNIEDYMVEKLGIDESKIENLGNLLYKNYGTTMAGLRAIGYSFDYDEYHAFVHGRLPYDNIKPDPVLKHILKNLRIRKLIFTNGDKVHAVRALKRLGLEDCFEGIICFETLNPPCPPRSDQAPEIFDIAGHFALSGTADELPKTPVLCKPNVDAMGEALRIANVNPHKAIFFDDSVRNIQAGKQIGLHTVLVGKSQRVKGADHALESIHNIREALPELWEKAEKAEDVLYADRVAIETSVTA

SEQ ID NO: 20996 - DNA, 717 bp, Panicum virgatum
  misc_feature: Ceres CLONE 1814044
  misc_feature: Encodes the peptide sequence at SEQ ID NO. 20997
aatccatcctaagcagtagccgaactctccgtctctacccactcttcccgccaccatggccgccgccgccatgtgcttgccccattctctctcccctccctttcaagccactcgccgccgcccagcgcctccctcctgcttgcactctgagcgcggcgtctccttcgaccccggctccgccttctaccgcagcgacagcgccgcgggccgcgacctcgccgtcctcgcggccacgctccaccgccgccacggccgcctcgatccctccgccccgttcctgtgcctcgacgcgatgtgcggctgcggcgtccgtgccctccgctacctagcgcaggctggcgccgacttcgtctgggccaacgacgcctccgaggcgctccgccctgtcatcgtcgccaacctctcccgcttcgagcggggttcgccgccggcggaagcggggcgcaggaggtgggtcgtgtcgcacaacgatgccacccggctgctagcggagcggtacctccggcgcgagtacttcgacgtcatcgacgtggactcgttcggtggcgacgccgcgtatgtaagggcggcgctcttggcgctcaagattgggggccttctctacctgacgtccacggattggcggtcggcgagagggtatggttcgagaaggtggtgctgcgcgggaagcagctcttctgggatttcacgtaagaccagtattctcgtattttgcat

SEQ ID NO: 20997 - protein, 141 aa, Panicum virgatum
  misc_feature: Ceres CLONE 1814044
  misc_feature: SWISSPROT Homolog: EC 2.1.1.32 tRNA (guanine-N(2)-)-methyltransferase
MCGCGVRALRYLAQAGADFVWANDASEALRPVIVANLSRFERGSPPAEAGRRRWVVSHNDATRLLAERYLRREYFDVIDVDSFGGDAAYVRAALLALKIGGLLYLTSTDWRSARGYGSRRWCCAGSSSSGISRKTSILVFC

SEQ ID NO: 20998 - DNA, 1240 bp, Panicum virgatum
  misc_feature: Ceres CLONE 1814048
  misc_feature: Encodes the peptide sequence at SEQ ID NO. 20999
aagaggcgcgcacgcttaacgccgccgccgccgccgcgcactagggtttttcggacctcgcatcctcctcctcctccccgtcacgccgccgccgggagccgcgcccaagctcgagcgccagccatggccttcggagctctcgtcgcctcgaggctggccaggtccggccgcaccctcgcctccgccgttacccaggctcccgcggcccagcgaacggcgcctcctctgctctccaggctcggagctgtagctcgtgctctcagcacaaagccggcggcggcagatgtcatcgggatcgatcttggcacaacgaattcctgtgtctccgtcatggagggaaagacaccacgggttattgaaaatgccgaaggcgcgaggacgacgccgtccattgtcgccaagaatcagaatggtgacctgctaattggtatcactgcgagccggcaagcagtgaccaatgcccagaacacaatccgtgggtctaagcgtctgattggtaggacttttgatgacccacagacccagaaggagatgaagatggtgccttacaagattgtcagggcaccgaatggtgatgcctgggtggagatgggtggccagaagtactccccaagccagatcggtgcatttgttctcaccaagatgaaggaaactgcagaggcttaccttggcaagacagtctccaaggctgttattaccgtcccagcttatttcaatgatgctcagcgtcaggctaccaaggatgctggtaggattgctggactggaggtgatgaggattatcaacgagcccactgctgcagctctgtcgtatggaatgaacaacaaggagggccttatcgctgtatttgaccttggtggtggcacatttgatgtgtcaatccttgagatatcaaatggtgtttttgaggtcaaggcaaccaatggtgatactttccttggtggtgaggattttgatggtgccctgcttgagtatcttgtttccgagttcaagaaatctgacaacattgatctgagcaaggacaagttagcgctgcaaaggctcagggaagctgctgagaaggccaaggtcgagctttcctccactatgcagactgaaatcaacctcccctttatcactgctgatgcctctggtgcgaagcacttcaacattaccttgaccagatcgaagtttgagtctcttgtgagcaacctcatcgagaggactcggatcccttgtgtgaactgcctcaaggatgctg

SEQ ID NO: 20999 - protein, 372 aa, Panicum virgatum
  misc_feature: Ceres CLONE 1814048
  misc_feature (55)..(372): Pfam Name: HSP70 Pfam Description: Hsp70 protein
  misc_feature: Useful for making plants with modulated heat sensitivity
MAFGALVASRLARSGRTLASAVTQAPAAQRTAPPLLSRLGAVARALSTKPAAADVIGIDLGTTNSCVSVMEGKTPRVIENAEGARTTPSIVAKNQNGDLLIGITASRQAVTNAQNTIRGSKRLIGRTFDDPQTQKEMKMVPYKIVRAPNGDAWVEMGGQKYSPSQIGAFVLTKMKETAEAYLGKTVSKAVITVPAYFNDAQRQATKDAGRIAGLEVMRIINEPTAAALSYGMNNKEGLIAVFDLGGGTFDVSILEISNGVFEVKATNGDTFLGGEDFDGALLEYLVSEFKKSDNIDLSKDKLALQRLREAAEKAKVELSSTMQTEINLPFITADASGAKHFNITLTRSKFESLVSNLIERTRIPCVNCLKDA

SEQ ID NO: 21000 - DNA, 152 bp, Panicum virgatum
  misc_feature: Ceres CLONE 1814048-R
agttttctgtgagggctacgaaaattgtaacatttctttcggcaaattttgggctgctggataaattgtgtggggcggacaaactcatctgtcactagatttaattatctgttttctgtgagggctaagggaattgtaatatttctttgggc

SEQ ID NO: 21001 - DNA, 1108 bp, Panicum virgatum
  misc_feature: Ceres CLONE 1814051
  misc_feature: Encodes the peptide sequence at SEQ ID NO. 21002
gatttcggcccactaccgcacagccgcgccggcccgcagaggggcctggcacagaaatcgtcgctccctccccctcctcgagctgctccgggctccggcgaaaagctggccggatctctgctgctctgccgggcggatcgctccctccccgtctcccgaagccacaccacagccgccgctcaagccccctcctaggaggagtggggcccccggccgcccacggctgccgcgcgccatcccgttggagagaagacggaggctggggttgcggttggctgccgtcgtcgcgtcgcgacgcgcggaggtcgttgcgggcggtggaggtgggtgtgtgtgtgtgggggggggggtgagtacgggatcgaggggagccgcgccgccgcttgggcgttggcgggtgttcccacgccgatgccgcagtggcgccgccgtgagtcgtatcagttgcgggcgggggtctaccgtcggtggttaagcggatgcattgcaatccattctgaccctccgcgggcaacgaatttagcaacctccgtgtgggatagttgcaagaataaaatggatgacggttccatcttccatgaattgagacagtcgcatcaaaataaattgttgatagcatcatgagtgcttacaactttgatactgacggaagcagaaattgcttgcttcttcaccgatccagagcattgccacggtgctgtagctgtcatggaagatgccatcagtattgctgccgtcgtggatgcsacgcgatgaaratgtcgtccttgccgagggaaagttactgcatcgccaagccatgaaagtcaagcagagcctggaatacatttgaaggtttggagtctgaagttgcctgcagactacgacsccaagccatggaagtcaagcagagcctggaatccatgtgaagagtatggtgctgggaacatggtgtcgacatatggagacatctatagttatggaattttagtattggaaaccataactgggaggaggcccactgaragtgcattccsacaargattgagcctccgtgaacaakttgatctggccctgcaggacaggaacaggattgtggatgctgttgacacacccctgtcactggacc

SEQ ID NO: 21002 - protein, 60 aa, Panicum virgatum
  misc_feature: Ceres CLONE 1814051
  misc_feature: SWISSPROT Homolog: EC 2.7.11.1 Non-specific serine/threonine protein kinase
  misc_feature (30)..(30): Xaa is any aa, unknown, or other
  misc_feature (32)..(32): Xaa is any aa, unknown, or other
  misc_feature (39)..(39): Xaa is any aa, unknown, or other
MVSTYGDIYSYGILVLETITGRRPTESAFXQXLSLREQXDLALQDRNRIVDAVDTPLSLD

SEQ ID NO: 21003 - DNA, 408 bp, Panicum virgatum
  misc_feature: Ceres CLONE 1814051-R
gagagtgagagaacacagaacatgacaggtggatgatatgccaacgctgcgacacagaacatgacaggtggatgatatgccaacgctgcgacagtttcatgtgcacatggacagtaccattttccttatcaagtgcctgcagcttttttagaaaatgggaaagatatctgcaacttatttttttaagaggaagaacgtggaacggtttctttttgtattcctttgcagagttgatagcttcagccatgagccaatgaggctacacggtcgcatagtatatgtattgttcatgatgtgcactggcacattcatacctgtttttggtgatgcaattgtatccggagatgttaacgacgttgagggtcggggcacctgccgctatgggcacccgatgttttccgtttcagc

SEQ ID NO: 21004 - DNA, 2251 bp, Panicum virgatum
  misc_feature: Ceres CLONE 1814061
  misc_feature: Encodes the peptide sequence at SEQ ID NO. 21005
atcagaccatcgcccccttccactccctccctttcacagttggagttgctgataaaatacaaaaacagaggagagagagagaagaaaggggaggagggaggaaggaaaaaacagggagagaggggaggttgccaggtgaggggagagataaataaacacagcgaggcctctggctcggcggcgcccgggatgcggctccactgttctccttccggcatcgcgccgctgcgggaggcgccaatggcgctggactgatctgtgagttacccgcttctcaggtgccgggctgccggcggcggttgaaggtcagaccttgccggtggaatgcacggtcggcgaggcggcgagtcatgttacttctcgcacaattcgagatcggttcccctgattgcgctcattccttgatcgcttcggaggttcaaccctgaatttaaggagggaaaaaagggaccgtttccagcttgcaactagtttgcttgtgtagatttggctgctggaagattcatgcagcttttagcattgctgtagagtcgttgtgaagtttgaaggctgttctggttatgttgagggaccagcaggtattgaccttagattcagcaagctcatcaagctcggcacctgatttgaccctctctgaagagctcacttctggaagcagcaactgtgtgtctgagagcctgcaggtggcttggtcagagaaaggaggacaggtgaaggctctggtgaattgttatagcaagaagaataaggtttgcagtggttcagggagtcctgcaatcgaatcttggggctctgagatggaggatgctgatcagaatggcgaagtcaacacaagtgagctcatcgaccggattggtcgggagttgaccatctcctgcctgctccgtcttccccggtcctactattacgacgtggcatctgttaaccggtctttctactcccttgtaaggtccggggagctttataggttgagacgggaggcccggattgtcgagcagatgatctattgctcatgcaatgtactcgagtgggatggttttgatccatgccgccaacggtggttcagcatcacttccatgcctgccatagaatgctttacacttgccgataaagaatcccttgccgtgggcaccaatatccttgtctttgggaggagggtggaggcccatgttgtgctgaggtatagccttctaactaactcctggacaactggggagatgatgaacacaccgaggtgcttgtttggctcagcaagctttggtgagaaggctattgtagctggtggtatcggtgagaatggtacattgaactctgctgagctttatgattctgagatgcagacctggaccactcttccaaacatgaacagggcgcggcagatgtgctctggtttcttcatggatggcaagttctatgtcattggggggaaggcagagaagcataatgagatccttagttgtgctgaggagtttgatttggagaatggcacctggcgattgatcccagatatggcacaaggccttaatggtgggagcggtgctccacctcttgttgctgttgtgaataatgaactttatgctgctgattatgcatcaaaggaggttaaaaagtatgataaggaaaataatgcttggatcactcttggatcattacctgggaggtatacatcagttcatggctggggcttggcttttcgcagctgtggagatatgctcattgtcattggtggaatcagtgtcggtggtagtggagtgattgaaatttgttcctgggtacccaataatggactgcctgattggaagatcattggcacccaccattcaggaagctttgtatacaactgtgctgtgatgagttgttgacatacaaaggttattacattatcaaaactgtacatcttgaccaaaaggaaggataaagaaggcaaattctgctgagcttgtttactacatgatggggaacttctgccccctggaattttaggctgagctgaaggttggatagaactttctcatgtagattcttgcttatgtctaatctcttcattttaattttaattccatttggagggcctgcaattggacatgcagtgcagcattagattaataatttggagcaacctcaaacattttgatcttccctgggtaccttgatcaaagttttttagctccagagagtagccttacattggcaaatcatttgcccatagattgtaagaaataaaggaagaaagaaatatgtccttgttgac

SEQ ID NO: 21005 - protein, 433 aa, Panicum virgatum
  misc_feature: Ceres CLONE 1814061
  misc_feature (224)..(269): Pfam Name: Kelch_1 Pfam Description: Kelch motif
  misc_feature (271)..(318): Pfam Name: Kelch_1 Pfam Description: Kelch motif
MLRDQQVLTLDSASSSSSAPDLTLSEELTSGSSNCVSESLQVAWSEKGGQVKALVNCYSKKNKVCSGSGSPAIESWGSEMEDADQNGEVNTSELIDRIGRELTISCLLRLPRSYYYDVASVNRSFYSLVRSGELYRLRREARIVEQMIYCSCNVLEWDGFDPCRQRWFSITSMPAIECFTLADKESLAVGTNILVFGRRVEAHVVLRYSLLTNSWTTGEMMNTPRCLFGSASFGEKAIVAGGIGENGTLNSAELYDSEMQTWTTLPNMNRARQMCSGFFMDGKFYVIGGKAEKHNEILSCAEEFDLENGTWRLIPDMAQGLNGGSGAPPLVAVVNNELYAADYASKEVKKYDKENNAWITLGSLPGRYTSVHGWGLAFRSCGDMLIVIGGISVGGSGVIEICSWVPNNGLPDWKIIGTHHSGSFVYNCAVMSC

SEQ ID NO: 21006 - DNA, 1598 bp, Panicum virgatum
  misc_feature: Ceres CLONE 1814077
  misc_feature: Encodes the peptide sequence at SEQ ID NO. 21007
aattagcatcttaataatccacctccgaatcgcaagcttaacccaactccttccctttatcaatcctccccctcgatcagctaggagcatagctgcgaacgccgcccaacttctcgccacggacgcgcactccctcccgcgcgacgtggccacgtaaggccatgcactcgctgttccggcgcgccaaggcgccagcggcggcgtccccgccggcgccgatgccgatgctgtccttcccgggcaagaaggcgctgcgcttcgagggggacacctcggcggccgagagggacgcggacctcgcggtcctgatgcacgcccgcgcgcacgtcgtgctcgcctcggagagcgccagggccggcgccgcggaggccgccgccgcgctccgcacgtacctccgcgtcatctacgcatcgaacatcctggccgggcccggccagcagaagctctgcttcgcgtggcgcgacgacgctgtcgcagggaacgagagcgacgggaggaaggccaaggccaaggcggcggcggtggggcagggccagggccagaccctgcggcacacgtcgctggcgacggagtgggcggtggcgctggtcgcgttggccgcggagctggctcgcgccgcggcggccgaggacaggcgcggggccgacgggatacggcgcgcttgcggcgcgctctgcgacgcggcgggcgcgctgagggcggccgcggggccccgcacgacggacgcctgcctcgccgcgttcgagcgcctcgtgctcgtgcaggcgctcgagtgctacttcgagcttgccgtcgccggtggcaagccgccagcgttgcgctccaagattgcgcagcaggtcagccacgactatcatgaagtgttcatcagtttgggcagcctcgagcagcagcagcagccgccgccgccgatcgacaagtcgtgggcgccgcacgtgcaggccaaggccgcctatttccaagccgaggccaacctccagcgcgtgcgggcgctgcgcgagcagggccccggctccgtcggcgaggcggtggcgcggctccggctcgcggtatcggtcctggacgccgccgccggcaaggcgggcccgctgggcaagaagtcgtcgtcgtcgtcgtcgtccaccgcggcagcgctggcgcccctgcgggacgccgcggcgcgcctccggaaggaggtcgaggccgagctggccgccgcggagaacgacaactgccacgtgtacttcgagcgcgtgccggccgccgacgcgctcaaggagctgcctgcgctgccggagccgctcgtgcgggccaccgcagtggagaaggtcctcagggaagccgacggcgaggcggccttggccaacggcggggcggcgacgattggccattgaccttttttttgtggtgaaggtggttggaattttatttttctccttgttgcatgcgttcgcgtgtttgttcgttggtttgttcgaatccaatcgtgtgctcggcgagaaaattcgcgcggccctgatttgtgattgtttcttcttttttctggtgattcctacgtttcaatgagaagcagcacgataattgtattcgttttaaatagagaatgtacaattgttcgg

SEQ ID NO: 21007 - protein, 403 aa, Panicum virgatum
  misc_feature: Ceres CLONE 1814077
  misc_feature (21)..(401): Pfam Name: BRO1 Pfam Description: BRO1-like domain
MHSLFRRAKAPAAASPPAPMPMLSFPGKKALRFEGDTSAAERDADLAVLMHARAHVVLASESARAGAAEAAAALRTYLRVIYASNILAGPGQQKLCFAWRDDAVAGNESDGRKAKAKAAAVGQGQGQTLRHTSLATEWAVALVALAAELARAAAAEDRRGADGIRRACGALCDAAGALRAAAGPRTTDACLAAFERLVLVQALECYFELAVAGGKPPALRSKIAQQVSHDYHEVFISLGSLEQQQQPPPPIDKSWAPHVQAKAAYFQAEANLQRVRALREQGPGSVGEAVARLRLAVSVLDAAAGKAGPLGKKSSSSSSSTAAALAPLRDAAARLRKEVEAELAAAENDNCHVYFERVPAADALKELPALPEPLVRATAVEKVLREADGEAALANGGAATIGH

SEQ ID NO: 21008 - DNA, 1721 bp, Panicum virgatum
  misc_feature: Ceres CLONE 1814082
  misc_feature: Encodes the peptide sequence at SEQ ID NO. 21009
aagcgcagagcagagaccaccactccagcctcgtgcagtctgccgagagcaaggcggcgggggttttcctagtagctgcagtcgattgcttggcatctttatcagctcgcgatctccctgctccctcctatagttatctccagatattgcagcgaaggtggaagcagcacttgagagagagagagagagagagagagagagagagagagagagagagagttcttggacgaatccatccagggagtggggagcggtcgagggagaagagaagagaagagaagaggaacagaggggatggagacggacagcccgcggagccccgaggcggagatcgggcaccgggtggaggacctctgggaggtggcggagccgcagctctcgccgtccgagaagctcaactcctgcttcgaggacatccccgtcgcgtcctttccccgcacgcacccctcgcaagtaattgagataccctctgatgccagtcttgctgaaactgttgaaatattgtccaaaaacaaaatcctgagtgcacccataagaaacgttgaggctccagaagatgctagttggatggacaaatacatcggtattgtggaatttgctggtattgccatgtggctgctcagtcagtctgatgctgcagctaatgggacggctggttctggaataggatcacctgtctccaatctagtttctaggttgggttccttcacattcagaaggacatcatccggcagggtagaaactgctactgattctgaatcagatgaagctgcatcggttggaggaagttttttcgaaaccctaacttcctctgagttctacaagaatacaaaggttggcgatatctcagggagcttccggtgggcaccatttcttgcactgcagacgtctgacacattccttaccatgttgctgcttctgtctaagtacagaatgaagagcctgccagtagtagaagttggaggagataagattgagaacatcatcacacaatcttctgttatgcacatgcttgcagagtgtgttgggctcccatggtttgagagctggggaactaagaaactttctgagcttgggcttcctatcatgaaaccatccaaacttgtcaaggtaaatgaagatcagccggttctaaaagccttccaactgatgagggaaaaaggagttggtggtctaccagtcatggacacgagtggagcaaaagcaattggtaacatcagtatcagagatgttcaatatcttctaactgcccccaagatatacaaagagcacaggacaatcacaacaaaggattttctcactgcggtgcgacagcatctccaggagcaacatgagacctcaccctttctgcacgatgtgatcacttgcaaaaaggacgacacgatcaaggacattatactgaagctggactctgagaagattcacaggatctacgttgtagatgacaaagggaacactgagggggtcatcacattgagggacataatctccaagctggtgcacgagcctcgccactactttggggatttcttcgatggtgttgttcccctgcctgcaaatagcactgtatgagacaaaatcgtggtccaatcgcattgatgtacctgtgcaaatgtatattatgaaccgttctctttggaggttccttgctgtgtatttcttttcccaacctcctcatgtgaacagagtatgaacaagaaagtaaaaaagaccaattcgcc

SEQ ID NO: 21009 - protein, 425 aa, Panicum virgatum
  misc_feature: Ceres CLONE 1814082
  misc_feature (264)..(402): Pfam Name: CBS Pfam Description: CBS domain pair
  misc_feature (48)..(241): Pfam Name: CBS Pfam Description: CBS domain pair
METDSPRSPEAEIGHRVEDLWEVAEPQLSPSEKLNSCFEDIPVASFPRTHPSQVIEIPSDASLAETVEILSKNKILSAPIRNVEAPEDASWMDKYIGIVEFAGIAMWLLSQSDAAANGTAGSGIGSPVSNLVSRLGSFTFRRTSSGRVETATDSESDEAASVGGSFFETLTSSEFYKNTKVGDISGSFRWAPFLALQTSDTFLTMLLLLSKYRMKSLPVVEVGGDKIENIITQSSVMHMLAECVGLPWFESWGTKKLSELGLPIMKPSKLVKVNEDQPVLKAFQLMREKGVGGLPVMDTSGAKAIGNISIRDVQYLLTAPKIYKEHRTITTKDFLTAVRQHLQEQHETSPFLHDVITCKKDDTIKDIILKLDSEKIHRIYVVDDKGNTEGVITLRDIISKLVHEPRHYFGDFFDGVVPLPANSTV

SEQ ID NO: 21010 - DNA, 703 bp, Panicum virgatum
  misc_feature: Ceres CLONE 1814129
  misc_feature: Encodes the peptide sequence at SEQ ID NO. 21011
agttcctatccgctgctcctaacagcagaggccgcggcacggaggggcgctctccctggcggtagagttggagctgcagcggggaagaagcgagctggagctggcaagaatgatgggcgccaacaccaacgacgccgactgcctgtgcccggagtacgcggaggtcgaccccaccggccggtacggacggttcaacgacgttcttggcaaaggcgcgtcaaagactgtgtatagggcgttcgacgagtaccaggggatggaggtggcgtggaaccaggtgaagctgcacgacttcctgcagagccccgaggacctggagcggctttactgcgagatccacctcctcaagacgctcaagcaccgcaacatcatgaagttctacacctcctgggtcgacgtctctcgccgcaacatcaacttcatcaccgagatgttcacctccggcaccctccgccagtacaagcagaggcacaggagggtgaacatttgggcggtgaagcactggtgccggcaaatcctcagcggcctggtgtacctgcacagccacaatccgcccatcatccaccgggacctcaagtgtgacaacatcttcgtgaacggcaaccaaggtgaggtcaagatcggcgacctcggcctggctgccatcctccgcaagtcccatgccgttcactgcgtcggcacaccggagttcatggcacctgag

SEQ ID NO: 21011 - protein, 197 aa, Panicum virgatum
  misc_feature: Ceres CLONE 1814129
  misc_feature (26)..(197): Pfam Name: Pkinase Pfam Description: Protein kinase domain
  misc_feature: SWISSPROT Homolog: EC 2.7.11.1 Non-specific serine/threonine protein kinase
MMGANTNDADCLCPEYAEVDPTGRYGRFNDVLGKGASKTVYRAFDEYQGMEVAWNQVKLHDFLQSPEDLERLYCEIHLLKTLKHRNIMKFYTSWVDVSRRNINFITEMFTSGTLRQYKQRHRRVNIWAVKHWCRQILSGLVYLHSHNPPIIHRDLKCDNIFVNGNQGEVKIGDLGLAAILRKSHAVHCVGTPEFMAP

SEQ ID NO: 21012 - DNA, 702 bp, Panicum virgatum
  misc_feature: Ceres CLONE 1814130
  misc_feature: Encodes the peptide sequence at SEQ ID NO. 21013
actaatttccgtacccctctgttcgcgtcgctcgctcgctcgggtttggatccgagcggaggcccggccggcggatgctgtagggaaatggcggaggccgtcgcgtccgcgggcgggctcgccatggcggcagcctcgacctccgtcacgcccggccaggtttctgctattctggggtttctttgggttttcgcagcctgggcatatgctgaggttctcttttataggaagaatgctgcttctattaaaactagacactcggatgtcaatttagcagtgatggataatagttcggtcaaagaagatcaaacacttctgttggaggagggtggccaagctgtagctgcaaagccagcttatacttccttcacatcacaaatgctcagacttttcttcatggaccagatgcttcttctggagaatcgtttaacactgagggcaatatctgagtttggagggtatctactttatttttacatatgtgatcgtactgacttactcggagagtctgctaagaattacagccgagacctgttccttttcctctactttcttctcattattgtagcagctatgacttcctttaaagtccatcaagacaagtctgcgttcacaggaaaatctatattgtacttgaacagacatcaaaccgaagaatggaagggttggatgcaggtgctattcttgatgtaccactacttc

SEQ ID NO: 21013 - protein, 204 aa, Panicum virgatum
  misc_feature: Ceres CLONE 1814130
  misc_feature (128)..(204): Pfam Name: Cas1p Pfam Description: Cas1p-like protein
MAEAVASAGGLAMAAASTSVTPGQVSAILGFLWVFAAWAYAEVLFYRKNAASIKTRHSDVNLAVMDNSSVKEDQTLLLEEGGQAVAAKPAYTSFTSQMLRLFFMDQMLLLENRLTLRAISEFGGYLLYFYICDRTDLLGESAKNYSRDLFLFLYFLLIIVAAMTSFKVHQDKSAFTGKSILYLNRHQTEEWKGWMQVLFLMYHY

SEQ ID NO: 21014 - DNA, 1582 bp, Panicum virgatum
  misc_feature: Ceres CLONE 1814132
  misc_feature: Encodes the peptide sequence at SEQ ID NO. 21015
gaatcggagaaaaaaaagaaaaaatcgttttccttttcttccgaagtcgtcctcttcttcccgtcgcttcgccgtgccgcaccagggaagggaggaggcttccccgcgaagctcgccatgatctcgccggagaggagcccgtcgcagagcccgcggtcgccggcggggccgggggcggcggcggcggcggtggcgccgttcctttcgatctccgtcacggatcccgtcaagatgggcaccggcgtgcaggcctacatctcctaccgcgtcatcaccaagaccaacttgcctgaatttgagggaccagagaaaattgttattcgtcactatagtgattttgaatggttgcatgataggcttgctgagaagtacaaaggcatttttatacctccccttccagagaagaatgctgttgagaaatttcgttttagcaaggagttcattgaattgcggcgtcaagctctggacttattcgtgaacaggatagcttcacaccctgaactcaagcaaagtgaagtcttgagggtatttttgcaggctgatgaagagaaaatggatagggcaaggtcttatgagactggcatttttaagaaaccagcagatttcttacagatgtttaaggatgtacagtcaaaagttagtgatgttgttctgggaaaagaaaagccggtggaggaatctactcctgaatatgagaagcttaaaaattacatatttgagctagaaaatcatttagcagaggcacagaaacaagcataccgtcttgtgaaaagacacagagaacttgggcaatctttggcggagttcggaaaggcgatcaagcttttaggtgcttgtgaaggagatgtgatggaaaaggtgttttctgaagttggttcaaagtcagagatgttgtcaataaaactgcaaagagaggcagacaaccttctctttaactttgaagaaccattgaaagattatgtccgtgccgtccaatcaataaaagccactatgatggatcgagccaatgctttcaggcagcactttgatttggatcaggagaggaagtataaagagcttaaccttgaaaaattgaaattcatgaaccccgagaagtatgccgaagcagaatcagagtttagagagttgaaagcagacagcgaggaggctacaaagaagtttgaacacatagttagactaatgaatgaagaacacgctcgtttccaggaggaaaaaacagctgatatcggacttgcattccatgaatttgccaaagggcaggctaagctagccaaagacattgctgatgcgtggcgcagcgtcctcccaaagctggaagcttgttcgacatcataagtgtgattcatgtttcctcgtgatgtttgggatagggattcacactaggttgagttttaggctgtttttcccggcctgttttgacactgattcctgtatacttaaaagtgatgtttggagataatacagctattagattcagtcagacatcatttcttcctgttgagtatgtgtaaccgtcttcttttctttgatcagttgacaatttgacagaactactggaatctcgtaataatgatagttaatg

SEQ ID NO: 21015 - protein, 405 aa, Panicum virgatum
  misc_feature: Ceres CLONE 1814132
  misc_feature (26)..(142): Pfam Name: PX Pfam Description: PX domain
  misc_feature (167)..(398): Pfam Name: Vps5 Pfam Description: Vps5 C terminal like
MISPERSPSQSPRSPAGPGAAAAAVAPFLSISVTDPVKMGTGVQAYISYRVITKTNLPEFEGPEKIVIRHYSDFEWLHDRLAEKYKGIFIPPLPEKNAVEKFRFSKEFIELRRQALDLFVNRIASHPELKQSEVLRVFLQADEEKMDRARSYETGIFKKPADFLQMFKDVQSKVSDVVLGKEKPVEESTPEYEKLKNYIFELENHLAEAQKQAYRLVKRHRELGQSLAEFGKAIKLLGACEGDVMEKVFSEVGSKSEMLSIKLQREADNLLFNFEEPLKDYVRAVQSIKATMMDRANAFRQHFDLDQERKYKELNLEKLKFMNPEKYAEAESEFRELKADSEEATKKFEHIVRLMNEEHARFQEEKTADIGLAFHEFAKGQAKLAKDIADAWRSVLPKLEACSTS

SEQ ID NO: 21016 - DNA, 2273 bp, Panicum virgatum
  misc_feature: Ceres CLONE 1814159
  misc_feature: Encodes the peptide sequence at SEQ ID NO. 21017
gcgcgcactgccaagtctccgtgtcgtctccacgactccacttgctcgctgttcgctggctgcttgcggcaactcccgtccccacgcgctccctacccctccgatatttgagatctcgccggcgggcggctgacggggagggagagccccgccggcgatgggtaactgctgctccgacgaggcgggccacggcggcgcccaccccgtcggccccgccgccgccaaagccgcccaggccgcctccgccgcggccgatcgcttcctccgctcccgcggcgccggcgcgtccacgcagatcgagattaaccccatggtggttgtgtactccaaaaggaaagatgggcaacttgaagaaattgggcgtagtgaagtaactttaaattctctgaacccatcttggatgacaaaaatcagtgtgaagtaccagtttgaggttcttcagccattggtgtttcaggtttttgatattgacccacagctacatgatgtcagtgaaaagattcttaagctagaggagcaacagtttcttggagaggctacctgtcttttgtcagaggttgtcaccaagcgggacagactgttgactctgaagcttggtgtctctgaacacaacttgccaaatcctagtaaatttggtgagctaactgttcaggccgaagaaagtgcaggttcaaaagcaattatggagatggtattccgctgttcggatcttgaaatcaaggatcttctcacaaagagtgatccgttcttgctaatatctagaatatcagatagtggaatgcctgttccaatttgcaagacagaagtaagaaagaatgatctcaatcctaggtggaagccagtgattctaaatctccaacagattggaagtaaggagaatcctctaattatagagtgctttaacttcagtagcaacggcaagcatgacctagttggcaagatagtcaaatctgtagcagaattggaaaacatgtaccattggcagaatggtgaatttttttttgttcctgtcagcaatgcacatgaatgtcacagtaaggaggtattaaagagtcagttatatgtggagaaatatgttgagagcaatagacatacttttctagattatatttctgccgggtgccagttgaattttatggtaggcgtagatttcacagcttcaaatggaaatccacgtctcccggattccttgcattacattgatccctcaggtcggccaaatgtatatcagaaggcaatactggaaattggcgatgttctacagtactatgacccagctaagcgtttcccctcttggggcttcggagcaagacctattgatggtcctgtttcccattgtttcaacctaaatggaagcacttatcaacctgaggttgacggaatacaaggaattatgtcagcttatatcagtgcacttcgtaatgtatcattggctggtcctactctctttggtcagttgattggcaccgctatggcaatagctagccaatctctcgctgacaatcaacagaaatacttcactttgttaatagtcactgatggtgtggtgactgattttcaagagactattgatgcaatcataagggcatcagattttcccatgtccatcattgtcattggagttgggggtgctgatttcaaggaaatggagtttctagatcctaataaaggagagaaactggaaagctcaaccggaagggttgcatcaagggatatgatacagttcgccccaatgaaggatgtgcacggcagaggggtgtcgacagtacagtcacttcttgctgagataccaggtcaattcatgacatacatgagaacaagagaaattcaaacagtcagtatatgatgccctctatcagtagaagatgagcacaccaatgtcctttgttaatatgtttttggccttttccatcacataatttgtgcacttaacgcatggctgcaagatagtatggatgtgttgagaggtagatgagagattcatttcctgcagatgccaacatcaaatctgtgagctgagcttcgatggcaggtggagaggcaagaaccgcaaggtcttcagatccaggaattgctgtttgtgaagaggcactaggacctccaccaggcgccttagtttcatgtccaaatttttaccaagctgtattctggttcgagttggatctctagcctagcaattcgtaattggaaagatgcaactgtcatctttctctgtacctttttgtaatatatgacttttgggtttgaattttgtatgtattacccttttaggt

SEQ ID NO: 21017 - protein, 562 aa, Panicum virgatum
  misc_feature: Ceres CLONE 1814159
  misc_feature (344)..(490): Pfam Name: Copine Pfam Description: Copine
  misc_feature (175)..(263): Pfam Name: C2 Pfam Description: C2 domain
MGNCCSDEAGHGGAHPVGPAAAKAAQAASAAADRFLRSRGAGASTQIEINPMVVVYSKRKDGQLEEIGRSEVTLNSLNPSWMTKISVKYQFEVLQPLVFQVFDIDPQLHDVSEKILKLEEQQFLGEATCLLSEVVTKRDRLLTLKLGVSEHNLPNPSKFGELTVQAEESAGSKAIMEMVFRCSDLEIKDLLTKSDPFLLISRISDSGMPVPICKTEVRKNDLNPRWKPVILNLQQIGSKENPLIIECFNFSSNGKHDLVGKIVKSVAELENMYHWQNGEFFFVPVSNAHECHSKEVLKSQLYVEKYVESNRHTFLDYISAGCQLNFMVGVDFTASNGNPRLPDSLHYIDPSGRPNVYQKAILEIGDVLQYYDPAKRFPSWGFGARPIDGPVSHCFNLNGSTYQPEVDGIQGIMSAYISALRNVSLAGPTLFGQLIGTAMAIASQSLADNQQKYFTLLIVTDGVVTDFQETIDAIIRASDFPMSIIVIGVGGADFKEMEFLDPNKGEKLESSTGRVASRDMIQFAPMKDVHGRGVSTVQSLLAEIPGQFMTYMRTREIQTVSI

SEQ ID NO: 21018 - DNA, 2220 bp, Panicum virgatum
  misc_feature: Ceres CLONE 1814189
  misc_feature: Encodes the peptide sequence at SEQ ID NO. 21019
agtgttgccgctttcattcccgccgccgcggccaaaatcttcattcgaattgagaattgagacgcgggggcgggatctggagctccccgatcgctacggggagcgcggtggagaaatccccgctcgttcgctggcggagccggtcgccgtcgacgccgaaggcagaattttctgtaaaccacaagatggctcaggctgcaaggctgagcctgagaatgcagaaagagattaagcttctattggatgatccaccccatggggtctcacttaatctttctaaagatgaaaatgtcctatcatcattatcaagtattgaagccagaattgaggggcctgagggaacagtatatgctaagggagttttcattctgaagatacaaattcctgaaaggtatccttttcaaccacccaatgtgacttttgtcactcccatttatcatccgaatattgacaatggaggacgcatttgccttgatattctcaatttacccccaaagggagcctggcaaccatcactcaacattgctactgttttgacaagtattggcttgctgctaagtgaaccaaacccggatgatggacttatggctgaaataagtcgagaatacaaatacaacaggcaaatttttgacataaatgctcggttatggactgagaagtatgctagtccttctgttgtcggtgctagcggttgggattctgtagatgctggtgtcctggcacagaatgcccaaatggaggacacaaagagccaagggtcattgccaaatgcttctaaaaaagattgtgaagggaatcaaaggaagatgcggttactgggacaaaagttatcgctgaagtctgaaagatctgaagataatatgaaaattgtcaagcaagatcctgttgctagccacttaccatccacggcccgatccatcaatcctactgcttgcttttctgatgtttcaagcagacagaatgacacttcaggaaacatgtctgtcaggactgctagtggagtggtttcaaagaaagaataccaaggaaataataagaacttgcagttacctggcctggggctttctgttatctcagagtcagaagctcctagcaaaaggagcgatggcaatgatatgttacctaatcatcttccaacatctgcatctgctgctaatgatcacgccgtgcaatcttctgatgacattttagggaacagtttgccaaggagcattggtggatcatcagatagttcatataaaccaccagaaggaaaccgaaggaatatcaggacactggatatgaagttgtcgctgaaatcagtaaatcctgaaaagcagagcgatgatcagaaggaaaatatggctccaaatcacctgcctccacagcctggcttcaacaaattgcagaaaaggcccttagatgttgtttcaaggaaaaaaatcagtggaggtcctgcactggttcaacaggatccaagtacggaacatcagcagtcaaacactcagatggtgtcaaatgaagagtgcaatcaaggtcgaaagaagctgtgttcactaagcaggaggctgtcattgaaatctgagctgctcagagcggacagtgcctgtgacaaggattataagccacccaattgttctgtaagcgataagaagcccgatgaactgcaattgtcagaactaccagcaccaatcccaaaaggtgaggccgtggcacccagtgaacggccattgttagctccaacagtccttgaaagtcaagccaagacccgcagctttgctgctgaacagaaagacgccagctcaggcaattcctctgtgaaacaaaacgcggttgccgtggagaacatcgtcgtttcagatagtgaagagagcgaagatgaacgcgaaaggcccccgaggtcaaggttgtcactgatgcggagacgattggcaggaaagctgagaacctaatggggcagcactttatggcctgtctttctaaaaaaagaaaaaagcttagaacctaatgttaccctccttcggagctcttgctctttctaatgctgcgtcgtaaatccttggaagaagacgagtattccaatatatacttctagtaagttatgtctctttctgtggtagatcatgccatgcgtgtgttagattactcgatgccgcccgacaacgctggactctggatcctgttttggcggcacatccttttgttggaagtcaaattctaagaactagactttacctatgc

SEQ ID NO: 21019 - protein, 581 aa, Panicum virgatum
  misc_feature: Ceres CLONE 1814189
  misc_feature (10)..(156): Pfam Name: UQ_con Pfam Description: Ubiquitin-conjugating enzyme
  misc_feature: SWISSPROT Homolog: EC 6.3.2.19 Ubiquitin--protein ligase
MAQAARLSLRMQKEIKLLLDDPPHGVSLNLSKDENVLSSLSSIEARIEGPEGTVYAKGVFILKIQIPERYPFQPPNVTFVTPIYHPNIDNGGRICLDILNLPPKGAWQPSLNIATVLTSIGLLLSEPNPDDGLMAEISREYKYNRQIFDINARLWTEKYASPSVVGASGWDSVDAGVLAQNAQMEDTKSQGSLPNASKKDCEGNQRKMRLLGQKLSLKSERSEDNMKIVKQDPVASHLPSTARSINPTACFSDVSSRQNDTSGNMSVRTASGVVSKKEYQGNNKNLQLPGLGLSVISESEAPSKRSDGNDMLPNHLPTSASAANDHAVQSSDDILGNSLPRSIGGSSDSSYKPPEGNRRNIRTLDMKLSLKSVNPEKQSDDQKENMAPNHLPPQPGFNKLQKRPLDVVSRKKISGGPALVQQDPSTEHQQSNTQMVSNEECNQGRKKLCSLSRRLSLKSELLRADSACDKDYKPPNCSVSDKKPDELQLSELPAPIPKGEAVAPSERPLLAPTVLESQAKTRSFAAEQKDASSGNSSVKQNAVAVENIVVSDSEESEDERERPPRSRLSLMRRRLAGKLRT

SEQ ID NO: 21020 - DNA, 707 bp, Panicum virgatum
  misc_feature: Ceres CLONE 1814192
  misc_feature: Encodes the peptide sequence at SEQ ID NO. 21021
agctctttctcacctcgcttccaagcgacaccaaaagcggcagcgagcggcaagaaccaccaccaccaccacttgatcctccccttggcttccactccaccgaaccagaccggaaaggcggaggcggggcaggccagaggccatggcgagcaacggcgacgggaagggccgcgtggcggcggcggcggggggagggtacgggtacgggtacggcgggtacgaggggcccgaggagcgcaagtggtggccgtggctcgtgcccaccgtcatcgtcgcctgcatcgcggtcttcgtcgtcgagatgtacgagaacaactgccccaagcacgggagccagctcggggactgcgtcgccggctttctgcgccgcttctccttccagccgttccgggagaacccgctcctcgggccctcgtcctccactttggagaaaatgggagcccttgactggaacaaaattgttcatcagcaccaaggctggcgccttattagctgcatctggctccatgctggcctaatccatttggttgtgaacctgctgagtttgctgtttattggaatccgccttgaacagcaatttggatttgttcgcattggtgccatatacctactatccggttttggtggcagcgtgttctctgcactcttcctacagaacaactacatctctgttggtgcatctggagctttatttggcctgcttggat

SEQ ID NO: 21021 - protein, 188 aa, Panicum virgatum
  misc_feature: Ceres CLONE 1814192
  misc_feature (106)..(188): Pfam Name: Rhomboid Pfam Description: Rhomboid family
  misc_feature: SWISSPROT Homolog: EC 3.4.21.105 Rhomboid protease
  misc_feature: Useful for making plants with altered cell wall content and/or composition
MASNGDGKGRVAAAAGGGYGYGYGGYEGPEERKWWPWLVPTVIVACIAVFVVEMYENNCPKHGSQLGDCVAGFLRRFSFQPFRENPLLGPSSSTLEKMGALDWNKIVHQHQGWRLISCIWLHAGLIHLVVNLLSLLFIGIRLEQQFGFVRIGAIYLLSGFGGSVFSALFLQNNYISVGASGALFGLLG

SEQ ID NO: 21022 - DNA, 1723 bp, Panicum virgatum
  misc_feature: Ceres CLONE 1814210
  misc_feature: Encodes the peptide sequence at SEQ ID NO. 21023
gcaatggcgtcgctgctgcgcctcccctctctcctctcgccgtccaagcccctgctccggcgccggctgccggcggcgaggctcgcggccgccgccgcgtacaggggccaggcctcggaggccgtgggcgcggcggcgccggcagccgcggagacccgcggcggggacagggaggggcaggtgacgccgcggtccgtggacttcaacgcctggtacacggacgtgatcgccgccgccgagctcgcggactacgggcccgtcaggggcaccatggtcatccgcccctacggatacgccatctgggaggccatccaggattatctgaatgtgaaattcaaagaaacagggcacagcaacatgtacttccctcagttcattccgtactcatttatagagaagaaagctagtcatgttgaagggtttagtccggagcttgcactggtcaccattggaggaggaaaagaactagaggaaaagcttgtggtaagaccaacaagtgagaccattgtaaaccacatgttcaccaaatggattcagagctaccgtgatcttcctctcatgattaaccagtgggctaatgtgacaagatgggaaatgaggacaaaaccatttatccgaactcttgaatttttgtggcaagaaggtcatacagcccatgctacccttgaggaggcagagaaggaggcaatgcaaatgattgatgtatataccaaatttgcctatgagcaagctgcaataccagtcattccaggtaggaaatcaagggtagagacatttgctggtgctaatcggacttacactatagaagctatgatgggtgacaagaaggccttacaagctgggactagtcacaacctcggccagaacttttcgcgagcttttggaacacagtttatggatgaaaatggtcaaatcgaacacgtctggcagacctcttgagctattagtacccggttcgttggtgggattatcatgacccatggtgatgatgctggtctaatgcttcctccaaggattgcacccattcaggtcataatagtacctatatggaaaaagggtgatgagaaggctactgttctggaagctgtagattcagtcctaaaaatactgaaagaagcaggaattagagtcaaagtggatgactcagaactgcggacaccaggatggaagttcaaccattatgagatgaaagggattcctataagaatagaaattggtcctcgtgatgtcacaaataagagtgttgtggtttctaggcgtgatgtccccggaaagcaaggaaaggagtttggagtttccatggacccttcaatactggtgaaccatataaaggggcgtctagaggatatacaagcatcccttttacacaaagccatcacattccgtgatagtaacataattgatgtaagctcatatggagagctgaaggaagccattgctgaagggaagtgggctagaggcccttggtcagctagcgatgctgacgaactgaaggtgaaagaagagaccagcgccaccatcaggtgctacccgttcgagcagctggagggcaccaagaaatgcttcatgaccggtaaccctgcagaggaagtggcgatttttgcaaagtcatactaggtcatctctgtgtctatctactcccagagattaaaactgtcttttcttctctcttttaggattggataccttgtctgcctgtgtttctataagatctgcattaacc

SEQ ID NO: 21023 - protein, 311 aa, Panicum virgatum
  misc_feature: Ceres CLONE 1814210
  misc_feature (99)..(274): Pfam Name: tRNA-synt_2b Pfam Description: tRNA synthetase class II core domain (G, H, P, S and T)
  misc_feature: SWISSPROT Homolog: EC 6.1.1.15 Proline--tRNA ligase
MASLLRLPSLLSPSKPLLRRRLPAARLAAAAAYRGQASEAVGAAAPAAAETRGGDREGQVTPRSVDFNAWYTDVIAAAELADYGPVRGTMVIRPYGYAIWEAIQDYLNVKFKETGHSNMYFPQFIPYSFIEKKASHVEGFSPELALVTIGGGKELEEKLVVRPTSETIVNHMFTKWIQSYRDLPLMINQWANVTRWEMRTKPFIRTLEFLWQEGHTAHATLEEAEKEAMQMIDVYTKFAYEQAAIPVIPGRKSRVETFAGANRTYTIEAMMGDKKALQAGTSHNLGQNFSRAFGTQFMDENGQIEHVWQTS

SEQ ID NO: 21024 - DNA, 661 bp, Panicum virgatum
  misc_feature: Ceres CLONE 1814214
  misc_feature: Encodes the peptide sequence at SEQ ID NO. 21025
aatattcttgtcaccgttgctgtgttaattggaaccatcttcttgctgaaagctgctcaacttgcttggccaccctgcacagattctcacatggttacactcagagcagcatgcccacctgttcttagtcaccttccttccaattggcctaggtgccctctaccacacccaccgctctcgcagctagtgtataccttatggactatgcttgcttccaccacacatccgactgccgtatccccatcgcctcttttgtcaaacatgctcaccacatgccattcatcgatgataaaataaagcatccgcttcatgaagcccatgcttaagaactccggcatcggtgatcagagctacatcccagctgctacccactacatcccaccatctaacacactaactgatgctcgcgacaaggctgaacaggttgttttctcatccatcgatgacctattcgctaagacatgcatcagccctgaggcaattgacataatcgtcacgaactgcaccgtgttcagtccagtgccatctttagctgacatgattgtaaacaaatactagctacgaagagacgttcggaccatccacgcatggtttttaatttcatttatgcaaaaatatcggtcaacaccgaaattaccgaaattcgccaaatttcgcctag

SEQ ID NO: 21025 - protein, 82 aa, Panicum virgatum
  misc_feature: Ceres CLONE 1814214
  misc_feature (1)..(82): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
MKPMLKNSGIGDQSYIPAATHYIPPSNTLTDARDKAEQVVFSSIDDLFAKTCISPEAIDIIVTNCTVFSPVPSLADMIVNKY

SEQ ID NO: 21026 - DNA, 691 bp, Panicum virgatum
  misc_feature: Ceres CLONE 1814216
  misc_feature: Encodes the peptide sequence at SEQ ID NO. 21027
ttacaacatgcaattcaaggaccaaattgggagctactactacttcccttcccttttattccacaaggcagccggtggttatggtggcatcagggttcttagcagagcaaggatcccggttccatttgacccccctgctggtgatttcaccatattggccggtgactggttcaaactcaatcacactgacttgaaaggcattttagacagtggaaatgacctgtcattccctgatgggcttcttattaatggacaaggctcgaatggcaatagatttacagtggaccaagggaaaacataccgttttcgggtatcgaatgtgggcattgcaacatcagtgaatattacgattcaaggccattccatgctcctggttgaggtggagggatctcacaccatgcagaccactttcacatccattgatatccatctaggccaatcctactcattccttgttactgctgatcaaccaccggcagactactccataattgtctcgacacgttttatcacccctgtgctcaccaccacagccatcctgcactacagcaatgcaaatggggctgcaacagtaccgcctcccccagcgcctacaaccgatatcgatttttctctcaaccaggctagatcaattcggtggaatctgacagcgagtggaccaaggccaaaccctcaaggttcataccactat

SEQ ID NO: 21027 - protein, 229 aa, Panicum virgatum
  misc_feature: Ceres CLONE 1814216
  misc_feature (47)..(185): Pfam Name: Cu-oxidase Pfam Description: Multicopper oxidase
  misc_feature: SWISSPROT Homolog: EC 1.10.3.2 Laccase
YNMQFKDQIGSYYYFPSLLFHKAAGGYGGIRVLSRARIPVPFDPPAGDFTILAGDWFKLNHTDLKGILDSGNDLSFPDGLLINGQGSNGNRFTVDQGKTYRFRVSNVGIATSVNITIQGHSMLLVEVEGSHTMQTTFTSIDIHLGQSYSFLVTADQPPADYSIIVSTRFITPVLTTTAILHYSNANGAATVPPPPAPTTDIDFSLNQARSIRWNLTASGPRPNPQGSYH

SEQ ID NO: 21028 - DNA, 1884 bp, Panicum virgatum
  misc_feature: Ceres CLONE 1814218
  misc_feature: Encodes the peptide sequence at SEQ ID NO. 21029
attccttagtcattccccgagagtccgagaccccgacacccgcgcctctgacgcctccctcccagcctccctccacctctgacgcctccctccctccaccctctcctccaggcaacctcagcgcctcagccgcttgcgctcgcccgcaccgggcctccggcgctcccttccctccctgagctccctgcctccctccatcctcccttcatctccgcgcatccgcgggccggggctccgccccctccagccggcggagctgcagatccggccgacagagctgcagatctgggcatccggccggctcttcggccgatctggcccgggttagtgcggccggcgcgacggaagccagcgggcacggcggcggcaagcgaggcgagccagcgggcgcggttgtggggcaggcgcaggtaaggaacacccccgagttacttttcccttctcgtccccgtctcccctatttctacagtagacagaggcgactcacgggcgattctcgatcccggcccgctcctcgccggatctcttccctccaacggcgtctccggcgctgggaggtgagggatctggttggggacgggtgcggttgtccatactactacctagtattgctttaggttgagtatgaacttgcgttggccacatctgaattctgaagtagtaagagaggatggaagggaggaatgacttgtatgattagcttgtcgctgcttcctatgaagcaagtaaattgattgagtgcataagtcaattcaggctgcaaagttgtagaaattgattcatgatttttttaatttatgtccgtcaaagtgtcccctacgccatatcatacaactagcacttacctgaaacttttgttatggatggagttttcaagtgggttctttgcctcttgtttcaataatcatgtaactccatgagactatcatcttttatctgtgctgtccaacaagtctttcaactataaatgaaaaatccaatagtttgcatatcattgtcagcaacttttgagtgcacgaatctaaatgctgttacgctatttgcacttgcacccatttgcattcaacacttgttattttgttaagctcctcttttgaattatattgctatttacaagaccaagagactgtactctctgaatgtttggaagccaattggaaatttggttcaatcaagatgcaaagttttccagcagttccattttgtgccccacatggaacacttgcaacctgaagttctgatcccatcattgcctccgttatatacctgtatcatattttcaaaattttaaattatgatattatgcattctgctacctcttttacactatgaatcaggtgttattagcttgaaagaaacaatcaccttagcaacatttttattttgacaacctgatgcactgtagctccagacttactgttgtttttttttttggattgacactggctcgacgaaaaccatgcttggtactatccacaacttgcttatactgattctttcttttcgcttggcattatcagaagcgcagcatggcgaagctcaagccaaaggcgttgctggcacaaagcaaagtgaagaaggtccctagccaaatcagtgtgatcacgatcttcacctacttggtcctcggtgtcgtagtcgtgtcctctgtttatgctgcttacaaatactgggtaggcaacggaccagcagtgacagcagcaggcgtggaggggaactaaacccccaaactatgtaactgattttgttgttgtatcatccagttggataattttggttgctgcagcccagtaaacggaatatggatagattgtatcttgctacagttttactgtaaaccttgggtacattatattgatatatgtatgctaaatttctttcctc

SEQ ID NO: 21029 - protein, 63 aa, Panicum virgatum
  misc_feature: Ceres CLONE 1814218
  misc_feature: SWISSPROT Homolog: EC 5.2.1.8 Peptidylprolyl isomerase
MAKLKPKALLAQSKVKKVPSQISVITIFTYLVLGVVVVSSVYAAYKYWVGNGPAVTAAGVEGN

SEQ ID NO: 21030 - DNA, 2289 bp, Panicum virgatum
  misc_feature: Ceres CLONE 1814219
  misc_feature: Encodes the peptide sequence at SEQ ID NO. 21031
acaccactgcccacagcccacaggccgcaccgcaccgaaaagacgagaggctgcgagaaacgaacgccaggaagaacccagagcgccccggagatgtcggcggaggagctgcgtctggagctggacgagctgaggcagctcgagggcctcgccaagcgcccccgcgtccagtccctccttgccaacgagatccgcaacgttgaagccaaggttgcatcttcccctttcttttcttttcttttcttctgcattcatttcttctcccccattttctcggtctccccgccgatccctttcgacgcatcgctggattccgattccattctttcgatcctcaatttgcgatgtctgattgtgattggcagttggcgaaggcagctgcaccaacacccgagccgcaggcggcggttgcggctgcgactgcgccggcacgccctggtttgaactacgtcacgttggggtccttcagctgggatcaggacaatgacaagatcaggatttatattttcctggagggggttgagcaagagaaggtggagactatatttaagccaatgtcagtggatataaagtttcacgatgttaatagcaagaattatcggtgtgccataccaaagctgaacaaggaaattgttcctgacaaatgtaaggttgtggtgaagcctacaaaggttgttgttaccctctgcaaagcttctaaaggcaactggttagacctgtacttcaaggaagacaaggtactgaatgtgttgaactaatatagttttctttgtgccattcatgtttcagataattctaatctttctgatattggattgccctgaacgactaaaaagtgatctgtgggacattattttttttattgattttgcctataggaaactgaaatttcgtacttagacaaatgcaaatacctaatagaaatcacatggatggatagtccagtcaattcagtcagctatgtttacttctcctaaattgagtatcttgtacttaggaaaaaagaacttcgacttagtaacaaaaaacttacttactgatagtgatctatcacaagggactgataaacttttgtgcatgggcgagttttgtgttatcttgattgctggtacaacctgccaagttcagtttacgttattttttggatcacagcgctatcttcttctatttcagtcttttatttgtttacatctctggtgaaaatggctcaagtgttggggaaagaaacatagttagaagctcttttttttaaaacttatacagctctaggtgaggttattttctacactaatgcaaagtttcaagtttaaatttgataatctctaaaagatgataatgataaaagacgaaaattgtgtatttagtaacattaaactcgaacttttgcataaatccggaacataaacccgcctagggctgcaatgtctcatatttgattttgaatactttaagatatgtttttttgatgaatttctaccatgtccaacccttgttatctggcctcttgaagttccttttcagtgtttcataccgacaaagaacttatttctccttttgccattactagcaaaaagttactggtgcttttgctcacttttgttggtccaatctgtggaactaggtaacagcaatatgtgcaaatcctaaaacacatagatgggttagtttgtcgtagcacttgtagcacttgtctggatactgcttggctggttaggccaatctagtgggagtgtcatgagcattaaatatgctgacatggcataagagagagaagggagagtgtcatgggatgtgagaggagtgtcatcatgacactccagctcagttgcctagtttacagttaggaactgtgacatgacactccccactgagactggccttacattacaaaaaaaaaagtagtttgttagaactggtcaggcttaagtctctttttgttgacagttcaagccaagcatggacaaggagaaggatccaatgtctggaatcatggacttaatgaagaacatgtatgaggaaggtgacgaagatatgaagcgtacaatagccaaagcttggaccgacgccagatctgggaaaacgactgattcattgagtggattacgttgagatggtataaaatggagactgcgctagccctgcacagtgtgtttttgatggttgaaacagcgtttacaatgtgttgtaggtgctagtgctggattgtcatatttctgaaggtgacatgtgagaaatatttaaatatatccttctgaacacagaaatggtgtgaagctccatgaaagtgtt

SEQ ID NO: 21031 - protein, 137 aa, Panicum virgatum
  misc_feature: Ceres CLONE 1814219
  misc_feature (39)..(116): Pfam Name: CS Pfam Description: CS domain
MSDCDWQLAKAAAPTPEPQAAVAAATAPARPGLNYVTLGSFSWDQDNDKIRIYIFLEGVEQEKVETIFKPMSVDIKFHDVNSKNYRCAIPKLNKEIVPDKCKVVVKPTKVVVTLCKASKGNWLDLYFKEDKVLNVLN

SEQ ID NO: 21032 - DNA, 682 bp, Panicum virgatum
  misc_feature: Ceres CLONE 1814230
  misc_feature: Encodes the peptide sequence at SEQ ID NO. 21033
agcagcgtcctccccatcagaagcctagcagaagcctagcagctcttcctcgccccaacagccgtttctcagatctttttcaacaccggcactccagcagggcacagcaagggcatctgctctgcatttcttcgcctgatccagtccaaccggagagagtgacagtgaaaccattggacgccgcttagaaacttcttgatatttctaaggggcgataaggcagggaatgagtacaaccaaggtgaagagacgtgtggggaagtatgagctcggtcggaccataggtgaaggcacattcgcaaaggtcaggttcgcaaagaacactgagacaggcgaaccggtagccatcaaggtcatagataaggagaaggtcctcaagcacaagatggttgaacagattaagcgggaaatttcgacaatgaagttgatcaagcatcccaatgttgttcgcatatatgaggtgatgggaagtaaaacaaagatctacattgtgttagaatatgctacaggtggcgagctctttgacataattgctaaccatggtcgaatgagggaagatgaggccaggaggtacttccaacaattaatcaatgcagttgattattgtcacagcaggggtgtgtaccaccgggatctaaaacctgaaaatttactgctcgattcatatggaaacctgaaggtc

SEQ ID NO: 21033 - protein, 151 aa, Panicum virgatum
  misc_feature: Ceres CLONE 1814230
  misc_feature (13)..(151): Pfam Name: Pkinase Pfam Description: Protein kinase domain
  misc_feature: SWISSPROT Homolog: EC 2.7.11.1 Non-specific serine/threonine protein kinase
  misc_feature: Useful for making plants with modulated salt sensitivity
  misc_feature: Useful for making plants with modulated biomass
MSTTKVKRRVGKYELGRTIGEGTFAKVRFAKNTETGEPVAIKVIDKEKVLKHKMVEQIKREISTMKLIKHPNVVRIYEVMGSKTKIYIVLEYATGGELFDIIANHGRMREDEARRYFQQLINAVDYCHSRGVYHRDLKPENLLLDSYGNLK

SEQ ID NO: 21034 - DNA, 1746 bp, Panicum virgatum
  misc_feature: Ceres CLONE 1814232
  misc_feature: Encodes the peptide sequence at SEQ ID NO. 21035
gaaaaaacaaaacaaacaaactaatccccttccggattccgtttccgattccgcctgctccggccgccgccgatggccgcgccgccgccacgggcgcggacgcgctggtcggccctggccgccagcgcgctcatccagtgctgcgcggggagctcctactgcttcggcgtctactccccggcgctcaaggcctcccagcgctacgaccagtccgcgctcgacgccgtcgccttcttcaaggacgtcggcgccaacgccggcgtcctctcgggcttcctcgccgcgtgggcgcccgcgggaaggcgccgcccatggctcgtcctcctcgcgggagccgtcctctgcgccgccgggtacctccccatgtggctcgccgtcgccgggatcgcgcccgcgccgctcccgctcatgtgcgtctacatgctgctcgccgcgcaggcgcagaccttcttcaacaccgccgatgtcgtatccgccgtcgagaacttccccgatcgccgaagcacattaatcggcatcatgaagggttttctaggcctaagtggggcaatacttgtccaattataccgcactctccatattgatcctaccaggttcatactgatgctggcaattttgcccacggccatcactttgttgctcatgtattttgtcgacgtccacaacacacatgaacggtacaacaagaagttcctagatgctttctctctcatcgctgttactgttgccacatacctaatgatcatcataatctgtgatcaagtgttcacgataaggtcagctgtgcagagtgtttgttttgtgatactcctgctgctagtcttatctccagtagccgttgctctaaaggcccagaagccagaatcaatgcagcatgaagaatcaacttcagaacaaagaatcggattgctccgggaagaggtggcagagggatctgacagtgccggctcaagtactgcactcgggggatctaacctagacctgtcagcaggcaaagaaaacctgaatgtgctacaggccatgggcaaactgaacttctggttgctcttcctagcaatggcttgcgggatgggatcgggtctggccacggtgaacaatatcagccagatcggcggctcccttggttacacgagcaaggagaccagtacactggtgtcgctctggagcatctggaacttctcagggaggtttggcgcaggattcatctcggaccatttccttcgccagcgaggagttggtaggccattcttcataggcgccacgctattgatcatgagtgtgggtcatgtcatcatctcctccggccttgctgcatcgctctacatcggctccgtgctagttggcctgtgctatgggtgccagtgggcgcttatgccgagcataacgtctgagatcttcgggctgaaccactttggcaccatcttcaacatggtggccgttgcaagccccgttgggtcttacatcctctcggtccgggttgtgggttacatatatgacatggagtcgccacctgatgagcatgcctgccaaggtaagcactgctttgcgctatctttttttatcatggcctgtgtgtgcttgtttgggtctgccgttgcatttgtgctgttcatcagaacgaggaagttctatagacaggtggtatacgcaaggttgaagtctttccttgagaaatgagatcgatgtaaactgcacatgttgcaacaacctaataaactgtatccacagtttttgcaagtgatgcat

SEQ ID NO: 21035 - protein, 534 aa, Panicum virgatum
  misc_feature: Ceres CLONE 1814232
  misc_feature (11)..(258): Pfam Name: Nodulin-like Pfam Description: Nodulin-like
MAAPPPRARTRWSALAASALIQCCAGSSYCFGVYSPALKASQRYDQSALDAVAFFKDVGANAGVLSGFLAAWAPAGRRRPWLVLLAGAVLCAAGYLPMWLAVAGIAPAPLPLMCVYMLLAAQAQTFFNTADVVSAVENFPDRRSTLIGIMKGFLGLSGAILVQLYRTLHIDPTRFILMLAILPTAITLLLMYFVDVHNTHERYNKKFLDAFSLIAVTVATYLMIIIICDQVFTIRSAVQSVCFVILLLLVLSPVAVALKAQKPESMQHEESTSEQRIGLLREEVAEGSDSAGSSTALGGSNLDLSAGKENLNVLQAMGKLNFWLLFLAMACGMGSGLATVNNISQIGGSLGYTSKETSTLVSLWSIWNFSGRFGAGFISDHFLRQRGVGRPFFIGATLLIMSVGHVIISSGLAASLYIGSVLVGLCYGCQWALMPSITSEIFGLNHFGTIFNMVAVASPVGSYILSVRVVGYIYDMESPPDEHACQGKHCFALSFFIMACVCLFGSAVAFVLFIRTRKFYRQVVYARLKSFLEK

SEQ ID NO: 21036 - DNA, 1905 bp, Panicum virgatum
  misc_feature: Ceres CLONE 1814268
  misc_feature: Encodes the peptide sequence at SEQ ID NO. 21037
accaacgaatccccaaatcaccacccagctctctcgatttcaatctcacccccacctccgagctaggagccatgtcgggccgcggcaagggaggcaaggggctgggcaagggcggcgcgaagtggctgcggatgatggtgttcagccacaaacaagtgaggcaattgcacatgcaagggcagctggagttcctattataatagcaataaacaagatagacaaggagggagctaatccagatcgagtcatgcaagagctttcccaaatcggacttatgccagagatgtggggtggtgataccccaatgattcagataagtgctcttactggagacaatgttgacgaacttttggagactgtcatgcttgttgctgagttacaagaattaaaggccaacccacaaagaaatgcaaagggcactgttattgaagcgtgccttgacaaggccaaagggcctcttgccaccttagttgttcagaatggaaccttaaacaaggctgatattattgtgtgtggtgaagcttttggaaagatccgagcaatgtatgacgaccgtgggaagcttgttgacaaggcaggaccatccaacgccgtgcaggttattggccttaataacgttcccctcgctggtgatgaatttgaggttgttgataacctagatgttgcacgggaaagagcgaatgagcgtgctgaaacattacgcatagaaaggatatctgcaaaagctggtgaagggaaagtcactctctcatcaattgcagcatcagtttcatctgcgaagcaagctgggattgatacacatgagctgaatgtcatccttaaagttgattttcagggttcgattgaggccattaggcaagctatccaggcattaccacaagaaaatgtctctctgaggttcctacttcaagctcctggagatgtgagtgttagtgatgctgatatggctgttgcttcggaaggtattatatttggatttaatgtgagagctcccggatcagttaaaaactatgctaagaagaaaagtgttgaaattcggctgtacaaggtcatctatgatttgattgatgatttgcggaatgccatggaaggtcttcttgaacctgctgaggaggaagtaccaattggtacagcaaaagttcgagcggttttcagtagtggcagtggcaaagtggcaggttgcatgattactacaggaaaagttgttcaagattgcaatgttcgggtccttcgtagagggagagaaatatatgtgggttcacttgattccttgcgaagggtgaaagaaactgttaaggaggttggtgctgggctagagtgtggcatcggggtagaggactttgatgaatgggaggaaggtgacgttgtagaagcattcaacactgtcaaaaaggcaagaaccctcgaggaggcctctgcaaccgtaactgctgctctgaagggtgcaggggtccagctgtagaattggcagtgatgataaatgataagtggtttaacagctacagcagcctgtggccaacaatatttttggcaacgaaacaggagcacgttgatcgagctgctgaagaatgacactcatgtacttgtacagaaagaatttatgcaggccaattcatgatgtctgagctggaccatgtcatgcctccggaagctgcatctgctgctgaaagttgttgtacatagtggagacgagatcagctgttttacactttttagttttgcctctaacaagtagataatgggtgtctaattttgcaactgctgatttttgacatgagatgtaacctgcaacggtgatgccacgcatggtatcattgttcaatcatcattcatactcttcatcatacgtaaaagatgtattctgaagagagaagatcaataaagaattaaaggagttgttgagcc

SEQ ID NO: 21037 - protein, 486 aa, Panicum virgatum
  misc_feature: Ceres CLONE 1814268
  misc_feature (151)..(214): Pfam Name: GTP_EFTU_D2 Pfam Description: Elongation factor Tu domain 2
  misc_feature (3)..(126): Pfam Name: GTP_EFTU Pfam Description: Elongation factor Tu GTP binding domain
PTNPQITTQLSRFQSHPHLRARSHVGPRQGRQGAGQGRREVAADDGVQPQTSEAIAHARAAGVPIIIAINKIDKEGANPDRVMQELSQIGLMPEMWGGDTPMIQISALTGDNVDELLETVMLVAELQELKANPQRNAKGTVIEACLDKAKGPLATLVVQNGTLNKADIIVCGEAFGKIRAMYDDRGKLVDKAGPSNAVQVIGLNNVPLAGDEFEVVDNLDVARERANERAETLRIERISAKAGEGKVTLSSIAASVSSAKQAGIDTHELNVILKVDFQGSIEAIRQAIQALPQENVSLRFLLQAPGDVSVSDADMAVASEGIIFGFNVRAPGSVKNYAKKKSVEIRLYKVIYDLIDDLRNAMEGLLEPAEEEVPIGTAKVRAVFSSGSGKVAGCMITTGKVVQDCNVRVLRRGREIYVGSLDSLRRVKETVKEVGAGLECGIGVEDFDEWEEGDVVEAFNTVKKARTLEEASATVTAALKGAGVQL

SEQ ID NO: 21038 - DNA, 686 bp, Panicum virgatum
  misc_feature: Ceres CLONE 1814272
  misc_feature: Encodes the peptide sequence at SEQ ID NO. 21039
acacggcaccgccgcctgctccgagcctcacccatcccgtaggcggcggcggcggcatcagcagcggaggagaaaaggccttccggctgcggacgccagcggaccagccacgcgcccccctccgatccgcgagacgcttccctccaaatcccaaaaaagcacgaacgcgcggcgccatggcggagcgcctcgccgcctccctcctcccagcggcctcctcctccccgtcggcccgccgcgccacggtcggggccgcggccgccgcgtccttcccttgctcgtgccccgcccgcgcggggctgcgcctccgctcctcctcccgtggcccggcccgcttctccaaggcagccggccgcggcggcggcggcggcggcggcgcgctgcgggtggtccggtgcatggcggcgtcggacgcggcgcagctcaagggcgcgcgggaggacatcagggagctcctcaagaccacgtactgccacccgatcatggtccgtcttgggtggcatgattctggtacgtatgacgagaatattgaggagtggccccagcgaggcggagctgatggaagcttaaggtttcaacctgagttgaatcatggagccaatgcaggtctgattaatgctttgaagcttatccaacctatcaaggacaaatacccaggtatcacttacgcggatttgttccaattg

SEQ ID NO: 21039 - protein, 169 aa, Panicum virgatum
  misc_feature: Ceres CLONE 1814272
  misc_feature: SWISSPROT Homolog: EC 1.11.1.11 L-ascorbate peroxidase
MAERLAASLLPAASSSPSARRATVGAAAAASFPCSCPARAGLRLRSSSRGPARFSKAAGRGGGGGGGALRVVRCMAASDAAQLKGAREDIRELLKTTYCHPIMVRLGWHDSGTYDENIEEWPQRGGADGSLRFQPELNHGANAGLINALKLIQPIKDKYPGITYADLFQ

SEQ ID NO: 21040 - DNA, 2463 bp, Panicum virgatum
  misc_feature: Ceres CLONE 1814276
  misc_feature: Encodes the peptide sequence at SEQ ID NO. 21041
gaatcgaaacagcattccgttccgttcgcaaggtctgcgccccagccatggccgcgccccccggcgacgctcccctcaccgccgccaacaatatccagccgttcttcgtcctccacaaggcatccccggccgccgcttcgtcggtgccatcctcccgagctcggcggcggattgatgcctcacccccatcttcccccaaccccaaatccgcgaagaggacccgtgatgttgacgcgcaggatgaggaagactcggagctgtgcgagcggctccgcctggaggccttccaccgaatctggtccaggatccagtccaccatcgatgaggtcctcaggggcatcaacctcaagctgttcgaccaagtgctgcagtgggcgcaggaatcattgtctgcgatccgcgctgttgcaaaaccttgccatgctgaagtccagcagccgtaccctctcctaaccgatgtgatctgcagaaggatcccgactgcatttgttctcaccaagaatgcggagtttgttgatgacatcacaacttttcgggatctcgcggggcatctccagtccagtggatgccacctggccaagctgtcagcagctgaattgtcagtgaaacatggagttggtggttgctttaggagcctgttgaggcagctactagcagatgttccagatgtcgttgatgtatctgcactggcatcttggtactgtgaagctgagaactacgatcagccaatcattgtcataattgatgatttggagcaatgttccggtgatgtgctgggagatcttgtgatgatgctgagtgaatgggtaattaaaattccaatattcttcgtaatggggatagcaactaccattgatgcacctaagaaactgctctcatcagaggctcttcaacgattagaaccctgcaaacttaccttggggtcaccctcagatagaatgaatgcacttgttgaggctatccttgttaaaccatgtgctggattctgcatcagtcatgaagttgcaatgttcctcagaaattacttctttaggcatgatggaacaataacttcttttattagtgctctcaagcttgcatgcagtaagcacttctccatggaacctctaagctttttgtgcatgggagtacttcaggaagattgtgaggaattttggcatgataaatttgaagcactacctcaagtgatacagaaatacgcttttggtcttccctcatgtacaagtgcaacgaacttgagcaattctagcgacgacgtggtaaatggattgtctaagctactgaaattgcaaaaggattggagttctgttctcttgtgcctgtatgaagctggaagacatgacaaactgcagcttttagatattttctgtgaggcagtcaacccagatctgcatactcaaaatgcatcaaatgctgagctgcccatctctaaagtgaacattgaaaaattatcaggaatgaagtcgggatctggtaaagtgtatatggcccaagtaatgaatgccataaggtacctgccagtggaaactttattacgtgtacttgaagtttggagcatccatttaagaggaatgagtgagatcaatgacaaagtgaaagagctccagtcaaccacaattgatgcagatagtgtgagagccacaaaggaaaagtggactaggagatcaactggcagtgctggaaatgggacagttccattgaatgagaaagttgctgtgctattacaggacattactaggaaatatttggtgcctgttgagtgtttaccttttcatgaaatcatctgcttcaagaatgttggtgttctccaatctgcactgattggaaatccaagaagaatggttcaacttgatctactgaagtcacagagccgtctgaaatgctcttgttgcagtaggactggagctgctttgtcaggaaccttgcatgacacatcaattatgtgcaatctagcccaagaatatggtgatgtaattaaccttcatgattggtacatatcctttgagggaattatcaacagcagaaattcaaaagtcaaacggaaatcatacagttctccctcaaaaaagaagtcaaaatctacacctccagagagtgaagctctgatccaagcaaggttctgcagagctgttactgagatgcaaatcactggcctccttcggatgccaagcaagagaaggcctgatcttgtgcagagaatcacctttggtccttgatgattttgtgttgacatgctacacagaggtgatgaattcgctgcacatggggattggaatgttccaagctgagcaagatagattacctagtaaccaatggtgcttttctagctctaagatggctttaatgttggagtcagtaagcttacgatagtatcttgtaaattaaacctgtggaaagttcaacttgtatgggtacatgtaaagaatgaagtggctcaggaaccttaggccatgtttagtttcc

SEQ ID NO: 21041 - protein, 722 aa, Panicum virgatum
  misc_feature: Ceres CLONE 1814276
  misc_feature (39)..(357): Pfam Name: ORC3_N Pfam Description: Origin recognition complex (ORC) subunit 3 N-terminus
MAAPPGDAPLTAANNIQPFFVLHKASPAAASSVPSSRARRRIDASPPSSPNPKSAKRTRDVDAQDEEDSELCERLRLEAFHRIWSRIQSTIDEVLRGINLKLFDQVLQWAQESLSAIRAVAKPCHAEVQQPYPLLTDVICRRIPTAFVLTKNAEFVDDITTFRDLAGHLQSSGCHLAKLSAAELSVKHGVGGCFRSLLRQLLADVPDVVDVSALASWYCEAENYDQPIIVIIDDLEQCSGDVLGDLVMMLSEWVIKIPIFFVMGIATTIDAPKKLLSSEALQRLEPCKLTLGSPSDRMNALVEAILVKPCAGFCISHEVAMFLRNYFFRHDGTITSFISALKLACSKHFSMEPLSFLCMGVLQEDCEEFWHDKFEALPQVIQKYAFGLPSCTSATNLSNSSDDVVNGLSKLLKLQKDWSSVLLCLYEAGRHDKLQLLDIFCEAVNPDLHTQNASNAELPISKVNIEKLSGMKSGSGKVYMAQVMNAIRYLPVETLLRVLEVWSIHLRGMSEINDKVKELQSTTIDADSVRATKEKWTRRSTGSAGNGTVPLNEKVAVLLQDITRKYLVPVECLPFHEIICFKNVGVLQSALIGNPRRMVQLDLLKSQSRLKCSCCSRTGAALSGTLHDTSIMCNLAQEYGDVINLHDWYISFEGIINSRNSKVKRKSYSSPSKKKSKSTPPESEALIQARFCRAVTEMQITGLLRMPSKRRPDLVQRITFGP

SEQ ID NO: 21042 - DNA, 2911 bp, Panicum virgatum
  misc_feature: Ceres CLONE 1814296
  misc_feature: Encodes the peptide sequence at SEQ ID NO. 21043
agaccagtctccgtctactcttctcctctcttctctttccctgtccggtccccagcgcgcgacacgggtccagctcctcagccgccgccggcgatcgccggagccggggatccgtgcttccgatcacgcgcggcccagagccatggtcaggaccgggagtatgcgccgcttcttcctgcccacgccggcggcggtgcccgcgttcaccgcgtcgcccgaggactaccgcctgctggaggaagtgggctacggcgccaacgccgtcatgtaccgcgcggtcttcattcccaccaaccggacggtcgccgtcaagtgcctggatctcgatcgggtcaacagtaaccttgatgatgtaagaaaggaggctcaaactatgagcttgatagatcaccctaatgtcatcaagtcttactgctcatttgttgtggatcataacctttgggtggcaatgccgttcatgtcagagggttcatgtttgcacctaatgaaggttgcataccctgatggttttgatgagccagttatcgcctctattctaaaggaaacactcaaagctctagagtacctccataggcaaggacatattcatcgtgatgtgaaggcaggtaatatccttattgatagtcctggtgtagtcaagcttggggactttggtgtctctgcttgcatgttcgatagaggtgataggcaaagggctcgaaatacatttgtggggacaccttgctggatggctccagaagttctccagcctggaactggatataatttcaaagctgatatatggtcatttggaataactgcactggagctagcacatggacatgctcccttttcgaagtaccctcccatgaaggttcttctcatgacgcttcagaatgctcctccaggtcttgactatgaccgtgataaaagattctcaaagtccttcaaggaaatggttgccatgtgcttggtgaaagatcaaacaaaaagaccaacagccgagaaattacttaagcattcttttttcaagaatgcaaaacctcctgagctgactgttaagagtgttttgactgatttgccccctctatgggatcgtgttaaggctatccagctaaaagatgcagcacagctggctttgaagaaaatgccttcttcagaacaggaagcactttccatgagtgagtaccaacgaggtgttagtgcatggaacttcgatattgaggatctaaaagcccaagcatcactgatttgtgatgacgatccacttgaagtaaaagaacatgatgacagtgctaggataactggcattgataaggatacgtcttctgacagtcattttggaaagccgacacagttgaatggaaatcgcagcagtgaaagaacttctgctgcagcaaatcaaagtcaaaatgtccccgaaacaagcaaagcattgtcttccaacaatggtagtgccgatagtgaaaggaaggttgatggacctagaagccaggtgtcagaaattgatcaattgccctctacatcgaagcatgactcagatgggaaaaaaagtggagtcagacaaacacaaagaacatattctggtccaattctgcaatctggtcagcataatagttcgttgactgaaaggggtcacactgttgaaagggatgtaggagctcaatctggatctgataaacaaaagaatggtacaagaagaaccaataatctgagcggtcctctgtcacttccaactcgtgcttctgcaaatagtctttctgctcctattcgatcatctgcaggttatgtaggctctttgggtgataagcctaagcgtaccatagtggaaattaaaggccgcttctcagtgacatctgagaatgtggatcttgcaaaagtccaagaaatgccggcgagcagtgcctctcgcaaattgcaagaggggccttcactgagaaaatcagcaagtgtcggtgattggtcagtaaatgccaagacaatgtctactagtcatcaacggaaggaactctgcaataactctgtatctgcatcaattctgattcctcatcttcaaaaccttgtaaagcaaactgcgtttcagcagggtctgattacagacctactaagcaacttgcagcaaaatgagagagttgacgcccagtcaagaggccagagtatggggactgatacagtagttgaagcgtctacggctgagggagaacgctccttacttgttaaaatttttgaattacaatcgagaatgatttctttaactgatgaattgattgcggcaaagctgaaacatgtccagcttcaagaagagctaaatgcgctctactgccaaaaagaaatagtcgacatgagagaggaagagaatgaataagcatgatgagtcaaagctggccattcttactagttgggagggagctaaatgaaatatattctgggctcatgcaatcgacgcttcgctaacttgcctgcccttgaggtttttaaggtgcattggtgctgagccagcttaattccgggtctcatcagagaagaaaattgttgggcagccgcgaaactgcaatgagcttgaaggagaggggagaggtcttcgaggtgtacgatcatcgatggctcggcttgagattggccggttgttacaaatatgtgtattcggtcgatctgttttggtccgggtttggttcttgagtgagtgttagctgtttcttgcggtgtgcgttcattttggtcgcaccgatcgctgagatggcgggtggccatgctgccaacctctaatatactagtagtatagcaccattgtacttgtaccgcagaaagattgcgagaataatcgcatcgcatctaatctaggacagcgggatgtatatgtagtgtaaaagttactagcacattttgggaaggaaatacaactccggctgtatggaaacagcttctcatgcag

SEQ ID NO: 21043 - protein, 733 aa, Panicum virgatum
  misc_feature: Ceres CLONE 1814296
  misc_feature (28)..(289): Pfam Name: Pkinase Pfam Description: Protein kinase domain
  misc_feature: SWISSPROT Homolog: EC 2.7.11.1 Non-specific serine/threonine protein kinase
MVRTGSMRRFFLPTPAAVPAFTASPEDYRLLEEVGYGANAVMYRAVFIPTNRTVAVKCLDLDRVNSNLDDVRKEAQTMSLIDHPNVIKSYCSFVVDHNLWVAMPFMSEGSCLHLMKVAYPDGFDEPVIASILKETLKALEYLHRQGHIHRDVKAGNILIDSPGVVKLGDFGVSACMFDRGDRQRARNTFVGTPCWMAPEVLQPGTGYNFKADIWSFGITALELAHGHAPFSKYPPMKVLLMTLQNAPPGLDYDRDKRFSKSFKEMVAMCLVKDQTKRPTAEKLLKHSFFKNAKPPELTVKSVLTDLPPLWDRVKAIQLKDAAQLALKKMPSSEQEALSMSEYQRGVSAWNFDIEDLKAQASLICDDDPLEVKEHDDSARITGIDKDTSSDSHFGKPTQLNGNRSSERTSAAANQSQNVPETSKALSSNNGSADSERKVDGPRSQVSEIDQLPSTSKHDSDGKKSGVRQTQRTYSGPILQSGQHNSSLTERGHTVERDVGAQSGSDKQKNGTRRTNNLSGPLSLPTRASANSLSAPIRSSAGYVGSLGDKPKRTIVEIKGRFSVTSENVDLAKVQEMPASSASRKLQEGPSLRKSASVGDWSVNAKTMSTSHQRKELCNNSVSASILIPHLQNLVKQTAFQQGLITDLLSNLQQNERVDAQSRGQSMGTDTVVEASTAEGERSLLVKIFELQSRMISLTDELIAAKLKHVQLQEELNALYCQKEIVDMREEENE

SEQ ID NO: 21044 - DNA, 509 bp, Panicum virgatum
  misc_feature: Ceres CLONE 1814303
  misc_feature: Encodes the peptide sequence at SEQ ID NO. 21045
ggtgccttgggggtggatcggaggggaccattctcacgctccatgttcgtccccgcctgatccgccggccggatcggatagcatcctcctccccctcccgctccggcgcgggggccgattagattcgatggcccgatttgacaccttggtggctgcctcgcagcggggggatgagggaggggctgtctggctctgagggcagggcctagacgcgctgcttggcggttggcgtgagcaggaggctgaggaggagggtgcttgcgagacctgcaccgaagactaacctggtcatgggttttggtgagatcaccaccaaggcccatgttgactacgagaagattgtctgggagacctgacgcaccgtcggtttcatgtctgctgatgttgggcttgatgctgacaactgtcaagtgctcgtgaacattgagcagcactcccctgatattgctcagggtgtgcatgggcacttcactgagcgccctgaggagattggagctggtgaccgggga

SEQ ID NO: 21045 - protein, 45 aa, Panicum virgatum
  misc_feature: Ceres CLONE 1814303
  misc_feature: SWISSPROT Homolog: EC 2.5.1.6 Methionine adenosyltransferase
  misc_feature: Useful for making plants with modulated biomass
MSADVGLDADNCQVLVNIEQHSPDIAQGVHGHFTERPEEIGAGDR

SEQ ID NO: 21046 - DNA, 1531 bp, Panicum virgatum
  misc_feature: Ceres CLONE 1814305
  misc_feature: Encodes the peptide sequence at SEQ ID NO. 21047
aagcaagcgagccgccggagtgctctccatccccagtcgccactcctttctttgacctccttgccgccgccggatccgccgccatcgccggccgcgcttgaacagatccaaagggccgggcggcaccacccccgcggcggggatctgcctccagctccccacaagatggaggaggcccctgctaagaggaatccggcggccagccttacagacgacctcctcgtcgagattctccgccgcctgcccatccgctccgtatgccgcttcaagtgcgtctcgcggtcctggcgcaacctcatctccgaccccgcccaccgcaagaagctcccccagaccctcaccggcttcttctactgtagcctcagcggcgagcgcttccccatcaaggcgcaccacttcaccaacgttaccggaaaaggcatacccttcatttttccttccttctccttcttgcccgtccccagtgatgatgtagtcctcttggattgctgcaatggcctcctcctttgccgttgctatgagcctgatcctcataatggcgatgagagcgatgagtctggtcctagtgatggcgacgggtttcgaccgttccattatgttgtgtgcaatcccgcgaccaagaagtgggtgatgttgccggatggcagttgggctagtggcgagactcgcacacccgcttggcgtttgatccggcagtctcctcgcagttccatgtggttcagtatgtggtggacgaggcttggtgcgtcacaggggtggagatttattcatccaaaactgcagcatggaggtttaaggaaagtgaatggggcgatgatgttatgctacatcatcaagtgagaagtgtgtttcttaacggcttcttgcatatgctcacggtccttgatgggatagcgttggtggacatgaatgcaaaaacatggaggacaattcctgtgccaactgataatttttttgatggctgcatccatcaagctcagggtcgcctgtgttttcttaatgttgatgatgctgatttcttcaagctgtcgatctggttccttgaagaccatggtactaatgaatggacattgaagcattccgtcaggactccactgctgtttgggtggaagaagcttcgatttgagttcgactacacagtgattacaattcacccagaatgcaatttgatttactttgtttatgggtgggacaagacactgatggcatatgaaatggaccgcaaggaagttcgtgtcatccgcaatcttggacatgattgctcggtgacctattttccttatgttcccttgttcttagaggcattagaagatgagcagtgaaactgttagatttactgcagctattgttactgcaatgatgaattcatattggtgcagtaaggagtacgtggcattccttctagctgtctgattgttctagcaatctgtaagttgagtagactgccagaaaaattctgttttctttgttttatgcatttgagcatgtctgttgtgatattttgatttgaatcaatgttgtttaattgttg

SEQ ID NO: 21047 - protein, 224 aa, Panicum virgatum
  misc_feature: Ceres CLONE 1814305
  misc_feature (9)..(56): Pfam Name: F-box Pfam Description: F-box domain
MEEAPAKRNPAASLTDDLLVEILRRLPIRSVCRFKCVSRSWRNLISDPAHRKKLPQTLTGFFYCSLSGERFPIKAHHFTNVTGKGIPFIFPSFSFLPVPSDDVVLLDCCNGLLLCRCYEPDPHNGDESDESGPSDGDGFRPFHYVVCNPATKKWVMLPDGSWASGETRTPAWRLIRQSPRSSMWFSMWWTRLGASQGWRFIHPKLQHGGLRKVNGAMMLCYIIK

SEQ ID NO: 21048 - DNA, 653 bp, Panicum virgatum
  misc_feature: Ceres CLONE 1814305-R
  misc_feature: Encodes the peptide sequence at SEQ ID NO. 21049
cgagcgagcaggcgatgcgcgacgccatcgaggggatgaacggcaaggagctggacggccgcagcatcaccgtcaacgaggcccagtcccgcggcggcccgcgctccggcggcggcggcggctacgggcgccgcgagggcggcggtggctacggcggcggcggcggcggcggcggctacggtcgccgcgagggcggtggcggctacggcggcggcggcggcggctacggtggccgcgccgccgcttcctcagccatgggtaaggtgcacggatcgctggcccgtgccgggaaggtccggggccagacgcccaaggtggcgaagcaggacaagaagaagaagccccgcggccgcgcgcacaagaggatgcagtacaaccgccgattcgtcaccgccgtcgtcggcttcggcaagaagcgcgggcccaactcatccgagaagtaagcgccgcgccgcgcagccgccggctcgacccgccccggttcctctattccgttctcagtatgcttatgctcttgtcggtagtagtttcgttgtgcaagcaaaggaagaaccttttgtagtttcagtttcgttgttcgtgtgatgagatgggaacttgagatggtatctgtaccccgtttaagattttgagatatgatgatatgatcccat

SEQ ID NO: 21049 - protein, 146 aa, Panicum virgatum
  misc_feature: Ceres CLONE 1814305-R
  misc_feature (87)..(145): Pfam Name: Ribosomal_S30 Pfam Description: Ribosomal protein S30
SEQAMRDAIEGMNGKELDGRSITVNEAQSRGGPRSGGGGGYGRREGGGGYGGGGGGGGYGRREGGGGYGGGGGGYGGRAAASSAMGKVHGSLARAGKVRGQTPKVAKQDKKKKPRGRAHKRMQYNRRFVTAVVGFGKKRGPNSSEK

SEQ ID NO: 21050 - DNA, 1719 bp, Panicum virgatum
  misc_feature: Ceres CLONE 1814321
  misc_feature: Encodes the peptide sequence at SEQ ID NO. 21051
gccggcctctgctcctgtgatggttggtgaccaagcacagatcagtgtgtgtcttgctgtagggccgtgccggcggcatcacagcgatctgcgggtagccgacatgtctctgtaaacaatgctccatcattagcagcaagcaggtcattagcagcttagcggctctggttagcgtggcgtgttaggcgcgggaggctttgccgttcaaaaaatgagccaccatgtgccggccggcaggaatatttcccacacatggcgcgccggcgaagtgcggtttctggccatgttcatgtggcgtgcttcgtctctgctatgctaacctgggagggagaagacgtggcctgtttctgtgggtttgttagttgagcctcatgtgtctgctgatccatatctagtgctaaatcatgtgttcagtgacgggcgtcggcgccgatttcatagtttagtctgctactagtattgtattcccatactctgaatttcctcaactgtactaataattgatgagagaatataaataaaactactcgatcccatgctctcaagtctcaagtcggaactgctccagaactccattattgatgataaatagaataggactgttatgtaatggtgagtcaatgcgctgacttgatctgatctctgcgcatgcagtcctaccctgccgtcaccgacttcctccagtcggggctcttccgctgggctggcgacgccggctcgttcacgggcgacacctacatcgagctggtgtgctccccgaacaaccccgacggcgccatccgcgaagctgttctctcctccgagtccggcgtcgccgtgcacgacctggcctactactggccccagtacaccgccatcaccaggcgggccgaccacgacatcatgctcttcaccgtgtccaagagcacgggacacgccggcacgaggatcgggtgggcgttggtgaaggaccgcgacgtcgcgaagaagatgaccaagttcatcgagctcaacaccatcggcgtgtccaaggactcgcagctgcgcgccgccaaggtcctcagggcggtctccgacgcctacgagctctcgggggcgggggaagagcaccgccgcctgttcgactacgggcggcgcaaaatggcggagcgctggagcatgctgcgcgaggccgccgccgcgtcgggcatcttcagcctgcccgacgagacctccggctactgcaacttcaccgaggacatggcatccactaaccctgcgttcgcgtggctgcgctgcgacagggaggacgtggaggactgcgcgagcttcctccgggggcacaagatcctgacccggagcgggagccaatttggagcggacccgaggtacgtccgggtcagcatgctggacagggacgacgcctacgacatcttcgtgaagcgcctcgcctccctcaagtgaggtgaagacgacggaccatggatcgatgccaccctgccggcgccggcaacgcatgccccgtgggagcatgagtagagcagcagtatcggtagagtaggaagaagcagaagaggcaggagcaacgttttgttttgctttttccttctgctgtgtgctgtgttgttggggatggatgcatgtcgcatcgtctcaaaaattcttataaaggtttcattttttttcttgctaattgctagtatgtgagactaagctgacatgagaaaataatcgatctggaaatacacttgtggactggat

SEQ ID NO: 21051 - protein, 257 aa, Panicum virgatum
  misc_feature: Ceres CLONE 1814321
  misc_feature (1)..(257): Pfam Name: Alliinase_C Pfam Description: Allinase
  misc_feature: SWISSPROT Homolog: EC 4.4.1.4 Alliin lyase
MQSYPAVTDFLQSGLFRWAGDAGSFTGDTYIELVCSPNNPDGAIREAVLSSESGVAVHDLAYYWPQYTAITRRADHDIMLFTVSKSTGHAGTRIGWALVKDRDVAKKMTKFIELNTIGVSKDSQLRAAKVLRAVSDAYELSGAGEEHRRLFDYGRRKMAERWSMLREAAAASGIFSLPDETSGYCNFTEDMASTNPAFAWLRCDREDVEDCASFLRGHKILTRSGSQFGADPRYVRVSMLDRDDAYDIFVKRLASLK

SEQ ID NO: 21052 - DNA, 724 bp, Panicum virgatum
  misc_feature: Ceres CLONE 1814323-R
  misc_feature: Encodes the peptide sequence at SEQ ID NO. 21053
atgcattcctttcccataccagaaatcagcaaaggctgaactccagtacttgcaccaccatgttggtgtcgctgctagtgttggcctgaatgcaaaccctgttattaacttttccggtgtattcgggactaaaactgtcgctgttggtgctgacgcttcatttgatacttcatctggggacttgaccaaatacaatgctggactgagctacactactagtgactttgttgctgcagccactctgaacaacaagggagacagccttgctgcttcctactaccacttggtgaattcaaccacagctgttggaggagagctgactcatagcttctcaagcaatgagaacaccctcacctttgggacacagcacgccctggaccctctgaccactgtgaaggcacgcttcaacaactatggcatggcaagtgcgctcatccagcacgaatggaggcccaagtcattggtcaccatctccacggaggtcgacaccaaggccatcgagaagagctccaaggttgggctctccctggtccttaagccctgagggcgccagcttctggttttaggatgttagcgtttgttatcagcagctgaagtccagtaaacaagcttggactaaacttgtaggctcagctttggtgccgtggggtctcagatcccacaaactcaattcattgcgtgttaccctgttctagactacttgaggggtttctgcttttaccag

SEQ ID NO: 21053 - protein, 180 aa, Panicum virgatum
  misc_feature: Ceres CLONE 1814323-R
  misc_feature (1)..(173): Pfam Name: Porin_3 Pfam Description: Eukaryotic porin
  misc_feature: Useful for making plants with modulated drought sensitivity
CIPFPYQKSAKAELQYLHHHVGVAASVGLNANPVINFSGVFGTKTVAVGADASFDTSSGDLTKYNAGLSYTTSDFVAAATLNNKGDSLAASYYHLVNSTTAVGGELTHSFSSNENTLTFGTQHALDPLTTVKARFNNYGMASALIQHEWRPKSLVTISTEVDTKAIEKSSKVGLSLVLKP

SEQ ID NO: 21054 - DNA, 1526 bp, Panicum virgatum
  misc_feature: Ceres CLONE 1814323
accccccactccgctcccccctccgggctctcgctggtcgcccaactccaaagcccccgcctttccgcgaatttcctccccgtcggctgccccctgatccggcttcgggtcccgtggatcgacgcgccgcctcctcgcgctcgggacggtggttttccccgggatttacggcgccggaagtggagagatttgccggcgcagatctggtggtggtccgctctcagaagcagtgtgttcgctgccggatctacattgccacggacgggattagcgtggaggagacgacgccctctgtgctggctccgttcggctcctcggctatagatctggaaggactctgggtgatcggctgctgcaagctgcctcaggtgtattggagagtcaccacttcaccgaagcatcatcgtcgcaagcatagcctgacatggaggctcttgtggttataccagagcagcacaaccatcaccgccaccctggtccccgtagcaagccatcaggaccacacttcacttcaccaccaccatctcgtagcttccgtggaatgaactgccggtcgttctactctggtggctgcatgagtgtcctcccttccccaccaccctcacctgcccgcacctactcatccccagagcccaaggcacctaagcagcagcagctgcctcgtcatggtggcaagcgcactcgacccatttccttaagcccctccacatctccgtcccgatctgagctgtgggcgggcccggcgttctccaactctccacctcccagttcactgcccatccccaagttctccctccgccagaagcgcagcatctctcttgagctaccacctgttgagcgctctgatgatgtggaggtcagactgcatgctaaatcagctccttcatccccggttgggggatcagggtatgatttcttcaatgacaatgaaactgctactgctatagcaacagagaatctgaggaggattctccagttggatatcacagatcattgaatactgggaggatggaagggtggttcctgtgtacataggttatcttccactgacatcttttctacctgcatagtagtgtatagagatacctggtggttgtaagatatggtcagtatcatggtggtgtagttccgacttcctaggatagctgaaagtgacactgccgtattgggtgttatggaggtggattctagattaataaggatggggtggacggcagttgatagtattcacttatatgcttccttcatttcttagttatagaatttgagccctctgcattgtttgcatccacagtatatgttctgaactgacagtggcagtctgccaaagtagcagtgtcttctgctgcagttagttcgtgcatgggagaatggcatacatcctaatcagatgtcaaatatttgtagggtatacctgcatttagtgcatcctgcatgtccttgcatgcttgtttccttctatcctttagccaactcattccactcttaactatcctggcttcctggtgctctgcaaagaacactat

SEQ ID NO: 21055 - DNA, 663 bp, Panicum virgatum
  misc_feature: Ceres CLONE 1814352
  misc_feature: Encodes the peptide sequence at SEQ ID NO. 21056
attggctcaactggcagttgtgaggcgcatcatcacagaggaagagcgagtggaaatcgaagcagcagcagcaatggcggcatccatgatcacgtcgtcagctctgatggcggccggcaagggcgacgagtccaccccgacaaacggcggcggcgtcctcccggccaacttcgccgaggtggtggcctcccttccccaagggccgcagtgctccatgtttccttccctccgccattaccgcggcttctggatcccggagatcagcctgctgagcctccccgaggtccacgcccgcttcgcgctgagccccacggatgtcctcgtcgcgagcttccccaagtgcggcaccacctggctcaagtccctttgcttcgccgccgcgcgccggtcctcccacccgccactcgacggcgggcacccgctcctccgccgcaacgcacacgactgcgtcaggtccatcgacacccttcggttcctgcaaggcggcggggacgacgacggcgaggcgccgcgcctcctcgggacgcacctgccctactccctgctcccggcgcgcgcaacggcggaggacggctccgggtgccggatcgtgtacgtcatccgggaccccaaggacacgctggtctccctctggcacttcaactccggcgtggtgctgacgcg

SEQ ID NO: 21056 - protein, 196 aa, Panicum virgatum
  misc_feature: Ceres CLONE 1814352
  misc_feature: SWISSPROT Homolog: EC 2.8.2.1 Aryl sulfotransferase
MAASMITSSALMAAGKGDESTPTNGGGVLPANFAEVVASLPQGPQCSMFPSLRHYRGFWIPEISLLSLPEVHARFALSPTDVLVASFPKCGTTWLKSLCFAAARRSSHPPLDGGHPLLRRNAHDCVRSIDTLRFLQGGGDDDGEAPRLLGTHLPYSLLPARATAEDGSGCRIVYVIRDPKDTLVSLWHFNSGVVLT

SEQ ID NO: 21057 - DNA, 713 bp, Panicum virgatum
  misc_feature: Ceres CLONE 1814364
  misc_feature: Encodes the peptide sequence at SEQ ID NO. 21058
aacctcaactccctctcctcctctctcgccgcccatcacctcttcctcgctcgctccaaagtccaaacccacagcgatcgatctcttgccacgcgcgcccgccgccgcaagcaatcaatcaaagcaagccgcattcgcctcgggtcagttctcgatcgggatctcggagcagcgttggcgcacgccatggccgcgcagccgtggaggtcgctgctctgctgcgtgggcggcggcggtggcgcggcaggcgagggcgacggcccggcatcgccgcggcgggggaggaccgcgcgcgggagggaccgggaccgcgaccagctgctgcgggtcccctcctcgtcgtcgtcggcggcgtcgcgggcgtcgctgatgtcgagcctgggctcgtcgggcccgctcacgccggaggacctctcgctcacgctgtccagctccgacctgcacgccttcacccacgccgagctgcgcgccgccaccgcggggttcgcccgcgccaactacctcgcctgcggcgggttcggccccgtctaccggggccgcgtcgaggccggcctccgcccgaggctcgccgcgcaggacgtggccgtcaagtacctcgaccccgactgcggcacgcagggccaccgggagtggctcgccgaggtcttcttcctcgcccagctccgccacgggaacctcgtccgcctcctcggctactgctacgaggaccaccc

SEQ ID NO: 21058 - protein, 175 aa, Panicum virgatum
  misc_feature: Ceres CLONE 1814364
  misc_feature: SWISSPROT Homolog: EC 2.7.11.1 Non-specific serine/threonine protein kinase
MAAQPWRSLLCCVGGGGGAAGEGDGPASPRRGRTARGRDRDRDQLLRVPSSSSSAASRASLMSSLGSSGPLTPEDLSLTLSSSDLHAFTHAELRAATAGFARANYLACGGFGPVYRGRVEAGLRPRLAAQDVAVKYLDPDCGTQGHREWLAEVFFLAQLRHGNLVRLLGYCYEDH

SEQ ID NO: 21059 - DNA, 1895 bp, Panicum virgatum
  misc_feature: Ceres CLONE 1814383
  misc_feature: Encodes the peptide sequence at SEQ ID NO. 21060
agggctgctggcctgctgccccccacacggaaggcgccaggagccgccgcatccggccgcatcgccgccggtcccgcgccaggagagacagcggcggcgtcttctacccgtttgaggagcaggggaagctggatttgaggatttggggcaccaactaacggccggctccagcatggacactgcgtttcttcgttctccgcttgctcgcaatctagtttatgacgagtttgccgttcttcactccccaagctaccgtttccatcctctgcgctattcgaggtgcaatccgacaaactcgacgccctgccaaacgttgtctgcttcgccatcaaggggcttgactcagcgagtggccgcattacctaatgttgatgattttttctgggagaaggatcctactccgatcctggacacaattgatgcgcccattcatttgaaaaatctatctagtaaggagctcaagcagttagctgatgaagttcgttctgaaatatctttcataatgtccagcaaatgccagccatgtggtcctggtcgctcagttgtggagctgacaattgctatacattatgtgtttaatgccccaatggataagatactgtgggatgctggtcagcatgcgtatgcacacaagattctcacaggaaggcgctctctcttccatactattaaacaaaaaaacggcctttctggtttcacatctcgatatgagagcgagtatgatccctttggtgctggacatggatgcaatagtctttctgctggccttgggatggcggttgcaagggatataaatgggagaaaaaatcgaatagtgacagttataagtaattggacaaccatggctggccaggtgtatgaggcaatgggtcatgctggtttcctcgattccaacatggtagttattctaaatgatagctgtcactccttgcttcctaaagctgatggccggccaaagatgtcagtcaatgccttttctagtgctgtcagcaagattcaatccagcaaaggatttaggaggtttagggaggctgcaaagggactcgctaaatggtttggcaaaggaatgcatgagtttgctgccaaaattgacgagtatgctcgtggtatgataggtcctcatggagcaactctttttgaagaacttagattatattatattggtcctattgatgggcataacattgatgatctcatctgtgtattaaaggaggtctcaactctagattcaactggcccagtactggtacatgtaattactgggactgaaaatgacactggtggaaatatgaggagtgaaataactccaaatgacgaagggcctccaaactcaagtcatgatcttcttaaatttttagaaactggactttctaggacatataatgactgctttgtagaagcattaacagcagaagctgagaatgacaagcgcattgtggtagttcatggtggcatgggaatggatcgattactccgcttattccagtccagcttcccagacagattttttgacctgggcatcgctgagcaacatgctgttaccttttctgctggtttggcctgtggaggtttaaagcctttctgcataattccatccacatttcttcagcgagcatatgatcagatagttgaagatgtggacatgcaaaagataccagttcgatttgctatcacaaatgctggtctagtggggtctgagggcccaactaattcaggaccgtttgatataacattcatgtcctgcttgccaaacatgattgtcatgtcaccatctaacgaggatgaacttattgacatggtggcaacagctgcaatggttgaggacagacctatttgcttcgggtatcctaggggtgccgttgttgggactagtggcactttcacgtatgggaatc

SEQ ID NO: 21060 - protein, 574 aa, Panicum virgatum
  misc_feature: Ceres CLONE 1814383
  misc_feature (399)..(565): Pfam Name: Transket_pyr Pfam Description: Transketolase, pyrimidine binding domain
  misc_feature: SWISSPROT Homolog: EC 2.2.1.7 1-deoxy-D-xylulose-5-phosphate synthase
  misc_feature: The sequence is a functional homolog of SEQ ID NO 12 in US patent 7132250
MDTAFLRSPLARNLVYDEFAVLHSPSYRFHPLRYSRCNPTNSTPCQTLSASPSRGLTQRVAALPNVDDFFWEKDPTPILDTIDAPIHLKNLSSKELKQLADEVRSEISFIMSSKCQPCGPGRSVVELTIAIHYVFNAPMDKILWDAGQHAYAHKILTGRRSLFHTIKQKNGLSGFTSRYESEYDPFGAGHGCNSLSAGLGMAVARDINGRKNRIVTVISNWTTMAGQVYEAMGHAGFLDSNMVVILNDSCHSLLPKADGRPKMSVNAFSSAVSKIQSSKGFRRFREAAKGLAKWFGKGMHEFAAKIDEYARGMIGPHGATLFEELRLYYIGPIDGHNIDDLICVLKEVSTLDSTGPVLVHVITGTENDTGGNMRSEITPNDEGPPNSSHDLLKFLETGLSRTYNDCFVEALTAEAENDKRIVVVHGGMGMDRLLRLFQSSFPDRFFDLGIAEQHAVTFSAGLACGGLKPFCIIPSTFLQRAYDQIVEDVDMQKIPVRFAITNAGLVGSEGPTNSGPFDITFMSCLPNMIVMSPSNEDELIDMVATAAMVEDRPICFGYPRGAVVGTSGTFTYGN

SEQ ID NO: 21061 - DNA, 753 bp, Panicum virgatum
  misc_feature: Ceres CLONE 1814383-R
gccttcgccttcgtcgcgctcgtgctcgtcgcgtccaaccagcacggcgactggatgcagttcgaccgctaccaggagtacaagtacctgctcgcaatcgcagcgctggcgttcctctactcgctggcgcaggcggcgcggcacgcgctccggatgcgcggcggcgtcgaccccgtctccgcgccgtcagggaggctgctcgatttcgtcggtgatcaggcagttgcatacttgctgatgtctgcgctttcggctgccgtccccatcacgaaccgcatgagatcggcagtggtcaacaacttcacagatgcaaccgcagcagcgatcagcatgaccttctttgcatttgtagctcttgccttgtcagccgtggtttctggatacaagctctccaaacaaacgtacatgtgaatcatcattgtagaagagtaaaacacattacgtggtctattaatcatggattgctcatcagaagagaaacatgcttctatagttctcttcaacttgaaggtcatgtattgtgtgtgctgaggtgattgttgttgcatgcagtagcttccatgcgtgtacatagaattatacgcagcatgcctgaatgtgattgttttcctttccaagatattgctgtcctgacaagaaattttagcttttctgaacatatgcagaagtggagctgtatgcttattttagggcccataattttccatgagacctgtgaagaacgaaatgtttattacccttactgtagcgtgc

SEQ ID NO: 21062 - DNA, 1753 bp, Panicum virgatum
  misc_feature: Ceres CLONE 1814401
  misc_feature: Encodes the peptide sequence at SEQ ID NO. 21063
ctcgaaccatctcgtttcgtttcgtttcgtttcctctccttccctcgcctgctcgctcgctccccaggaccccagccacatctcgagcgcgctccttggcggccggccgcccacgccccccctccgtgcccgtgcggtggtccgacgcgccgctcttagaggcgaggccggccgcccccgccgctcgccggggcggcgcgaggccgggtgccgtcccaggttcgtggcgcctgcgcgaaccgagccttggttcgtgggcccggatttcccgcgcttgatttgcagccggggaagcatcacaagggaaacgggattagctagctctgcagaggccgccgggcttccccgcccctcgcgcgcaggcgcgtgcgcttgaataagttggaactccttcaagttcccggcttcgaatggcttcctcagatgtctctgttgatattcggtccgactttaactcattcgatcattttccaagcatgcgatacattgcaacagatagaccctggttgaagttatatggaataagagttcagcctatgccgccattcagaagtttgagctgcaaacctgatccggcactcattcatcattgcctacctgatgaactacttcttgagattttcacaagaatgaacccatatacgttagggagggctgcctgtgtctgccgcaagtggaaatatactgcacgtaatcctgctttgtggcgtgctgcatgcttgaaaacttggcagaggagtggaactgaagtaaactacatgatggttcggtcgttgtatgattcttcttggaggagaatgtggctgcagagaccaagaatccgaattgatggtctctatgtgagcaggaacacatatattcatactggagttacagagtggcaattcaagaaaactgtcaatgtggtttgctactaccgttacttgagatttttccctagcgggaagttcctctacaagatttcccctgaaaaaattaaagatgctgtcaagtgcatgcatttccgggcatcaaaggctgattgtgtatttaaaggcgactatatactgtcagaggatggccagatagaaatggcactcctatatccggggcatcggtacacacttgttaggatgcgccttaggcttagaggcactacaattggtacaaataacaggttggatgtactaaagattctaaccactggagttaatgcaactgaactgaaaaactggacaagcagcatacttgaacttgttgagggctgggaggaggatgagacgcatgacccagatgtgcctgccgtttcccacagcaggggtttgtctcccttcgtgtttgttccgtttgaggaggctgatacttcggtgctaaacctcccagtggagaagatggattactatgtccctgggtgagctactcatggcgacaattatgatggagaatggagatgattgatggccctattgcaggttcagatgatggtggagatgataagcgatttcatttcctcacggattcttgccagagcaatatgtaaatacacagtgttgttttatttccccttctgggttgcttgcatgaagttgtatgaataattatacacgtgttcgttgatgctttaaaacggggtaggcaagaaataagttctttgtcgatgctataaaacgagtggaaccacccccctcaagttgtgggtctgtactatagaaacaagcagtctatcgttgtaaatgtaaactcttgaatctgaatatgtattttttgactgtac

SEQ ID NO: 21063 - protein, 327 aa, Panicum virgatum
  misc_feature: Ceres CLONE 1814401
  misc_feature (57)..(104): Pfam Name: F-box Pfam Description: F-box domain
MASSDVSVDIRSDFNSFDHFPSMRYIATDRPWLKLYGIRVQPMPPFRSLSCKPDPALIHHCLPDELLLEIFTRMNPYTLGRAACVCRKWKYTARNPALWRAACLKTWQRSGTEVNYMMVRSLYDSSWRRMWLQRPRIRIDGLYVSRNTYIHTGVTEWQFKKTVNVVCYYRYLRFFPSGKFLYKISPEKIKDAVKCMHFRASKADCVFKGDYILSEDGQIEMALLYPGHRYTLVRMRLRLRGTTIGTNNRLDVLKILTTGVNATELKNWTSSILELVEGWEEDETHDPDVPAVSHSRGLSPFVFVPFEEADTSVLNLPVEKMDYYVPG

SEQ ID NO: 21064 - DNA, 2164 bp, Panicum virgatum
  misc_feature: Ceres CLONE 1814409
  misc_feature: Encodes the peptide sequence at SEQ ID NO. 21065
gtgcacggtttcaagtacctagaagaagaacatccttgcagagccgctgctatggccatggacaccttaaccaccaccgtcgtcgtcacccttttattcctcctgccattgctggccctagtagtaaggcaaacgcggcagcggcggcggacgactggccatgttccaacgccaccagagcccacagcgatcccggtagtcggccaccttcacctcttgctaaagaaaccactccaccgcaccctctccgacctcgccgccggccatggggatctcttctgcctgcggttcggctccagtagggtggcagtcgtgtcctctgccgcagtggctcagcagtgcctgagagcattagacaccacgttcgccaaccgtccgcggctgccgtcggcgaagatcctctccttcgactggtcgaccatgggccattccaactacgggccacactggcggcaggtccgccgcaccaccacctcagagatcctctctgcggagcaagtgcagtacttcgccgacgtgcacgtgcagcaggcccgggccatggcccggcgcctctgtcgtgtggcggcgcttcgttccgggggccgcgtacttgtcgacctcaaggcacgcgtagctgagatgctattaaacgtcttgctcgacatgatttgcatgaggacgacgtgctctcgcgggtaatccatcttattacatgcgcagatcatacatgaatgctacctgaatatgacacactaatgctaccgtaatatgatatggcactggtgttgtgtagtgacgaaggggacaagaccggggaagtgagtgagagggcccgagttttcatggcgatggcggaggagacgatagagctcacgctgacggcgtgggacttcctgccatcactggcacggtggctggacattgacggcgtgggccggcggctgaagcgactgcaagcaaacaggacaaggtttttgaagatgatggtggaggagcacagagagatggaaaagaagcagggcgcacaggcgacaaggaatacaatggtccgggcgctgctggagctgcagaagaaggatcccgaggcctgcacggataagctcatccactccatgtgtatcgtgagtagtatctacgtactgctaatattattttgcactctttttggacagagatagtatattaaccatttctgttcgcatcgatcgcatatctatcaatcgatcgaagagtgcactcgaagctgggacacttagtacagaatacacaattgagtgggcgatgacactgttgctaaactgccctcacgtcatgaagaaggctcgcgatgagattgacgcgtgcgtcgggaaagcaaaacgcctactggagttgaccgacgtccccaagctgccatacctgcgatgcatcatcctagagacgcttcgcctgtacccagttgtaccgcttctagtccctcgtgaatcctctgccgactgcaccgtcaatgggttccatattcccaaaggaaccatgcttctcgtgaacacatttgtgatccatagggatcctagggcatgggatgacccagaaacgttcctcccggaaaggtttgaggatggcaggaacaataatcaagctggtaagatggccttgtcatttggcatggggagacgacgacggtgcccagcagagaaccttggcatgcagctggcaagccttgcgttgggaaccatgatccagtgcttcgactgggaacgagtgggcacggagcttgttgacatgtctgaaggctctggcttaaccttgttcaagaagaacccattggaggccatctgccagcctcgtgcttctatggttgatcttctatcattctgtgatttaatatagagacacgcacgcacatcaataattaatgcttagtgtctctttcggagggcatggcagcccaccggaaggatgatgatgtgtgtgtggagtcgttggtcattgaatacgtatattgttgttgtacgtaccccaggtgctgctctagccagcgacacttcggctctctgtgcgagcctgttttctatcctcatcttctctttacacttgttggcttgttgcgtccggtagttgagtcaggtcatagtcatgcacttcgccattgtaaccatacgtctacttaatctcgtgctatatatatattttatgtttattc

SEQ ID NO: 21065 - protein, 195 aa, Panicum virgatum
  misc_feature: Ceres CLONE 1814409
  misc_feature: SWISSPROT Homolog: EC 1.14.13.89 Isoflavone 2'-hydroxylase
  misc_feature: Useful for making plants with modulated nitrogen use efficiency
MTLLLNCPHVMKKARDEIDACVGKAKRLLELTDVPKLPYLRCIILETLRLYPVVPLLVPRESSADCTVNGFHIPKGTMLLVNTFVIHRDPRAWDDPETFLPERFEDGRNNNQAGKMALSFGMGRRRRCPAENLGMQLASLALGTMIQCFDWERVGTELVDMSEGSGLTLFKKNPLEAICQPRASMVDLLSFCDLI

SEQ ID NO: 21066 - DNA, 1485 bp, Panicum virgatum
  misc_feature: Ceres CLONE 1814415
  misc_feature: Encodes the peptide sequence at SEQ ID NO. 21067
ttagggggaagccagccaagccgagccaagccagcggaggggagagagagacaggagggagggggagaggctcggaagcgggggaggttggtggcgcagcaggtggaggaggagcttctagaggagggttaagggaggcgggcgcgccatgggggactccagcggctcggtgtcgatcgacgtcgagcggatcttcttcggcggcaaggaacatcgagtaagaacgagacatggccctctttcggtttctgtatatggagacgaagacaagcccgcgctcataacttatccagatgtagccttgaaccacatgtcttgcttccaaggattgtttttctgtccagaggctgcgtcgctgttgcttcacaatttctgtgtctaccacatcacccctcaaggacacgagttaggagccgctccgatttcatctgatgtgcccgtgccatctgtcgatgaccttgcagaccaggttgccgatgtccttgatttttttagtttaggtgctgtaatgtgcttgggtgtcaccgctggtgcctatgttctcactctctttgcgacaaagtatcgggagagggttcttggcctcatgttggtttcacctctatgcaaagccccttcatggagcgagtggttgtataataaggtattattaaacttgctttattattatggaacacgtggcttagtcaaggaaagcttgcttcagcgttatttcagcatggaagttcgtggcaacaggcaagatcctgaatcagatattgtccaagcctgcagaagtttacttgaagaaaggcagggagctaatgtctggcggttccttcaagcaattaacaggcggcatgacttaacagaatcactgatgaagcttcagtgccggacgctaatttttgtgggagaaaactcacaattccatgccgacgcagtccacatgaccacaaaactagaccagagatactgcgctctagtcgaggttcaggcttgtggttcactagtgaccgaagagcagccccatgcgatgctcattccgatggaatacttccttatgggatacgggctttacagacctccacagcaggacactagcccccggagtacactgaacccgttctgcatatcgcccgaacttctgtctcccgagagcatgggggtaaagctgaagcccatcaagacgcggatctcactaaatgtttagcatgggcagatcttggatggccatggcctgacaagtaacaaccacagctcatgaaagtgaagactgcttgggctgagttttgcaaccacaagttttgcgcctggtatgcgaagaaaattctacaggctgaaggcagattttgttgatgcggggaggttgtagtattgtaggggagggcagaatggcagatggctgtttgttaatatgtttgtagtcagtacacatgtatatgtcacgatatcgtgtcatacaaaaatataaatggtaaaggtgaattccacttcgattctcgc

SEQ ID NO: 21067 - protein, 347 aa, Panicum virgatum
  misc_feature: Ceres CLONE 1814415
  misc_feature (21)..(305): Pfam Name: Ndr Pfam Description: Ndr family
MGDSSGSVSIDVERIFFGGKEHRVRTRHGPLSVSVYGDEDKPALITYPDVALNHMSCFQGLFFCPEAASLLLHNFCVYHITPQGHELGAAPISSDVPVPSVDDLADQVADVLDFFSLGAVMCLGVTAGAYVLTLFATKYRERVLGLMLVSPLCKAPSWSEWLYNKVLLNLLYYYGTRGLVKESLLQRYFSMEVRGNRQDPESDIVQACRSLLEERQGANVWRFLQAINRRHDLTESLMKLQCRTLIFVGENSQFHADAVHMTTKLDQRYCALVEVQACGSLVTEEQPHAMLIPMEYFLMGYGLYRPPQQDTSPRSTLNPFCISPELLSPESMGVKLKPIKTRISLNV

SEQ ID NO: 21068 - DNA, 1528 bp, Panicum virgatum
  misc_feature: Ceres CLONE 1814419
  misc_feature: Encodes the peptide sequence at SEQ ID NO. 21069
acttgcccgccgatccgtgctccccgcatcggcacgccagcgccaagaccgtgcgccggctgacgcgactgcacacacgcacacgcacgcaccaatggccacctccggccacgccgtggtcgacatcgacgaggccggcggcgacagcggcggcggccaggccatgcggccgccgctcccgccggtcccgtacgcgctcaacttcgccgacctgtcgtacagcgtcaagaatggcggcgggctgggctgcctcccgtctcggcccagcaaccacctcgcgtccgcggacgcgccgccggccggctcgtccgggaacaccaagacgctgctcgacggcatctccggggaggcgcgggagggggagctgttcgccgtcatgggcgccagcggctccggcaagtccacgctcgtggacgcgctggcggggcggatcgcgcgggagagcctccgggggaccgtcacgctcaacggggagccgctccacggccgtcgcctccgcgccatcgccgcctacgtcatgcaggacgacctgctgtacccgatgctgacggtccgcgagacgctgctcttcgccgccgagttccgcctcccgcgcgcgctgccccaggacaggaagcgcgcgcgcgtggacgcgctcatcgaccagctcggcctgtcccgggcagcggacaccatcatcggcgacgagggccaccgcggggtgtccggtggcgagcgtcgccgcgtgtccatcgggacggatatcatccacgacccgatcctgctgttcctcgacgagcccacctccgggctggactcggccagcgccttcatggtggtgcaggtgctccgccgtatcgcgcagagcggcagcgtggtcatcatgaccatccaccagcccagcgcgcgcatcctgggcatcctcgaccacctgctcctgctctcgcgcggacgcaccgtgtacgccggcacgcccgccggcctcaagcccttcttcgccgagttcggcgtgcccatccccgacaacgagaaccccgccgagttcgcgctcgacaccatccgagagttcgagcgccagcccgacggcgccgtcgcgcttgccgacttcaacatcaagtggcagaacacttcagcagtggataaggacagcaagctcctgagcacgacgatgcccctggagctcgccatcgccgagagcgtgtcccggggcaagctggtcgccgggagcggatctgggagcgcggtgagcgggtcggtgccgacgttcgcgaacccgccgtggacggaggtgtgggtgctaatcaagcggtccttcaccaacacggggcgcatgccggagctcttcgccatgaggctgggaacgatcatggtgacggggttcatccttgccaccatcttctggcgcctggacgacacgcccaagggcgtgcaggagcggctgggcttcttcgccatggccatgtcgaccatgttctacgtgtgcgccgacgcgctgccggtgttcgtgcaggagcgccacatctacctccgcgagacggcgcacaacgcc

SEQ ID NO: 21069 - protein, 477 aa, Panicum virgatum
  misc_feature: Ceres CLONE 1814419
  misc_feature (89)..(279): Pfam Name: ABC_tran Pfam Description: ABC transporter
  misc_feature: SWISSPROT Homolog: EC 3.6.3.28 Phosphonate-transporting ATPase
MATSGHAVVDIDEAGGDSGGGQAMRPPLPPVPYALNFADLSYSVKNGGGLGCLPSRPSNHLASADAPPAGSSGNTKTLLDGISGEAREGELFAVMGASGSGKSTLVDALAGRIARESLRGTVTLNGEPLHGRRLRAIAAYVMQDDLLYPMLTVRETLLFAAEFRLPRALPQDRKRARVDALIDQLGLSRAADTIIGDEGHRGVSGGERRRVSIGTDIIHDPILLFLDEPTSGLDSASAFMVVQVLRRIAQSGSVVIMTIHQPSARILGILDHLLLLSRGRTVYAGTPAGLKPFFAEFGVPIPDNENPAEFALDTIREFERQPDGAVALADFNIKWQNTSAVDKDSKLLSTTMPLELAIAESVSRGKLVAGSGSGSAVSGSVPTFANPPWTEVWVLIKRSFTNTGRMPELFAMRLGTIMVTGFILATIFWRLDDTPKGVQERLGFFAMAMSTMFYVCADALPVFVQERHIYLRETAHN

SEQ ID NO: 21070 - DNA, 684 bp, Panicum virgatum
  misc_feature: Ceres CLONE 1814419-R
tctttctcctcctcgccgccctcgccgcctccgccgccgtccctgcccgcgcgacgctgggcggggtcggccgcggcaccggcccgcgggtgggcgggtggagcgcgatcccggacgtgagcgacccgcacatccaggagctgggcgggtgggcgctggggcaggcgaagcaggcgcggctggccggcgaagggctgcagttccgccgcgtggtgcgcggggagcagcaggtggtgtccgggatgaactaccgcctctacatcgacgctgcggacgccgcggggcggagcgcaccctacgtcgccgtcgtgtacgagcagagctggaccagcacccgccagctcacctccttcaacaaggcgccccgcgcccactgaatcatctgtccatgccttgatccaccccggcggcccggttcggcggtcggcgacgacggcgtctcctctcctccatgtttaattagtaattacttctagtgaacattactgctcctagtatatgctgccagtgaatgagtactgcgttttactactagttgctgttgtggggttaatctgcgacccagccatgtggatgaagatgcgcgtaatcgatcgaggctatgtgctagaagtagaactactgctggaatgtactcctataatgatgtaatcaagggtttgtgcctgtgttggctcttgtgtc

SEQ ID NO: 21071 - DNA, 1814 bp, Panicum virgatum
  misc_feature: Ceres CLONE 1814437
  misc_feature: Encodes the peptide sequence at SEQ ID NO. 21072
ctacccttcgagtcttctccctgataccctcgcgcccgaccttcctcctccatctgaccatctccatcccaccgatcgcatccgcaccgaaaccctagctccggccatggcgcggcgatcgacccctctcctacgccgcctcctcgccccatccccttcccccaccccgtccactcccctcgccggtgtcgcgtcccgccgcaccgtcacctacatgccccgcccgggggacggcgccccgcgcggcgtcacgctcatccccggtgacggcattgggcccctcgtcacgggcgccgtgcggcaggtgatggaggcgatgcacgcgcccgtctacttcgagacctacgaggtccacggcgacatgcccacggtgcccaccgaggtcatcgagtccatccgccgcaacaaggtctgcctcaagggcggcctcgccacccccgtcggcggaggtgtctcctccctcaacgtgcagctccgcaaggagctcgacctctacgccgcgctcatcaactgcttcaacctccctgggctgcccaccaggcacgacaacgtggacatcgtcgtcatcagggagaacaccgagggcgagtactcggggctcgagcatgaggtcgtgcccggcgtcgtcgagtctctcaaggtgataacaaagttttgctcagaaagaattgccaagtatgcttttgagtatgcataccttaacaatcgaaagaaagtgacagcagtacataaagcaaacatcatgaagcttgctgatggtttgttcttggagtcttgccgtgaggttgcgaagaagtaccccggaattcagtataatgaaatcatcgtggacaactgttgtatgcagcttgttgcgaagcctgaacaattcgatgttatggtatgtaatacgccgtcttatcactcaaatttctcttttttctcaccgagctgatgtttaacatgtattttcatgttaagtgtaagcataaatgcattattattgatcttgcatctgcttcctgctgtatacctacaatctcattaatcttgtgtggactattgggataccaaagtgaactggtgttctgcaatttgatattgctacatgttagctcctattgttgtcaagctcatttttcctttactttttattgatttagtggaccgcttttctgatcaacccagagttttgaaatgaattttcttagattatttatgaatttgaaactcactattttggatcctttcataggtcaccccaaatctttatggcaatctggtggctaatgtagctgcaggtattgctggaggcactggtgtcatgcctggaggtaatgtgggtcaggaccatgctgtattcgagcaaggtgcttctgcaggaaatgtcggaaatgaaaagattgtggagaagaagagagctaaccctgttgcactgttgctctcatccgctatgatgttgaggcatttgcagttcccatcatttgccgaccggctggagacggccgtgaagcttgtcattgcagaaggcaagtacagaaccaaagatttgggtggtaccagctcaacccaggaagtcacagatgcggttattgccaaactgaattaatgaccagccgtgtgtttttgaaactttgttttcctctattggactaggtgactagtcctgactacatattcgttccttgtagctttagatcaccattttgttcggcaacacccttgtacaatcttcaggtgtctctgtttctcccattctggtttgggtctggagtaactgagcaaactcagtgttaatttttacgcatatttttgcgatcttaattcttaactgg

SEQ ID NO: 21072 - protein, 275 aa, Panicum virgatum
  misc_feature: Ceres CLONE 1814437
  misc_feature (47)..(275): Pfam Name: Iso_dh Pfam Description: Isocitrate/isopropylmalate dehydrogenase
  misc_feature: SWISSPROT Homolog: EC 1.1.1.41 Isocitrate dehydrogenase (NAD(+))
MARRSTPLLRRLLAPSPSPTPSTPLAGVASRRTVTYMPRPGDGAPRGVTLIPGDGIGPLVTGAVRQVMEAMHAPVYFETYEVHGDMPTVPTEVIESIRRNKVCLKGGLATPVGGGVSSLNVQLRKELDLYAALINCFNLPGLPTRHDNVDIVVIRENTEGEYSGLEHEVVPGVVESLKVITKFCSERIAKYAFEYAYLNNRKKVTAVHKANIMKLADGLFLESCREVAKKYPGIQYNEIIVDNCCMQLVAKPEQFDVMVCNTPSYHSNFSFFSPS

SEQ ID NO: 21073 - DNA, 2070 bp, Panicum virgatum
  misc_feature: Ceres CLONE 1814459
  misc_feature: Encodes the peptide sequence at SEQ ID NO. 21074
gctttggttaggctaccgccgcgccgcgccgggctgggtttggggggttgttgaaaccgtcaaggaacggggacgtgggggccaaggaaggtggcgctcggtgctggtttcttcgtcgatcgattccttgcggcgcccgattcgccctgttcttgctcgccccgcccgttccgcggttgattggctggcctggttccgttctgcccacccgcgccgcggattcggggggaatctgattcgccgccgggcggggagggattggattcttggtcttggtgcgggtgcgcgcggcgcgatttgataagaacgaaaagaaaatccaagcagggagggaattgccagggggagcatcggttcttggtggtggttgcgggaatcgcggccgggggacgccgatcttggcgaggaggaggggaggtcctgccacggcggcccggcagggaccggcggcggcggcgatggccgacgggctggatcggtggcgcgacttcttccgcggcgccggggccggcatctgcgacgtgatcgagaacgccatcctcgtggcggcggctgacgcgccgcgggagctgctgcaccgccgcgaccgcatcgccgagcggctcttcaccgcgcaccgccgcgacgcggcgccgccgtccctcggcagcgccgcggcgtccgccacgccggccacgcccgtcgaggaggacaagggcagcgtgcgccgcgttgccgagaaggagagcaaggtcgacagcagcagcaacggcgcccacggcgggggccgcggccacggcgacgaggacgatgactccgactccgacgacgagcgcctccgccgcgccgccgcgagcaactacggccacagctacgatgacgacgaccaagaggaggaggatgagcagcagcacgccgcggataatgcggaggaagaggaagaggaccacgaggctgaggagcttgtggcgctcaccaatgagatcgacgaggagtcacagatcgttggtgaggtcctccgcatcaaggacctccttttgcacaaagaagatcattcggatgccactttgtttgagtcgctgaggaggctgcagttgatgcaattgtctgtgtccacgctaaaggctactgagattgggagggctgttaatcggctgcggaagcacagctcacaacagattcgccaccttgtgcgcactctcattgaaggttggaaagttctggtcgatgagtgggttagtacgagaaatgctgccctggcagaaaactcccctggttcttcaaatccttctgttgttgatgaagaagatgaagaaggccttccgtccccacctttagatgaaggggccttctttgcaacccagccaacttctattcaactctctgagttctttgatgaaatggacgaagatggaaacttgagacataacagtgatgcgagccttggaaacaagaggggaaataatggtgggaggcctgcaaactattcagcagttgcaacacaagaacctcctcgacattctcctggaactgtagaaaaagttcaatttaggaggccagaatcggcaaggcaagagccatcaatgaggcaagcaaaccgacagaaacctcaaagttcaagtttgcaagtgaagcctcatggcgtgctcaacagcaacaagcaatctatgccctcaagttatgaatctgggcctgggagaccattaaaggcagctcctccacagaaaccctttggtgacatgaaaccccgacaaactcacaattctgttgagagaagacctacaacgatccagatggataaatcgaggcttgctgcgcaatcttcatctggagccaggctagagttggcaaagccaaaggtcaatgatgatggtttggataataataggaagctggaagcagcaaagagaaggctccaggagcgttaccaggaggctgagaatggttcgtgtctttattttgaaactcagtactatcctcttttgtcacttatagatctctactcgtgagattttacctaattgttccatgcttcatctgtgcagccaaaaggcagcgcacgatacaagtaatggagctgggtgacattcc

SEQ ID NO: 21074 - protein, 509 aa, Panicum virgatum
  misc_feature: Ceres CLONE 1814459
  misc_feature (172)..(259): Pfam Name: TFIIS Pfam Description: Transcription elongation factor S-II protein N terminal
MADGLDRWRDFFRGAGAGICDVIENAILVAAADAPRELLHRRDRIAERLFTAHRRDAAPPSLGSAAASATPATPVEEDKGSVRRVAEKESKVDSSSNGAHGGGRGHGDEDDDSDSDDERLRRAAASNYGHSYDDDDQEEEDEQQHAADNAEEEEEDHEAEELVALTNEIDEESQIVGEVLRIKDLLLHKEDHSDATLFESLRRLQLMQLSVSTLKATEIGRAVNRLRKHSSQQIRHLVRTLIEGWKVLVDEWVSTRNAALAENSPGSSNPSVVDEEDEEGLPSPPLDEGAFFATQPTSIQLSEFFDEMDEDGNLRHNSDASLGNKRGNNGGRPANYSAVATQEPPRHSPGTVEKVQFRRPESARQEPSMRQANRQKPQSSSLQVKPHGVLNSNKQSMPSSYESGPGRPLKAAPPQKPFGDMKPRQTHNSVERRPTTIQMDKSRLAAQSSSGARLELAKPKVNDDGLDNNRKLEAAKRRLQERYQEAENGSCLYFETQYYPLLSLIDLYS

SEQ ID NO: 21075 - DNA, 670 bp, Panicum virgatum
  misc_feature: Ceres CLONE 1814474
  misc_feature: Encodes the peptide sequence at SEQ ID NO. 21076
cttcgcctcacacaaacgcatcgagctcagactcagagaactaagaagccgaacctctccctcacgtttcctgcacgaatccggcttccatccatcgatcggaacaccacacactgccagccggacgcagccgatcaagggcaatgggcgagctgatccccgggttgccggaggaagtggcgcgggagtgcctcgtccgggtgggcttcgaccagctgcccgtggtgcgccgcatctcgcgccagtggaagtcggagctggagtcgccggactaccaccgcctgcgccgggccgaggggctggcgcgcccggtgctcgcgctggtccaggcgagccccgcgccgccggccgacggcgacgcgggcacggctgcggacaagcagcgctcctcggcggcgggccccgcgaactcgtaccggatggtgctgctggacccggaggagggccggtgggcgccgctgccggcgccgcccgggccggcggggagcctgcccctgttctgccaggtggccgccgtgggcggcggcgggcaggggcggaagcggctggtggtcgtcggcggctgggacccggagacgtgggcgccggtggacgcggtgctcgtgtacgacttcctgaccggcgcgtggcgccgcggcgcgccgatgccgggcccccgccggtccttctt

SEQ ID NO: 21076 - protein, 175 aa, Panicum virgatum
  misc_feature: Ceres CLONE 1814474
  misc_feature (118)..(169): Pfam Name: Kelch_1 Pfam Description: Kelch motif
  misc_feature (3)..(50): Pfam Name: F-box Pfam Description: F-box domain
MGELIPGLPEEVARECLVRVGFDQLPVVRRISRQWKSELESPDYHRLRRAEGLARPVLALVQASPAPPADGDAGTAADKQRSSAAGPANSYRMVLLDPEEGRWAPLPAPPGPAGSLPLFCQVAAVGGGGQGRKRLVVVGGWDPETWAPVDAVLVYDFLTGAWRRGAPMPGPRRSF

SEQ ID NO: 21077 - DNA, 675 bp, Panicum virgatum
  misc_feature: Ceres CLONE 1814494
  misc_feature: Encodes the peptide sequence at SEQ ID NO. 21078
cgagcacgagcaaggcagggaaggccgtcccaatcccctcaaaaccctagcgagcgagcagcaagggaagcggaggaggaaggcgatggatgcctccaaggcccgcgagctccgggagttcgtggaggcgtgcaagaaggacccttctctcctcgccgaccccaacctcgccttcttcagggactacctcgaaagtttgggagccaaaatccccgccgcctccgccgccaaggccgcctccttcgacaagcccaagagatcttccatggacgacattgatgatgatgatgacgacgatgacgatgaagatctggatatgagggatgccactcctgagccagacgagctcgatgaagagattgttgagtctgatcttgagcttgaaggagacactgtacaatctgaccatgatgacccaccacagaagatgggagatccttcagttgaggtaactgaggaaaatcgtgatgcctctcaagaagcaaaagggaaggctatggaggctatgtcagaaggaaaactcgatgaggctattgaacatcttaccaacgcaatagtgctgaatccgctctcagcaatcatgtatggtactagagcatctgtgtttataaaaatgaagaaaccagctgctgccattcgtgatgcaaatgctgctctagagattaacccagactc

SEQ ID NO: 21078 - protein, 196 aa, Panicum virgatum
  misc_feature: Ceres CLONE 1814494
  misc_feature: SWISSPROT Homolog: EC 3.1.3.16 Phosphoprotein phosphatase
  misc_feature: Useful for making plants with altered terpenoid content
MDASKARELREFVEACKKDPSLLADPNLAFFRDYLESLGAKIPAASAAKAASFDKPKRSSMDDIDDDDDDDDDEDLDMRDATPEPDELDEEIVESDLELEGDTVQSDHDDPPQKMGDPSVEVTEENRDASQEAKGKAMEAMSEGKLDEAIEHLTNAIVLNPLSAIMYGTRASVFIKMKKPAAAIRDANAALEINPD

SEQ ID NO: 21079 - DNA, 1669 bp, Panicum virgatum
  misc_feature: Ceres CLONE 1814501
  misc_feature: Encodes the peptide sequence at SEQ ID NO. 21080
gctcgctccctcttctcgtccgcacaacaccgagcaagcgagaggagacggagagccgggtggcgatggcgggcaccggctgccactcgctcctctcgccgctctcccccaacatcttctcgcaccgtcgagcctccgccgtcggcagcggagcctgccggcccagtaaaggtgagtcttcttgggagagtgctctcgggggcgctcattcttgcctccttggacagctaattttcagcatgtagcattgtttccgtgctatgcttggctgcataaacaccgggctatgcgtagcactctgcatgttttaagggaaatggttttctaggagaaataaagttgtgctgattttggcggtgattgatgatgctaactttcagttattggcatgtttgtgcttcagtgcgacctcagatcaggtgttgctcgaaagttgatgatgcaaaggtatgtgcagacacgtgcaagagaggcaaggttgtgagtgttgccttatcctcatgtccaattcgtgatgttaacttagcatgtatctgattgcagtaacccgtatagtagttgtaatgttcaagctaagccatcccttagaccctttagtaggttctctcttccaacacaattagagttgaaacacatgaataaggatagagagcctgatctgatttgtgtgtcgtagtgagtggaaggttcttactacaatcatatctttagaatataggcattttatattctcataattgaatttctggttcatctatgaatgattaaattgaaaataccaaaggccccaggtatagctgtccaatagctctagacgcggtgcccgttatattagttccagacttgtaacatttgacagccaaaatcttgccattgaggaatgtacaactttggcctgcattttgagtgagctgattctactcaagcagttatgcaagcccactactgaattcacctttttgtggtatttgacgttcctttccagcaacattttaccgaattcccttttctgagtttcttcaagtgttctaatgcaccatctgttatacaggatgaagaaactagaccttcaagacgaaaatgtcttgtctgcctaggtgctgtaaccataatcagtacaacaggcccaacgatttgtacaccaaacggaatcgccgcagatatgacgaacaagtctgggatacagaaagctgtttgcagaaattgcaacggcagtggtgctgtgatatgtgatatgtgcggtggcacaggaaaatggaaggccctcaacagaaagagggcaaaagatgtttatgaattcacagagtgccccaattgctacggccgagggaaactggtctgccctgtctgtcttggaactgggctgcctaataataagggactcctccggcgaccagaagccaagcagttgctcgataagatgtacaacggcaagatattgccaaggtcgtagttcgtagaccgcacaagcagtcagccacatgattttgcatcagttatcgagtaggaataacattcgcgacaaatgattttgcatgattttgtactaagttcaaagattatatcttggatttagctttcaaattaccacagatacgaagtgacaagtgattcaatagtcttctgtcagacattgccaactaaattattaaacgaatatagtgatttt

SEQ ID NO: 21080 - protein, 96 aa, Panicum virgatum; identical to SEQ ID NO: 13503
  misc_feature: Ceres CLONE 1814501
  misc_feature (1)..(74): Pfam Name: DnaJ_CXXCXGXG Pfam Description: DnaJ central domain (4 repeats)

SEQ ID NO: 21081 - DNA, 709 bp, Panicum virgatum
  misc_feature: Ceres CLONE 1814505
  misc_feature: Encodes the peptide sequence at SEQ ID NO. 21082
gccctctcaaccggcccctagacggtttggggccgtctacacccggcgcggcgcgccggccgatgcaccgtctccaccaggccgcttcggcatcgtctacaccaggcgcggtgaccacggctcgggcgcacccgcgcctggccctgctgcgacaccggcggcggcggctggcccagcttccaccatggcggacgtcgatgtcgagcccgaggtcgccgccggcgcgcctaagaagaggacgttccgcaagtacagttaccgcggcgtcgacctcgacgcgctgctcgacatgtccaccgacgacctcgtccagctcttccccgcgcgcgcaaggagaaggttccagaggggtctgaagaggaagcccatggcgctcatcaagaagctgcgcaaggcgaaaaaggatgctcctgccggtgagaagccggagccagtgaggacccatctccgcaacatgatcattgtccctgagatgattggaagcatcatcggtgtctacaatggcaagacattcaaccaggttgagatcaagcctgagatgattggccactacctcgctgagttctccatctcctacaagccggtcaagcacggtaggcctggtattggtgccactcactcctcgcggttcattccgctgaaatgagttattgcccagttgtcagccccagaatccagcacggaaggcttatggcatgtcatgtttccc

SEQ ID NO: 21082 - protein, 153 aa, Panicum virgatum; identical to SEQ ID NO: 12318
  misc_feature: Ceres CLONE 1814505
  misc_feature (55)..(136): Pfam Name: Ribosomal_S19 Pfam Description: Ribosomal protein S19

SEQ ID NO: 21083 - DNA, 709 bp, Panicum virgatum
  misc_feature: Ceres CLONE 1814509
  misc_feature: Encodes the peptide sequence at SEQ ID NO. 21084
gaagctcgcccaactccctcccaccctcgcaaccatcaccgccgccgcctctatatctcctcccttccccctcgcatgccccgctcgtcgccgccacttccccctattcctcctcctcctcccgcccccaagtgaaccgcggctgcctccaccgccgccgcatctcttcctcccgcagcagccgccgccgcgagatctccggctgcccgcgccatggtcgcagcctccggcctcgcgctgccgcgggcggccgcaccctgcccggcgcgcacgcgcgctggcctccgccccgccttcctccgattcgtgccgccggtggcgctgccaccgcagcagctccggtgctgcgcgtccacagtcgacgatggcgtggtgtccgcagaggcctccaagccccgcctccccagagtggttggtatgggctcaaagcttgttggatgcggatcggcgatcccagcacttagcatttcaaatgataacctttcaaaaatagttgaaacgtcagatgaatggattgcggctcgaactgggattcagaataggcgagttctttcaggagatgaaacattgcgggggctctcaatacaagcagcacaaagggcacttgagatggctcaagtaaaagctgaagatgttgaccttgttctcctatgtacatctactccagatgatctgtttggaggtgctgctcaggtgctgacggaagtgg

SEQ ID NO: 21084 - protein, 165 aa, Panicum virgatum
  misc_feature: Ceres CLONE 1814509
  misc_feature: SWISSPROT Homolog: EC 2.3.1.41 Beta-ketoacyl-acyl-carrier-protein synthase I
MVAASGLALPRAAAPCPARTRAGLRPAFLRFVPPVALPPQQLRCCASTVDDGVVSAEASKPRLPRVVGMGSKLVGCGSAIPALSISNDNLSKIVETSDEWIAARTGIQNRRVLSGDETLRGLSIQAAQRALEMAQVKAEDVDLVLLCTSTPDDLFGGAAQVLTEV

SEQ ID NO: 21085 - DNA, 431 bp, Panicum virgatum
  misc_feature: Ceres CLONE 1814511
  misc_feature: Encodes the peptide sequence at SEQ ID NO. 21086
attgtaatctaccgtacaaagctcaaagtgtacatccatacatgtgaatacttgcgtcccatcccattatcccatatagagcgtacaggggacatcactgacgagcaagatcgctgcacgctgcgttggagcgagatgattgccacgggcagctcggcgaataagggggcggcggcggccggggcggtgggcggcaaggtggcgcgggcctgcgacgggtgcctgcgccggagggcgaggtggtactgcgcaccggacgacgcgttcgtgtgcaaggggtgcgacacttccgtgcactccaccaacccgctcgcgcggcgcgacgagcggctgggcctgcgcccgacttcgcagatgcgggcggcgccgcccgcgggggaggagaaacgcgagcaccgggacaagctggtgcccaaatggatcaagcacaa

SEQ ID NO: 21086 - protein, 98 aa, Panicum virgatum
  misc_feature: Ceres CLONE 1814511
  misc_feature (21)..(68): Pfam Name: zf-B_box Pfam Description: B-box zinc finger
MIATGSSANKGAAAAGAVGGKVARACDGCLRRRARWYCAPDDAFVCKGCDTSVHSTNPLARRDERLGLRPTSQMRAAPPAGEEKREHRDKLVPKWIKH

SEQ ID NO: 21087 - DNA, 678 bp, Panicum virgatum
  misc_feature: Ceres CLONE 1814515
  misc_feature: Encodes the peptide sequence at SEQ ID NO. 21088
agtgacaagtgcagcagcaactgatctgagtcagtccatcgcatcagcagctagcaggccactgacaagtgcagtgcagcaggtgcgatggcctcctcctcgtggctcgtcttggccctgctcgccgctctctgcctgggactgggaacgctgccgacgagctcccacgcggcccgcgccttcttcgtcttcggcgactccctcgtcgacaacggcaacaacaactacctggtgacggcggcgcgggctgactcgccgccctacggcatcgacaggccggaccaccgcgccacggggcgcttcagcaacggcaagaacgtgccggacatcatcagtgagcacctcggcgccgagccagtgctgccgtacctgagcccggagctggacggcgacaagctgctcgtcggcgccaacttcgcgtcggccggcgtcgggatcctgaacgacaccggaatccaattcgccaacatcatccacatctcgaagcagctgctctacttccagcagtaccagaagcgtctgagctcgctgatcggcgcggagcagacggcccggctggtgcgcggctcgctggtgctcatcaccctcggcggcaatgacttcgtcaacaactactacctggtgccctactcggcgcgctcccgcgagttctccctccccgactacatcaactacatc

SEQ ID NO: 21088 - protein, 196 aa, Panicum virgatum
  misc_feature: Ceres CLONE 1814515
  misc_feature: SWISSPROT Homolog: EC 3.2.1.51 Alpha-L-fucosidase
MASSSWLVLALLAALCLGLGTLPTSSHAARAFFVFGDSLVDNGNNNYLVTAARADSPPYGIDRPDHRATGRFSNGKNVPDIISEHLGAEPVLPYLSPELDGDKLLVGANFASAGVGILNDTGIQFANIIHISKQLLYFQQYQKRLSSLIGAEQTARLVRGSLVLITLGGNDFVNNYYLVPYSARSREFSLPDYINY

SEQ ID NO: 21089 - DNA, 539 bp, Panicum virgatum
  misc_feature: Ceres CLONE 1814525
  misc_feature: Encodes the peptide sequence at SEQ ID NO. 21090
cgtgctctctcagaggtgggttggcttctcctccccctcttaccaagtcctcggctctagggttttagtgggaagggagatggcggccgcggatgtggagtaccgctgcttcgtcggcggcctcgcctgggccaccgacaacgcgtccctccagcaggccttcgcctcctacggtgacgtcctcgactccaaggtcatcaccgaccgtgagacggggaggtcccgcgggttcggcttcgtcaccttctcctccgagcagtcgatgctggacgccatcgaagccatgaacggcaaggatctcgacggccgcaacatcaccgtcaaccaggctcagtcccgcggcggcggtggcggcggcggctacggcggcggtcgtcagggtggctacggctggcggcggcggtgcgacctcagatcaggggttgctcgaaagttgatgatgcctaggtctgtgcagacacgtgcaagagaggcaccgttgtgagtgttgccttatcctcgtgtccaattcatgatgttaacttagcatgtatctgatt

SEQ ID NO: 21090 - protein, 134 aa, Panicum virgatum
  misc_feature: Ceres CLONE 1814525
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with modulated flowering time
  misc_feature: Useful for making plants with altered lignin content
  misc_feature: Useful for making plants with modulated nitrogen use efficiency
  misc_feature: Useful for making plants with altered alkaloid content
  misc_feature: Useful for making plants with modulated biomass
MAAADVEYRCFVGGLAWATDNASLQQAFASYGDVLDSKVITDRETGRSRGFGFVTFSSEQSMLDAIEAMNGKDLDGRNITVNQAQSRGGGGGGGYGGGRQGGYGWRRRCDLRSGVARKLMMPRSVQTRAREAPL

SEQ ID NO: 21091 - DNA, 2061 bp, Panicum virgatum
  misc_feature: Ceres CLONE 1814544
  misc_feature: Encodes the peptide sequence at SEQ ID NO. 21092
aaaacccctgcgggcctgcggcggctgcctctcctttccccacctgcgccccccctctccgtctcgccggccggcgcacccctcttcgccttgccctctccaacgcccaatctcccccaggtcaagggcgggggcttatttggtttgtttcagcggagatagtcggctgctaacgagatgctggtgctgttcgagacccccgcggggttcgccctcttcaaggtgctcgacgaggggaagctcgacaaggtcgaggatctatggaaggagttcacgacatcggaatcggcgagaagggtggttgagctgaaggctttcaacaagtttgagaacacatctgatgctctctctgctgcgaccctaattattgatagcaagcctagcaaaagtctgcgcaagttcttgcagaagcattgtgagggtgaaacattagctgttgctgattctaagcttggcaatgctataaaggaaaagctgaaaattgactgccttcacaacagtgctgtgatggagctgatgagagggctgagaaatcagctcactgagcttataactgggttgggtgcacaagaccttggtccgatgagcttgggactgtcacacagcctgtctaggtataagctgaagttcagtcctgagaaggttgataccatgatcattcaggccattggcttattggatgatcttgacaaagagcttaacacgtatgccatgagggttcgtgaatggtatggttggcactttccagagctcactaagatagtcacagataatatacagtatgcaaaagttgtgaagatgatgggcaacagagctaatgcagtcaagcttgatttctctgagatactgtcagatgaagatgtagaaacacagctaaaggaggcagcagtaatatccatgggaacagaagttaatgaccttgacctgttaaatatcagagagctatgtgatcaagtattggctctttctgagtacagagcgcagctgtacgagtatttaaaaagcaggatgaacactattgctccaaatctgaccgcactggtgggtgaattagttggtgctcgccttattgcgcatggtggcagtttgctaaatttagccaagcagcctggcagcacaattcagatacttggtgcagagaaggctttatttagagctctaaagacgaagcattctacaccaaagtacggcctcatctaccatgcatccttaattggcaaggcatctcaaaagcacaagggaaagatatctcgttctctcgctgcgaaaactgctcttgccatccggtatgatgcccttggtgatggtgaggacaactccattggcacggagagtcgactcaagcttgagacacggcttcaagttcttgagaaaacagaatttgggaaatctgctggttccgctaagggaaagcccaagatagaagcgtatgaaaaggacaggaagaagggtgctggggctttaatcacccctgctaagacctacaacgctgctgcggatgttgtactggggcaatccactgaagagacaccaaagaagtcagaattggcttcaaagaagaggaaacatcatgatgcggaggctgcaccgccaacaaagcctacagcagaagcaatcgaggaggatggtgaccaggaaaggaagaaaaagaagaagaagtccaaggaaactgaggagactcctgcggctgacgctgatggtgagaagaaaaagaaatctaaggagagcgaggaggagcctgctgtggccgctgcagaaggagagaagaagaaaaaaaagaagaaatctgacgcagatggtgaggatgttgcaatgcaaaccgaggagccgggcaagaaagataagaagaaaaagaagaaaaagcacgccgatgatgagtgaggtatttattggtaagggagagccaagaagacgaaggctgggactccctgttttgtagaatgaatattacaggctagtaaccatgttgagattagttttttttggaacccagcttgtattcaagtacttgccagatcaagacgattgatgaaaattgaatttttgctgtcgcggccacgt

SEQ ID NO: 21092 - protein, 567 aa, Panicum virgatum
  misc_feature: Ceres CLONE 1814544
  misc_feature (252)..(400): Pfam Name: Nop Pfam Description: Putative snoRNA binding domain
  misc_feature (159)..(211): Pfam Name: NOSIC Pfam Description: NOSIC (NUC001) domain
  misc_feature (1)..(66): Pfam Name: NOP5NT Pfam Description: NOP5NT (NUC127) domain
MLVLFETPAGFALFKVLDEGKLDKVEDLWKEFTTSESARRVVELKAFNKFENTSDALSAATLIIDSKPSKSLRKFLQKHCEGETLAVADSKLGNAIKEKLKIDCLHNSAVMELMRGLRNQLTELITGLGAQDLGPMSLGLSHSLSRYKLKFSPEKVDTMIIQAIGLLDDLDKELNTYAMRVREWYGWHFPELTKIVTDNIQYAKVVKMMGNRANAVKLDFSEILSDEDVETQLKEAAVISMGTEVNDLDLLNIRELCDQVLALSEYRAQLYEYLKSRMNTIAPNLTALVGELVGARLIAHGGSLLNLAKQPGSTIQILGAEKALFRALKTKHSTPKYGLIYHASLIGKASQKHKGKISRSLAAKTALAIRYDALGDGEDNSIGTESRLKLETRLQVLEKTEFGKSAGSAKGKPKIEAYEKDRKKGAGALITPAKTYNAAADVVLGQSTEETPKKSELASKKRKHHDAEAAPPTKPTAEAIEEDGDQERKKKKKKSKETEETPAADADGEKKKKSKESEEEPAVAAAEGEKKKKKKKSDADGEDVAMQTEEPGKKDKKKKKKKHADDE

SEQ ID NO: 21093 - DNA, 2467 bp, Panicum virgatum
  misc_feature: Ceres CLONE 1814547
  misc_feature: Encodes the peptide sequence at SEQ ID NO. 21094
acatttcgtttaggggtcattagtgcctcctcaatttcagcagccggtttctcgcgttcaggcctgtaaagctctgtcctttccaatccccatcatctctgtcccgattgtttacacctgacaatcagagccctctctattccagcggattaatcttcccttttgcgctaaagcagtccagagtcagcattgctggctcataagcctctgccgggccagcatttagctccgcctgcagcagtggaaagcctcatcctgatcttggcgtcgaatcccatccgtttccattagttcaccaatctccctggtgctctcgagctctaggatagaggcctggtcccaattccggccctcaaaatccgatctttgctggtgattccttggccggcccgatggggaagttcggggacaggctgcgcgccttctccacgaaccggtggctggtgttcgtcgccgcaatgtggctgcagtccatggccggcatcggctacctcttcggcgccatctcgccggtggtcaaggcggccctcgggtacaaccagcgccaggtggccgcgctcggcgtcgccaaggacctcggcgactccgtcggcttcttcgccggctcgctctccgccgtgctgccgtcgtgggcgatgctgctcatcggcgcggcgcagaacttcctcgggtacggctggctctggctcatcgtcaccaggcaggcgccggcgctgcccctctagataatgtgtgttctcatctttgttggaaccaatggagagacatacttcaacacaactgcacttgttacatgcattcagaacttcccaaagagcagaggtccaatagtgggcattatgaaaggatttgcgggtcttagcagtgcgatcttaacacaactgtatgcagtaatgcacacaccagaccatgccacacttgtcttcatggttgcagtcggtccatcattggttgccattggcctgatgcttattattaggcctgttggaggtcaccgccaggtgcgtccatccgacaagaacagcttcttgttcatctacactatctgcttgctccttgcctcatatcttgttggcgtcatgctagtccaagatttcatggaactgagcgacaatatggttaattttcttactttgattctattcatacttcttattttaccaatcgcaatccctgtgaccttgacactatcatcaaaaacgcaacatccaactgaagaggctctcctttctgaaccatcaaaaggagagacaagcacttcacaagagaaagaggatcaaccagaggtcattttaagtgaggtggaagaggagaaacctaaggacattgattctttgcctccatctgaaagaagaaagaggattgcagagttgcagaccaagttagtgcaagctgcagcaaggggtggggttagaatccgcaggcgaccacaccgaggggaaaactttaccctgatgcaagcattagtgaaggctgatttttggcttatttggttctcgctcctgcttggatcaggatcagggctgacagtgatagataatctgggtcagatgagccagtctgtagggtttgaagatgcacatattttcgtgtcattgataagcatatggaatttccttggtcgtgttggaggaggctacttctctgagattattgtcagggagcacacttacccaaggcacgtagcactggcaatcgctcagatcctgatggctgctgggcatttcctcttcgcaatggcttggcctggaactatgtacattgggaccttcctggttggacttggctacggagctcattgggctattgtgccagctgctgtttctgaactttttggcgtaaaacacttcggtgcaatgtacaattttctcacagtagcaaaccctgcagggtcacttgttttctcggggcttattgctagtaacctgtatgactctgaagctgagaaacaagcacagcaacatcatatgacagcattgcaatctccaagattgcttcacaacatgggtttgcttgcagatggaccactgaagtgcgaaggttctgtttgcttctttgtcagctcactgattatgtcagcattctgtgttgtgggagctggtttgagcctcattattgttcagagaaccaaacgagtttatgctcacctctatcgttctgtccgtacatgaaacttcaatggaaaggagatgttgaaccctcctatcattgatccatgtaccatatctttttgcatatatgtggtcatatgtacacaacattaaagtttgcctatatattcccaaatcatttcagaggttgtaatccgtgaagtgatgtttcctagtgggaatttacatgtcctacgcatcagataacaaggatgtggttgatgcttggaccatgaattctgatacttgtagtcctgtaataaatactttttgctcagatgaaaatctgtatattgatctgcggatggtttttcagt

SEQ ID NO: 21094 - protein, 110 aa, Panicum virgatum
  misc_feature: Ceres CLONE 1814547
  misc_feature (15)..(110): Pfam Name: Nodulin-like Pfam Description: Nodulin-like
MGKFGDRLRAFSTNRWLVFVAAMWLQSMAGIGYLFGAISPVVKAALGYNQRQVAALGVAKDLGDSVGFFAGSLSAVLPSWAMLLIGAAQNFLGYGWLWLIVTRQAPALPL

SEQ ID NO: 21095 - DNA, 1525 bp, Panicum virgatum
  misc_feature: Ceres CLONE 1814549
  misc_feature: Encodes the peptide sequence at SEQ ID NO. 21096
gtccgaaatcatctctccaggctgcaggttcacgccatggaggcggccctccttccacggcaagatccgccgctggctgcggtggaccacctcggccgtccggccgtccgcggcagctccggccggtggccggccgcgctcttcatcatcggaatggaagtggcggaacggttcgcgttctgtggcatcatgggcaacctgatcatgtacctgaccggcccgctcgggcagtccacctcgtccgccgcggcggccgtcaacgcctggatgggcgcctcgttcctgctggcgctgcttggttcggcagttgccgactcgtggctcggccgctatcgcaccgtcgtcgccgcatccgtcctctacatcttggggctggccatgctcaccctctcatcagttcttgtgccacaagtgcgagtggagtgtgaaggcagggtggaggcagctgaatgctcagatttgtctggccaagtggcatttttctacttctccctctatctgttggcgtttgcccagggtggacacaaaccttgcgcccaggcattcggtgcggatcaatttgacgagaatgagcctcaagaactggcatcgagaagctctttcttcaattggtggttctgggctgcatatggcggcaatacttttaccgtctccatacttaactacattcaagaaagcgtaagctggcagcttgggtttgggatcccgtgtgttgccatgatccttgcccttgctgttttctgtattgcgaggaagacttaccgcttctatcctcctaagactagtggaaacccttttggccaagttggcaaaccgtttgcagcatggattcgtggttggcttgcagcatggcactcaagattacctgctgattctagctgcgatctgccaacaccgtcgtcaccgaaggtggatgctagtgatagcgacacgggcagctcgaatgatcctcatgaagccacagcattgctcaggttgtttcccatatgggctacctgcctgattaacacggttgttggcgcacagtgcttcactttcttctctaaacaggcaagcacactggacaggaacatagggggcttagtggcaccagctgcttccctgctaaacttgagcaacgcttcgatcatgatctttcttccaatctatgacaaaatcttcgttccgatagctaggaaatttacaaagaacccttcaggtatcacagtgctgcagagggtcggcaccggcttggttattatgatcctcatggtgattgttgctgccttggtggagatgagaaggctcaagctagcaagagactacggcctcttggataagcctggagctgttgttcctatgagcgtcctatggatggtccctcagtacattctgtttgggttggctgatgcggttgcactcgtcggccagcaggaattcttctacgaccaagttcctgatggtttccgcagcatgggcttggctttgtacataagcatagctggaatagggaacatcagcagcagctttcttgtttatgccatcg

SEQ ID NO: 21096 - protein, 496 aa, Panicum virgatum
  misc_feature: Ceres CLONE 1814549
  misc_feature (99)..(482): Pfam Name: PTR2 Pfam Description: POT family
MEAALLPRQDPPLAAVDHLGRPAVRGSSGRWPAALFIIGMEVAERFAFCGIMGNLIMYLTGPLGQSTSSAAAAVNAWMGASFLLALLGSAVADSWLGRYRTVVAASVLYILGLAMLTLSSVLVPQVRVECEGRVEAAECSDLSGQVAFFYFSLYLLAFAQGGHKPCAQAFGADQFDENEPQELASRSSFFNWWFWAAYGGNTFTVSILNYIQESVSWQLGFGIPCVAMILALAVFCIARKTYRFYPPKTSGNPFGQVGKPFAAWIRGWLAAWHSRLPADSSCDLPTPSSPKVDASDSDTGSSNDPHEATALLRLFPIWATCLINTVVGAQCFTFFSKQASTLDRNIGGLVAPAASLLNLSNASIMIFLPIYDKIFVPIARKFTKNPSGITVLQRVGTGLVIMILMVIVAALVEMRRLKLARDYGLLDKPGAVVPMSVLWMVPQYILFGLADAVALVGQQEFFYDQVPDGFRSMGLALYISIAGIGNISSSFLVYAI

SEQ ID NO: 21097 - DNA, 613 bp, Panicum virgatum
  misc_feature: Ceres CLONE 1814549-R
aaaacgcagcaccagccatccacgtccgcaccgcaccagcagctagcagcagcaccgcagcagcggccgacgacaacccgcttactgatggcgtcgctcaccatgatggcgccctccttcgcggcagtggcggcggccgcaccctcccgccgcggcagtctcgccgtggccagggccgccaaggtcgagcgcggccaccagcatcaggagcccgcgaggctggcggcggccgccgccggggaggcgcccgccgaggggcgccgcgccgtgatgctcgcggcggcggcggcggccgtcgcggccgtcggcggcgccggcgccgccacggcgggccccaagaacgggagccccgaggcgaagaagaagtacgcgcccatctgcgtcaccatgcccaccgccaaggtctgccacaactgaggcctaggccgagcacgctacgcgagctgctggtatggtatataacgcgcgcgcgccgcacggttcgcctctccctgttgatgcatgattcttcgagcttagatgagacggcttgcatggcccggtcgccatggacggtctcaaagttgtaataatattgttgcaaatttgaagataaaaccgttcctgcttcgtc

SEQ ID NO: 21098 - DNA, 1808 bp, Panicum virgatum
  misc_feature: Ceres CLONE 1814558
  misc_feature: Encodes the peptide sequence at SEQ ID NO. 21099
aataaaaatccgggggggagattccaccttccgccgtggcggggatggggcaggagggcatggggtacagcagcaaggggggaggcgggggcggcggggcgctcccgatgtcggcgccgcggccgcggggcgcgtcgccgctcggccacctccacagccgctcgcgcaagatccaccgcaccttcaacaacctcaagatcaccgtgctttgcggcctcgtcaccatcctcgtcctccggggcaccatcggcctcaacctctccctcccctcgcagccctccgacgccgacgcgctcgccggcgccaaggccgtcgaggacatcgaccgcatcctccgcgagatccgctccgactccggcccggaccccgacgacgacgccggcgacttcagcgccgcctccgggttcaacgcctccgcgctcagcgccgccgaggccgccgcggcgtacgcggccgccgcgggcaggtacgtgctcgggcccaagatctccgactgggacgcgcagcggcgtcgatggctcgccgagaatccggggttcccggccactgctgccggggggaagcccaggataatgctcgtcactggctcgcagccggggccctgcgacaacccgctcggcgaccactacctgctcaagtccaccaagaacaagatcgactactgccgcctccacggcatcgagatcgtccacaacctcgcgcascttgacaccgagctcgcgggatactgggccaagctgccgctgctccgccgcctcatgctctcccacccggaggtcgagtggatctggtggatggacagcgackcgctgttcaccgacatggcgttcgagctgcccctgtcgcggtacgagggtcacaacctcatcatccacgggtaccaagacctgctcttcgagaagcactcctggatcgcgctcaacacaggcagcttcctcttccggaattgccagtggtcgcttgacctcctggacgcgtgggcacccatggggcccaaggggttcatccgtgaccaggccggcaaggtactcacggcgaacctcaagggccggccagcatttgaggctgacgaccagtcggcgctgatttacctcttgctctcgcaaaaggataagtggatgggcaaggtgttcatagagaattcctactacttgcatggattctgggctgggctggtggacaagtatgaggagatgatggagaatcaccacccgggacttggtgatgagcggtggccttttgtgacacactttgttgggtgcaagccatgcgggagctatggagattacccggtggagcgctgcctcaagagcatggagcgagcgttcaattttgccgataaccaggtgcttcggctatatggtttctcacacaaggggctggaaagccccaagattaagaggatcagggatcaracmaccaagccaattaatgatgtggagaacttaratatgaaggccaaaatatcsatggcttcttgatgattcagatgagttggtggtatgatattttcatactkgctttggctatcaacaaggtcaragcatcttgtgatatgggggatattgytgtatctaktttccactctctttctctcccttttccttttgktcaccaatcgttattgttaagtgacagctacaggttgcgatctctgtttttatggaattaaacatgataggagatcaaatctgaaggatagcataacttttgtacttattgcttttcatttttggtgctaggctctagcgcgacaaatatcactaatatgtggagcttgcgcattgtagtagttataaaaaaaacag

SEQ ID NO: 21099 - protein, 478 aa, Panicum virgatum
  misc_feature: Ceres CLONE 1814558
  misc_feature (172)..(416): Pfam Name: Glyco_transf_34 Pfam Description: galactosyl transferase GMA12/MNN10 family
  misc_feature: SWISSPROT Homolog: EC 2.4.2.39 Xyloglucan 6-xylosyltransferase
  misc_feature: Useful for making plants with altered cell wall content and/or composition
  misc_feature: Useful for making plants with altered carbohydrate content
  misc_feature (220)..(220): Xaa is any aa, unknown, or other
  misc_feature (255)..(255): Xaa is any aa, unknown, or other
  misc_feature (469)..(469): Xaa is any aa, unknown, or other
MGQEGMGYSSKGGGGGGGALPMSAPRPRGASPLGHLHSRSRKIHRTFNNLKITVLCGLVTILVLRGTIGLNLSLPSQPSDADALAGAKAVEDIDRILREIRSDSGPDPDDDAGDFSAASGFNASALSAAEAAAAYAAAAGRYVLGPKISDWDAQRRRWLAENPGFPATAAGGKPRIMLVTGSQPGPCDNPLGDHYLLKSTKNKIDYCRLHGIEIVHNLAXLDTELAGYWAKLPLLRRLMLSHPEVEWIWWMDSDXLFTDMAFELPLSRYEGHNLIIHGYQDLLFEKHSWIALNTGSFLFRNCQWSLDLLDAWAPMGPKGFIRDQAGKVLTANLKGRPAFEADDQSALIYLLLSQKDKWMGKVFIENSYYLHGFWAGLVDKYEEMMENHHPGLGDERWPFVTHFVGCKPCGSYGDYPVERCLKSMERAFNFADNQVLRLYGFSHKGLESPKIKRIRDQTTKPINDVENLXMKAKISMAS

SEQ ID NO: 21100 - DNA, 583 bp, Panicum virgatum
  misc_feature: Ceres CLONE 1814558-R
  misc_feature: Encodes the peptide sequence at SEQ ID NO. 21101
gccccccggacttcatccccgtcctcgccaacttctcctcctacctcggccgcccgtggaagctctactcgcggacggtgttcgcgcagaccaagatggagagcctcatccacccgagggggtggctcgagtggaacggcagcttcgcgctcgacacgctctactatgccgagtacatgaaccgcgggcccggcgccaacacgtcggcgagggtggcctggcccggctaccacgtgctcaccaacgccaccgacgccgccaacttcaccgtgctcaacttcattcagggcgacctctggctcaacgccacctccttcccctacacactgggcttcagctagctagctatttgcagcttatgggaatttttaacccatttttcttattctctctctctttttttggaagaataaattaatagtggtggctgggctaagctcgggttccgtagttcctagtactaatcctgaaagctggacctctgctactacggagtgtagcacatgtgttcccatatgattcttggttaaagtctgaacgaaaaagccgaaggctaatcatggaaggagatgacctcgatctc

SEQ ID NO: 21101 - protein, 112 aa, Panicum virgatum
  misc_feature: Ceres CLONE 1814558-R
  misc_feature (1)..(97): Pfam Name: Pectinesterase Pfam Description: Pectinesterase
  misc_feature: SWISSPROT Homolog: EC 3.1.1.11 Pectinesterase
  misc_feature: Useful for making plants with altered cell wall content and/or composition
  misc_feature: Useful for making plants with altered carbohydrate content
  misc_feature: Useful for making plants with modulated time to senescence
PPDFIPVLANFSSYLGRPWKLYSRTVFAQTKMESLIHPRGWLEWNGSFALDTLYYAEYMNRGPGANTSARVAWPGYHVLTNATDAANFTVLNFIQGDLWLNATSFPYTLGFS

SEQ ID NO: 21102 - DNA, 564 bp, Panicum virgatum
  misc_feature: Ceres CLONE 1814564
  misc_feature: Encodes the peptide sequence at SEQ ID NO. 21103
aactatatcctacgcacacagcaacatctcccagtccgcagcagaagcgagcgtaagcggtgcatgaaatggacagcgcgagcagcctcgtggtgagacgacaccagcggcggcggcgcgtgcatggacaagctcatggcgctggccgccgcggtcgccgagggggcgacgctggagcgcatgggcagcggcgccagcgcggtcgtggacgctgccgagccgggcgccgaggcggactcgggctcctcgggccacgccggcgcgggcgggtagctgccgtcgtcctggtacaagggcgtggtgccgcagcccaacgggtggtggggcgtgctcatctacgagcgccaccagcgcatgtggttcggaactttctcgggggaggccgaggccacccgctcctacgacgtctccgcgcagcgcttcctcggccgctacaccgtctctatcttcctcccgctcgcgcacgcccactcgtatgccaccgccgagctgtgcttcctctcgtcacgctcgtaggtcgaggtcgtcgacatgctccactagcacacctacttcgaccagctc

SEQ ID NO: 21103 - protein, 49 aa, Panicum virgatum
  misc_feature: Ceres CLONE 1814564
  misc_feature: The sequence is a functional homolog of SEQ ID NO 36 in the 10/838,616 US patent application
  misc_feature: The sequence is a functional homolog of SEQ ID NO 738 in the 11/435,388 US patent application
  misc_feature: The sequence is a functional homolog of SEQ ID NO 1178 in the 10/374,780 US patent application
  misc_feature: The sequence is a functional homolog of SEQ ID NO 1374 in the 10/412,699 US patent application
  misc_feature: The sequence is a functional homolog of SEQ ID NO 53 in the 10/838,616 US patent application
  misc_feature: The sequence is a functional homolog of SEQ ID NO 38 in the 10/838,616 US patent application
  misc_feature: The sequence is a functional homolog of SEQ ID NO 740 in the 11/435,388 US patent application
  misc_feature: The sequence is a functional homolog of SEQ ID NO 1186 in the 10/374,780 US patent application
  misc_feature: The sequence is a functional homolog of SEQ ID NO 1185 in the 10/374,780 US patent application
  misc_feature: The sequence is a functional homolog of SEQ ID NO 40 in the 10/838,616 US patent application
  misc_feature: The sequence is a functional homolog of SEQ ID NO 742 in the 11/435,388 US patent application
  misc_feature: The sequence is a functional homolog of SEQ ID NO 1179 in the 10/374,780 US patent application
  misc_feature: The sequence is a functional homolog of SEQ ID NO 34 in the 10/838,616 US patent application
  misc_feature: The sequence is a functional homolog of SEQ ID NO 52 in the 10/838,616 US patent application
  misc_feature: The sequence is a functional homolog of SEQ ID NO 736 in the 11/435,388 US patent application
  misc_feature: The sequence is a functional homolog of SEQ ID NO 50 in the 10/838,616 US patent application
MDKLMALAAAVAEGATLERMGSGASAVVDAAEPGAEADSGSSGHAGAGG

SEQ ID NO: 21104 - DNA, 448 bp, Panicum virgatum
  misc_feature: Ceres CLONE 1814568
  misc_feature: Encodes the peptide sequence at SEQ ID NO. 21105
ggcgacaggggcgaccgcgcgcgccccacgccggtgccaatcccgaccgccccatgcacccattccgctacgcgccgctcgatgcccgtgtcacccgcggcctccgacgcctccggcgcggccgagtcctccgctgcggagggagcaccagcgaccatgccgccgccccagcccccgccgctgccacctccgcaaccgcggagcagctctgctcccgtatagttagacgacggcgagcacggcgggggcgagcgatggcagaagaagccgttcctcgccgcccgagggaatgaagcagaacaagatcgacggcggcggcctctaaggaatcaagtacaagtgggtcgactaccggcacggctggagacaacacacggcggagcatcacgacggcgtgatcaaagacaaagggatccacggggccgaccacaccgacctctcgaacgag

SEQ ID NO: 21105 - protein, 46 aa, Panicum virgatum
  misc_feature: Ceres CLONE 1814568
  misc_feature: Useful for making plants with modulated nitrogen use efficiency
  misc_feature: The sequence is a functional homolog of SEQ ID NO 160 in the 10/714,887 US patent application
  misc_feature: The sequence is a functional homolog of SEQ ID NO 160 in the 11/435,388 US patent application
  misc_feature: The sequence is a functional homolog of SEQ ID NO 28 in the 10/903,236 US patent application
MPVSPAASDASGAAESSAAEGAPATMPPPQPPPLPPPQPRSSSAPV

SEQ ID NO: 21106 - DNA, 1925 bp, Panicum virgatum
  misc_feature: Ceres CLONE 1814572
  misc_feature: Encodes the peptide sequence at SEQ ID NO. 21107
ctctctcgcaaacgaatctcgccttgcctcgctgctcgcctagccgcgtgcgtgcgactgtgagccgtgaggagcgccgccgccgccgccgccgccaccgcgcctctcctcgtcaccgccgcagcactcgtaggtgccggtatcgcatatcttcacgtcacctgcaccgccgcctgctgccctgcctccgcctccgccgtccgtcaaaccctaagtgggctgtcgagttcaccggcgaggtgctaccaattttgaaagatggcggatgatgaacaggcgccaagctctaggaagagggttgcaggtacccaaatcaacaaggataatcctgagcctgatgatgacggaccagagcaagagatgggtacgtttaagaaagctcccgaggaagtgatggcaacccgaagaattgtaaaggttcggcgccagcagccgtcctcagctccttcttctaatcctttctctgcaatcagatttacccccacagattctagtgttcaagcgagtgcccctgtcacagaacctcaaccttcagaagtcaaagctgatgagggcagcaacgacagtgctaaagaaactttgcctatgtcggacaagaatgctagctctggtgaggtaactgagattcagaaggatgaatcagctgtgaaaactgactctggtgccacaactgaagcgccgcctcaacctgttgaaactagtgacaaagcagaagacacaaaggatcgatctggtggagacaaagtagtagttggagaacccaaggaaggtgatagtatgccatctgaagttgagggcaaaacaaacgacagagatgctgaagaaaagaaaggggcagatgaagctggaaatgaagatgaaatcagtaaggatgatactgagaagaaagatggagttgaatcagagaccaaggatgggttgtctgatgagcagaaaaatgctgatagcaaagggcagtcctcatcatcagcacctcttttctcctttaagaatatgtcaagtggtcaaaatgccttcacaggtctggctggaactggattttcaagcacatcattctcatttggctcggcatctaaagatggatcaagtgctggtcctctatttgggctgaagattgatggttcttcattcccttcttttaaccttggtgctaccaacaacggtagttcctccacagtgctcgctacttcaggagaggcacccaagaaatttgctatgacagagggccctgttgaaactggtgaagaaaatgagaaggctgtatttactgctgactctgctttgtatgagtatttagatgggggctggaaagaacggggaaaaggtgaactgaagctgaacgtctctgtatctggtgatgagagagcccggctcgtcatgaggaccaagggaaattaccggctggtcctgaacgcgagcctctacgacgacatggcgctcaaggacatggacaagaagggagtgacgttcgcctgcatgaacagcatcggcgagttgcagagcggcctcgcaacgtttgctctgaagttcaaggacaccgccatgagggaggagttcaagggcgcggtggaggctcacaaggcgaggaaggcacctgatgtgccactgaagacgcccgagaactccccaaaggcagccgaggtctgaagcctgccaatcacacttacgcatccttagtacctttccagtaaaaaggagccgagagataccgtctgttatttgcggagttttaagtaagatatcgtcctgagttgtgactgcatacggtttcctgatgttttttggggggaacagtgggtagcctggcgaactttattaaagtcataatcttagtataacctggggatgagactgttttgatctacatactgtatgcttttgtacggtcgctctgtcttgggctattaaagtcataatcttagtac

SEQ ID NO: 21107 - protein, 462 aa, Panicum virgatum
  misc_feature: Ceres CLONE 1814572
  misc_feature (10)..(294): Pfam Name: NUP50 Pfam Description: NUP50 (Nucleoporin 50 kDa)
  misc_feature (324)..(445): Pfam Name: Ran_BP1 Pfam Description: RanBP1 domain
MADDEQAPSSRKRVAGTQINKDNPEPDDDGPEQEMGTFKKAPEEVMATRRIVKVRRQQPSSAPSSNPFSAIRFTPTDSSVQASAPVTEPQPSEVKADEGSNDSAKETLPMSDKNASSGEVTEIQKDESAVKTDSGATTEAPPQPVETSDKAEDTKDRSGGDKVVVGEPKEGDSMPSEVEGKTNDRDAEEKKGADEAGNEDEISKDDTEKKDGVESETKDGLSDEQKNADSKGQSSSSAPLFSFKNMSSGQNAFTGLAGTGFSSTSFSFGSASKDGSSAGPLFGLKIDGSSFPSFNLGATNNGSSSTVLATSGEAPKKFAMTEGPVETGEENEKAVFTADSALYEYLDGGWKERGKGELKLNVSVSGDERARLVMRTKGNYRLVLNASLYDDMALKDMDKKGVTFACMNSIGELQSGLATFALKFKDTAMREEFKGAVEAHKARKAPDVPLKTPENSPKAAEV

SEQ ID NO: 21108 - DNA, 567 bp, Panicum virgatum
  misc_feature: Ceres CLONE 1814578
  misc_feature: Encodes the peptide sequence at SEQ ID NO. 21109
atctcatcgatcgagccagccatccatccatccatccatccagccagccgcctctcctcgactgctgcgcgcatctctctgctctcgtagggagatctcgcgcagcccggaaaccggtcgacccagctcgtcgtcgtcgcagatggccggcctcaggatgaagttcgtcgccgccgcggccgtggccaccgcgctcgtggcgtccgccgccgccgccatcgcggcccccgccccggcgcgcgcctccgaggccgcccccgagctggccctcgcggaggtctccctccccgccaccgccggcggctaccacttctgctaaaggcatcgggctgtcagcgtgggtgccgccgatatgatgactggtgttcgcctgaatcgagctcctcgacggtggcgtggaggaaagatgcgggggggggctgtgcatataccatgctgcgtcccctggagctggtatgggtgggaccgcgacgtgccacgacaaaccgttatctcgtggctgccatcacgcgttcaccccgttaccgatcattgacgacttcatctcctccatgctgtgcctcttat

SEQ ID NO: 21109 - protein, 58 aa, Panicum virgatum
  misc_feature: Ceres CLONE 1814578
  misc_feature: Useful for making plants with altered carbohydrate content
MAGLRMKFVAAAAVATALVASAAAAIAAPAPARASEAAPELALAEVSLPATAGGYHFC

SEQ ID NO: 21110 - DNA, 624 bp, Panicum virgatum
  misc_feature: Ceres CLONE 1814595
  misc_feature: Encodes the peptide sequence at SEQ ID NO. 21111
caacgacctctcctccgtcctcactcccactctcgacctctctacaatggcgagaaggtgcaggagcagcggcggcggcaacgtgccgggcttggcggccatggcggcggcgtcatggctcctggtggcggtggcgctcgccggcgtcgccgacgcccagctgcaggtggggttctactccaggtcctgcccgggcgccgagtccaccgtcgcggacgtcgtccggcaggccggctccgccgaccccaccatcctgccggcgctcctccgcctccagttccacgactgcttcatccggggctgcgacggctccgtcctcatcaagggcggcggcggcggcagcgccgaggtggacaacagcaagcaccagggcctccgcgggctcgagatcgtcgagggcgccaagacgcagctcgaggcccagtgccccggcgtcgtctcctgcgccgacatcgtcgccctcgccgcccgcgacgccgtcgcattcgtacgcatactatatatatatatatatatatatatatatatatatatatatatatatatatatatatatatatatatatatatatatatatatatatatatgtatatagatatatatatatatatatatatatatat

SEQ ID NO: 21111 - protein, 192 aa, Panicum virgatum
  misc_feature: Ceres CLONE 1814595
  misc_feature (55)..(189): Pfam Name: peroxidase Pfam Description: Peroxidase
  misc_feature: SWISSPROT Homolog: EC 1.11.1.7 Peroxidase
  misc_feature: Useful for making plants with altered cell wall content and/or composition
  misc_feature: Useful for making plants with altered carbohydrate content
MARRCRSSGGGNVPGLAAMAAASWLLVAVALAGVADAQLQVGFYSRSCPGAESTVADVVRQAGSADPTILPALLRLQFHDCFIRGCDGSVLIKGGGGGSAEVDNSKHQGLRGLEIVEGAKTQLEAQCPGVVSCADIVALAARDAVAFVRILYIYIYIYIYIYIYIYIYIYIYIYIYIYIYMYIDIYIYIYIY

SEQ ID NO: 21112 - DNA, 692 bp, Panicum virgatum
  misc_feature: Ceres CLONE 1814596
  misc_feature: Encodes the peptide sequence at SEQ ID NO. 21113
atcacgaatccgaagaatccccacgagcagaagagaaaacccagagaaaccaagcgaaaaatccaatcttttcctcgattcagcccccgattccgcggcgagaagagccatggccgagtccgccaacaacgacgccccggccgccaccaacaaccagcccactacggaggaggtgacgattgagagggcggcgacccaggaggaggaggagaggctgcggtacctcgagttcgtgcagcaggcggcggcgcaggcgctggtgctggccgccgcggcgtacgcgtacgccaagcagggcgcggggccgctccgccccggtgtcgaccacgtcgagggcaccgtcaagaccgtcgtggggcccgtctacgaccgcttccatgccgtcccgctcgacctcctcaagttcctcgaccgcaaggtaaggaggaccattctctttagttggttttaatttttagtttcaaattgttccattcttgtagttgctacttgttaagttccatcctgcgtcccaaaatgaatcttttagggtgaaattttttgtatctaatagcgcttggatgcatggcatgtagattattcagacataatttcaggtgttctttttaaagacagttctgcacaggtgtatgattgaatcattggatcgacttagcataagtttaatgatgaccggtaaaagaacattatgc

SEQ ID NO: 21113 - protein, 113 aa, Panicum virgatum
  misc_feature: Ceres CLONE 1814596
  misc_feature (27)..(111): Pfam Name: REF Pfam Description: Rubber elongation factor protein (REF)
MAESANNDAPAATNNQPTTEEVTIERAATQEEEERLRYLEFVQQAAAQALVLAAAAYAYAKQGAGPLRPGVDHVEGTVKTVVGPVYDRFHAVPLDLLKFLDRKVRRTILFSWF

SEQ ID NO: 21114 - DNA, 1516 bp, Panicum virgatum
  misc_feature: Ceres CLONE 1814601
  misc_feature: Encodes the peptide sequence at SEQ ID NO. 21115
atccgtttcccaattccattcctccattgataaacaagttgcggtttcgtttccccacctgttcgtatactaccacaccaaaaaatattccaggcacctaccactcatcccaatcggcaaaaggtcaatttcggggctttatttaggccaattggagggaaggtggtgtttgtggtttcttcctgccgacggtttcttggcgagttgaatttgggtgcctcttgctccagacagtactttacacccggtgactcttgcttggctccagctcaaatcggtgtcttgttgggttaaatagaaggattctggatgggcgatgccatgggggtcagctgcactcaaggcgccatgaactgagatgtgggatttggtggcgtcagctggtggtggattcttggggcgtccacagacagattcttgggcctgatttggagagggacagcgcaggagaagagcgatgtccttcaggagcctgattcaggacatgagggacgagttcgggagcatctcgcggcacaccctgcggtcccggtcccaccggtctgccgggaacgcgtcgcgggccgctgccgcggagccgtcgcaggccatggatcagagctgctggtcgcagctgccccccgagctcctgcgggaggtgctagtgaggatcgaggcgtcggagagctggtggccggcccgcaaggacgtcgtgtcatgcgccggcgtctgccggacctggaggggcatcatgaaggaggccgtgcgcgtccccgaggtgtcagggaaactcacgttccccatctcgctcaagcagcctggcccaagggatggcactcttaaatgtttcatcaggaggaaccggactactcagacatattatctgtatattggactgacagaagcattggcagatgatggaaagtttttacttgctgcacgcaaatgccggaagcccacatgtacagactacctaatttctcttgacaaggttgatatgtcaaagggaagcagcacctacattggcaagctaagatcaaactttcttggaacaaagttcactgtctatgatgctcatccaccatatgatggtgcagtggtctcaaagagtcgctctgcacgtgtgattggtttgaaccaggtctcccccagaattcctgctgggaattatcctgtttcacatatttcgtatgagctgaatgttctgggatccagaggtccaagaaggatgaactgtgttatggattcaattcctgcatcagccgttgaggaaggagggaaagctccaacacagaccgaatttcctcttagcagccttgactctttcccatcaattccattcttcagatctaaatcagctcggatagacacagcttcgcaatcatccactcagaaggaagataggctagtgctgaagaataagtctcctaggtggcatgaacaactgcagtgttgatgcctgaatttccgtggtcgggtcactgttgcctcggtgaaaaactttcagctggtggcttcagatgacaacggatcaggt

SEQ ID NO: 21115 - protein, 325 aa, Panicum virgatum
  misc_feature: Ceres CLONE 1814601
  misc_feature (114)..(325): Pfam Name: Tub Pfam Description: Tub family
  misc_feature (48)..(103): Pfam Name: F-box Pfam Description: F-box domain
  misc_feature: The sequence is a functional homolog of SEQ ID NO 462 in the 10/666,642 US patent application
MSFRSLIQDMRDEFGSISRHTLRSRSHRSAGNASRAAAAEPSQAMDQSCWSQLPPELLREVLVRIEASESWWPARKDVVSCAGVCRTWRGIMKEAVRVPEVSGKLTFPISLKQPGPRDGTLKCFIRRNRTTQTYYLYIGLTEALADDGKFLLAARKCRKPTCTDYLISLDKVDMSKGSSTYIGKLRSNFLGTKFTVYDAHPPYDGAVVSKSRSARVIGLNQVSPRIPAGNYPVSHISYELNVLGSRGPRRMNCVMDSIPASAVEEGGKAPTQTEFPLSSLDSFPSIPFFRSKSARIDTASQSSTQKEDRLVLKNKSPRWHEQLQC

SEQ ID NO: 21116 - DNA, 644 bp, Panicum virgatum
  misc_feature: Ceres CLONE 1814601-R
  misc_feature: Encodes the peptide sequence at SEQ ID NO. 21117
ccccctttctcccccacccccatcatccagcggcaagtgcccggtgaacgcgctcaaattcggcgtgtgcgtcaacgtgctcggcctcgtcaagggcgaggccggcaaggtgcccgctgagccgtgctgcagcctcctcaacggcctcgccgacttggaggccgccgtctgcctctgcacggccatcaaggccaacgtgctcggcgtcgccatcgacatccctatcaagctcagcgccctcgtcaactactgtggcaagtgcgtgcccaaaggctacacctgtgcgtaaacacgccgcggctacacgctcgtatagccgctcacgcaatctgcatggcatatatacgtgcgttgggtttgctgctgaactcttctgtctcatttgtgcatgcaacttcggttctgcaacctagaaccatgcatttcgtccaaatgctttgtcagtttgtgtgtattgcattgtgtctcttgtcgaatttcctttcatttttgaatttgttcataagaggcatgcatctctccttgaagtgaacaagaggagtagtgttgcttctagttattgcaaatcatgtaatctgttgggaaacttttattgtgtatgtaaaatcaagcgcttgaactatctgtaataatacttattcgtc

SEQ ID NO: 21117 - protein, 95 aa, Panicum virgatum
  misc_feature: Ceres CLONE 1814601-R
  misc_feature (13)..(94): Pfam Name: Tryp_alpha_amyl Pfam Description: Protease inhibitor/seed storage/LTP family
  misc_feature: Useful for making plants with modulated oxidative stress sensitivity
  misc_feature: Useful for making plants with modulated biomass
  misc_feature: Useful for making plants with modulated flowering time
PLSPPPPSSSGKCPVNALKFGVCVNVLGLVKGEAGKVPAEPCCSLLNGLADLEAAVCLCTAIKANVLGVAIDIPIKLSALVNYCGKCVPKGYTCA

SEQ ID NO: 21118 - DNA, 2312 bp, Panicum virgatum
  misc_feature: Ceres CLONE 1814677
  misc_feature: Encodes the peptide sequence at SEQ ID NO. 21119
aaaaaaaaaaaatcccgtcacctcccattgcagcagcattgcattgcattgcttcctcagttgctccatgtggagtcacttattaccgcattacactagctagcacagcccagccagcttgatcttggatcggatcggatcagttgatcttgctgctgctgtgtgcatacgtgtgtaccttagcatctagctgctcgatcgccggccggccggcaatggaggtggggacgtgggcggtggtggcggccgccgccgccatttacctggcgtggttctggcggctgtcgcgggggctcagcgggccgcgggtgtggccggtgctcggcagcctgccggggctggtgcagcacgccgaggacatgcacgagtggatcgccggcaacctccgccgcacgggcggcacgtaccagacctgcatcttcgcggtgcccggggtggcacgccgcggcgggctggtcaccgtcacgtgcgacccgcgcaacctggagcacgtcctcaaggcgcgcttcgacaactaccccaagggccccttctggcacgccgtcttccgagacctgctcggcgacggcatcttcaactccgacggcgagacgtgggtcgcgcagcggaagaccgccgcgctggagttcaccacgcgcacgctccggacggccatgtcccgctgggtgtcgcgctccatccacctcaggctgctgcccatcctggaggaggccgccagcgagaggacgcacgtcgacctccaggacctcctcctccgcctcaccttcgacaacatctgcggcctggcgttcggcaaggaccccgagacgctcgcgccgggcctgccggagaacgccttcgcctcggccttcgaccgcgccacggaggcgacgctcaaccgcttcatcttcccggagtgcctgtggcggtgcaagaagtggctgggcctcggcatggagaccacgctggcccgcagcgtcgcccacgtggacgcgtacctcgccgccgtcatcaaggcgcgcaagctcgagctcgcgccgggcaacggcaggtgcgccgcggcgcacgacgacctgctctcccggttcatgcgcaagggctcctactcggacgagtcgctgcagcacgtggcgctcaacttcatcctcgccggccgcgacacctcctccgtggcgctctcctggttcttctggctcgtgtccacgcaccccgacgtggagcgcaagatcgtgcgcgagctctgcgccgcgctcgccgtgtcccgcggctcccacgccccggcattgtggctggcctcgcccttcaccttcgaggagctcgaccgcctcgtctacctcaaggcggcgctctcggagaccctgcgcctgtacccgtccgtcccggaggactccaagcacgtcgtcgccgacgactacctcccggacggcacgttcgtcccggcggggtcgtcggtgacctactccatctactcggcggggcgcatgaagacggtgtggggggaggactgcctcgagttccgccccgagcggtggctgtccgccgacggcgctcggttcgagccgcacgactcgtacagattcgtggcgttcaacgccgggccgaggatctgcctgggcaaggacctggcgtacctgcagatgaagaacatcgccggcagcgtgctcctccgccaccgcctggccgtcgcgccgggccaccgcgtggagcagaagatgtccctcacgctgttcatgaagcacgggctccggatggaggtgcacccgcgcgacctggccccggtcatcgacgagctccgcggcgccgacgcggcggcaaggccggccacggcgccctgcgcgtagaggatccgggtgtcccgtgcgccaagatccgtgctgccgaggagacaccgagcattgaatgttgttgataagcgtacaagacagtaagtaaattaaataggtctggtgagagcattcaagtctcttccttccgcaatttaccattctgatgatgagggagatggggaaattttgcaattggcaagatctaagctagatttggatccgggcatgtagtactactactacaaactaaaaggggtgaaacaaaaggggagagtaaaaaaaagagagagtttccaataattcaggatcgggtgctgcagattatttggtcgaggcagatcgtgttggtggccagccaactgttctactactattctttatttattttaaaactttttcatgttttttcagtactactatattctagagagctgttcagtttacccagaaacatgtaaagtaaacctgtactgaaccttcttttgcttctgtgagaccatcattttc

SEQ ID NO: 21119 - protein, 534 aa, Panicum virgatum
  misc_feature: Ceres CLONE 1814677
  misc_feature (27)..(509): Pfam Name: p450 Pfam Description: Cytochrome P450
  misc_feature: SWISSPROT Homolog: EC 1.14.15.3 Alkane 1-monooxygenase
MEVGTWAVVAAAAAIYLAWFWRLSRGLSGPRVWPVLGSLPGLVQHAEDMHEWIAGNLRRTGGTYQTCIFAVPGVARRGGLVTVTCDPRNLEHVLKARFDNYPKGPFWHAVFRDLLGDGIFNSDGETWVAQRKTAALEFTTRTLRTAMSRWVSRSIHLRLLPILEEAASERTHVDLQDLLLRLTFDNICGLAFGKDPETLAPGLPENAFASAFDRATEATLNRFIFPECLWRCKKWLGLGMETTLARSVAHVDAYLAAVIKARKLELAPGNGRCAAAHDDLLSRFMRKGSYSDESLQHVALNFILAGRDTSSVALSWFFWLVSTHPDVERKIVRELCAALAVSRGSHAPALWLASPFTFEELDRLVYLKAALSETLRLYPSVPEDSKHVVADDYLPDGTFVPAGSSVTYSIYSAGRMKTVWGEDCLEFRPERWLSADGARFEPHDSYRFVAFNAGPRICLGKDLAYLQMKNIAGSVLLRHRLAVAPGHRVEQKMSLTLFMKHGLRMEVHPRDLAPVIDELRGADAAARPATAPCA

SEQ ID NO: 21120 - DNA, 1375 bp, Panicum virgatum
  misc_feature: Ceres CLONE 1814683
  misc_feature: Encodes the peptide sequence at SEQ ID NO. 21121
catccccgtcggccgccctgtcctgctgtcccgcccgccaccgatggccgccgccgccgcaacgtcgtcgtggcttctccggagacctatctcctgcgtccttctagcgaggcgcgctacccctaggatcctgcgcaacaccatctgctattcctccttcgcatccgcccccgccgcaccaccgccgtctccgcctccgcctgccacatccgccagcgatggaggcggcgggatgagatgggagtcggcgcggaagaagagggtggtgctccgcgtcggctacgtcggcaccgagtaccgaggccttcagaagcagcgggagcttagcgtggactcgaccatcgagtcagtcttggaatctgccatattcaaggcggggggcattcttgagagtaattatgaaaaactgcaaaaggttgggtgggagaggagtagccgaactgataaaggggtacactcgctggctacaatgatctcccttaaaatggaaatccctgatagagcgtgggagaatgatcctgatggcatatgtcttgccagttttattaactcaaatttgccaagcaatgtcagggtttttagtatcttgcctgcacaaaggagttttgatgtaaggagggagtgcttataccgtgagtacttctatcttcttcctgctgaaactattggaattaaagatggttgtagctctgaagaagtgcaacagcacttatcagagttcaacagcatacttaaaggtttcgagggaaaccatccatttcataattacactgctcgtgccaagtacagaaaagttcttgcgggaagacagcgaagggtgaaaggtgcaggttcgacactgaagtccatgtcctctgaaatgggtatgaaagaaagctcttctgaagagaacaccccttcagaacatgatgaagacctgaatatttcatcaatgattgattctggtgtatgtgaagacagttgtatgagtgatattgccaaaggttctgagaatcgggtgcagattcaggctaggtggctatatgagcctgatgagagtgatagactaaatgcttcacatttcagagatattatcacctgttcctgtggagaattgcagagttcatcaggaattcaatttgtggaattgaccatatgcggagtatccttcatgctacatcagatccggaagatggttggaactgcggtggcagtgaagcgtggattacttcccaaagatatcatagaattgtctctagcaaagttttctagaatcgttctaccgatagctccgtcagaagtcctgatccttagagataatagtttctgcacgaaaaataaggaagggagaattgttcgccctgggatccagtcaattaacaattcggcagaaatc

SEQ ID NO: 21121 - protein, 443 aa, Panicum virgatum
  misc_feature: Ceres CLONE 1814683
  misc_feature (76)..(193): Pfam Name: PseudoU_synth_1 Pfam Description: tRNA pseudouridine synthase
  misc_feature: SWISSPROT Homolog: EC 5.4.99.12 tRNA-pseudouridine synthase I
MAAAAATSSWLLRRPISCVLLARRATPRILRNTICYSSFASAPAAPPPSPPPPATSASDGGGGMRWESARKKRVVLRVGYVGTEYRGLQKQRELSVDSTIESVLESAIFKAGGILESNYEKLQKVGWERSSRTDKGVHSLATMISLKMEIPDRAWENDPDGICLASFINSNLPSNVRVFSILPAQRSFDVRRECLYREYFYLLPAETIGIKDGCSSEEVQQHLSEFNSILKGFEGNHPFHNYTARAKYRKVLAGRQRRVKGAGSTLKSMSSEMGMKESSSEENTPSEHDEDLNISSMIDSGVCEDSCMSDIAKGSENRVQIQARWLYEPDESDRLNASHFRDIITCSCGELQSSSGIQFVELTICGVSFMLHQIRKMVGTAVAVKRGLLPKDIIELSLAKFSRIVLPIAPSEVLILRDNSFCTKNKEGRIVRPGIQSINNSAE

SEQ ID NO: 21122 - DNA, 592 bp, Panicum virgatum
  misc_feature: Ceres CLONE 1814683-R
cttggaccggttcgccagcatacaagattcacagctggatgaagttagggaggcctacagaatatggaaggctgattatgaccgagtgaagatggctagaaagagtgctgaagctgctcataaggtcgacaaataatcgaattgaatcgttcactgaagagaataccatttttctcctgtgcaggcagttccttatactggatctacgtgagttttaggttggcaatgtcaccacctgttttgatgagggggtttaatccaaatcttaaataattcctagagactgctctgagtttaatccgatccaagcaggtcctcgttgttgcatttctaatccaggacaacatgggcaagaggctgaagtgttgattgaccctaccaggacaattcgcggattgaaaaacagcgagattgtcttcgctgaattgcagacttacctatcaaagtgagcaagtactacacttcctctgatctccacttctgtgaagccattttggtccacttaaccttctttgaacaatggattgtactgcttcacttcatagtatccattcatacacgcagtcgtccgtcaagcagtttgctgttcttc

SEQ ID NO: 21123 - DNA, 1835 bp, Panicum virgatum
  misc_feature: Ceres CLONE 1814685
  misc_feature: Encodes the peptide sequence at SEQ ID NO. 21124
aaggataatccgccggagcgaacccccaccggcgccggtcggggtcggttggttcccttgcttgctgcggccgcggcgatgacggcccccggcggctgctgctcggcccccctcgcgtgggcgcggcctcgcgcctctcccgcccggcgcggcggccggtgtcgcgcggtcgcggccggggcgtctgacgtggcgttccacccggacgtgtcccgcgcggcggagtcgctgcaggcggagttccgcgccgtcgaccgcgccctcgccctcaactcctcccgcgtcgccgctgccttccgccgcgcccgcgtcgccccgcaccatttcggcgggtcgacggggtacggccacgacgacggcggcggccgggaggcgctggacgccgtattcgccgacatcgtcggcgccgaggccgccattgtgcgcccccagttcttctccggcacgcacgccattgcctgtgcgctatttgcgcttctgaggcctggacatgagctcctggcagtcgctgggcctccgtacgacaccttggaggaggtgattggggtcagggggtcggccaatgtaggatcactcaaagactttggagtggcgtaccgagaagttccgttgtagctcgcagcagacggtggccttgattgggaagctcttgcttgcgccatcagaccagaaactggatgtgccttcattcagagatcatgtgggtactcttggcgcaagagcttaagtgtagcagatattcacagagctataagtttgatcaagttgcaaaacccaaactgcatggtgatggttgacaattgctatggtgaatttgttgagacatctgaacctgcaatggtgggagcagacttgattgctggtagtttgataaagaatccgggtggaactattgcgccttgtgggggttatgttgctgggaagagaaattttgttgaagcagctgctgctcgcctatctgcccctggccttggagtagaatttggatcaacacctggccatgttatgcgttcgctttttcaaggcttgtttcttgctccacaaatggttggagaagcaataaaatatgatccatagggaggtttgctaattgcggaagtcatgtcagccaagggctacagagttcaaccacttccaagggttcctcgccatgatattgtgcaggcagtggagcttggcaacagggagagactcatagcattctgtgaagtggtgcaacaaacttgcccagtagggtcatttgttaaaccaactgctggggaaactcctggctatgcttcagaggtcatttttgccgacgggacattcatagatggaagcacaagtgaactatcatgtgatgggcccttgagagatccatatgccgtcttctgccagggaggaacacattggacacaataggcgcttgtcctcactgaagttctgaaggtcatataactgtgtggtgtcacgttcctggaatgggcaggcccttttctttaactatgcctggttacttgaaactcaatatgatggaactgattagcaccaggtggaattcatggcttaattgttggaacttggaaccatgttggatgatcttgaggttgaggggaagcagtggcagatggaataggtccttggacggttgagtggcaattttgcaagtctacgtttctttaatggcagattccagttaggaggtcaaaatagtggcaaatatgcaatttgccccctttttttttctaaacattgtccatgaagcaaaatatgtaacaagatactcttttactttcctagtttcctttctacaaaaatgtaggccaagaaagttttgcaaatgcaatcagagatag

SEQ ID NO: 21124 - protein, 178 aa, Panicum virgatum
  misc_feature: Ceres CLONE 1814685
  misc_feature (40)..(178): Pfam Name: Alum_res Pfam Description: Aluminium resistance protein
MTAPGGCCSAPLAWARPRASPARRGGRCRAVAAGASDVAFHPDVSRAAESLQAEFRAVDRALALNSSRVAAAFRRARVAPHHFGGSTGYGHDDGGGREALDAVFADIVGAEAAIVRPQFFSGTHAIACALFALLRPGHELLAVAGPPYDTLEEVIGVRGSANVGSLKDFGVAYREVPL

SEQ ID NO: 21125 - DNA, 667 bp, Panicum virgatum
  misc_feature: Ceres CLONE 1814692
  misc_feature: Encodes the peptide sequence at SEQ ID NO. 21126
gacgaggcgtgggagagaggaggagacggagaggggagaagcggcgcgaaggaacctgatgggccgcgcgttcacgtacgtgatcctgggcggcggcgtggccgcgggctacgcggcgctcgagttcgtccgccgccgcggcgacgccgcccccggcgagctctgcatcgtctccgaggaggccgttgctccttacgaacgtcctgctctaagcaaaggctatctgctcccggaaggtggcgctcgtctcccagcatttcatacttgtgttggtgccaacgatcagttacttacagaagattggtataatgaacatggtattgagcttattcttggaatgaaaataatttctgccgacgtgcgtcggaagacattgcttacttccagtggggaaactatcagctataaaactcttattgttgcaacgggtgctcgggccttgaagctggaagaatttggagggaatggctcagatgctgagaatgtttgttatctgcgtaatatcgaggatgcagataaattagtccatcaaatgagatcatgtcccggtggtaatgctattgtaattggtggtggatatataggaatggaatgtgctgccgctttggttgccaacaagataaaggttaccatagtcttccctggaaaacactgcatgggtcgtctg

SEQ ID NO: 21126 - protein, 202 aa, Panicum virgatum
  misc_feature: Ceres CLONE 1814692
  misc_feature (6)..(195): Pfam Name: Pyr_redox_2 Pfam Description: Pyridine nucleotide-disulphide oxidoreductase
  misc_feature: SWISSPROT Homolog: EC 1.6.5.4 Monodehydroascorbate reductase (NADH)
MGRAFTYVILGGGVAAGYAALEFVRRRGDAAPGELCIVSEEAVAPYERPALSKGYLLPEGGARLPAFHTCVGANDQLLTEDWYNEHGIELILGMKIISADVRRKTLLTSSGETISYKTLIVATGARALKLEEFGGNGSDAENVCYLRNIEDADKLVHQMRSCPGGNAIVIGGGYIGMECAAALVANKIKVTIVFPGKHCMGR

SEQ ID NO: 21127 - DNA, 747 bp, Panicum virgatum
  misc_feature: Ceres CLONE 1814706
  misc_feature: Encodes the peptide sequence at SEQ ID NO. 21128
cacccaatctccagccgcagccgcacccaagcacgagcggcggcgcgagttgcgagccgcggacgcaccgtcacctgcggcgcctcctcctcccatcgcagcctccttcgcgtccttagcggttcagccatgggtaaggagaagtcccacatcaacatcgtggtcattggccacgtcgactccggcaagtcgactaccaccggccacctgatctacaagcttggaggcatcgacaagcgtgtgatcgagaggttcgagaaggaggctgcggagatgaacaagaggtccttcaagtacgcgtgggtgcttgacaagctcaaggccgagcgtgagagaggtatcaccattgatatcgccctgtggaagttcgagaccaccaagtactactgcacggtcattgatgcccctgggcaccgtgacttcatcaagaacatgatcacgggtacatcccaggctgactgtgctgtccttatcattgactccaccactggtggttttgaggccggtatctccaaggatggccagacccgtgagcatgctctccttgctttcactcttggagtcaagcagatgatctgctgctgcaacaagatggatgccaccactcccaagtactcgaaggcccgttatgatgagattgttaaggaagtctcctcctacctgaagaagggtggctacaaccctgacaagattgccttcgtccccatctctgggttttgagggtgacaacatgattgagaggttcac

SEQ ID NO: 21128 - protein, 196 aa, Panicum virgatum
  misc_feature: Ceres CLONE 1814706
  misc_feature (5)..(193): Pfam Name: GTP_EFTU Pfam Description: Elongation factor Tu GTP binding domain
  misc_feature: SWISSPROT Homolog: EC 2.7.7.4 Sulfate adenylyltransferase
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKGGYNPDKIAFVPISGF

SEQ ID NO: 21129 - DNA, 1856 bp, Panicum virgatum
  misc_feature: Ceres CLONE 1814708
  misc_feature: Encodes the peptide sequence at SEQ ID NO. 21130
aacagagccgcaaggggacaaggcggtaggggtttccgatggcgccgaagcggaagcccgcgcggggggcggcggcggaggagcgggaccccgacggaatgttccacggcgtctccgccttcatcgttccccacggcgtccaggcccgccgtctcgaggtgtggaagcagaggctggtgcagatggggggccgcgtcgtggagaagctcgacaagggcggcgctgcggcgggggtcaacaacgtgctggccatggacgccaaggctctgctccgggagctcgacgccgcctggctccaccgtttccgcgggagtgtggtgtccttcgaatggctggaggaatgcctcaagtccggggagaggctgcccgagcacaagtttacaatcaactatgaagaggaatttaagccgaagaaggcagctggcaatggaggttcgggtgggttgcagcctgcgaaaaggagcaaaatatcatctgaggatcctggggatcagcagagaacaagcgacgaggatagggaggagcattcaaatgcaagtgcggataaaggttcaggtgtcaagacaaagcctaaccagtatgcaagtagccaaagtagctccggagataccaaggataccgtaggttctcatgctacatttgacatcgaggaagcctcctctggaggtcccagcatttatgctccggcagacttgaataggaacatcaccaagattttcggaaggcttatcgatatatatagggccctgggagatgacagaagatcatttagctattacaaggccataccggtaattgagaaattgccattcaaaatagaaagtgctgagcaagttaaagacctccctaccattgggaaatctttgaaagaccatataaatgaaatagttacaactggtaaactctccaagctggaacactttgagaatgatgaaaaggtgcggactatcagcttatttggagaagtttggggggttggccctgccactgcactcaagttatatgaaaagggacaccgtactcttgatgatctgcgaaaagatgagtcacttacaaatgctcagaggattggattgaagtactttgatgatatcaagcaaagaatcccccggcatgaggttagcgagatggagaagcttttgcaagatgttgggaaggatatcttgcctggggtaataattgtttgcggaggatcatatagacgtggaaaagcttcttgtggtgacatggatattgttataactcatcctgatggagaaagtcatgtaggttttttgcccaactttgttcaacggctgaaggaaattaactttttgagggaggatcttatctttagcatacacagcgttgatggatcaaatagtggggttgacacatattttggtctttgcacatatcctgggcatgaactgcggcaccgcattgacttaaaggtatacccaaggaacagatatgcatgtggactgcttgcatggactggaaatgatgtactaaatcgacggctaagactattagcagattcgaaaggatacgtgcttgatgacactggattgtatctagctacacggggcagtggtggaaagcatgcaggtagatcggatgcgattgtcaactgtcacactgagaaggatgttttcgacactcttggattcccttggctcgaaccccatgagcgcaatctttagtgggttttgagtgttcctgtagcggatgtattttgtaaagctgtatgtacctgaacttaatggggacttaaaaggcttcgtactgggtgttgttcatttatatgtccttcagttcccttgtgttgtgctgtgaattgtacgcaaccttattgaaagtatctaaagtagtct

SEQ ID NO: 21130 - protein, 548 aa, Panicum virgatum
  misc_feature: Ceres CLONE 1814708
  misc_feature: SWISSPROT Homolog: EC 2.7.7.7 DNA-directed DNA polymerase
MAPKRKPARGAAAEERDPDGMFHGVSAFIVPHGVQARRLEVWKQRLVQMGGRVVEKLDKGGAAAGVNNVLAMDAKALLRELDAAWLHRFRGSVVSFEWLEECLKSGERLPEHKFTINYEEEFKPKKAAGNGGSGGLQPAKRSKISSEDPGDQQRTSDEDREEHSNASADKGSGVKTKPNQYASSQSSSGDTKDTVGSHATFDIEEASSGGPSIYAPADLNRNITKIFGRLIDIYRALGDDRRSFSYYKAIPVIEKLPFKIESAEQVKDLPTIGKSLKDHINEIVTTGKLSKLEHFENDEKVRTISLFGEVWGVGPATALKLYEKGHRTLDDLRKDESLTNAQRIGLKYFDDIKQRIPRHEVSEMEKLLQDVGKDILPGVIIVCGGSYRRGKASCGDMDIVITHPDGESHVGFLPNFVQRLKEINFLREDLIFSIHSVDGSNSGVDTYFGLCTYPGHELRHRIDLKVYPRNRYACGLLAWTGNDVLNRRLRLLADSKGYVLDDTGLYLATRGSGGKHAGRSDAIVNCHTEKDVFDTLGFPWLEPHERNL

SEQ ID NO: 21131 - DNA, 1656 bp, Panicum virgatum
  misc_feature: Ceres CLONE 1814737
  misc_feature: Encodes the peptide sequence at SEQ ID NO. 21132
ctcctcctcctagtcctctccttggcctgcccgatgcgcccttagcgaactgaccgtagggttcgctggagtggcgccgcacgtcgctcttggtgggactggtttcggcgtccatttcgggttgaagcagcctcggcttccgcgccggtaagccgccgaggctggagttgaggtgagatggcgaacctgcagccttccctcaccattcccccctcgttcgccggggcctctccgccgtctccctcgccggtggctgggagcagcagcggccccgccctgggacaggcggccaaggacaagaagatggcgtcggcggagcagctggtgctggaactctgcgaccctgaactgcgcgagaacgcgctgcttgagctctccaagaaaagagagatatttcaagatcttgccccgctgctgtggcactcatttggcacaattgctgcgctactccaggagatcgtgtctatctacccctcactttcacctccaacactatcacctggtgcatcaaaccgagtttgcaatgctcttgcccttctgcagtgtgtcgcatcgcatcctgagaccaggatccttttcttgaatgctcatattccgctgtacctgtacccgtttctgaatactaccagcaaaacaagaccttttgagtacttaaggcttactagcctgggtgtcattggtgctcttgtcaaggttgatgatactgaagtcatcagttttttgctgcaaactgaaataattcctctgtgcttacgaaccatggagatgggcagtgagctgtcaaaaactgtggcaaccttcattgtccaaaagattctcctagatgatattgggttgcgctacatctgtgccactgctgagcgtttctttgctgtaggcagtgttttggcaaacatggttgtttcacttgctgatcagccctccacaaggctgctgaagcacatcattcgttgttacctcaggctgtcagataatcccagggcctgtgctgcattgcaaagctgccttcctgatatgctcaaagatgggacatttaataactgtcttagggatgacccagctacaaggcgttggctccaacagctgctgcacaatgtaacaggcgggggaggcatgggaggagctcctcagccaggcctggatcatatgatgggcatatgaagatgaagcagcctagtcgttgcaattcactacaataatacatcatctcagcagtgaattgcaactagagaagatctgtcggctgtccagaagaaaggtagaatggtctagtataactttttccgggggtaaacgaagaagaaaggattgttgtgtggaattaccgtaagcggttaagctgatgtgcgttcatcatgtaatgctgtggaaaacaagcacagcaggctgctcctttcctgtggttgcaccggaactcttttgctttgacagttcagaacctgagaacaaagaggaagaaccccgttccgtgaagctttctctatctgctgatgagttgggaacatgaattgcttttcagatgatgccttaagaaaagcatatcgggcaggagtatgacgagtgctttatttcctgttcagtattgtagcaacatatatctgactatatttgttttagaagggtcgtgtattaaggtaggtcggcctcaatttgtgc

SEQ ID NO: 21132 - protein, 327 aa, Panicum virgatum
  misc_feature: Ceres CLONE 1814737
  misc_feature (48)..(310): Pfam Name: Rcd1 Pfam Description: Cell differentiation family, Rcd1-like
MANLQPSLTIPPSFAGASPPSPSPVAGSSSGPALGQAAKDKKMASAEQLVLELCDPELRENALLELSKKREIFQDLAPLLWHSFGTIAALLQEIVSIYPSLSPPTLSPGASNRVCNALALLQCVASHPETRILFLNAHIPLYLYPFLNTTSKTRPFEYLRLTSLGVIGALVKVDDTEVISFLLQTEIIPLCLRTMEMGSELSKTVATFIVQKILLDDIGLRYICATAERFFAVGSVLANMVVSLADQPSTRLLKHIIRCYLRLSDNPRACAALQSCLPDMLKDGTFNNCLRDDPATRRWLQQLLHNVTGGGGMGGAPQPGLDHMMGI

SEQ ID NO: 21133 - DNA, 732 bp, Panicum virgatum
  misc_feature: Ceres CLONE 1814743
  misc_feature: Encodes the peptide sequence at SEQ ID NO. 21134
acacagccaaaggctagaagcatcctccttcagcagcttgaatcggcggcttccagcgcctctctcttccgatccacgcttctctttctagcaaccgctgctgtctagctgaccatgacgaagcacggcgtagtgctcggccccgaggacgccgtcgtcgcggcggcggcggccgcgcggcatttctcgttcccgccgccgaggacgaggggcgactcgtgcaggaagctggcggcgcaggtcgacctcggcgccgccgtcatggtatcctggctcgactccatgaaggcctcctcgcccaggcacaggctcatggcgcccctggccggcgccgccgacgcggagcacgacgactggatggagcggcacccgtcggcattggaccggttcgacgcgctggcggcggcggccaaggggaagcaggtcgccgtgttcctggactacgacggcacgctgtccccgatcgtcgaggaccccgaccgcgccgtcatgaccgacgagatgagggaggccgtgcgcggcgtggcggcgcgcttcccgacggcgatcgtcagcgggcgttgccgtgacaaggtgttcggcttcgtgcggctggcggagctctactacgccgggagccacgggatggacatccgagggcccaccgccgaccccaaccaccacggcaaggagggcaagtcggtgctgtgccagccggcgagcgagttcctgccggtgatcgaggaggcgtac

SEQ ID NO: 21134 - protein, 205 aa, Panicum virgatum
  misc_feature: Ceres CLONE 1814743
  misc_feature: Useful for making plants with modulated drought sensitivity
  misc_feature: Useful for making plants with modulated flowering time
  misc_feature: Useful for making plants with modulated low light sensitivity
  misc_feature: Useful for making plants with modulated water use efficiency
  misc_feature: The sequence is a functional homolog of SEQ ID NO 16 in US patent 7214858
MTKHGVVLGPEDAVVAAAAAARHFSFPPPRTRGDSCRKLAAQVDLGAAVMVSWLDSMKASSPRHRLMAPLAGAADAEHDDWMERHPSALDRFDALAAAAKGKQVAVFLDYDGTLSPIVEDPDRAVMTDEMREAVRGVAARFPTAIVSGRCRDKVFGFVRLAELYYAGSHGMDIRGPTADPNHHGKEGKSVLCQPASEFLPVIEEA

SEQ ID NO: 21135 - DNA, 724 bp, Panicum virgatum
  misc_feature: Ceres CLONE 1814763
  misc_feature: Encodes the peptide sequence at SEQ ID NO. 21136
atctatagctagtctctcacacaacacaacacaacacaacaccgcgcctcaagcagagagccgcagcagcagcagaggtaatgatgctggatgccatggacgcggcgagcatcatagggtacttcaagggcaagagcatcctcgtcaccggcgcaactgggtttcttggaaagatccttgtggagaagataatgcgcgtgcagcctgatgtccacaagatctaccttcttgtgcgagcgatcgatgagccatctgcaaagcaacgcgtccagcaagaggtgatagacgcggagctgtttgacctcctgagagagaaacatggcaagggcttccagcagttcgtggaggagaaggtggttgcattggccggagacatcatctacgagaacctgggcctggagacacccatgctggaggcgcttgccaaggagatcgacgtcatcgtcaacattgcagcaaccaccaacttctacggaaggtatgatgtttccttggatgtgaacgtgatgggggtgaagcacctgtgccacttcgccaagcagtgcgccaacctcaagatgctcatgcatgtctcgaccgctttcgtgtctggcttcagggaggggctgatcctggagaagcccatcaaccccggcgagtcgctgcgtgaaggcacccacctggacatcgacgccgagctgcgcctcgtcagagaagtcaagaaggagctgacgggcatgaactc

SEQ ID NO: 21136 - protein, 214 aa, Panicum virgatum
  misc_feature: Ceres CLONE 1814763
  misc_feature (22)..(213): Pfam Name: NAD_binding_4 Pfam Description: Male sterility protein
  misc_feature: SWISSPROT Homolog: EC 1.2.1.31 L-aminoadipate-semialdehyde dehydrogenase
MMLDAMDAASIIGYFKGKSILVTGATGFLGKILVEKIMRVQPDVHKIYLLVRAIDEPSAKQRVQQEVIDAELFDLLREKHGKGFQQFVEEKVVALAGDIIYENLGLETPMLEALAKEIDVIVNIAATTNFYGRYDVSLDVNVMGVKHLCHFAKQCANLKMLMHVSTAFVSGFREGLILEKPINPGESLREGTHLDIDAELRLVREVKKELTGMN

SEQ ID NO: 21137 - DNA, 655 bp, Panicum virgatum
  misc_feature: Ceres CLONE 1814770
  misc_feature: Encodes the peptide sequence at SEQ ID NO. 21138
atggcattggcctcccaccactgaccacccccgcccgtcctcttctgcgccgcaagcgcttcggctgctgctgctgacggcggccgccgtcccgtagcgagtgcagccgccgagtcgccaggaaggaaagcagcaaggcaggtgaggaagaagaagaacaggaggggatggcggcaatgccggcggttctgctgctcctcctggtggccgcgctggccgcccccgccgccgcccgcattcccggcgtgtacggcggcggcgactggcagagcgcgcacgccacgttctacggcggcagcgacgcctcgggcaccatgggcggcgcgtgcgggtacggcaacctgtacagccaggggtacggcgtgaacaacgcggcgctgagcacggcgctgttcaacgagggcctgagctgcggcgcctgcttcgagatcaagtgcgagaaccagcccgggtggcggtggtgccgccccgggagcccctccatcctggtgacggccaccaacttctgcccgcccaactacgcgctcccctccgacaacggcggctggtgcaacccgccgcgcccccacttcgacctcgccatgcccatgttcctccacatcgccgagtaccgcgccggcatcgtccccgtctcctaccgccgggtgccatgccg

SEQ ID NO: 21138 - protein, 162 aa, Panicum virgatum
  misc_feature: Ceres CLONE 1814770
  misc_feature (68)..(157): Pfam Name: DPBB_1 Pfam Description: Rare lipoprotein A (RlpA)-like double-psi beta-barrel
  misc_feature: SWISSPROT Homolog: EC 3.2.1.4 Cellulase
  misc_feature: Useful for making plants with altered carbohydrate content
  misc_feature: Useful for making plants with altered cell wall content and/or composition
MAAMPAVLLLLLVAALAAPAAARIPGVYGGGDWQSAHATFYGGSDASGTMGGACGYGNLYSQGYGVNNAALSTALFNEGLSCGACFEIKCENQPGWRWCRPGSPSILVTATNFCPPNYALPSDNGGWCNPPRPHFDLAMPMFLHIAEYRAGIVPVSYRRVPC

SEQ ID NO: 21139 - DNA, 971 bp, Panicum virgatum
  misc_feature: Ceres CLONE 1814794
  misc_feature: Encodes the peptide sequence at SEQ ID NO. 21140
attttctcaactaagaagaagccgccccgccccgtccacggtcgaggaggccggcggccgccatggactgccagcaagctgcgaccaacggcggccaccacgacgacggcgacgccgccgagtggaagcaggtcgccgagctgagggccgtcaccgaggcgcaggaccctgcctgcaaggatgaggacgactacatgctgcggcggttccttcgcgcccgcgaccaccacatcggcaaggcgtcggcgatgctgctcaagtacctcaagtggaagccgacggccaagccccacggctgcatctccgagtcggaggtggcgcacgagctctcccaggggaagctgtacctgcagggccacgaccggcaggggcggcccatgatctacggcttcggcgcccggcaccacccgtccaaccgcgacctcgacgagttcaagcgcttcgtcgtccacgtgctggacgccaccgtcgccaggctgccccccggggccgggcaggagaagttcgccgccgtcgccgacctcaagggctggggctactccaactgcgacatccgggcctacctcgccgcgctggagatcatgcagaactactacccggagcgcctcggccgggtgttcctcatccacgtgccctacgtcttcatggcggcctggaagatcgtctaccccttcatcgacgacaacaccaagaagaagttcgtcttcgtcgccgacaaggacctccacaggacgctccgggaggccatcgacgacgcgcagctgccggagatgtacggcggaaagctcaagctcgcctcgccaagtaattaattaagtggtcactagtacatatactagctgatgatcgccggccggtgatggtacggttcagcagatggagagacgaggaacgtgtgcatcggtgcatgtattattggaggatggtacaatacagtctccagaggtatatagtacgtgtatgcgtacacc

SEQ ID NO: 21140 - protein, 249 aa, Panicum virgatum
  misc_feature: Ceres CLONE 1814794
  misc_feature (93)..(249): Pfam Name: CRAL_TRIO Pfam Description: CRAL/TRIO domain
  misc_feature: SWISSPROT Homolog: EC 3.1.3.48 Protein-tyrosine-phosphatase
MDCQQAATNGGHHDDGDAAEWKQVAELRAVTEAQDPACKDEDDYMLRRFLRARDHHIGKASAMLLKYLKWKPTAKPHGCISESEVAHELSQGKLYLQGHDRQGRPMIYGFGARHHPSNRDLDEFKRFVVHVLDATVARLPPGAGQEKFAAVADLKGWGYSNCDIRAYLAALEIMQNYYPERLGRVFLIHVPYVFMAAWKIVYPFIDDNTKKKFVFVADKDLHRTLREAIDDAQLPEMYGGKLKLASPSN

SEQ ID NO: 21141 - DNA, 635 bp, Panicum virgatum
  misc_feature: Ceres CLONE 1814801
  misc_feature: Encodes the peptide sequence at SEQ ID NO. 21142
ccaaagtcccagccgctctcctcctcctctctgcgtgcgcgctccgccgccgccccacccgcgccgcctgttcgacgagatggcgcagtgggacgctctggtggacgccgcgctcgcgaggctggaggccaggagcctgttgcgcgccacgcgccccatcgcgctcgcgccgccgcctgcggcacccgagaccttcgccggcccggggccctgggaccgcgcagccgtcgagatccggctcgaccacggcaccctccaccagtggctcgccgaaggtggtgaggcgggtgagcaggaagagaagctggacgggaatctgattcttttctcggggaatgactacatgggcctcagctcgcatcccgcagtccgtgaggctgcagtgaaggcagcacaagagtatggcatgggcccaagaggttccgcgttgatatgtggctatacaacttatcacaaattggtggaggaatcattggcagaactcaagaagaaagaggattgccttctatgccccactggattttcggccaacatggctgtgatgacggccctggggagtatcagctctcttttggctgttgggagaaagcctgcagaggatgagagaatagcgatcttctcagatgcactgaacc

SEQ ID NO: 21142 - protein, 185 aa, Panicum virgatum
  misc_feature: Ceres CLONE 1814801
  misc_feature: SWISSPROT Homolog: EC 2.3.1.47 8-amino-7-oxononanoate synthase
MAQWDALVDAALARLEARSLLRATRPIALAPPPAAPETFAGPGPWDRAAVEIRLDHGTLHQWLAEGGEAGEQEEKLDGNLILFSGNDYMGLSSHPAVREAAVKAAQEYGMGPRGSALICGYTTYHKLVEESLAELKKKEDCLLCPTGFSANMAVMTALGSISSLLAVGRKPAEDERIAIFSDALN

SEQ ID NO: 21143 - DNA, 730 bp, Panicum virgatum
  misc_feature: Ceres CLONE 1814809
  misc_feature: Encodes the peptide sequence at SEQ ID NO. 21144
gtcccgtgtcactcaccggccggctcgccacccaccagacaagcgagcggcgaagcagatcaagagcgctgccgagaagttggagtgatggcgttcgcgtccggcgccggcgccggcggcccgcaggtgctgacggcgcggttcgtccggcaggtggtgctcgggcggtggttcatggtgttcgcgtgcctgctcatcctgtcggcgtcgggggcgacgtacatcttcagcatctactccaaggtgctcaagtcgtcgctggggtacgaccagcgcacgctcaacacgctctccttcttcaaggacctgggcgccaacgtgggcgtcctctcggggctcatcaacgaggtgacgccgccgtgggtggtgctcgccatgggtgccgccatgaacctcgcggggtacctgatgatctacctcgccatcgacgggcgcacggcgcggccgcccgtgtggctcatgtgcatctacatctgcgtgggggccaactcgcagtccttcgccaacacgggggcgctcgtcacctgcgtcaagaacttcccggagagccgcggcatggtgctgggcctgctcaagggcttcgtcggcctcagcggcgccatcttcacgcagctctacctcgccatctacggcgacgacgccaagtcgctcgtgctgctcatcgcctggctccccgccgccatctccatcctcttcgtccacaccgtccgcatcatgccgtacccccggc

SEQ ID NO: 21144 - protein, 214 aa, Panicum virgatum
  misc_feature: Ceres CLONE 1814809
  misc_feature (27)..(214): Pfam Name: Nodulin-like Pfam Description: Nodulin-like
MAFASGAGAGGPQVLTARFVRQVVLGRWFMVFACLLILSASGATYIFSIYSKVLKSSLGYDQRTLNTLSFFKDLGANVGVLSGLINEVTPPWVVLAMGAAMNLAGYLMIYLAIDGRTARPPVWLMCIYICVGANSQSFANTGALVTCVKNFPESRGMVLGLLKGFVGLSGAIFTQLYLAIYGDDAKSLVLLIAWLPAAISILFVHTVRIMPYPR

SEQ ID NO: 21145 - DNA, 639 bp, Panicum virgatum
  misc_feature: Ceres CLONE 1814812
  misc_feature: Encodes the peptide sequence at SEQ ID NO. 21146
aaaaggggggcagctccctcgtggcctgtcgccgcccgcctcactccactcctcccctcccctcgccggcctggatctgccgcggggttctcatctctcctgccctgagcagaagccgccgccgccgctgccgcagatgctgcccaccaaccgcggcaggccgcagcagaggccgccgcccagatcttggtccttctcagagatggtggacttctccgaccccaagcgcaggccgcgccacctcagcaagctcgtcatggccgcgctcctcaccgccatgtgcgtcctcatgctcacccagccgccatgccacaggaggcccgcccccagcgtgttctccatccatcaacctggggtcacacacgtgctggtgaccgggggcgccggctacatcggttcgcacgccgctcttcggctcctcaaggactccttcagagtcaccatagtggataatctttcaagaggaaatattggtgcaatcaaggttcttcagaacctgttcccagagcctgggtggttgcagttcatacaagctgatttaggagatccaaaagcagttaacagaatatttgcagagaatgcatttgatgctgtcatgcacttcgctgctgtcgcttatgttggagagagcacacttga

SEQ ID NO: 21146 - protein, 167 aa, Panicum virgatum
  misc_feature: Ceres CLONE 1814812
  misc_feature: SWISSPROT Homolog: EC 5.1.3.5 UDP-arabinose 4-epimerase
  misc_feature: Useful for making plants with altered carbohydrate content
  misc_feature: Useful for making plants with altered cell wall content and/or composition
MLPTNRGRPQQRPPPRSWSFSEMVDFSDPKRRPRHLSKLVMAALLTAMCVLMLTQPPCHRRPAPSVFSIHQPGVTHVLVTGGAGYIGSHAALRLLKDSFRVTIVDNLSRGNIGAIKVLQNLFPEPGWLQFIQADLGDPKAVNRIFAENAFDAVMHFAAVAYVGESTL

SEQ ID NO: 21147 - DNA, 676 bp, Panicum virgatum
  misc_feature: Ceres CLONE 1814830
  misc_feature: Encodes the peptide sequence at SEQ ID NO. 21148
aacaaatccgtatcccgacgccggcgacggccagaccagacgccggtatcgagtccacactgccaccccatccatcacacacctgtcctcccatccgcttcgccgcgccgcgccgcctcggcaccccaatctcaatcacacgcgcgccacccgcgatgacgccgccgccgtgtccactcccgccgcgtccgccgccgcggggaaagatgccaaacaggctcctaaggatttccttcatatcaatgattttggcaaggatacgatcatgaatatccttaatcgggcgattgaggttaagacactgataaaatctggagacaggagcttccaaccgttcaaagggaaatcaatggcgatgatttttgccaagccgtcaatgaggacccgtgtttcatttgagacaggattcttcttacttggtgggcatgctatctatttgggtcctgatgatatccaaatgggcaagcgtgaggagactcgtgatgttgctcgagtactctctggctataatgacatcattatggctagggtttttggtcaccacgatattctggacttggcgaaatatgcatctgtacctgtcataaatggtctcactgactataaccatccatgccagataatggctgatgcacttactatgcttgagcacattggtcgtattgaaaacaccaaa

SEQ ID NO: 21148 - protein, 224 aa, Panicum virgatum
  misc_feature: Ceres CLONE 1814830
  misc_feature (75)..(217): Pfam Name: OTCace_N Pfam Description: Aspartate/ornithine carbamoyltransferase, carbamoyl-P binding domain
  misc_feature: SWISSPROT Homolog: EC 2.1.3.3 Ornithine carbamoyltransferase
  misc_feature: Useful for making plants with modulated nitrogen use efficiency
TNPYPDAGDGQTRRRYRVHTATPSITHLSSHPLRRAAPPRHPNLNHTRATRDDAAAVSTPAASAAAGKDAKQAPKDFLHINDFGKDTIMNILNRAIEVKTLIKSGDRSFQPFKGKSMAMIFAKPSMRTRVSFETGFFLLGGHAIYLGPDDIQMGKREETRDVARVLSGYNDIIMARVFGHHDILDLAKYASVPVINGLTDYNHPCQIMADALTMLEHIGRIENT

SEQ ID NO: 21149 - DNA, 726 bp, Panicum virgatum
  misc_feature: Ceres CLONE 1814835
  misc_feature: Encodes the peptide sequence at SEQ ID NO. 21150
actcgagcacgcatcggcagcgcgccgtcctcctgctccgtcctcctccgccgccgccgtcgcggaagggaaggatccgtccctccgaccgggcttcggttggtctcgccctcgccggggtgagaggtgacgggacggcggtatgaggcagtggttatgttgtaactgccactttgatgacgaggaagatggccatgacaaggagcaatccaaagttcagagcaataagatagacccgaagcagaagtcttcaaagcctcctgttagtcaacctgagccagagatttcccctcctacaattgatgtccctgacttatcattggatgacttgaaagaaaagactgataattttggatccagagctctgattggtgaaggatcttacggacgagtatatcatgccactttggatgatgggaggcaagcagctgttaaaaaacttgatgcgtctgaaaatgaacctaatgatgagttcttgaaacaggtctcactggcatcaaagctaaaacatgaaaatcttgttgagatgttgggttactgtgtggagggaaattaccgtatactggcatatgaatttgcaaccatgggttctcttcatgatgttttgcatggaagaaaaggcgtccagggtgcacagcctagacctgtgcttgactggatgcaaagggtcaaaattgctattgaggctgcaaaaggtatagaatatctgcacgaaaaggttcagcc

SEQ ID NO: 21150 - protein, 194 aa, Panicum virgatum
  misc_feature: Ceres CLONE 1814835
  misc_feature (58)..(194): Pfam Name: Pkinase_Tyr Pfam Description: Protein tyrosine kinase
  misc_feature: SWISSPROT Homolog: EC 2.7.11.1 Non-specific serine/threonine protein kinase
MRQWLCCNCHFDDEEDGHDKEQSKVQSNKIDPKQKSSKPPVSQPEPEISPPTIDVPDLSLDDLKEKTDNFGSRALIGEGSYGRVYHATLDDGRQAAVKKLDASENEPNDEFLKQVSLASKLKHENLVEMLGYCVEGNYRILAYEFATMGSLHDVLHGRKGVQGAQPRPVLDWMQRVKIAIEAAKGIEYLHEKVQ

SEQ ID NO: 21151 - DNA, 1662 bp, Panicum virgatum
  misc_feature: Ceres CLONE 1814849
  misc_feature: Encodes the peptide sequence at SEQ ID NO. 21152
aaaacctaaaccctcaccacgcttctcgatccttcctttctccatctcccacccccgtctccgacctccctccccttgcgcccgcacgaacaaagccgagcgagcgaggagccgacgagccttcccgtcctcgaagcctctctcccctccgaggcgcagccatggcgaccgtcatgcagaagatcaaagatatcgaggatgagatggcaaggacgcagaagaacaaagccactgctcaccatcttggtcttctgaaggctaaacttgcaaaattacggcgggagttgctcactccaacatccaaaggtggtggtggtgcaggtgaaggatttgatgtcacgaagagtggagatgcacgtgttggtttagttggttttccctctgttgggaaatcaacattgctgaacaagttgacaggaacattttctgaggttgctgcctacgagtttacaactttaacatgcattcctggagtcatcatgtataaaggtgccaagattcagcttctagatcttccagggatcattgaaggtgctaaagatggaaagggtagaggaaggcaggttatcagcacggctaggacatgcaatgttattttgattgttcttgatgctataaaaccaataacacacaagcgtctcattgagaaggaacttgaggggtttggcattaggttgaacaagacaccacccaatttgacattcagaaaaaaggacaagggcggaatcaactttacatcaacagtgacaaacacacacttggaccttgagacagtaaaagccatctgtagtgagtacaggatccataatgctgatgtgtccctgagatatgatgcaacagcagatgatctcatagatgtcattgaaggaagccgcatttacacaccgtgcatctatgttgtgaacaagattgatcagataacacttgaagagctagaaatcttggacaagcttccccattactgcccgattagtgctcacctcgagtggaatctcgacggacttctggagaagatatgggaatacttggatttggttaggatatacacaaaaccgaaagggctgaacccagattacgaggatcctgttattgtgtcatcgaagaagaaaacagtggaagacttctgcaacagaatccacaaggatatggtgaaacaatttaaatatgctctggtatggggttccagtatcaaacataagccacagaaagttggcaaggagcatgagcttgaggacgaggatgttgtccagatcattaagaaaatataggtatacagtggaatgacagctgtttacaaaactgaaggagagatgaggattttgagtagttgcctcatgggttgctgtgatggtcatatgcccttggttcacctatactgcgttgaacaaaagacaatgtagacatgttttcttttgccgcaaatcatgtcctccgttgcttggtgccatgtggagtcagtgagtcatcaatgtaccaagtgtcctaccagtaccgtcgaacacatggagagatgctctccatatctttagaggataatgataagatgattcttgtactgcgagtgttccttctttgttaggtgtacctttttctagtgtatcacaagtgtcacaccttttgtacgtacattttctaatgaaatggctgtaggagcttattagt

SEQ ID NO: 21152 - protein, 368 aa, Panicum virgatum
  misc_feature: Ceres CLONE 1814849
  misc_feature (292)..(366): Pfam Name: TGS Pfam Description: TGS domain
  misc_feature (65)..(176): Pfam Name: MMR_HSR1 Pfam Description: GTPase of unknown function
MATVMQKIKDIEDEMARTQKNKATAHHLGLLKAKLAKLRRELLTPTSKGGGGAGEGFDVTKSGDARVGLVGFPSVGKSTLLNKLTGTFSEVAAYEFTTLTCIPGVIMYKGAKIQLLDLPGIIEGAKDGKGRGRQVISTARTCNVILIVLDAIKPITHKRLIEKELEGFGIRLNKTPPNLTFRKKDKGGINFTSTVTNTHLDLETVKAICSEYRIHNADVSLRYDATADDLIDVIEGSRIYTPCIYVVNKIDQITLEELEILDKLPHYCPISAHLEWNLDGLLEKIWEYLDLVRIYTKPKGLNPDYEDPVIVSSKKKTVEDFCNRIHKDMVKQFKYALVWGSSIKHKPQKVGKEHELEDEDVVQIIKKI

SEQ ID NO: 21153 - DNA, 692 bp, Panicum virgatum
  misc_feature: Ceres CLONE 1814872
  misc_feature: Encodes the peptide sequence at SEQ ID NO. 21154
gtgctctctcagaggtgggttggcttctcctccccctccggttcgcggttcggttcggtccgggttcgtgaggttcttgggggtgagaggaagagatggcggcgtcggatgttgagtaccgctgcttcgtcggcggccttgcctgggccaccgacgacaactcgctccacaacgccttcagccccttcggcgaggtcctcgagtccaagatcatcctcgatcgtgagacccagaggtcccgcggcttcggcttcgtcaccttctcgagcgagcaggcgatgcgcgatgccatcgaggggatgaacggcaaggagctggacggccgccgctgccgccatctcctcctcttccacccgccccatcttctcgtcacggcccaatcgcatcctcctcgcccgcttcttccccgccgcgccggcgccgtccggggcgagggggctccggacgtccgcggctgcggcggctgcggccgtcgaggtgggcggcgtcaagatcgcgcgcgacgatgttgtaaaggaggatgacccgacaaacaatgtgccagatactatcttttcgaagattggactgcagctgcacaggagggacaaccaccctctagggattctgaagaacactatttatgattactttgacaagaactttgccgggcagtttgacaagtttgatgatctttgccctcttgtctctgt

SEQ ID NO: 21154 - protein, 142 aa, Panicum virgatum
  misc_feature: Ceres CLONE 1814872
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with modulated flowering time
  misc_feature: Useful for making plants with altered lignin content
MAASDVEYRCFVGGLAWATDDNSLHNAFSPFGEVLESKIILDRETQRSRGFGFVTFSSEQAMRDAIEGMNGKELDGRRCRHLLLFHPPHLLVTAQSHPPRPLLPRRAGAVRGEGAPDVRGCGGCGRRGGRRQDRARRCCKGG

SEQ ID NO: 21155 - DNA, 722 bp, Panicum virgatum
  misc_feature: Ceres CLONE 1814878
  misc_feature: Encodes the peptide sequence at SEQ ID NO. 21156
aggagagcacgcatcaagaagctagtacgacacgccgcgcgcagatggcgtcgacgatcatggccgccacctcccgcgtcctcgccgcctagaccccgttcctcggccagggccgcgccgccgccgttgccaggccgctccgcgacgtcctcgccgccgccgccgccagcggccggatcaccatgggcaacgacctgtggtacggccccgaccgcgtcaagtacctgggccccttctccgcccagacgccctcctacctcaccggcgagttccccggcgactacggctgggacacggccgggctctccgccgacccggaggcgttcgcgcgcaacagggcgctggaggtgatccacgggcggtgggcgatgctgggcgcgctggggtgcatcaccccggaggtgctcgagaagtgggtgcgcgtggacttcaaggagcccgtctggttcaaggccggcgcgcagatcttctccgagggcgggctcgactacctgggcaaccccaacctggagcacgcgcagagcatcctcgccgtgctggggttccaggtcgtgctcatgggcctcgtcgagggcttccgcatcaacggcctcgacggcgtcggcgagggcaacaacctctaccccggcggccagtacttcgaccccctgggcctcgccgacgaccccgtcaccttcgccgagctcaaggtcaaggagatcaagaacggccgcctcgccctg

SEQ ID NO: 21156 - protein, 179 aa, Panicum virgatum
  misc_feature: Ceres CLONE 1814878
  misc_feature (21)..(179): Pfam Name: Chloroa_b-bind Pfam Description: Chlorophyll A-B binding protein
MGNDLWYGPDRVKYLGPFSAQTPSYLTGEFPGDYGWDTAGLSADPEAFARNRALEVIHGRWAMLGALGCITPEVLEKWVRVDFKEPVWFKAGAQIFSEGGLDYLGNPNLEHAQSILAVLGFQVVLMGLVEGFRINGLDGVGEGNNLYPGGQYFDPLGLADDPVTFAELKVKEIKNGRLA

SEQ ID NO: 21157 - DNA, 705 bp, Panicum virgatum
  misc_feature: Ceres CLONE 1814882
  misc_feature: Encodes the peptide sequence at SEQ ID NO. 21158
cgtccgtgctgactcatttacacatcctcctccctcttcttcccctcctcccttccatttctctcctcttccaccaaatccaacccatagaaattctccaaaaatttccagatcaaaccctcggatcctccgagcccctcgagaatccggccgaattgcctctccgctgcgtcgtgatccggctcgatcccatggagcgcgttttctccgtggaggagatccccaacccctactgggccccgccgcagcctcaggcggcggcaaccagcgctgttgccgcgccaggagtcggtggcggaggaggagcggggggagcgggggacgcggcgggcgcgatgaaccggtgctcgtcggagtggtacttccagaagttcctggaggaggccgtgctcgacagcccggggcccgtggcgggcgtggagaggggcggcggtggaggtggagctgaggcggcggagagcaagccgctgggggtcgcggcggcggcctcgagcgcggttgttgacccggtggagtacaacgcgatgctgaagcagaagctggagaaggacctagctgccgtcgccatgtggaggggctctggtgcgacgcctccagaacgttctgcagctggttcgtccttgccaaatgtggatgtttcgcatgcagttgcctttaaacgcgttggaggtaatggaattccagttgaaaacaagctagctgtcg

SEQ ID NO: 21158 - protein, 171 aa, Panicum virgatum
  misc_feature: Ceres CLONE 1814882
  misc_feature: Useful for making plants with modulated endosperm cell number
  misc_feature: Useful for making plants with modulated endosperm size
MERVFSVEEIPNPYWAPPQPQAAATSAVAAPGVGGGGGAGGAGDAAGAMNRCSSEWYFQKFLEEAVLDSPGPVAGVERGGGGGGAEAAESKPLGVAAAASSAVVDPVEYNAMLKQKLEKDLAAVAMWRGSGATPPERSAAGSSLPNVDVSHAVAFKRVGGNGIPVENKLAV

SEQ ID NO: 21159 - DNA, 701 bp, Panicum virgatum
  misc_feature: Ceres CLONE 1814887
  misc_feature: Encodes the peptide sequence at SEQ ID NO. 21160
gttgactccctcacccaccctgccccctggcgctctcttgctggcctttctttcctggcagcgacgactgggcgtttgggcgagacatcctacgcgaggttttcgtcggctcagccccggcggcaagtatatccaccagggacgcccttccgttccatttcgtcctcttcccttcccgctgtgcgaaatcgatctccccaaaccttgtgatggaaggggaggcagacatcgtggttggttcttgttctaagccatgtgggcccttggaggaatactgcattccagattacattctgaagccggattgccaacaagtgatggtcaatcatgctccttcctgtcctgtagtagtgttcatcaactcaaggtctggcggccaacttgggagtagtctgatcaaagcataccgtgagctcctcaatgaagcacaggtttttgacctctcagaagaggctccagataaggtgttgcaccgtttatatgtcaaccttgaaagactcaagatggaaggagacattcttgctgttcaaatttggaggaggctgaggctaattgttgcaggcggtgatggtacagctagctggctgcttggggtggtcagtgaccttaagcttgctcacccacctccagtcgcgactgtgcctctgggaacaggaaacaaccttcccttttcatttggatggggaaagaagaatccttct

SEQ ID NO: 21160 - protein, 163 aa, Panicum virgatum
  misc_feature: Ceres CLONE 1814887
  misc_feature (45)..(163): Pfam Name: DAGK_cat Pfam Description: Diacylglycerol kinase catalytic domain (presumed)
  misc_feature: SWISSPROT Homolog: EC 2.7.1.107 Diacylglycerol kinase
MEGEADIVVGSCSKPCGPLEEYCIPDYILKPDCQQVMVNHAPSCPVVVFINSRSGGQLGSSLIKAYRELLNEAQVFDLSEEAPDKVLHRLYVNLERLKMEGDILAVQIWRRLRLIVAGGDGTASWLLGVVSDLKLAHPPPVATVPLGTGNNLPFSFGWGKKNP

SEQ ID NO: 21161 - DNA, 2601 bp, Panicum virgatum
  misc_feature: Ceres CLONE 1814900
  misc_feature: Encodes the peptide sequence at SEQ ID NO. 21162
aagagcaccaacaccgaacaaaaacataatcaaattgcgagcccagaaatacaaggaaaaatattgctcctgcaactcgtgcggcgcactcctccactgttctggggaatcttgggaggaagagagtctctgagctccctgccagttcgtggcgcgagtggcttcatggtttcttgacgtcctctcctcttgatccaagaactcggggggttcttggattggccggccatgtcggtctcgtccccgtccatgtgcggcggcggggagaccgggaagaggatcgtggtgtggttccggagggacctcagggtggaggacaacccggcgctagcggcggcggcgcgcgcgggaggggaggtggtgccggcgtacgtgtggtcgccggaggaggacggcccttaccatccggggcgcgtgtcccggtggtggatcagccaaagcctgcagcacctggacgcctcgctccgccggctaggcgctggaaagctcgtcacgcggaggtcagccgacgccgtcgtcgcgctgctccagctggtccgcgacaccggcgccacgcacgtctacttcaatcatctctacgaccctatctcactggtcagggaccaccggctaaaggagatgctgacggctgagggcatcgttgtgaattctttcaatgcggatctgctgtatgagccatgggaagttgttgacgatgaagggcagccattcaccatgtttgccccattctggaacaggtgcctcagcatgccgtacgatcccccagcgccgcttctgcccccgaagaagatcaattcaggtaacttatcaatgtgcccatccgatgatctgatctttgaggatgaatcagagaggggaagcaacgctcttctggcccgagcatggacaccaggatggcagaacgcagacaaggcgctaacggccttcctcaacggtcctctggctgactattcagtgaaccgcaagaaggctgatagtgcaagcacatccctactttcacctcacctccattttggtgagcttagcgtgcgaaaggtcttccacctagttcgaatgaaacagcttgtgtggagcaacgagggcaaccacgctgctgaggaaagctgcaccctgttcctgcgttccattggcctgcgggagtactcccgctatctgagcttcaaccatccaagcagccatgagaggcccctcttggcacacctcaggttcttcccctgggtagtcaatgagtgctacttcaagatttggaggcagggaaggactggatacccgcttgtggatgctggcatgagggaactgtgggcgacagggtggttgcatgaccgaatacgtgtagtggtgtcaagcttctttgtcaaggtccttcaacttccatggcgatggggtatgaagtacttctgggacactttactggatgcagatcttgagagcgatgcactgggctggcagtacatcactggctctctccctgatgggcgagagcttgaccggattgacaaccctcagtttgaaggctacaagtttgacccgcatggggagtatgtccgacggtggattccggagcttgcaaggctgccgacagaatggatacatcacccatgggatgcacctgtttctgtgctacaagctgcaggaattgagttgggctccaactatcctctccccatagttgagctagacgcagccaaagccaggctgcaagaagccctgtcagaaatgtggcagctggaagctgcatcaagggccacaatgaacaatggaatggacgaaggtctcgatgactcctcggaggttccaccgattgagtttcctcaagaattacagatggaaatcgatcggcagccagcccaggcaacggccaatgtgtcgatgactgctcgaaggcgtgaggatcagatggtgcctaccatgacgtcttcactgaacagagctgaaacagaggtttctgccgacctggggaacagtgaggacactagagcacaggttccgtttcatgcacatttcgaacctcgagttgagagggaagatgcaatccaaaatgcagaaggccctgctcctagaatcaatggagttcaccagcacaacatctttcagcaacctcagcctcgtaggcgagaagctgttgcgccatccgtgtcagaggcttcgagtagctggaccgggagagaaggcgctgtagtcccagtttggtcacttcctgcagcgtcaggccattcagaaacttttgctgctgatgaagctgacgtttctagtaggagttatttggataggcatccacagtcgcaccggttgatgaactggagtcagttatcccagtcattgtgagttcagatgcaccgtaacccactcactgttctcagacaacaggctgggaagtggaaaattccgtgcagccaaacttaatcggttagggtcttctgaagacggattcatatgtaaattttccagtctgttgctcatagtctggtgggcatgcaaaccaggctgctcgttcctgtatgtgataatagtcgtgtaaatctaatccgctagaacttgtgtgatcgacatagggtgcttaaaaaagtcactattattgatcaaacaatgaagatttcctgc

SEQ ID NO: 21162 - protein, 698 aa, Panicum virgatum
  misc_feature: Ceres CLONE 1814900
  misc_feature (220)..(498): Pfam Name: FAD_binding_7 Pfam Description: FAD binding domain of DNA photolyase
  misc_feature (16)..(189): Pfam Name: DNA_photolyase Pfam Description: DNA photolyase
  misc_feature: SWISSPROT Homolog: EC 4.1.99.3 Deoxyribodipyrimidine photo-lyase
  misc_feature: Useful for making plants with modulated light quality response
  misc_feature: Useful for making plants with modulated low light sensitivity
  misc_feature: Useful for making plants with modulated nitrogen use efficiency
  misc_feature: Useful for making plants with modulated light quality sensitivity
MSVSSPSMCGGGETGKRIVVWFRRDLRVEDNPALAAAARAGGEVVPAYVWSPEEDGPYHPGRVSRWWISQSLQHLDASLRRLGAGKLVTRRSADAVVALLQLVRDTGATHVYFNHLYDPISLVRDHRLKEMLTAEGIVVNSFNADLLYEPWEVVDDEGQPFTMFAPFWNRCLSMPYDPPAPLLPPKKINSGNLSMCPSDDLIFEDESERGSNALLARAWTPGWQNADKALTAFLNGPLADYSVNRKKADSASTSLLSPHLHFGELSVRKVFHLVRMKQLVWSNEGNHAAEESCTLFLRSIGLREYSRYLSFNHPSSHERPLLAHLRFFPWVVNECYFKIWRQGRTGYPLVDAGMRELWATGWLHDRIRVVVSSFFVKVLQLPWRWGMKYFWDTLLDADLESDALGWQYITGSLPDGRELDRIDNPQFEGYKFDPHGEYVRRWIPELARLPTEWIHHPWDAPVSVLQAAGIELGSNYPLPIVELDAAKARLQEALSEMWQLEAASRATMNNGMDEGLDDSSEVPPIEFPQELQMEIDRQPAQATANVSMTARRREDQMVPTMTSSLNRAETEVSADLGNSEDTRAQVPFHAHFEPRVEREDAIQNAEGPAPRINGVHQHNIFQQPQPRRREAVAPSVSEASSSWTGREGAVVPVWSLPAASGHSETFAADEADVSSRSYLDRHPQSHRLMNWSQLSQSL

SEQ ID NO: 21163 - DNA, 1716 bp, Panicum virgatum
  misc_feature: Ceres CLONE 1814908
  misc_feature: Encodes the peptide sequence at SEQ ID NO. 21164
tgctggtgcgggggagggaaagcggcgtcgcacctcgcagcgcagcgcaccgcaccgcaccggcctcccctcgggccgtcatgctgccgcgcacgcactcccactcggcgcggcggcgctccgggctgggcccgcagctctgcgccgccgtcgccgcgctcctcctgctcctctccctcgccgtcctccactcgcgcctctcgtcgtcgtcgtcctccaacttcccaacctcccgctcccactccacagccgccgactccaactcatccgccgccctcctcgccgacgaagaagtcgccgaggacgtggccgccgcgctcgacccgctgctcgccgtcaccaccacgaccaccgccgccgacggcggcggaggcgccgtcgctaaccccgacgacgaccgcatcgacgagctcgacgtgctggacgaggacgccgcgggcgccgacgcggccgacgatgccaccgcctccgcggcggccgccacgtccctcgtctgggaccacgtcgccggcgccgcccgcctgccgttccgcctccccgccgccggcgaatccctatcctctggactcccccgcctcgactccccgcgccggatcgttgccgccgcctttggatcggacgacgagctggtggatctggaactgcgggtggagatctcgtctatcgccggcatcgaggacgccctactcctgaagcccgcctccgccaagggcgccgagacgcggctccgggccgggtgggcgcggtggctcgagggtaaggccgactacctccggcgcgatcgcatgctccgctccaacctggagtcactcaatccgcgcaatcacccgctgctccaggaccccgacagccccggcctcacctctctcacccgtggtgaccgcatggtgcagcggatgctactagctgagctcgacaaacctgcgtcgaagaattttgagcggcgtaggctccaatcttacgaaaacgagcagggcatgagagcagctgtgaaggtgaagcaacagaagggaaggaggtggggatatttcccggggattgatccccatttggggttctcggagttcatggagaggttcttcgagcttgggaagtgctccatgagggtgttcatggtgtggaacagcccacagtgggcgtatggtatccgacaccagcgtggattggagagcctgctcaagcagcacccagacgcctgcgtagtcatgctatcagagacgctggagcttgaatccttccaggaatttgtgaaggaaggatataaagttgctgttgcattgccgaatcttgacgagcttttggaaagcactccaactcatgagtttgcatcattgtggtatgaatggaggcagacaaaatattacccgctgcactacagtgagctaatacgccttgctgctctttacaaatatggtggaatataccttgactctgatattattgtacttaaacctttaacatcgctccgaaatactattggtgccacaaattctgtacctggaagttccagttatagtggtgctgtgctagcatttgaaaaacagagcccgttattggaggagtgtcttaaagagttttattcaacatatgatgataccctcttgcagtggaatggtgctggacttatgacaagagtaataagcaatctatctagcaaagcagatgaaaatatgtggcatcttcacacaaaactggagccctctgctacattttacc

SEQ ID NO: 21164 - protein, 545 aa, Panicum virgatum
  misc_feature: Ceres CLONE 1814908
  misc_feature (394)..(480): Pfam Name: Gly_transf_sug Pfam Description: Glycosyltransferase sugar-binding region containing DXD motif
  misc_feature: SWISSPROT Homolog: EC 2.4.1.228 Lactosylceramide 4-alpha-galactosyltransferase
MLPRTHSHSARRRSGLGPQLCAAVAALLLLLSLAVLHSRLSSSSSSNFPTSRSHSTAADSNSSAALLADEEVAEDVAAALDPLLAVTTTTTAADGGGGAVANPDDDRIDELDVLDEDAAGADAADDATASAAAATSLVWDHVAGAARLPFRLPAAGESLSSGLPRLDSPRRIVAAAFGSDDELVDLELRVEISSIAGIEDALLLKPASAKGAETRLRAGWARWLEGKADYLRRDRMLRSNLESLNPRNHPLLQDPDSPGLTSLTRGDRMVQRMLLAELDKPASKNFERRRLQSYENEQGMRAAVKVKQQKGRRWGYFPGIDPHLGFSEFMERFFELGKCSMRVFMVWNSPQWAYGIRHQRGLESLLKQHPDACVVMLSETLELESFQEFVKEGYKVAVALPNLDELLESTPTHEFASLWYEWRQTKYYPLHYSELIRLAALYKYGGIYLDSDIIVLKPLTSLRNTIGATNSVPGSSSYSGAVLAFEKQSPLLEECLKEFYSTYDDTLLQWNGAGLMTRVISNLSSKADENMWHLHTKLEPSATFY

SEQ ID NO: 21165 - DNA, 211 bp, Panicum virgatum
  misc_feature: Ceres CLONE 1814908-R
ggtgtgtggtgcttaacgagagactctgggaaggagatgtcactggcggacatgcgacaagcgcggtgtgactatcttctgcataaacagcatcggcgagtcgcagacggggctgggggtggtttggtttgaagctcaaggagacagcctgggggggggagttcaagggcccggtggaggctgataaagtgaggactgatcttagcaggag

SEQ ID NO: 21166 - DNA, 2323 bp, Panicum virgatum
  misc_feature: Ceres CLONE 1814911
  misc_feature: Encodes the peptide sequence at SEQ ID NO. 21167
atctatctcctccctttgtttctttcttcccttctctcgggctctctctctctcctcccttgctcttccttccctccctggcggcggcgacggctgggcgagcggcggcgccaggtcttcgtccagccctttgccggcgacgagcatcctccagataccaatgacatccatcaaccacttcacaaaagaaggcacatctgtactgcagcccatatatactgtactgcaagcggttttgcaatatatgccaagcggttttgcaatatatgccaagcgggggcaatatgaagtttgaggaagatggccatttgctatctcaggcaaaaagggatttgtcacgtgtggattatcaaacacagccttcggagtccaactatgttactgaccttagatcacatgcatattctgaggatcgtttgccgctgggaagagaatgtcagaggcagaagtcacaccttcctacttcaagctgttcttgggaaaactcttctgcattagaagcagcagcaccaccaccaagtagcccagatgcattagggcatgcattcgggaaaatgagaaccaaaaccaacaccctcagtgcaagaccacattatcgtgcttcatatcctgccactgctcttcacatgacaaagcatctaggagaagttgaactcgattatggtttaaatcattctgatcgttgttgcagaagatcagaccgatttactgccttgtcaagccgcagtggtcaatctgtagaaaattgcagtgagctgggcgattatgccagtgccccccactatgtagatgggatcaatcctatttcacgtcaatggtgctttgatgatggaggcccttcggtaccaagagggctgcagtatggcgatgagatcccttctttgtctagtaagaagcataatgggctaccttcactctcaagccaatggcactacgatcttcaaaccccattgttctcaagaagacaggagtatggtgatgagatcccgtcactgtctccaaattggcgttaccgatataagattcctctgcactctggtcattggtgccatgatgctgaggcacctgcaccatcaaggtaccggcaaggtgcttctcattggaatggtcactcaagacaaaattttgccaggattaataccaatgagcaatccaaagttaccacaagcaaacatgcttttatgaaacataggatggtcaacagagttgtaaacagtagtatccaccacaggaccaatatgaaagataataggtgcagaaatcctgaggatataaaggaccaagttcgtgggccaagagcaagtaaattgaataatacttcagcttcatccagtgtgaaagatatctcaagtccatttgtctgtagggatcaaattaatagatccgacttttcagttcagtataaacaggccaagtttttcatgataaaatcatatagtgaagacgatattcataaaggtatcaaatacaacgtttgggcaagtacagcaaacgggaatgataaacttgatgctgcttaccatgaagctcaaattttaatgaaagagaatggggagaactgtcctgtgttcctattcttctcggttaacaccagcggacagtttgtagggttggctgaaatgttaggccctgttgatttcaagaagaccatggatttctggaaaggagataaatggaatggctttttccctataatatggcatattataaaggacattccaaatcttctgttcaaacatataattcttgaacacaatgattacagaccagttacttttagtagggacactcaggagattgggttggcacaaggtatgcaaatgttgaaaattttcaaggatcaccttcagggaacatcaattctggatgattttgatttttatgaagaaaaagataatgcatgccgtgcccaaaagggcgaaaacccagagtcaacacatcaagctagattttctgaagacttggagccgatgggaaatttggaggcacgcatggagagctggagtttgtacgagaattgggactagtgcacagatcactgtacaactgaaataaagagcattatttatgagtcagtaaagtagctgaaggcactgacgctcctttggagaacaattccaaccaaaaattgtctatacgtgtcatctgaaactgctttattgttatacagtgtttatgtagtagcataggtgtattggtaaacagagacgtgaagagattttagcaccggagatttcctgaaaccagggtacttcgatatttccagaattctggttacttgtcaaatgtgagttttgagccttgttgcttgttactacttttt

SEQ ID NO: 21167 - protein, 580 aa, Panicum virgatum
  misc_feature: Ceres CLONE 1814911
  misc_feature (430)..(520): Pfam Name: YTH Pfam Description: YT521-B-like family
MKFEEDGHLLSQAKRDLSRVDYQTQPSESNYVTDLRSHAYSEDRLPLGRECQRQKSHLPTSSCSWENSSALEAAAPPPSSPDALGHAFGKMRTKTNTLSARPHYRASYPATALHMTKHLGEVELDYGLNHSDRCCRRSDRFTALSSRSGQSVENCSELGDYASAPHYVDGINPISRQWCFDDGGPSVPRGLQYGDEIPSLSSKKHNGLPSLSSQWHYDLQTPLFSRRQEYGDEIPSLSPNWRYRYKIPLHSGHWCHDAEAPAPSRYRQGASHWNGHSRQNFARINTNEQSKVTTSKHAFMKHRMVNRVVNSSIHHRTNMKDNRCRNPEDIKDQVRGPRASKLNNTSASSSVKDISSPFVCRDQINRSDFSVQYKQAKFFMIKSYSEDDIHKGIKYNVWASTANGNDKLDAAYHEAQILMKENGENCPVFLFFSVNTSGQFVGLAEMLGPVDFKKTMDFWKGDKWNGFFPIIWHIIKDIPNLLFKHIILEHNDYRPVTFSRDTQEIGLAQGMQMLKIFKDHLQGTSILDDFDFYEEKDNACRAQKGENPESTHQARFSEDLEPMGNLEARMESWSLYENWD

SEQ ID NO: 21168 - DNA, 1883 bp, Panicum virgatum
  misc_feature: Ceres CLONE 1814912
  misc_feature: Encodes the peptide sequence at SEQ ID NO. 21169
gcaaacgaatctcgtcttgcctcgctgctcgcctagccgcgtgcgtgcgactgtgagccgtgaggagcgccgccgccgccgccgccgccgcgcctctccttgtcaccgccggcgcccctcttctcgtcccggccgctgcactcgcaggtgccggtatcgcatatcttcccgtcaccttcgccgccgcctgctgccctgcctccgcctccgccgtcaaaccctaagtgggccgtcgacttcacccgcgaggtgctaccaattttgaaagatggtggatgacgaacaggcaccaagttctaggaagagggttgctggtacccaaatcaacaaggataatcctgagcctgatgatgacggaccagagcaagagatgggtacatttaagaaagctcccgaggaagtgatggcaacccgaagaattgtaaaggttcggcgccagcagccgtcctcagctccttcttctaatcctttctctgcaatcagatttacccccacggattctagtgttcaagcaagtgcccctgtcacagaacctcaaccttcagaagtcaaagctgatgagggcagcaatggtaatgctaaagaaactttgcctatgtcggacaagaatgctagctctggtgaggtaactgagattcagaaggaagaatcagctgtgaaaactgaatctggtgccacaactgaagcgccgcctcaacctgttgaaaccagtgacaaggcagaatctggtggagacaaagtagtagttggagaacccaaggaaggtgacagtacgccatctgaagttgagggcaaaacgaaggacggagatgctgaagaaaagaaaggggcagatgaagctggaaatgaagataaaatcagtaaggatgatactgagaaaaaagatggaggtgaatcagagaccaaggatgggttatctgatgagcagaaagatgctgatagcaaagggcagtcctcatcatcagcacctcttttctcctttaagaatctgtcaagtggtcaaaatgccttcacaggtctggctggaactggattttcaagcacatcattctcatttggctcggcatctaaagatggatcaagtgctggtcctctatttgggctgaagcctgatggttcttcagtcccttcttttaaccttggtgctaccaacaatggtggttcctccacagtgcgcgctacttcaggagaggcacccaagaaatttgctatgacagagggccctgttgaaactggtgaagaaaacgagaaggctgtatttactgctgactctactttgtatgagtatttagatgggggctggaaagaacggggaaaaggtgaactgaagctgaacgtctctgtatctggtgatgagagagcccggctcgtcatgaggaccaagggaaattaccggctggtcctgaacgcgagcctctacgacgacatgtcgctcaaggacatggacaagaagggagtgactttcgcctgcatgaacagcatcggcgagtcgcagactggcctcgcgacgtttgctctgaagttcaaggacaccgccatgagggaggagttcaagggcgcggtggaggctcacaaagtgaggaaggcacctgacacaacgctgaacacgcccgagaactccccaaaggcagccgaggtctgaagcctgccaatcatgcttacgcattcttagtaaccagttcaggaaaaaggagctgagagatactgtctgttatttgcggagttttaagcaagatgtcgtcctgagttgtattcttagtaaccgtacgagtctttttcaaaagagtaaccgtatgagttttacggatacggtttcctgatgttgttttttgggggaacagtgggtatcctggcgaagcttattaaagtcataatcttggtat

SEQ ID NO: 21169 - protein, 457 aa, Panicum virgatum
  misc_feature: Ceres CLONE 1814912
  misc_feature (10)..(289): Pfam Name: NUP50 Pfam Description: NUP50 (Nucleoporin 50 kDa)
  misc_feature (319)..(438): Pfam Name: Ran_BP1 Pfam Description: RanBP1 domain
  misc_feature: SWISSPROT Homolog: EC 3.4.21.72 IgA-specific serine endopeptidase
MVDDEQAPSSRKRVAGTQINKDNPEPDDDGPEQEMGTFKKAPEEVMATRRIVKVRRQQPSSAPSSNPFSAIRFTPTDSSVQASAPVTEPQPSEVKADEGSNGNAKETLPMSDKNASSGEVTEIQKEESAVKTESGATTEAPPQPVETSDKAESGGDKVVVGEPKEGDSTPSEVEGKTKDGDAEEKKGADEAGNEDKISKDDTEKKDGGESETKDGLSDEQKDADSKGQSSSSAPLFSFKNLSSGQNAFTGLAGTGFSSTSFSFGSASKDGSSAGPLFGLKPDGSSVPSFNLGATNNGGSSTVRATSGEAPKKFAMTEGPVETGEENEKAVFTADSTLYEYLDGGWKERGKGELKLNVSVSGDERARLVMRTKGNYRLVLNASLYDDMSLKDMDKKGVTFACMNSIGESQTGLATFALKFKDTAMREEFKGAVEAHKVRKAPDTTLNTPENSPKAAEV

SEQ ID NO: 21170 - DNA, 1810 bp, Panicum virgatum
  misc_feature: Ceres CLONE 1814950
  misc_feature: Encodes the peptide sequence at SEQ ID NO. 21171
aataaaaaacgccccgttattcgtcacctcccccctcccctcccatcccctcccccgccgatcgaaatccgatcggaaatgcggcccccgcagacccccattccgccgtgggggtccaaatctcgctggtacatgacgccgacgccgctcagcccttccttctcacgacatccgttccaaggcaccgccgccgccgcctccgagcaaccctgcgtcacgctgttcgagtggtggctggagagagtggaaggggatgaccagaaggtcgccgtcgcagggaaatttgaaaggaatcaaacagtctacgaattcggttctgcaaccattgcaaagcgccacgaagtttgcgttcttgaaactgaaggtggaattctacttctcatctatggcacactcaaccgttcgcggatgctagccggcggatactcaagtgaggtctatgaaaagttcaagatcggatttccatactgctgggaatattgcatctaactttatcccaaggtggcacaaacaggattggatagtgctataaatgaaaatgctgctgtctcaaatgatggcggagaaagacatgaagctgcatgtaatgaggcgtataatgtggaaacagacttgattgcatgcagagctttaagagaaagagatgatggtggcatagatactaatgcatctttagtgcatatagtggagtgtgctaatgatgctagcaatgaagaggcagataatgctacacccacaatcacatgcgatcagggaaaagctcagcatgttgcattgagtaagaaggcaaaagtaaatgaaaatgtgccaacttttgtttgtttagacatgcaaaactcctctgatcttcctaaaggaacaccaagatttcaggaatacacttgtgatggtgatattgcaacaaatgaaaatgctgctgcctcaaatgatgatggagaaaaagatgaagatgaatataatgatgtgaataatgtgtttgagtgtgctaatgatgcaagtaatgaagaggcagacaatcctccacccacaagcaaaaagagagatctagtggttccattgaagactcaaggttgtgaaaaaactcagcacacagcaaagagagatccagcaccttcttgtccttcaggcccaccaaagaagcaaaggtctgcacttgagaagttgcagggtgctacaagatctccattcaccagccctgttccatatgcccgtgagactccgcttactcgtggtagggccatgtcattgtcaatgtccacacctgaagatctcaaactgagaaaaaccagatcgggtcgtgtagttgtacccactttggatgcaggatgccaaaggattgtctatgacatggacggcacgattactggtgtcatcggtctggattcaccattgcccaaagggagcaagctgaaaacggcgaggaggaagagagaggctgagccaccaaacaagctgaaaacgtatgcaaggaagaagagaagggctcagtgagcaattctcccagacgtgattggtaggatttaggacttaaaaggctgcacgtgcaggagttggttggctttcggtagatctgtgcgaaagcctgtcttgccgctgatactaggcgttggcatggattggtgatgaaggcttgttaagcatgtgcctgtgttaccagtgccagtgccaccttttgctgcaattcttgacctgaggcagtatctagttttactaccttggcgttctgaaccttagttgcctgcctgactggtggtcagtggtgatctggacgtgctttggttgcagaatgagattctgttgcgtgctcggt

SEQ ID NO: 21171 - protein, 136 aa, Panicum virgatum
  misc_feature: Ceres CLONE 1814950
  misc_feature (46)..(136): Pfam Name: SANTA Pfam Description: SANTA (SANT Associated)
MRPPQTPIPPWGSKSRWYMTPTPLSPSFSRHPFQGTAAAASEQPCVTLFEWWLERVEGDDQKVAVAGKFERNQTVYEFGSATIAKRHEVCVLETEGGILLLIYGTLNRSRMLAGGYSSEVYEKFKIGFPYCWEYCI

SEQ ID NO: 21172 - DNA, 1653 bp, Panicum virgatum
  misc_feature: Ceres CLONE 1814951
  misc_feature: Encodes the peptide sequence at SEQ ID NO. 21173
tcccaacccctcgttttttccctgcctcttttctcaattcgagccttccagcccacgcccattcctggactgctccccaaacggtcaaagccagagccgatcgcgcgcggcggcgataacgataaggtagctgaaccggccgggaggaggaagagccgccggcgagcagcaatgccttactgcgaggtgggtgggtacgcggacggcgaaaagtgggagggcgtccggctcttctaccgccgctacggccgcggagccaccaaggtgctcctcatcatcggattggcggggacgcatgactcgtggggcccgcagataaaggggctgaccaggtcgctcgagcccgccgacgacgagcccccgcggccggacgaggaggccggcgccggagccgccggcgcggcggaggcggcgcccgcggaaggggatgatgccggcggcgatggcatcgaggtctgttgcttcgacaaccgcggtgtcggccgcagctccgtgcccccgaacaaatcctactactcgacggcgatcatggcgaaggacgccttggccttgatggatcatttggggtagaagaaagcacatgtctttggccactctatgggtgcgatgatttcttgcaagctagcggcgatagcgcctcacaggctgtgttcactggcattgctcaatgttaccgggggtggctttcagtgtttcccaaaggtagacgggcagatgctatcgcttgcattccgtttcttaagggcaaaaactccagaggaaagagcgcttgtggacttggaaacccattatacgaaggaataccttgatgagactgttgggtcatgcactagaagaatgatcctttatcaagaatatgtgaagggcatatcttcaacaggaatgcaatctaattgtggttttgaagggcaagttaatgcatgctggactcacaacatgactacaaaagaattagatgcaatacggtctgccggttttctaatttcagttattcatggaaggtacgatataattgcacaattgtgtcatgcaaaacgtctagcagaaaggcttgttcctgcagctagaatggtagaacttcatggtgcacatctagtgagccacgaaagaccagatgaggtgaacaatgcgcttatggatctaataaaggctaccaaatctgcggtaaaacctgaagagtggtctgcccagcctgagaatgtatcagaaaccggggcacttatatctgggagacccattaccgtcacgatgcgaacagatgaaggtgcaaccgccaccaatgctgccgtagcagtctataacttgcttggcaagctgcaactaagctttctttatctcataggggtgatagtcatggggtttgagcacatgaggaacattgtaaaggtaatgaagccagtaagggtggcagcaatcgagtcataattcatcataaggtaaaaggatcctccatgggcccttgcagtatctgtgaaactaattctctgtgtggtggccttgcacttactgaactttctctggtctttcagaaacaaggacatgtaaattattctcaataccttgcgggagtcgagatgatatctcacttctccccaatacttcggagatgatgattttagagtagcatctccaaacaaatgtggaacttttctg

SEQ ID NO: 21173 - protein, 132 aa, Panicum virgatum
  misc_feature: Ceres CLONE 1814951
  misc_feature: SWISSPROT Homolog: EC 3.1.1.24 3-oxoadipate enol-lactonase
MPYCEVGGYADGEKWEGVRLFYRRYGRGATKVLLIIGLAGTHDSWGPQIKGLTRSLEPADDEPPRPDEEAGAGAAGAAEAAPAEGDDAGGDGIEVCCFDNRGVGRSSVPPNKSYYSTAIMAKDALALMDHLG

SEQ ID NO: 21174 - DNA, 725 bp, Panicum virgatum
  misc_feature: Ceres CLONE 1814956
  misc_feature: Encodes the peptide sequence at SEQ ID NO. 21175
aaaacacctcccaattccagcaatgtcggcgccaccgtcgggcggcggcggcgccctcatcaacgaggtgctcaccgacgacgagctccgcgcggtgctctcccgtctggggcccgaggcggagcgcgacgccttcgggctcgtgtgccgccgatggctccggatccagagctccgagcggcggcgcctgcgcgcgcgcgccggcccggacatgctgcgccgcctcgccgcgcgcttcccgggagccctcgagctcgacctctcccagtccccctcccgctccttctaccccggggtcatcgacgacgacctcgacgtcatcgccagcagcttccgcaacctgcgtgtcctcgcgctgcagaattgcaaaggtatctctgatgttagaattgccaaattgggagatggactgccatttctgcagtcccttgatgtttctcgctgcataaagctgagtgataaaggtttgaaggcagttgcactggggtgccagaaattgaggcagctgcatatcacaggatgcagattaataactgataatttattgctttctctatcaaagagctgtctacaattggaaaatcttggagcagcaggatgtaacagcataacagatactggtatatctgctctagctgatggctgtcatcatataatattccttgacattagtaaatgtaataaagttggtgatcctggagtctgtaatattgctgatgtttctt

SEQ ID NO: 21175 - protein, 234 aa, Panicum virgatum
  misc_feature: Ceres CLONE 1814956
  misc_feature: SWISSPROT Homolog: EC 1.14.11.27 [Histone H3]-lysine-36 demethylase
MSAPPSGGGGALINEVLTDDELRAVLSRLGPEAERDAFGLVCRRWLRIQSSERRRLRARAGPDMLRRLAARFPGALELDLSQSPSRSFYPGVIDDDLDVIASSFRNLRVLALQNCKGISDVRIAKLGDGLPFLQSLDVSRCIKLSDKGLKAVALGCQKLRQLHITGCRLITDNLLLSLSKSCLQLENLGAAGCNSITDTGISALADGCHHIIFLDISKCNKVGDPGVCNIADVS

SEQ ID NO: 21176 - DNA, 681 bp, Panicum virgatum
  misc_feature: Ceres CLONE 1814972-R
  misc_feature: Encodes the peptide sequence at SEQ ID NO. 21177
gggagaatgttgggaggattgtcatcggcttgtatggagatgatgtcccccaaacagcagagaacttccgtgctctttgcactggagagaaagggttcggatacaagggatccagtttccaccgtgtcatcagggatttcatgattcaggggggagattttgacaagggcaatggtactggcgggaaaagcatatatggacgaaccttcaaagatgagaacttcaaattggttcacactggacctggagcggttagtatggctaatgctggaccaaacaccaatggcagccagtttttcatctgcactgtcaagacaccttggttggacgggaggcacgtcgtgtttggccaggttctagaaggcatggatgtcgtgaagctgatcgaatcgcaggagactgacagaggtgaccgtccgaagaagaaagtagtcatcagcgattgcggggagcttccggtggtctaagttttacatgtcttaccacagacaagaagttgataccactcaccccacttgagttgacatgagaatatcatgatacttatcgtgttatctcccactagttatagagattattttgagttaaagccaaggtcacaaatctgaggcatactgttgcttttcggctaaaataaatgtgctagctttccttgccctgtctgggggaaggcttttgttc

SEQ ID NO: 21177 - protein, 154 aa, Panicum virgatum
  misc_feature: Ceres CLONE 1814972-R
  misc_feature (1)..(151): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
ENVGRIVIGLYGDDVPQTAENFRALCTGEKGFGYKGSSFHRVIRDFMIQGGDFDKGNGTGGKSIYGRTFKDENFKLVHTGPGAVSMANAGPNTNGSQFFICTVKTPWLDGRHVVFGQVLEGMDVVKLIESQETDRGDRPKKKVVISDCGELPVV

SEQ ID NO: 21178 - DNA, 729 bp, Panicum virgatum
  misc_feature: Ceres CLONE 1814972
gattgcagcatccaattcctcgttgatcgctgcatgtccgggatcggcacggcgcccatcaggcggccaggcgggtgcactttggccttccgtgattgcatcgtccagttcatccagccagcagccatgcgggttctgctacggggatcgccggcctcgcctccgcgttcgccctcgacgtcgtcccggcctcgcccgtctgcctagcttgccgcgttacgctgcttgccggcgcctgatcttcaggcgaatcgagccgccggagacgggagaccccgttcatccgcgcagatcccccaccgctcccccctacgggcggatgggcggagcgacgctcggacctccagccgcgacgagccgtgatgcgcggatcgatccagaagtcgtcgccactcccggtctccgagcgctcaggcctcccctgcgctccgtgcctctccagcctccaagatctgtgcgcctccggcctccccctcgctcggctccggccgcctgcagcctcccccgcctgcgccaccaactccgctccccatcccacgtcacaatctgaaggaaagaaacactcctccccctcaatatccggtgcctcacgtcgctctcccgtctaatccgtttaaggatcaatgtggacgatgctgccattgcggcacggctggattactctgcaccttatccggacgagctgaacctacaggtaactgatgtgcaccgcggagttcactattacgc

SEQ ID NO: 21179 - DNA, 702 bp, Panicum virgatum
  misc_feature: Ceres CLONE 1814975
  misc_feature: Encodes the peptide sequence at SEQ ID NO. 21180
aacctcagcagaacccaagagaatcggcggccaagaaaatgctcctcctcatcctcttcgcccttctcgccggcgccgccgccttcctcctcttcatgttcgccaccgtcgtcgatggggacttgacgctcgtgtcgcgcggcccgccgcggcgggagagggtggacggcaaggtcgtgtggattactggagcgagccgcgagattggggaggtccttgcaatgcaatttgcaaacttaggagcaaagctgatactatctgctcgtaacaaggacgagcttgagagagtaaaacaaaacattctcagtaagtatggaaactatttctgatgctgcataaatttttcctttagaggggatgtggtaatctgaaagatctgaatgatgtttcatgtacttttcaaaggcaagaatccagatagcagagttgaagtgttacccatggatttatcagctggtgaaaaatctctgaaacaagttgtacatgcggcagaatcactcttttctaatgcaggcgttgactatatgatccataatgctgcctttgaacgtcctaaacggggggcactggaagaaagtgaggaaggtctcaaggctactattaatgtcaatgtcatcggaactattactctaacacgccttcttgcaccttatatgctggatagagggatgggtcatttttgtgtgatgagcagtgcggctg

SEQ ID NO: 21180 - protein, 96 aa, Panicum virgatum
  misc_feature: Ceres CLONE 1814975
  misc_feature: SWISSPROT Homolog: EC 1.1.1.146 11-beta-hydroxysteroid dehydrogenase
MLLLILFALLAGAAAFLLFMFATVVDGDLTLVSRGPPRRERVDGKVVWITGASREIGEVLAMQFANLGAKLILSARNKDELERVKQNILSKYGNYF

SEQ ID NO: 21181 - DNA, 631 bp, Panicum virgatum
  misc_feature: Ceres CLONE 1814980
  misc_feature: Encodes the peptide sequence at SEQ ID NO. 21182
gacgcaccaactctctctctctctctctctctctctctcacttcctcaggagcgctagggttttcctgcggcggcggcggaggaaggcggcgatggggcactccaacgtgtggaactcgcaccccaagaactacgggcccggatcccgcgtctgccgggtctgcgccaaccctcatggactgatcaggaagtacgggctgatgtgctgcaggcagtgcttccgcagcaacgccaaggacattggcttcatcaagtaccgctgaagtcagctgtgggctatgagaatgccatcttcgggtatgacatggaccatgttttagaagcgaggcgataatttaaattccagtaatttagatgttttgttcagaactctgcaagtgaagtctgttgcctgtgtttttgatggagaacttggccatgtcggtcatgtttgaatcatgagttacctgcatatgtgcagaatttgagctaccttgtttggtaaccatcttatctttgtctagttgagcatcaagtggatggttattgttgaacttggcatatttaacatgccataaagacccatttgtggtgcctttggattgatattggaatattgaacatgtgatcaagatgcaaatttggacggatc

SEQ ID NO: 21182 - protein, 56 aa, Panicum virgatum; identical to SEQ ID NO: 9888
  misc_feature: Ceres CLONE 1814980
  misc_feature (3)..(56): Pfam Name: Ribosomal_S14 Pfam Description: Ribosomal protein S14p/S29e
  misc_feature: Useful for making plants with modulated nitrogen use efficiency

SEQ ID NO: 21183 - DNA, 691 bp, Panicum virgatum
  misc_feature: Ceres CLONE 1814987
  misc_feature: Encodes the peptide sequence at SEQ ID NO. 21184
accccctccccaatctacccccgcaccccacgccattgctcgtgcccgcgaagtccaagctcccacgactccaccgcgaccgcggagacgccggcgccccagatcagccggggcggatggcggcgccgaccttcccggcgctgctgctgtcggcggtgctgcttctgctgctgctgatgccgccgccgcccggggcggaggcggtgtggcttgaactgccgccgtcggggaccaagtgcgtctccgaggagatccagcccaacgtcgtcgtgctcgccgactacgccatcatgtacgagtcccaccccacctcgcaccccaccgtcgccgtcaaggttacctcaccatatggcaatacagtacatcacaatgagaatgccacaacgggtcagtttgcattcactacctcagaagctggaaactaccttgcatgcttctggatagacagtgcagagaaagggtcaggaacatctctaaatcttgattggaagatagggattgcagcaaaggactgggatacaattgctaagaaggagaaaattgagggtgtagagctagagcttaggaaacttgaagttgctatcgaatccatccatcacaacttgctgtacctcagagcaagggaagcggatatgcggacggtgagcgagaaaacaattctagagttgcctggttcagcatcttgtcactt

SEQ ID NO: 21184 - protein, 191 aa, Panicum virgatum
  misc_feature: Ceres CLONE 1814987
  misc_feature (61)..(126): Pfam Name: EMP24_GP25L Pfam Description: emp24/gp25L/p24 family/GOLD
  misc_feature: Useful for making plants with altered carbohydrate content
  misc_feature: Useful for making plants with altered cell wall content and/or composition
MAAPTFPALLLSAVLLLLLLMPPPPGAEAVWLELPPSGTKCVSEEIQPNVVVLADYAIMYESHPTSHPTVAVKVTSPYGNTVHHNENATTGQFAFTTSEAGNYLACFWIDSAEKGSGTSLNLDWKIGIAAKDWDTIAKKEKIEGVELELRKLEVAIESIHHNLLYLRAREADMRTVSEKTILELPGSASCH

SEQ ID NO: 21185 - DNA, 1368 bp, Panicum virgatum
  misc_feature: Ceres CLONE 1814992
  misc_feature: Encodes the peptide sequence at SEQ ID NO. 21186
gagttctagggttttatcgtctccgccgccgacgcgtcccaaatcaaacccttccccatccaccaccctcccccacacccggcggcggcgaccaccaccggcagcagcgccaccgccgccacccccgcggagccacgatgaggccgatcctgatgaaggggcacgagcgcccgctcacgttcctgcgctacaaccgcgatggcgacctccttttctcctgcgccaaggaccacacccccacggtctggtacgccgacaacggcgaccgcctcggcacctaccgcggccacaacggcgccgtctggtcctgcgacgtctcccgcgactcagcgcgcctcatcacgggctccgccgaccagaccgccaagctctgggaggtcagcacggggcgggagctcttcagcttccgcttcgacgcgcccaccaggtccgtcgagttcgccatcggggacgcgctcgcggtcgtcaccaccgacaacttcatggaccacgtccccaccgtccaggtcaagcacatcgccgaggaccttgacgaccagacggatgaatccgcgctcgtaatcaccggcatcaaggggaggatcaacagggcggtttggggcccgctcaacaggacaatcatcactgctggcgaggatgctaccattcgcatctgggactcagagaccggaaaactgctgaaagagtcggataaggaatctggacatcagaagacgattacatcactgtcaaaatcctcagattggtctcatttcattacaggttccttggataaatctgctaagctatgggatgcaagaacgctaaccctgatcaagacatatgtcacagagcgacctgttaatgctgttgacatctctccaactcatgatactgtggttctaggaggcgggcaggatgcaatgaatgtgactatgacagaccgccgagctggtaaatttgaggctaaattctatcataagattttgcaagaggaaattggtggtgtcaaaggacattttggaccaattaatgctttggcatttaaccctgatgggcggagcttttcgagtggtggtgaagatggatatgtaaggctgcaccattttgattccgactacttcaacatcaagatgtagataatggacatcacaaactaatccgaggttgtattcaagaggacccaacaggaacggagttacttttttggttcatttggtgctggttcgtgaggctcgcagagttggctcagatcttagctattggtgttgtgttgcttgttagacgctcttgttgctctaaacaggacaggcagctttttgtagatgcttgagaaatttgtacacttggcaatgaaaagatcgttggatcttcagttatttttctttt

SEQ ID NO: 21186 - protein, 326 aa, Panicum virgatum
  misc_feature: Ceres CLONE 1814992
  misc_feature (42)..(80): Pfam Name: WD40 Pfam Description: WD domain, G-beta repeat
  misc_feature (181)..(219): Pfam Name: WD40 Pfam Description: WD domain, G-beta repeat
  misc_feature (278)..(316): Pfam Name: WD40 Pfam Description: WD domain, G-beta repeat
  misc_feature (136)..(174): Pfam Name: WD40 Pfam Description: WD domain, G-beta repeat
  misc_feature: SWISSPROT Homolog: EC 2.3.1.48 Histone acetyltransferase
MRPILMKGHERPLTFLRYNRDGDLLFSCAKDHTPTVWYADNGDRLGTYRGHNGAVWSCDVSRDSARLITGSADQTAKLWEVSTGRELFSFRFDAPTRSVEFAIGDALAVVTTDNFMDHVPTVQVKHIAEDLDDQTDESALVITGIKGRINRAVWGPLNRTIITAGEDATIRIWDSETGKLLKESDKESGHQKTITSLSKSSDWSHFITGSLDKSAKLWDARTLTLIKTYVTERPVNAVDISPTHDTVVLGGGQDAMNVTMTDRRAGKFEAKFYHKILQEEIGGVKGHFGPINALAFNPDGRSFSSGGEDGYVRLHHFDSDYFNIKM

SEQ ID NO: 21187 - DNA, 608 bp, Panicum virgatum
  misc_feature: Ceres CLONE 1815003
  misc_feature: Encodes the peptide sequence at SEQ ID NO. 21188
agacaccgcggcgggagctcctcccctcccctcccggcgctgcgagctgtgcgaccacagcgcaatccaatgcgagactaagccctacccttccttcgatccaacccgatgctctcgtactcgagcacatcgaaaccatggccgcagcgccacccgccgtccccgagccaaggcgcgggcgccgccaccgccgccgcgcgccttgtagcgctggcggccaggagcaagcggcggggcgcgggcgccgcggcggcggagggggtggacgaggcggctgaggcggcagagctggtgcgctcgctcctgcggaggacgggcggaggcaaggagcggctggtcccggtactggaccggcgcgttcgggtggtccgcaccgagcactgcttcctcctcttcgaggagctcggccgccgcgacgcatggctccagtgtctcgaggttttcagatggatgcagaaacaaaggtggtatgttgctgacaatggcatctactccaagttaatatcagtaatgggaaggaaaggccagatacgtatggcaatgtggctattctctcagatgcggaacagtgggtgcaaaccagacacttctgtgtataactctcttat

SEQ ID NO: 21188 - protein, 166 aa, Panicum virgatum
  misc_feature: Ceres CLONE 1815003
  misc_feature (126)..(160): Pfam Name: PPR Pfam Description: PPR repeat
MLSYSSTSKPWPQRHPPSPSQGAGAATAAARLVALAARSKRRGAGAAAAEGVDEAAEAAELVRSLLRRTGGGKERLVPVLDRRVRVVRTEHCFLLFEELGRRDAWLQCLEVFRWMQKQRWYVADNGIYSKLISVMGRKGQIRMAMWLFSQMRNSGCKPDTSVYNSL

SEQ ID NO: 21189 - DNA, 1729 bp, Panicum virgatum
  misc_feature: Ceres CLONE 1815027
  misc_feature: Encodes the peptide sequence at SEQ ID NO. 21190
gcatctcacaaactcacattttcctctccttctctctcgcgccccgacctgctccaggcctatcccactagctaattctagctagcaacaggagccatggacgccatgggcttgccatgggcagcgcagtgcgcgggcatggccttctcagccttgtccctctgcttggttgcgctggccgccgtgctcctgctcgtgcgccggtggccgtggtgcaactgccatgtctgccgggcgtacctgacggggtcctgggcgagagacttccccaacctcggcgactggtacgcgcacctgctccgggagtcccccaccggcaccgtccacgtccacgtcctcggctgcaccatcaccgccaacccggccaacgtcgagtacatgctcaagaccaacttcgacaacttccccaagggcaagaccttctccgcgctcctcggcgacctcctcggcggcggcatcttcaacgtcgacggcgccgcctggcgccaccagcgcaagatggccagcctcgagctcggcagcgtcgccgtgcgctcctacgcctacaagatcatcgcccaggaggtggaggcccgcctcatgccgctcctcgccgacgccgccgacaggggcgccgtcgtggacctgcaggacgtgttccggcgcttcgccttcgacaccatctgcaagatctccttcggcctcgacccgggctgcctcgagcgggaaatgcccatgtccaagctcgccgacgccttcgacacggcgacgcggctctgcgccatgcgcggcgccgcggcgtcgccgctgctctggaggatgaagcgcctgctcaacgtcgggtccgagcgggagctcaggaaggccatcaggctcgtcgacgagctcgcggccgccatgatccgggagcgccggaagctgggcgtcgccagcagccatgacctcctgtcccggttcatggcctcggccggcggcgacgcccacgccgtggacgacaagtacctccgcgacatcgtggtcagcttcctcctcgccgggcgcgacacggtgtcctccgcgctcaccacgctcttcatgctcctgtccaagcacccggaggtggcggccgccatgcgcgccgaggccggggacggcgactcgacgccggtcacctacgagcacctcaagggcctgcactacacccacgcggtgctgtacgagaacatgcgcctgttcccgcccgtgcagttcgactccaagttctgcgccgggcccgacgtgctccccgacggcacctacgtctccggtggggcgcgcgtgatgtaccacccctacgccatgggccgcctgcccagcatctgaggcgccgaccatggcgacttccgcccggaccggtggctcaccggacccggccgctccttcgtgccggagagcctgtacaggtaccccgtgttccaggcgggcctccgcgtgtgcctcggcaaggagctcgcggtcaccgagatgaaggcggtgggcgtggcggtggtgaggttgttcgacgtcgaggtggtcggggagagtggcagcggcgcctgcgccccaaagttcgtgtcgaggctcaccgcgtccatcagcggcgggctcccagtcaggattagaagagttagaaattagagattcaaggtttcagagaaaagaggttagatagagtgttgtttcgcgaaaacggctatgaaatgtacatagactaattaaacgaacaagggaatggaaatagctagttgaatcg

SEQ ID NO: 21190 - protein, 407 aa, Panicum virgatum
  misc_feature: Ceres CLONE 1815027
  misc_feature (31)..(407): Pfam Name: p450 Pfam Description: Cytochrome P450
  misc_feature: SWISSPROT Homolog: EC 1.14.13.98 Cholesterol 24-hydroxylase
MDAMGLPWAAQCAGMAFSALSLCLVALAAVLLLVRRWPWCNCHVCRAYLTGSWARDFPNLGDWYAHLLRESPTGTVHVHVLGCTITANPANVEYMLKTNFDNFPKGKTFSALLGDLLGGGIFNVDGAAWRHQRKMASLELGSVAVRSYAYKIIAQEVEARLMPLLADAADRGAVVDLQDVFRRFAFDTICKISFGLDPGCLEREMPMSKLADAFDTATRLCAMRGAAASPLLWRMKRLLNVGSERELRKAIRLVDELAAAMIRERRKLGVASSHDLLSRFMASAGGDAHAVDDKYLRDIVVSFLLAGRDTVSSALTTLFMLLSKHPEVAAAMRAEAGDGDSTPVTYEHLKGLHYTHAVLYENMRLFPPVQFDSKFCAGPDVLPDGTYVSGGARVMYHPYAMGRLPSI

SEQ ID NO: 21191 - DNA, 1577 bp, Panicum virgatum
  misc_feature: Ceres CLONE 1815031
  misc_feature: Encodes the peptide sequence at SEQ ID NO. 21192
tcgccccctctcgcccctcacctcacacgcacgctcgctcccaccccccatcgccgccaccaaaaccccaatccgtgccgggcccgtctcggccaccatctcctccccatcctcctcctcctcctcggtggcgcggcgagccgcgggcgatccggccggtgaggggggcgcgcgcggggcgggggcggagatggcatcggaggacgtggtggggaagagcaggggcgacacggccgtcaccaccatcgtcaacctggcggaggaggccaagctcgcgcgcgagggggtcaaggggccggggcaccaggtcctcaccatctgcaagtcgctcgtcgccggcggcgtcgcggggggagtgtcacgcactgctgttgctccgcttgaacgattgaaaatcttgctccaggttcaaaatccacacagtatcaagtacaatggtacaattcaaggtctcaagtatatatggagaactgagggcctccgtggacttttcaagggcaatggtaccaattgtgcaaggattgttccaaattctgctgtgaagttttttagctacgagcaggcatcaaagggaattttgtgggcttaccgccaacagactggggatgaggatgctcagctttctccactattacgccttggagctggagcctgtgctggtatcatagccatgtctgctacttacccgatggatatggttaggggtagaatcaccgttcagacagacaagtctccctaccagtaccgtggtatgtttcatgcactgggcacagtttaccgtgaggaaggctttcgtgctttgtacagagggtggcttccatctgtaatcggagttgttccgtatgttggcctcaactttgctgtttacgagtctctcaaggactggctgctccagacaaatccttttgggcttgcaaatgataacgagctgcatgtagttacaaggcttgggtgtggagctgtggctggaactattggccagactgttgcgtaccctcttgatgtcatcagaagaagaatgcagatggtcggctggagccatgctgactctattgttactggacaaagcaaagaagcactccagtacaatggtatgattgatgcatttaggaaaactgttcgtcatgaaggtgtaggtgctctgtacaagggtcttgtgccaaattcagtgaaggtggtgccctcgattgccattgcatttgtcacttacgaggttgtgaaggatgtgctaggagtagagatgaggatatcagactgaggggattggattagcgctgggtgttatcgactgctatttttgtaggtgttggagttctgtttttgtaggcagggcgggtagaaggatatgactgcggctccattcagcatcaggccctctcagcccatgttgatatatcctgctactggcttcaggtcctaaattgttgctagatcgtggaaaattaataagttggctgtaaagctttgaagcatttgcctaactcataaaaagtttattccttgttgatgtatcgagattgaacttaaaagcggtattgcttgctgctaatagttgattctaatgattttcctttgcc

SEQ ID NO: 21192 - protein, 355 aa, Panicum virgatum
  misc_feature: Ceres CLONE 1815031
  misc_feature (145)..(237): Pfam Name: Mito_carr Pfam Description: Mitochondrial carrier protein
  misc_feature (42)..(133): Pfam Name: Mito_carr Pfam Description: Mitochondrial carrier protein
  misc_feature (248)..(351): Pfam Name: Mito_carr Pfam Description: Mitochondrial carrier protein
MASEDVVGKSRGDTAVTTIVNLAEEAKLAREGVKGPGHQVLTICKSLVAGGVAGGVSRTAVAPLERLKILLQVQNPHSIKYNGTIQGLKYIWRTEGLRGLFKGNGTNCARIVPNSAVKFFSYEQASKGILWAYRQQTGDEDAQLSPLLRLGAGACAGIIAMSATYPMDMVRGRITVQTDKSPYQYRGMFHALGTVYREEGFRALYRGWLPSVIGVVPYVGLNFAVYESLKDWLLQTNPFGLANDNELHVVTRLGCGAVAGTIGQTVAYPLDVIRRRMQMVGWSHADSIVTGQSKEALQYNGMIDAFRKTVRHEGVGALYKGLVPNSVKVVPSIAIAFVTYEVVKDVLGVEMRISD

SEQ ID NO: 21193 - DNA, 1770 bp, Panicum virgatum
  misc_feature: Ceres CLONE 1815034
  misc_feature: Encodes the peptide sequence at SEQ ID NO. 21194
gtctcttctctagctgaagtgcgccaaaaatataaggtggagcttgctgagatacttgatgccaatggaagcaaaggcaaaaaggtaagtacctcaaccaatggcaacaatgcatctcatgcttcagaggcgaatacccctgctagtgggtcaggcgacccatctgaagcttcacctgttgaggttaagcctcgtcctgtattgaaggaactatgtgagcagatggacaccaaaggccttctgaaattcctttcagaaaattgtaaaaaacttgctagtcttcgtgatgaacttcctgttgcactaagatgtgcaactgaccctgcccgccttgtgcttgattccctggagggtttcttcccaccagaccaaaccgattcacctgggaataaacaaaatgcccttgaggtccagcgcaggagctgtattcttttaatggaagctatatcacctgcactaggggccaaggagcaagctggcaatgactcttggagctctgaaattaaggagcaagccaaggcaattgccgaagagtggaagagtaagttagctgaggttgacctagatgcttctaatggctcgtcattggaagcacaggcattcctgcagcttcttacaacttttaatgttgattcggtgcttgacgaagatgaactatgcaagatcgtagttgctgtctctcgtcgcaagcagactgctgtgacctgtcgctctcttggtcttaatgagagaataccaggtatcattgaagaattggttaacaggcacaggcaaattgatgcagttcatttcatacaagctttcgggctttcggagacctttccccctgcacctctgttaaagacatatgtagatgaattaaaagatacatttggcaataatggggatgccagtgcaacctcttcaaaggatgactctaagaccaaggagctacttgctttgagggctgtaataaagtgcatcgaagagtataagcttcagaaggagtattcacttggccctctccaaaagcgtgtttctgagctgaagcctaagagtgagaaaaggccatcatctgatgctgggcgtgcttactcaaagaagcctcgaggccctggtacttcatttcctcggagaccagctggtcctgttggttcaggtgctcgcagacctccatttccagtcagtaactggcagcgtgctcctgctccaattccctctcgtgcttctgtgccaatggctcctcttcctgaaagatatggagcagctgaccggtaccactacactccaccagcccctgcatatgacgctggggcattttcttcctaccgtgaaccattcagtgcccccaaaccgtttcagtacaccccagggtcagaggcagcatcatacaattcaagcccctataaagttgcatacgttggaccaggagcgctgccaggtgcaagcggatatgcaggttactcaggcacttcagggccgtctgcttccagcagctacgcaaactatttaggatctggttatcgccctacccagcagccatagattgacttctctcaaaatgccctcctggtgatgaaggatgtctggatatggcacccgacttcccgtcaaactgggatgtaacttattctgttcctcatctattgcagtgggttttgtaggtgtaactgatgtagagtttcgctcaaagcctgtgtgaggcgacgatcaaattctaagcgcactcatgacatgctacatgtaccttgcacgctgcactcttatttttttcttggtgctgtattcccg

SEQ ID NO: 21194 - protein, 507 aa, Panicum virgatum
  misc_feature: Ceres CLONE 1815034
  misc_feature (54)..(355): Pfam Name: Frigida Pfam Description: Frigida-like protein
VSSLAEVRQKYKVELAEILDANGSKGKKVSTSTNGNNASHASEANTPASGSGDPSEASPVEVKPRPVLKELCEQMDTKGLLKFLSENCKKLASLRDELPVALRCATDPARLVLDSLEGFFPPDQTDSPGNKQNALEVQRRSCILLMEAISPALGAKEQAGNDSWSSEIKEQAKAIAEEWKSKLAEVDLDASNGSSLEAQAFLQLLTTFNVDSVLDEDELCKIVVAVSRRKQTAVTCRSLGLNERIPGIIEELVNRHRQIDAVHFIQAFGLSETFPPAPLLKTYVDELKDTFGNNGDASATSSKDDSKTKELLALRAVIKCIEEYKLQKEYSLGPLQKRVSELKPKSEKRPSSDAGRAYSKKPRGPGTSFPRRPAGPVGSGARRPPFPVSNWQRAPAPIPSRASVPMAPLPERYGAADRYHYTPPAPAYDAGAFSSYREPFSAPKPFQYTPGSEAASYNSSPYKVAYVGPGALPGASGYAGYSGTSGPSASSSYANYLGSGYRPTQQP

SEQ ID NO: 21195 - DNA, 1527 bp, Panicum virgatum
  misc_feature: Ceres CLONE 1815041
  misc_feature: Encodes the peptide sequence at SEQ ID NO. 21196
agaaagcgccggagagtcggacggacgacgcaatccaggcgaggcgagcgaatcggggagaaaaccagagggggggctgcagaccgccgggcccaggtcccctcgtcgcctccgcgggaccggttcgccgtctcgtcgtccgcgcccgcccgcccgccccgcgcatggaggcgctgtggaagcaggcctccaggctcaaggagcaggtcgcccgccagggcgtgttcaagcagtttggctatggtaattcagacaactcgtttacagatgagtcagagattaaactgcatcagagattggaaaagttgtatttatcgactcgtgcggctaaacattttcaaagggacatcgttcggggcgtggagggctatatagtcacgggttccaaacaagttgaaatagggaataaattgtctgatgacagccagaaatatggtgtcgaaaacacatgtacaagtggtgatactttatccaaggctgctacatactttggaaaggcacgttcactgattgaaaaggagcgtggcaacatgttgaaagcatttggcacacaggtggcagagccgctacgggcaatggtaatgggtgcccccttagaggatgctagacatctggcccagagatatgacagaatgaggcaagaagccgaagcacaggttgttgaagtatcaagacggcagaacagagtgagggaatcacctgggaatggtgatatgatatccaagttggaagctgctgagtacaagcttgaagaactgaagtcaaacatggtgggattagggaaggaagctattgcagcaatgtcggctgttgaggctcagcagcaacggttgaccttacagcgccttattgcactggttgaggctgagagagcttaccatcagagagttctggagatacttgaccaattagaagaagagatggtgtctgagcgccaaaaaatcgaagcacctcctaccccggctgcagaaaattatatgccaccaccaccttcttatgatgaagttaatggagttttttcatccacttctgttaatgagacaatccaatctgtcgatttcttcctaggagaggcccttgattccttcaaagcagaaagtgagtttgagcttaccttgtcagctggtgacattgtaattgtccgaaagatctcaagcaatgggtgggcagaaggcgagtgcaagggcagagctggatggttcccccatgcttatattgaaaagcgagaacgtgttttagcaagcaaagttccacatatcttttaggagtcttgaactgtcgattacgtggttttggtcttatattgttggatgctggaacagtagctgccttctatttatatgcctcttagcttctgcgatgtagttaccgtgtggcatgtgtatagatcaaaattttgatttccgtttttttagttccgactagattttgaatgtaaacatttcgggagactgattgctgattggacaatggacattagttatattcatgatgtttgaaatggtgaaatagataccgttgatgttc

SEQ ID NO: 21196 - protein, 366 aa, Panicum virgatum
  misc_feature: Ceres CLONE 1815041
  misc_feature (300)..(354): Pfam Name: SH3_1 Pfam Description: SH3 domain
MEALWKQASRLKEQVARQGVFKQFGYGNSDNSFTDESEIKLHQRLEKLYLSTRAAKHFQRDIVRGVEGYIVTGSKQVEIGNKLSDDSQKYGVENTCTSGDTLSKAATYFGKARSLIEKERGNMLKAFGTQVAEPLRAMVMGAPLEDARHLAQRYDRMRQEAEAQVVEVSRRQNRVRESPGNGDMISKLEAAEYKLEELKSNMVGLGKEAIAAMSAVEAQQQRLTLQRLIALVEAERAYHQRVLEILDQLEEEMVSERQKIEAPPTPAAENYMPPPPSYDEVNGVFSSTSVNETIQSVDFFLGEALDSFKAESEFELTLSAGDIVIVRKISSNGWAEGECKGRAGWFPHAYIEKRERVLASKVPHIF

SEQ ID NO: 21197 - DNA, 1675 bp, Panicum virgatum
  misc_feature: Ceres CLONE 1815048
  misc_feature: Encodes the peptide sequence at SEQ ID NO. 21198
attttcctcttccggctctgcctccctgcctgcgcctgcgtgcggcctcggctccctccccccagcgcccatataatccggggcggccggctgggtccccgcggatgggctcgctcccgcggggctagggtttggtcggtcggtcggctggtcggcgtcgggggcgccggcgctgctccccctccctccctccctcgcccgcccgctcctctcgcgcgtcgctagggttcccccatggtgctgcagcgcttctcgtggccgtacggcggccggcacgcctccttctgcggcagcttcaccgggtggacggagtaccccatggcgctggtcgggaccgagttccaggtcgtcttcgatctgccccccggggtttaccagtaccgatttttggttgatggtgcctggaggtgtgatgagtcgaaaccctttatgcgtgatgaatatggactgatcagcaacgaagtgcttgtggaaaacaatgcacaaccagttgtgcagccagagccttctcctatcagaggaattaatatggatgagggtaccattttgacaacaatgcctccagagccttcgtctcaaaacccaggcatgcaaatagcagttttccgccatgggatctctggaatattattacataataccatatatgatgttgttcctctttctagcaagttagcaattttggacactcagcttcctgttaagcaagcatttaaaataatgcatgatgagggccttgctttagttcctctctgggacgaccatcagggaaccataacaggcatgctcactgcatctgattttgtattaatgttgagaaagttgcagagaaacataagggctcttggcaatgaagagcttgaaatgcatcccatttctgcttggaaagaagcaaaactgcagttttatggtgggcctgatggtactgctatgcagagaaggccattaattcatgttaaggattcagataatttagtggatgtggcactgagtataatgagaaatgaaatatcttcagttcctatctttaagtcgttgccagattcatcagggatgcctttgcttaatcttgcaacccttcaggggattttgaaatttctttgcttgaagctacaagaacagcctgaaggttattctcttctgcacaatcagcttctcaatattcctattggtacttggtctccacatacagggagaacaagtaacagactgctcagaactttgcgactgagttctccattaaattcctgcctggatctgctgcttcaagatagagtaagctcaattcctataattgatgacaatggatccctccgtgatgtctactcactcagtgatatcatggctctggcgaagaatgacgtctacgctcgcattgaacttgaacaagtaactgtgcaaaatgcattggatgtgcagtaccaggtgcagggccgaagacaatgtcatacgtgtttgcagacgagtaccttgcttgaagtcttggagaaattgtgtattccaggggtgcggcgggtggttgttattgaacaaagtaccagatttgtggaaggaatcatctcattgagagacatatttacatttcttcttggatagcatctgtgtagccatttcatacatgaaagcttcttgtacctgattcggacaaaataaaaaaggttgttggaaatgtgat

SEQ ID NO: 21198 - protein, 453 aa, Panicum virgatum
  misc_feature: Ceres CLONE 1815048
  misc_feature (321)..(452): Pfam Name: CBS Pfam Description: CBS domain pair
  misc_feature (141)..(290): Pfam Name: CBS Pfam Description: CBS domain pair
MVLQRFSWPYGGRHASFCGSFTGWTEYPMALVGTEFQVVFDLPPGVYQYRFLVDGAWRCDESKPFMRDEYGLISNEVLVENNAQPVVQPEPSPIRGINMDEGTILTTMPPEPSSQNPGMQIAVFRHGISGILLHNTIYDVVPLSSKLAILDTQLPVKQAFKIMHDEGLALVPLWDDHQGTITGMLTASDFVLMLRKLQRNIRALGNEELEMHPISAWKEAKLQFYGGPDGTAMQRRPLIHVKDSDNLVDVALSIMRNEISSVPIFKSLPDSSGMPLLNLATLQGILKFLCLKLQEQPEGYSLLHNQLLNIPIGTWSPHTGRTSNRLLRTLRLSSPLNSCLDLLLQDRVSSIPIIDDNGSLRDVYSLSDIMALAKNDVYARIELEQVTVQNALDVQYQVQGRRQCHTCLQTSTLLEVLEKLCIPGVRRVVVIEQSTRFVEGIISLRDIFTFLLG

SEQ ID NO: 21199 - DNA, 1823 bp, Panicum virgatum
  misc_feature: Ceres CLONE 1815052
  misc_feature: Encodes the peptide sequence at SEQ ID NO. 21200
aagatcgctcgcggcgctcgagcagcagcagcagcagccgggccgacgcggccggcgcgcacgacacgagcacgccggaggaggggacagcccagccagccacagccgttgccggcagccgaaacgcaccccggccgcaggcgccagcccacgcgccgcgccagctccataaagtcgccgcattcctcccgcggcgagcacgcgcggggccggcaagcgtatgagcagcggcgctcgcggcggggcgggttcatggaggccgtgggcgacggagccgcagcgggggcgggggacggggcgccgcccgcccggtcgcagcagggcgccaagcgcgggcgcggcggcggcgtgaggggcagcgacgcggaggcggcggcggcctggggccagccgccggcgctgccgccgccgcagggcccgggggcgggctctcggatctaccgcgtgcgggccagcgggggcaaggaccggcacagcaaggtgtacacggccaagggcatccgcgaccgccgcgtgcgcctgtcggtgcccaccgccatccagttctacgacctgcaggaccgcctgggcttcgaccagcccagcaaggccatcgagtggctcatcaacgccgcctccgacgccatcgacaagctcccggcgctcgacaccgccgccttcgcggccctccccggtcccggcgacgctgatgccgccaaggtcaagcagcagcagctggggagcagctccgggggcagcagcccgtcggagaccaacaaaggttccgagctctccctctcgcgctccgacggccgcgggggcgccgccgccgccgccgcgcgggacagggaggtcaccgtggccagcacctcggcgcaggccgcgtccttcaccgagctgctcaccggggtggcgtcggccggcgccattagcgccgccgagcacaagcagtcctggcagcagcagcagcccaacgcctccgcggcggccgccgctgactgcgtcggcattgcgcacccggggaaaggtgcgcacgggctgtcgacacacgccttctcgggccccatcaagttcggcaatgcgcctccgttcggcatggtcccggcgcagcccttcaacttcaccacccacgtcgagatgcctcacttctcgctcggccaggacgccttggcggcgtcctcggctcccgccgccggggactacaacctcaacttctccatgtcctcgggtttcttgggtgccaatagggggacccttcagtccaattcccagtctaacttttcaggccatcaccaccagcagctccagaggctggacggcccgttcttgttcggtcacgccgcggcggcggcggcgcaccccgcatctgagaaccagctgaccgcatccgcggcgttacagctgtgggatgggttccggcactccggcatgaaggagaagagcaagaactgattacacattgtccaacgaaactgaagacatccagttgctgggatctattccagcaacaattcatcctttggaggtgctgtggtcatcatcaaccctcaatcctgctgccattgatcaaacaatgatgtgctccgggtttttttcctctctctctctagatgctgttgtacaaattttgtgggagatgagagtttttgaacaagagttgtaagtgtgccccgctgtggtcgcggttctagtcctctccgcgtgtaacttttgcttgaattgatgctcccctgaattgagttcattggacaagcattattctcacgatttttctcggtttggtttgagagataatcctgattctgtggaactgattactgaatgctattttgtgtggaaagtac

SEQ ID NO: 21200 - protein, 392 aa, Panicum virgatum
  misc_feature: Ceres CLONE 1815052
  misc_feature (55)..(262): Pfam Name: TCP Pfam Description: TCP family transcription factor
MEAVGDGAAAGAGDGAPPARSQQGAKRGRGGGVRGSDAEAAAAWGQPPALPPPQGPGAGSRIYRVRASGGKDRHSKVYTAKGIRDRRVRLSVPTAIQFYDLQDRLGFDQPSKAIEWLINAASDAIDKLPALDTAAFAALPGPGDADAAKVKQQQLGSSSGGSSPSETNKGSELSLSRSDGRGGAAAAAARDREVTVASTSAQAASFTELLTGVASAGAISAAEHKQSWQQQQPNASAAAAADCVGIAHPGKGAHGLSTHAFSGPIKFGNAPPFGMVPAQPFNFTTHVEMPHFSLGQDALAASSAPAAGDYNLNFSMSSGFLGANRGTLQSNSQSNFSGHHHQQLQRLDGPFLFGHAAAAAAHPASENQLTASAALQLWDGFRHSGMKEKSKN

SEQ ID NO: 21201 - DNA, 684 bp, Panicum virgatum
  misc_feature: Ceres CLONE 1815055
  misc_feature: Encodes the peptide sequence at SEQ ID NO. 21202
aattccaattccgcctgctccggccgccgccgatggccgcgccgccatccacgggcatggacacgtacgcgctggtcctcccaggccgccagcgcgctcatccagtgctgcgctgggagctcctactgcttcggcgtctactccccggcgctcaaggcctcccaacgctaccaccagtccgcgctcgaccccgtcgccttcttcaaggacgtcggcgccaacgccggcgtcctctcgggcttcctcgccgcgggggcgcccgcgggcaggcgccgcccatggctcgtcctcctcgcggaagccgtcctctgcgccgccgggtacctcccaatgtggctcgccgtcgccgggatcgcgcccgcgccgctcccgctcatgtacgtctacatgctcctctccgcgcaagcgcataccttcttcaacaccgccgatgtcgtatccgccatctagaacttccccgatcgccgaggcacggtcatcggcatcatgaaggggtttcttggcctaaatggggtaatacttgtccaaatatgccacactctccatgttgatcctacctggctactactgatgctggcaatattgcccacagccataactttgatgctcatgtgtttcgtggacgtccccaacgcacatgatcggaacaacaagaaattacttacaggctttctctctcatcgg

SEQ ID NO: 21202 - protein, 149 aa, Panicum virgatum
  misc_feature: Ceres CLONE 1815055
  misc_feature (24)..(149): Pfam Name: Nodulin-like Pfam Description: Nodulin-like
NSNSACSGRRRWPRRHPRAWTRTRWSSQAASALIQCCAGSSYCFGVYSPALKASQRYHQSALDPVAFFKDVGANAGVLSGFLAAGAPAGRRRPWLVLLAEAVLCAAGYLPMWLAVAGIAPAPLPLMYVYMLLSAQAHTFFNTADVVSAI

SEQ ID NO: 21203 - DNA, 512 bp, Panicum virgatum
  misc_feature: Ceres CLONE 1815056
  misc_feature: Encodes the peptide sequence at SEQ ID NO. 21204
ttcttcgtgctctctcagaggtgggttggcttctcctccccctccagttcggttcggttcgggttcgtgaggttcttggggttccgttcgggggtgagaggaagagatggaggcgtcggatgttgagtaccgctgcttcgtcggcggccttgcctgggccaccgacaacaactcgctccacaacgccttcagcacctacggcgaggtcctcgagtccaagatcatcctcgatcgggagacccagaggtcccgcggcttcggcttcgtcaccttctcgagcgagcaggcgatgcgcgacgccatcgagaggatgaacggcaaggagctggacggccgcagcatcaccgtcaacgaggcccagtcccgcggcggcccgcgctccggcggcggcggcggctacgggcgccgcgagggcggcggtggctacggcggcggcggcggccgccgccgctaccgtcgccacgcgggcgggggcggttacagctgcggtggcggcggctacggtggccgtg

SEQ ID NO: 21204 - protein, 135 aa, Panicum virgatum
  misc_feature: Ceres CLONE 1815056
  misc_feature (10)..(81): Pfam Name: RRM_1 Pfam Description: RNA recognition motif. (a.k.a. RRM, RBD, or RNP domain)
  misc_feature (48)..(135): Pfam Name: GRP Pfam Description: Glycine rich protein family
  misc_feature: SWISSPROT Homolog: EC 5.2.1.8 Peptidylprolyl isomerase
  misc_feature: Useful for making plants with altered alkaloid content
  misc_feature: Useful for making plants with modulated flowering time
  misc_feature: Useful for making plants with altered lignin content
  misc_feature: Useful for making plants with modulated nitrogen use efficiency
  misc_feature: Useful for making plants with modulated biomass
MEASDVEYRCFVGGLAWATDNNSLHNAFSTYGEVLESKIILDRETQRSRGFGFVTFSSEQAMRDAIERMNGKELDGRSITVNEAQSRGGPRSGGGGGYGRREGGGGYGGGGGRRRYRRHAGGGGYSCGGGGYGGR

SEQ ID NO: 21205 - DNA, 2048 bp, Panicum virgatum
  misc_feature: Ceres CLONE 1815062
  misc_feature: Encodes the peptide sequence at SEQ ID NO. 21206
ggcgctcgcggccgcattagcgcggagatcgagagacaagagagggaagggcggcggctttgccggctaagccttctcctctcccctccgccgccgcctccctgctccacccccggaaactaatccctcgcctgaatggggacatcggcggcggagcccaatgccgcgcccgcgccgccggccgcggagccggcgcagccgcggcggcggatgccggacttccagcagtcggtgcggctcaagtacgtgaagctggggtaccactacctcatctcccacggcatgtacctgctgctgtcgccgctcatggcgctcgtcgccgtacagctctccaccgtctccccgcgcgacctcgccgacctgtaggagcagctccgcttcaacctcctctccgtggtcgcctgctccacgctgctcgtcttcctctccacggtctacttcctcacccgcccgcgccccgtgtacctgctcgacttcgcctgctacaagccggagccggagcgcaagtgcacgcgcgagaccttcatgcactgctccaagctcaccggctccttcaccgacgacaacctcgaattccagcgcaagatcctcgagcgctccgggctcggcgaggacacctacctgcccgccgccgtgctccgggtgccccccaacccgtgcatggacgaggcgcgcaaggaggcgcgcgccgtcatgttcggcgccatcgaccagctgctcgagaagaccggggtcaggcccaaggacattggcgtcctcgtggtcaactgcagcttgttcaacccgacgccgtcgctgtcagccatggtggtgaaccattacaagctgagggggaacattgtcagctacaacctcggcgggatgggctgcagcgccgggctgctgtccatcgacctcgccaaggatctgctgcaggtgcatcccaactcgtacgccttggtgatcagcatggagaacatcacgctgaattggtactttgggaacaaccggtccatgctcgtgtcgaattgcctgttccggatgggtggtgccgccatcctgctctcgaacaagcggtccgacaggcggaggtccaagtacgagctggtgcacacggtgcgcacgcacaagggcgccgacgacaagtgcttcggctgcgtgatgcaggaggaggacgagattggcaagatcggcgtgtccctgtccaaggatctgatggcggtcgctggtgatgccctcaagaccaacatcaccacgctggggccgctggtgctcccgctgtcggagcaactcctcttcatggccacactggttgccaagaagttgctcaagatgaagatcaagccgtacatccccgacttcaagctggccttcgagcacttctgcatccacgctggtggccgcgcggtgctggatgagctggagaagaacctggagctcactgattggcacatggagccatcgaggatgaccctgtacaggtttggcaacacgtcgagcagctcgctctggtatgagctggcgtactccgaggccaaggggaggatcaggaagcgcgacaggatctggcagatcgccttcgggtccgggttcaagtgcaacagtgccgtctggaaggcgctccggaccgtgaacccggccaaggagaagaacccctggatggatgagatcgacaacttcccggtggatgttccaaggatctcaaaggttggcaacgcgtgaagaacactggctgttcccaggtggcaattggagttggtcatcgtccgctgccaaggcagaggtttaagcttatgatcccatcgttcgcgctgtcagttattggtttcagttgagtagcatggcatctgtgtggggcacttgaagtagacgatttgattaggtagagggtgtggtttcttcgctagggttgcctgaatgtctgatatgtccagtttattcagattggggaaagcaattgcttttcagtatcggtatcacattctttgctgcctgatcgagatgtctcagttgcaggcccagctgatacttgaattcccctgttcaattgattgatcggttctgtcctg

SEQ ID NO: 21206 - protein, 391 aa, Panicum virgatum
  misc_feature: Ceres CLONE 1815062
  misc_feature (1)..(260): Pfam Name: FAE1_CUT1_RppA Pfam Description: FAE1/Type III polyketide synthase-like protein
  misc_feature (274)..(358): Pfam Name: ACP_syn_III_C Pfam Description: 3-Oxoacyl-[acyl-carrier-protein (ACP)] synthase III C terminal
  misc_feature: SWISSPROT Homolog: EC 2.3.1.119 Icosanoyl-CoA synthase
  misc_feature: The sequence is a functional homolog of SEQ ID NO 2 in US patent 7038112
MHCSKLTGSFTDDNLEFQRKILERSGLGEDTYLPAAVLRVPPNPCMDEARKEARAVMFGAIDQLLEKTGVRPKDIGVLVVNCSLFNPTPSLSAMVVNHYKLRGNIVSYNLGGMGCSAGLLSIDLAKDLLQVHPNSYALVISMENITLNWYFGNNRSMLVSNCLFRMGGAAILLSNKRSDRRRSKYELVHTVRTHKGADDKCFGCVMQEEDEIGKIGVSLSKDLMAVAGDALKTNITTLGPLVLPLSEQLLFMATLVAKKLLKMKIKPYIPDFKLAFEHFCIHAGGRAVLDELEKNLELTDWHMEPSRMTLYRFGNTSSSSLWYELAYSEAKGRIRKRDRIWQIAFGSGFKCNSAVWKALRTVNPAKEKNPWMDEIDNFPVDVPRISKVGNA

SEQ ID NO: 21207 - DNA, 2901 bp, Panicum virgatum
  misc_feature: Ceres CLONE 1815063
  misc_feature: Encodes the peptide sequence at SEQ ID NO. 21208
ggcatggcctgcccatctcttgtcttggtagccctcctcgtcgtctccgccgccgccgccgccgctgcgcagatgccaggtttcgtcagcatcgactgtggcggctccgcaaactacacggacgagctgggcctgctgtggacgggcgacgccggatggttccccttcggcgagacggccaccatcgccgtggcgtcggagaagcgcacgcagtactcgacggtgcgctacttccccgccgtgtccccctcgtcgccggcgagcagcagcagcagcaccaagcactgctacacgctccccgtccgcacccgcacccgctacctcgtccgcgccaccttcctgtacggcaacttcgacagcagcaacgtcttcccggagttcgacctctacctgggggcctcccgctggtccaccatcgtcatctacgacgacgccaaggtggtcacccgcgaggccgtcgtgctcgccgccgcgcccgccctcagcgtttgcctctccaacgccaccacgggccagcccttcatctccacgctcgagctccgccagctcaacggctccctctactacacggacgacgaggccgacgccttcctcggcctctccgccaggatcaacttcggggcgcccaccgccgaggcggtcaggtaccccgacgacccctacgaccggatctgggagtcggacatggtcaggagggccaactacctggtggacgtcgcccccggcaccgtgagcgtctccaccgacaggcccgtcttcgtggcctccggcgagaggccgccgcagaaggtgatgcagacggcggtggtgggctcgctcggggagctcacctaccgcctcaacctcaacggcttcccgggcaacggctgggccttctcctacatggcggagatcgaggagttcgtggcccccgagacgcgcaagttcaagctcttcatccccggcctgccggaggtgagcaagcccacggtggacgtcggcgagaacgcgccgggcaagtaccggctctacgagccgggcttcctcaacatcacgctgccgttcgtgctctcgttcgcgttccgcaagaccaacgactcgtccaaggggcccatcctgaatgcctttgagatatacaagtacatccacatccagctgggctccccggatgcgccggtgatggcaggcctggcgtcgcgttacgcctcggccgagtgggcaatggaaggcggcgatccgtgtctcccttggccgtggtcttgggtgaaatgcacatcagattcagaagcgcaaccaagagtcattgccataaatctttcaggaaagaacttgacgggcaacgtgccgccggaactaggggccttgccatgcttagcagagatcggacttgctaataacatgctgacgggcccaatccctgacctcagtggctcgtccaacctatccatcattcacctcgagaacaatcaactgacaggaaatgttccgtcatactttggcagcttgccaaaactgagcgagctgtaccttcaaaacaacaagctgtctggatccgtacccagggctctgctaagtcgaagcattattttcaactactccgggaacatgtatcttggaacagggacccaaaagaagaaacatgtaatcatcatcatatctgctctgcttggagcatccttgttgcttgcagccggcctatgttgctacatgctgacacgcaggagcactaagaaacagcactcctcaccgcaagcaggagcagatgatggcgatgactttacaaacaagaacaaggtcgtggtgccttggcacaagaacaagttgcagaaccacccaataataagctcgcagccgcagacccgtgaaatcgccaccgagactgctcatccgtacagtttatctgagctccaagtggcgaccagcaacttcgccagcaggatcggctcgggggggttcgggatcgtctactacgggaagctgagcgatggaaaggagattgcagtgaaggtgcctaccaacgactcgtaccaggggaagaagcagttcagaaacgaggtgtctttgctctcaaggatacaccacaggaacctcgtggcgtttctgggctactgccatgaggatgggagaaacattctggtctacgagttcatgcacaacggaaccctcaaggagcacctgcatgggcgcgacaagcacatcagctggatcaagaggcttgagattgcagaggatgcggcgaaagggatcgagtacctccacactggatgcacgccatccatcatccacagagacatcaagacgagcaacatccttcttgacaagcagatgcgagccaaggtgtccgacttcgggctctccaagttggtcgccgaggagtctcacgcgtccaccaacgtgagagggacactaggctacctggacccgcagtactacacctcccagcagctgaccgagaagagcgacatgtacagcttcggcatcatccttctggagctcatctccgggcggcctcccatctccaccatctccttcggggagcacttgcgcagcatcgggccatgggccaagtggtactacgaaagcggcgacatcgaggccatcatcgacccctccatctccggctccggcgggtaccaggacgtgcagtccatctggaagatcgccgaggccgcggtgcggtgcatcgacgcggagccccggaagcggccgtgcatgccggaggtggtgaaggagatccaggacgccatggcgctcgagcggtcgtcggcgtcggagaccatcatgaccatgaggggaggcgccggcggcgggtgccccttctcccctgcggcggcgagcgtcaggtccggcgggaccatgaggtcgcacgacatggtcatggacaacctgctgctcatggacgacgacgacgacgactcggcg

SEQ ID NO: 21208 - protein, 965 aa, Panicum virgatum
  misc_feature: Ceres CLONE 1815063
  misc_feature (633)..(904): Pfam Name: Pkinase Pfam Description: Protein kinase domain
  misc_feature: SWISSPROT Homolog: EC 2.7.11.1 Non-specific serine/threonine protein kinase
MACPSLVLVALLVVSAAAAAAAQMPGFVSIDCGGSANYTDELGLLWTGDAGWFPFGETATIAVASEKRTQYSTVRYFPAVSPSSPASSSSSTKHCYTLPVRTRTRYLVRATFLYGNFDSSNVFPEFDLYLGASRWSTIVIYDDAKVVTREAVVLAAAPALSVCLSNATTGQPFISTLELRQLNGSLYYTDDEADAFLGLSARINFGAPTAEAVRYPDDPYDRIWESDMVRRANYLVDVAPGTVSVSTDRPVFVASGERPPQKVMQTAVVGSLGELTYRLNLNGFPGNGWAFSYMAEIEEFVAPETRKFKLFIPGLPEVSKPTVDVGENAPGKYRLYEPGFLNITLPFVLSFAFRKTNDSSKGPILNAFEIYKYIHIQLGSPDAPVMAGLASRYASAEWAMEGGDPCLPWPWSWVKCTSDSEAQPRVIAINLSGKNLTGNVPPELGALPCLAEIGLANNMLTGPIPDLSGSSNLSIIHLENNQLTGNVPSYFGSLPKLSELYLQNNKLSGSVPRALLSRSIIFNYSGNMYLGTGTQKKKHVIIIISALLGASLLLAAGLCCYMLTRRSTKKQHSSPQAGADDGDDFTNKNKVVVPWHKNKLQNHPIISSQPQTREIATETAHPYSLSELQVATSNFASRIGSGGFGIVYYGKLSDGKEIAVKVPTNDSYQGKKQFRNEVSLLSRIHHRNLVAFLGYCHEDGRNILVYEFMHNGTLKEHLHGRDKHISWIKRLEIAEDAAKGIEYLHTGCTPSIIHRDIKTSNILLDKQMRAKVSDFGLSKLVAEESHASTNVRGTLGYLDPQYYTSQQLTEKSDMYSFGIILLELISGRPPISTISFGEHLRSIGPWAKWYYESGDIEAIIDPSISGSGGYQDVQSIWKIAEAAVRCIDAEPRKRPCMPEVVKEIQDAMALERSSASETIMTMRGGAGGGCPFSPAAASVRSGGTMRSHDMVMDNLLLMDDDDDDS

SEQ ID NO: 21209 - DNA, 723 bp, Panicum virgatum
  misc_feature: Ceres CLONE 1815063-R
  misc_feature: Encodes the peptide sequence at SEQ ID NO. 21210
tgttatgcacatgcttgcagagtgtgtggggctcccatggtttgagagctggggaactaagaaactttctgagcttgggcttcctatcatgaaaccatccaaacttgtcaaggtaaatgaagatcagccggttctaaaagccttccaactgatgagggaaaaaggagttggtggtctaccagtcatggacacgagtggagcaaaagcaattggtaacatcagtatcagagatgttcaatatcttctaactgcccccaagatatacaaagagcacaggacaatcacaacaaaggattttctcactgcggtgcgacagcatctccaggagcaacatgagacctcaccctttctgcacgatgtgatcacttgcaaaaaggacgacacgatcaaggacattatactgaagctggactctgagaagattcacaggatctacgttgtagatgacaaagggaacactgagggggtcatcacattgagggacataatctccaagctggtgcacgagcctcgccactactttggggatttcttcgatggtgttgttcccctgcctgcaaatagcactgtatgagacaaaatcgtggtccaatcgcattgatgtacctgtgcaaatgtatattatgaaccgttctctttggaggttccttgctgtgtatttcttttcccaacctcctcatgtgaacagagtatgaacaagaaagtaaaaaagaccaattcgcc

SEQ ID NO: 21210 - protein, 190 aa, Panicum virgatum
  misc_feature: Ceres CLONE 1815063-R
  misc_feature (29)..(167): Pfam Name: CBS Pfam Description: CBS domain pair
VMHMLAECVGLPWFESWGTKKLSELGLPIMKPSKLVKVNEDQPVLKAFQLMREKGVGGLPVMDTSGAKAIGNISIRDVQYLLTAPKIYKEHRTITTKDFLTAVRQHLQEQHETSPFLHDVITCKKDDTIKDIILKLDSEKIHRIYVVDDKGNTEGVITLRDIISKLVHEPRHYFGDFFDGVVPLPANSTV

SEQ ID NO: 21211 - DNA, 1245 bp, Panicum virgatum
  misc_feature: Ceres CLONE 1815096
  misc_feature: Encodes the peptide sequence at SEQ ID NO. 21212
acaggtagacaggacaaagatcggaattagtcacgcacccacaaggagagccaggggggacggagagagagccaagagagggagggaggaggaaaccttttcttcttcctcgccgccagcctcttttcctggtcgcgtcttcttggttcttgaatccgccggcgagttcttgcgtccgggcgtggcaatctgcatcttctctctctctctctctctctctctctctctctctctctctctcggggtctctctctctctcctgttccgaccccgtgtaaccgaagaagaactcaatcaaatctaattggaaaagaacgtaaattttaatctgctaggtaggggtggtgggggcgagggcgagcggtcctgacaggaggtaaggcgggccggccgattgatcggcgatggcgccgccgtccagggactactggttcggcttcttccgcggcgcgggggaaaacatcttcgacgccatcgacgtggccatcaccgtcgccgcgtccgaacacccggccgccctccgcgagcgccgcgacgccatcgccgagcgcctcttcaccgcgctcctggtgaccggcgccacgggggcgcccggggcggcggcggccgctggggcggccgcggggacccccgtggcgggggcgcccacgccggcgcagctccaccacgagggcgccgccagcgtgcccagcctctgcagctccgaccgcgccgaggccatcaccgacgatggcgcgccgcgctgcgacgatcccgtcctcgctgagacggagcgcatcaaggccatcctcctcaacgaccaagaaaagtcggaggccgagttgctggagctgctccggcggctgcaggagttggacctagcgttcgacaccttggatgttactgcgattggcaaggctgtggccaaccaccgtaagcacagctccaagcagattcggaacctcgtcagatcgctcattgaaagttggaagcatacagttgatgtgtggattgctcgccgccgagaggctgttgtagatcacacacctcagtccatgggtccttccagcttggagcaggaggagcgaggggtggcttctacccccatggatgaaggcgacctcttcgcaacgccaagcactaccattaggctgtctgaggaaaaccaaggttccaagttctctgatggaatggatgatgatgggagcgtcatgaacaataccggaggtagggactgtggatatccgacaaaccaagaaccagcta

SEQ ID NO: 21212 - protein, 280 aa, Panicum virgatum
  misc_feature: Ceres CLONE 1815096
  misc_feature (116)..(202): Pfam Name: TFIIS Pfam Description: Transcription elongation factor S-II protein N terminal
MAPPSRDYWFGFFRGAGENIFDAIDVAITVAASEHPAALRERRDAIAERLFTALLVTGATGAPGAAAAAGAAAGTPVAGAPTPAQLHHEGAASVPSLCSSDRAEAITDDGAPRCDDPVLAETERIKAILLNDQEKSEAELLELLRRLQELDLAFDTLDVTAIGKAVANHRKHSSKQIRNLVRSLIESWKHTVDVWIARRREAVVDHTPQSMGPSSLEQEERGVASTPMDEGDLFATPSTTIRLSEENQGSKFSDGMDDDGSVMNNTGGRDCGYPTNQEPA

SEQ ID NO: 21213 - DNA, 665 bp, Panicum virgatum
  misc_feature: Ceres CLONE 1815096-R
cttgcaagacctccaaatgcagagtcaggccctgggagaccacaggcaaggcctaggcagcatcaagatgcttcaccagctcaaggcaggacacagtcggctccatctgagaaaccggtggcccaccaggatgcaaactctgtccgagcaaagctggaactcgccaagaatgcgaagctagaggccactaagagaaagcttcaggaaggctaccaagaatttgataatgcgaagaagcaaagaaccatacaaatggtggatccgcaaaatttgccgaagcaagggaacaaccggactttccaacctagtggcaagccaaggaataacagcaacatcaacagcaaccggaattggtcaagatgaggcaccaattccactgagcagcagtgaccatagaattgcaaccatcaaatctccttcaaaacttcattcttctcctttttttttggttgtgatcggctaaatttttagtccaggccagtacataaacagcagcaataaggcttggttgagaatttgctcacattgccccccacagacacttccccagaggggcattgcatgtttgcattctctggctagggtcacagtggctggtcctagtgcttgtcaaacctgtaaagatacgatgctgagtcctaataccaattctgatcttgagctcc

SEQ ID NO: 21214 - DNA, 1759 bp, Panicum virgatum
  misc_feature: Ceres CLONE 1815110
  misc_feature: Encodes the peptide sequence at SEQ ID NO. 21215
atccatagtagcatatatggtacctacatccattggagggtcctcgctattatataccacagcttcctccccgggaatcacatcatcaacaggtaattcagctccatctaagtttaggtcctcaggaggaatatcagtttctttctcagcttcaactctagctgcctctgcctctgcctgcttatcctcttcttccaaaccaagataagtatacatttcatcatcattcatcacagctatagcagcacctatcctatcttccggaattggagtaatttccagggtatcccagtggccgcgggggatcaagcagcgccgcggcggcggtgtgaggaagaggaaggaaggggacaagatgaggaagcgggagcgggagaacccgtgcgggatctgcgggcactaccacaagtacgaggagggggaggtctgcggggtgtgcggccaccgctggaagccgtcggacggggagggcaccccggcgaagcacgagtccgccttccccaccgaggtgctcaaggacttcctcttcctcgggagctacaacaacgcctcccgctccgagactgtgcctgattgccaaaatctatacacgaattcattcacgtatcacaggcttcagcgtgacaggcctttggattttgatgacgcaaaccagtttctagaacaatgtgaaagagataaattacgcgttcttgttcattgcatgactggaaaaaacaggtcagcagctgttgttgccgccttcttgatgaagtctagaggatggagacttgctcagtctttccagtgggtgaaagaccggcggcagcaggttcaactgacagatgcttctcagaacgtgcttctggagtacgagcagaagctttttgggcccagttctcaacctgtgattcccactgaatcatttgtttctcttggatttggttacccaaaaccagcaggtgacacccaagcacctgcgttcaaccaaaatgaccgcgccatccatttttcagcgagtcggcccaaatgttttccccctgaattttgcttttggagccgaggggacagtgggagtcaacccagataacaatgacaatggtggggccaaggccaacccagcttcgactgataacccgatggacaggtcttaagatgatttcaggctatggaatctccatgttgctgaagtaacctactattaggtgtatcgaatacgcatcggggagggtgtttagctttcagatgggtatttttgccttttgtgcactcgagaaatggttgtggcaactgacccgtgctgtagagtgactataacattagacgctggaggaggtgctggccttctccctgcagaagctggaggccatggccgtgccctcggtccaggccgaggtggccaacgaggacgctccgttcgaggtggcggcggccgcggtgacgcgagcgtgttcaacacgctggtgccctcggatgagtggtccggcgggtcggacgggagcgtcacgctggtgcctgtggcggccatcaggtacgcgacccgtcgaggcggtgggcgcgccgatggtcaccgactcaccgtcatacagtcggcaaggcagggtgcggcggggcacagcaccgggaggttcaaagtgcagcataaatatgtggatgtacatgtgagatcagtattgtagaattgtcttttttttcgaagaaaaggaataattgtcagtttgtgcggtacgatacaattttagttcgtcatgtcaatctaagacgttcatatttgccgtgc

SEQ ID NO: 21215 - protein, 237 aa, Panicum virgatum
  misc_feature: Ceres CLONE 1815110
  misc_feature (48)..(169): Pfam Name: DSPc Pfam Description: Dual specificity phosphatase, catalytic domain
  misc_feature: SWISSPROT Homolog: EC 3.1.3.48 Protein-tyrosine-phosphatase
MRKRERENPCGICGHYHKYEEGEVCGVCGHRWKPSDGEGTPAKHESAFPTEVLKDFLFLGSYNNASRSETVPDCQNLYTNSFTYHRLQRDRPLDFDDANQFLEQCERDKLRVLVHCMTGKNRSAAVVAAFLMKSRGWRLAQSFQWVKDRRQQVQLTDASQNVLLEYEQKLFGPSSQPVIPTESFVSLGFGYPKPAGDTQAPAFNQNDRAIHFSASRPKCFPPEFCFWSRGDSGSQPR

SEQ ID NO: 21216 - DNA, 1416 bp, Panicum virgatum
  misc_feature: Ceres CLONE 1815113
  misc_feature: Encodes the peptide sequence at SEQ ID NO. 21217
aagaaagccgcacaaagggaagttgcccctcccggcctcccctcacatccccgcccgcccgcgcgtcaagggggaaggaatccggccggccccgagcaggaacggtcgggaatcagagccgcggcgtccggcgcgaggaggcgcggagcggggaccggggctgcggggacggggccgcgtggcgccgggcggggggaggggagttttgaaacggccgaaggagctccatcagggggagccggggtgaggaagagggaggtagaagacaaagctgacgagtggggcccgcctggcggtatatatggctgaaggctgacaggctgacaccgccgcgccgtcctcttccccggttcccccggcccgcgccgccttaaccggccgtccgctccccgtgtcagccctcgcacttccgccgccggcgtcgactcgccgcgctcctcctccgccctcagctggtttcggattggcgcggagcgggcgaatccgtccacgcttgtgattgatttttacccttggtgcaagcaacatcaaaccatttccagtaggcttatggatgctttaatttcaagtttaaacaccatggagatggaaaccagtcagacttcagaattggtaattcaacataagccaggaccagaggttaatcaaaatcctgtgcaaaatgattttaacccagaaaatgaaactgatgagcttccagggtccaaggtcaatgaagagccagtggaaacatgtcaggacacagtggtggaaactgatgtcatcccagagaagaaagctgaaccggaagcaggattggaggttaatcaaaagcctactgaaacatggcaggagaaatctgtagaatctgatgttaatccagaaaagcgaattcctgatccgggtgttatttaccgctgtaataaatgtcggaggatgcttgcaactcaagaatttgttgttacccatgaagtgggcgcaggtgggaagagcttcaacagaggcaaacagtcagatgatgatgacaaacaaactgaatgtccctgcatctttgtggagccgatgaagtggatgcaaactgtggaagaaggatatgttgcgaataagctcttctgtatgggatgcaaaactcgtctgggacaattcaactgggctggtatgcagtgcagctgcggagcctgggtgattccagcgtttcagctgactaaaagcaagattgacgaatgctcaatgtaaccacacaatcaagtgaagctttgatcccttagcagtgatgttacaacttacaacatatatatgtagctaggaaatagtatcggctagccttctatagccagtctggtgaagcggttatcagtagtttaattttctgatctcatccasagcatcagtgctttgatttcaccaagctgcaacaactgaacaaacccggaagca

SEQ ID NO: 21217 - protein, 221 aa, Panicum virgatum
  misc_feature: Ceres CLONE 1815113
  misc_feature: SWISSPROT Homolog: EC 3.1.3.48 Protein-tyrosine-phosphatase
  misc_feature: Useful for making plants with modulated biomass
MDALISSLNTMEMETSQTSELVIQHKPGPEVNQNPVQNDFNPENETDELPGSKVNEEPVETCQDTVVETDVIPEKKAEPEAGLEVNQKPTETWQEKSVESDVNPEKRIPDPGVIYRCNKCRRMLATQEFVVTHEVGAGGKSFNRGKQSDDDDKQTECPCIFVEPMKWMQTVEEGYVANKLFCMGCKTRLGQFNWAGMQCSCGAWVIPAFQLTKSKIDECSM

SEQ ID NO: 21218 - DNA, 721 bp, Panicum virgatum
  misc_feature: Ceres CLONE 1815117
  misc_feature: Encodes the peptide sequence at SEQ ID NO. 21219
aaaaaccacacgctgcgcgctttacgagagagagaagtgcaaaggttcgcttcttgtagcctagtttgccttcgctgccatggccgatccggctgaggagaccgccgccgcgccgccgccgactccggcggcccctgccgagagcgtctcagacccgccggtgcagtcgcctgcggacgctgcctcgccggagaaggtgtctcccccagccccggcgtcggcgccggagacaaggtcccgggggtttaggcttcttggagaggacacctccgtgcacaaggctcttgggggcggtaaaactgctgatgtactgttatggaaagacaagaagacctctgctggagtgataggtggcgcaactgtcatctggattctgttcgaagtgcttgattaccatctcctgactctgatatcccatgtgctgattggtgtcctggccatcctgttcctgtggtccaaagccaccaccttcatcaagaagagcccaccagatattcccctggtgcagatacctgaagatctcgctgtgaatgtttcacgagcgctatgcaacgatatcaacagagcgcttcacttgttccgggagattgcaatggggcatgatctaaagaagtttctgggagtgattgtggggctttggattctctcaggagttggaagctgctgtgacttcctcacattgatatacatagctgtcctgatgctccacacggtgccgatc

SEQ ID NO: 21219 - protein, 213 aa, Panicum virgatum
  misc_feature: Ceres CLONE 1815117
  misc_feature (74)..(213): Pfam Name: Reticulon Pfam Description: Reticulon
MADPAEETAAAPPPTPAAPAESVSDPPVQSPADAASPEKVSPPAPASAPETRSRGFRLLGEDTSVHKALGGGKTADVLLWKDKKTSAGVIGGATVIWILFEVLDYHLLTLISHVLIGVLAILFLWSKATTFIKKSPPDIPLVQIPEDLAVNVSRALCNDINRALHLFREIAMGHDLKKFLGVIVGLWILSGVGSCCDFLTLIYIAVLMLHTVP

SEQ ID NO: 21220 - DNA, 698 bp, Panicum virgatum
  misc_feature: Ceres CLONE 1815127
  misc_feature: Encodes the peptide sequence at SEQ ID NO. 21221
gctaaaggaagctcaccccctccgccccccaacgcgcccgacgtcacccaaatccccccacctccctccctcccctgctccgcggcgttctatggcatacacctcctccctccacctccccaagcacctgctcctgcccaacccccgccggaccaggcacaggtcctcctcctccgtctccttcgtccccgccgccgcggccagggccaacggcgtggacgggcgcgcgcccgagaagaagccgccgccgcccaaaggcaaggcgcgcatcaacggcgtgaacggcaagaagggggcgaacgggcacgtcaacagcaacaagggggtgaacgggcacgtcaacggcaacaagggcgtcaacggccatgccgaccggatccacctctcggtgagcacgggcggcggcggcgcgggggcacaggacggctccgggctccgcgtggcgttccagggcgcgcccggcgcgtacagcgagttcgcggccaagacggcgctgcccgggtgcgacacggtcccgtgccggaccttcgcggacgcgctggcggccgtggagcggggcgccgccgaccgcgccatcctccccgtggagtccaccatggagggcaccacgctgcggaactacgacctgctgctgcggcacggcctggtggtggcgcaggagatcaacctcttcgtgcactactgcctcctcgccatgc

SEQ ID NO: 21221 - protein, 202 aa, Panicum virgatum
  misc_feature: Ceres CLONE 1815127
  misc_feature (117)..(201): Pfam Name: PDT Pfam Description: Prephenate dehydratase
  misc_feature: SWISSPROT Homolog: EC 4.2.1.51 Prephenate dehydratase
MAYTSSLHLPKHLLLPNPRRTRHRSSSSVSFVPAAAARANGVDGRAPEKKPPPPKGKARINGVNGKKGANGHVNSNKGVNGHVNGNKGVNGHADRIHLSVSTGGGGAGAQDGSGLRVAFQGAPGAYSEFAAKTALPGCDTVPCRTFADALAAVERGAADRAILPVESTMEGTTLRNYDLLLRHGLVVAQEINLFVHYCLLAM

SEQ ID NO: 21222 - DNA, 703 bp, Panicum virgatum
  misc_feature: Ceres CLONE 1815139
  misc_feature: Encodes the peptide sequence at SEQ ID NO. 21223
atctattcggctattccacggtctctgagaaagacaactagctagctagtctggtgccatggcgggcggtggagaaggcggcggcgccggcagcgacgttgtccacgtcgtcatgttcccctttctcgccttcggccacataagcccgttcgtgcagctggcgcgcaggctggtctccgacgaggccgccggggtccgcgtcacgttcctcacggccgccgggatcgcgccgcgcgtcgaggccatgctggagtccgccgccggcacggtgagggtcctgcccctgaacctgcccgaggtccccggcctgcccgcgggggccgcgagcaccgcggacgtctccggcgacggcgccgagctgctgaagctcgccctcgacggcacccggcccgaggtgcgcgcgctgctcgccgagctccgcccggacgccgtgctggtcgagttcgccacctcctgggtctgcgacgtcgccgctcctctcggcgccaaggtgctctacttcagcgtcttctccgccgtctccttcgcctacttcaccgtccccgcccgcctcgccggcgggcagccgccgaccgcccgcgacctcatggtggcgcctgccgggtaccctgcggcctcgccgctcacctccgcgccgccccagctgcagggaccggccctggtgtacccgtacaccagctttcccggcatgccgtgcgtgtac

SEQ ID NO: 21223 - protein, 214 aa, Panicum virgatum
  misc_feature: Ceres CLONE 1815139
  misc_feature: SWISSPROT Homolog: EC 2.4.1.115 Anthocyanidin 3-O-glucosyltransferase
MAGGGEGGGAGSDVVHVVMFPFLAFGHISPFVQLARRLVSDEAAGVRVTFLTAAGIAPRVEAMLESAAGTVRVLPLNLPEVPGLPAGAASTADVSGDGAELLKLALDGTRPEVRALLAELRPDAVLVEFATSWVCDVAAPLGAKVLYFSVFSAVSFAYFTVPARLAGGQPPTARDLMVAPAGYPAASPLTSAPPQLQGPALVYPYTSFPGMPCV

SEQ ID NO: 21224 - DNA, 1365 bp, Panicum virgatum
  misc_feature: Ceres CLONE 1815146
  misc_feature: Encodes the peptide sequence at SEQ ID NO. 21225
agtagtccactgcctccaaaccctctgctccacctccaaactgccaactccgacgcccgccgccgccgccgccgccgcgacgcaacgcgtagatccaaacccccagcccacgccacctccgccgccgctgaaccgcgtccacgcggccgccccaggtgagcaaccctgcgcggaacccacccaccaacctcaccctcccacggaccccgcggccgcgacggctagggtttcgcttgcgacggcgtaggattctcgttactcgtcgcgggaatttcattcgctcgtttcgtcttggttcggtatggggactgggagtgtttcctcgccgcggtggcgagatccgtgaaggcggcgcggcgtttacaactggtccggcgttgatgcgtgggcactgagtttcctgcgttccggtttcaggccccggcgttgctcaagcagaaccgaagatggcgcgccgagggttgatggagcaggatctgagcacgctcgacgttttcaagctgagccctctgtcgccggaggtgatttcgcgccaggcgacgatcaacatcggtaccattgggcacgtggcccatgggaagtctacggttgtcaaagcaatctcaggtgtacagacagttcgtttcaagaatgaactggagcgcaatatcactataaagcttggttatgctaatgcaaaaatctataaatgtgaagatgatagatgcccacggccaatgtgctacaaggcttatggcagtggcaaagaagatagtcctctctgtgacgttccagggtttgaaaactgcaggatgaagctcctgagacatgtttcatttgttgattgcccggggcatgacattctcatgactacaatgcttaatggagcagctatcatggacggtgcactacttctgattgcagcaaacgagagctgtccccaaccccagacatctgaacaccttgcagctgttgaaattatgcgccttcaacatattatcattctgcagaacaaaattgatcttatccaggaaagtgcagcaatgaaccagcatgaagcaatccagaaatttatacagggaacaatagctcaaggtgctcctgtggtgccaatatctgcacagctgaagtacaatattgatgttatctgtgaatacatcgtgaaaaagatccccatcccagagaggaacttcacctctccacccaatatgattgttattcgttcttttgatgtgaacaaacctggttcggaggttgatgaaatcaagggtggagtagcaggtggcagtatcctcaagggagtcctgagggtgaaccagaaaatcgaagttcgcccaggcatcgtgatgaaagatgagaatggcaaaattaaatgcacacccatct

SEQ ID NO: 21225 - protein, 306 aa, Panicum virgatum
  misc_feature: Ceres CLONE 1815146
  misc_feature (30)..(237): Pfam Name: GTP_EFTU Pfam Description: Elongation factor Tu GTP binding domain
  misc_feature: SWISSPROT Homolog: EC 2.1.1.43 Histone-lysine N-methyltransferase
MARRGLMEQDLSTLDVFKLSPLSPEVISRQATINIGTIGHVAHGKSTVVKAISGVQTVRFKNELERNITIKLGYANAKIYKCEDDRCPRPMCYKAYGSGKEDSPLCDVPGFENCRMKLLRHVSFVDCPGHDILMTTMLNGAAIMDGALLLIAANESCPQPQTSEHLAAVEIMRLQHIIILQNKIDLIQESAAMNQHEAIQKFIQGTIAQGAPVVPISAQLKYNIDVICEYIVKKIPIPERNFTSPPNMIVIRSFDVNKPGSEVDEIKGGVAGGSILKGVLRVNQKIEVRPGIVMKDENGKIKCTPI

SEQ ID NO: 21226 - DNA, 540 bp, Panicum virgatum
  misc_feature: Ceres CLONE 1815146-R
  misc_feature: Encodes the peptide sequence at SEQ ID NO. 21227
gatgtttacattgagttagaggtgaacttcttcctcctaaggaggctgctgggggtgaggacaagtggaacagaaagggcaagcagggtctcaaagctcgccaagggtgagatcctgatgcttaacattgggtcaatgtccactggagcccgtgttgtcgctgtcaagaacgatcttgcaaagctgcagctgactgcaccggtgtgcactagcaagggtgagaagctggcccttagccggcgcatcgagaagcactggcgtctcattggttggggcacaatccaggccggcactacacttgacgtccctccctgtctgctctgaatcgtacaccacctgtttgacgtaagtagagtttgaaagaagagagtggacatgtggcaaggcagagcttttaggaactgtttttgtaaggtggaggagaaaacctgaaccaaaatgtttaagtattgttacatttacttggggagtgtaatgataagcttgaatattgaattgtgtaatttctggcttcagagcagtgaattgcggatgctgtgc

SEQ ID NO: 21227 - protein, 107 aa, Panicum virgatum
  misc_feature: Ceres CLONE 1815146-R
  misc_feature (3)..(94): Pfam Name: eIF2_C Pfam Description: Initiation factor eIF2 gamma, C terminal
DVYIELEVNFFLLRRLLGVRTSGTERASRVSKLAKGEILMLNIGSMSTGARVVAVKNDLAKLQLTAPVCTSKGEKLALSRRIEKHWRLIGWGTIQAGTTLDVPPCLL

SEQ ID NO: 21228 - DNA, 684 bp, Panicum virgatum
  misc_feature: Ceres CLONE 1815148
  misc_feature: Encodes the peptide sequence at SEQ ID NO. 21229
aaatccggcacgccacgtcgccacggcacggctcggttcggccccggcgtggcgccccaccccccgatggcgctcgcctccgccactaccgccgccgccgccgccgcggcctcctccccctcccgcctcttccgccgcttctcttcctccgcacctcctccctcgctcctccccctcgccgcgcgcccaggagccgggagctccccgcgcgcctgcagctaccaccagttcgtggtgcgatggaagggcagggcgcgggcgctcctcggggggttctcggacgccggcggcagcgagagcgacgacgatgaggaggacgccctgcgaaggggccagcgggagggagagggcgaggacgccgtcgagcccgccgcggcggccgccgggcctgagagatgggacgtgctcggcctcagccaggccatggttgatttctcagggatggtggacgatgagttcctcgagagattgggcatagagaagggcacgaggaaggttgtaaaccatgaggagagaggacaggtcttgcgcgccatggatgggtgcagctacaaggctgcagccggaggctccctgtccaactcacttgtggccctggccaggcttggaagtagccggtctgctgggtaccctgagcttaaaattgcgatggctggcagtgtgggcagtgacccactaggtagt

SEQ ID NO: 21229 - protein, 205 aa, Panicum virgatum
  misc_feature: Ceres CLONE 1815148
  misc_feature: SWISSPROT Homolog: EC 2.7.1.73 Inosine kinase
MALASATTAAAAAAASSPSRLFRRFSSSAPPPSLLPLAARPGAGSSPRACSYHQFVVRWKGRARALLGGFSDAGGSESDDDEEDALRRGQREGEGEDAVEPAAAAAGPERWDVLGLSQAMVDFSGMVDDEFLERLGIEKGTRKVVNHEERGQVLRAMDGCSYKAAAGGSLSNSLVALARLGSSRSAGYPELKIAMAGSVGSDPLG

SEQ ID NO: 21230 - DNA, 1352 bp, Panicum virgatum
  misc_feature: Ceres CLONE 1815150
  misc_feature: Encodes the peptide sequence at SEQ ID NO. 21231
agctttgggaactgactcttgggttggtgtcaaagattctctcgccgtctcgccgcaggcagcgcagagcactcaatctcacttcccgacacccgcacgcgctccctccactgatccagccatccactccccagtccccacccaaccgtagccaaaccgcacacggccacgcccatggacgcgagtggggcgccgccgccgctcctcctggccgcggctgtgctgctcgccgccgcgttgggatggctcctcgccgcgcggtcgtcgaagcgcgggtcggcgcggctgccgccgggcagcacggggctgccgctcgtcggggagacgctgcgcctcatctccgcctacaagacccccaacccggagcccttcatcgacgaccgcgtggcgcgccacggcagcggcgtcttcaccacccacatcttcggcgagcgcaccgtcttctccgccgacccggccttcaaccgcctcctcctcgccgccgagggccgcgccgtcgactgcagctacccgtcctccatcgccacgctgctcggcccgcactcgctgctcctcaccaagggccccgcgcacaggcgcctccacgcgctcacgctcacccgcctcggccgccccgcgtcgccgccgctcctcgcccacatcgaccgcctcatcctcgccaccatgcgggagtgggagcccgccgccaccgtccgcctcctcgaccaggccaaaaagatcaccttcaacctcaccgtcaagcagctcgtcagcatcgaccccgggccgtggaccgagagcgtccgccgtgagtacgtcaagctcatcgacggcttcttctccatcccgttccccttcgcccacctcctccctttcaccacctacggccaggccctcaaggcgaggaagaaggtggccggggctctgcgggaggtgataaggaagaggatggacgacaaggtgcaaaatggtgccgcgaatgggaaggaggatgacaagattgagaagaaggacatggtggaggagcttcttggagcagagggtgggagcttctccgaggaggaaatggtggatttctgcctctctctgctggtggctggctacgagacgacgtccgtgctcatgacgcttgctgtcaagttcctcaccgagacacccactgcgctggcgcagctcagggaagagcatgaaaatatcagagacattaaaggaaaaaaccaacctctggaatggagcgattacaagtccatgccacttacacaatgtgtgataaatgaaacattgcgtgttgctaacttaattagtggggtatccaggcgtgcaaacactgatattcattttaaaaactaccttatcccaaagggcctgcaaaa

SEQ ID NO: 21231 - protein, 392 aa, Panicum virgatum
  misc_feature: Ceres CLONE 1815150
  misc_feature (39)..(392): Pfam Name: p450 Pfam Description: Cytochrome P450
  misc_feature: SWISSPROT Homolog: EC 1.14.13.93 (+)-abscisic acid 8'-hydroxylase
MDASGAPPPLLLAAAVLLAAALGWLLAARSSKRGSARLPPGSTGLPLVGETLRLISAYKTPNPEPFIDDRVARHGSGVFTTHIFGERTVFSADPAFNRLLLAAEGRAVDCSYPSSIATLLGPHSLLLTKGPAHRRLHALTLTRLGRPASPPLLAHIDRLILATMREWEPAATVRLLDQAKKITFNLTVKQLVSIDPGPWTESVRREYVKLIDGFFSIPFPFAHLLPFTTYGQALKARKKVAGALREVIRKRMDDKVQNGAANGKEDDKIEKKDMVEELLGAEGGSFSEEEMVDFCLSLLVAGYETTSVLMTLAVKFLTETPTALAQLREEHENIRDIKGKNQPLEWSDYKSMPLTQCVINETLRVANLISGVSRRANTDIHFKNYLIPKGLQ

SEQ ID NO: 21232 - DNA, 497 bp, Panicum virgatum
  misc_feature: Ceres CLONE 1815150-R
  misc_feature: Encodes the peptide sequence at SEQ ID NO. 21233
tccctttggtggcggacctcgtctgtgcccaggctatgagcttgcccgagttgttgtttctgtttttctccatcatcttgtaacgcgctttagctgggaagaagctgaggaagataggattgtcttcttccccaccacccgaactctcaaaggataccccatcaatctccggcggcgaccagattctgttttctgacctcgcattaggttccagttacgcctatggagttatggtcaaagtaagagtaattaagtacatatactaaagggccaagaaacagcgcaacctcatgagtcgtgactcacgtggggccgtgcactgttcatgcctaaagggtccaaacggcgcggcccactgttcatgcgggtcccatatactattcaggcggggcccacgtggcccacgtactattcaggcggggcccgcgtgggacccatgtactattcaggcgggcccatgtggggccatgattctataaagttagtctttttatctt

SEQ ID NO: 21233 - protein, 64 aa, Panicum virgatum
  misc_feature: Ceres CLONE 1815150-R
  misc_feature: SWISSPROT Homolog: EC 1.14.13.93 (+)-abscisic acid 8'-hydroxylase
  misc_feature: Useful for making plants with modulated biomass
  misc_feature: Useful for making plants with modulated heat sensitivity
  misc_feature: Useful for making plants with modulated seed number
PFGGGPRLCPGYELARVVVSVFLHHLVTRFSWEEAEEDRIVFFPTTRTLKGYPINLRRRPDSVF

SEQ ID NO: 21234 - DNA, 1437 bp, Panicum virgatum
  misc_feature: Ceres CLONE 1815164
  misc_feature: Encodes the peptide sequence at SEQ ID NO. 21235
atgcatctcgatccatctcatatgcagacatacatgtatagatagatagatagatagatagatagatagaatgatccatgacctcacgcacctttactggccctctctctgagtctcttctcttattagcttcttctgagttctgagagttagttagatccatcggcgtgaccggccgctatgatcgatgcaatagcaacaagctataagataatagcaacctcagctcatggagggaagtaatggcaaagagttggagtactacagctctgcctctactacggatcatccgctgcagtcgtcgtctgccgatgtgcctcacgacgggaggagctccagcaataatagcagcacggtggagctggatgaagccggcgccggtgacagcagcaggaagaccgcggcctctccatcgtcggttcgcccctacgtccgctcaaagaaccctcgcctccgctggacgccggagctgcaccactgcttcctccgggccgtcgacaggctcggcggccaagatcgtgcaactcccaagctcgttcttcaactgatgaacgttaaagggctcagcataggccatgtcaagagccacctccaaatgtatagaagcaagaagattgacggctcggggcaggtgataggtggttcatggagaaatgatcatcggttgcaagagggggggcaagtgtacaacctcagccatctttcctcgcatcacggccagactggtgctagtactaccctattgtcagcaaggtttggtgcatggcctcattggaacaatttccatcaaccatactggcttcatggtcaccatgttcttggatcgaaaacctactactcatcagcagctgaagccgacgacccattccttagaacacgagctgatcagtctgttactggagcttcgattcttcaagggtgttcatcatatcaaaatgatcgatccatgaacaatcaaatacgactgctgcgcgatcaggagaacattaataaccaccatgatccccttgatctcgaactcacactggatattgggacacggcgggataagagaataaagagatcaggttctagctggggcagagaagatgagaatgccagggatcaagaacaagaagtggctgatactgggctctctctttctttcttctcatctcctcctgcgaggaccagtagtggtaggtgtcagtatggataaaggaaaagctcacccaacaaaggacaagtactcttgatctcaccatgcatgatctacttcgccgtcggtgtggtgatatcttgtggtacttatccatgtatgtagaggaacatacgtatgcatataaatatatatcttagagcgagctattaattatttatacatattttgatcttttgagtttagctatgtttgtaagtggctacatctgaatttatttttgatgtactctttcaacc

SEQ ID NO: 21235 - protein, 322 aa, Panicum virgatum
  misc_feature: Ceres CLONE 1815164
  misc_feature (74)..(125): Pfam Name: Myb_DNA-binding Pfam Description: Myb-like DNA-binding domain
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 1999 in the 11/479,226 US patent application
MEGSNGKELEYYSSASTTDHPLQSSSADVPHDGRSSSNNSSTVELDEAGAGDSSRKTAASPSSVRPYVRSKNPRLRWTPELHHCFLRAVDRLGGQDRATPKLVLQLMNVKGLSIGHVKSHLQMYRSKKIDGSGQVIGGSWRNDHRLQEGGQVYNLSHLSSHHGQTGASTTLLSARFGAWPHWNNFHQPYWLHGHHVLGSKTYYSSAAEADDPFLRTRADQSVTGASILQGCSSYQNDRSMNNQIRLLRDQENINNHHDPLDLELTLDIGTRRDKRIKRSGSSWGREDENARDQEQEVADTGLSLSFFSSPPARTSSGRCQYG

SEQ ID NO: 21236 - DNA, 2214 bp, Panicum virgatum
  misc_feature: Ceres CLONE 1815166
  misc_feature: Encodes the peptide sequence at SEQ ID NO. 21237
aatacccgcgcgcgccgctcgctgcgccgcgccgcgccgtgctgtctcccctcccgtcccgctctcggcgctgcggctcacgcagtccctgtgtgtgggaggggacggggagatgcgggttggtgatggcggcggcggcgagggagcggcggcgagggggaggcgtgaggccttggaggaaggggaaggggaggcaagtgggtgctcggcgtcggcgagctcgacgagccgcggcagtagcgcgcgcggatcgtcgggcggcgactcgcctttaaccaggttcgtgcgccggggcggtcgtctggtgaagggtccggagcctgacgagaggctcacttcctcttcctcctatgcttctgcaggttccacggaaccacaagaggatgatgatgagggggcattacaggagggcaaggacaacaggtgggtaagtgcacgactccaagagcaggccaagaatgcagtcccccgtcctaccagggaatgccaagaccagcggcatcggttgggggcggttcttttccaaggtaggaaggacagggcacagcgacctgcctcagttgattttggcagccctggcgttgccaaatccttgacgcattctccaggattccctgctaacggtgttggggtgatcaacaaggggttgggtgtgtcatattcatcatataacaggccagacgtgttgtcgagtccagggacaccgagctaccattggcgtgggacaacagttgttgggtatcaaaagggttcgaattccgaaagagtgatcccgccttcaaccggtcatagaaggcatccggcaagcagcacggtgctaccttatagcagtgggaggacactgccatcaaaatgggaggacgcagaacggtggatcttcagtccgaaccccggcaatgcacttggtaggtcaatcccacaactctggcggccaaagtccaaaagtggacctcttggacctcctggcagatttggcgaaccatattcatcttcttcgtcattggctctgttccttgagagtggtagagttggaaatctcactgtgaactcaccttacttggctggagttttgctacctgagcatgtttgtggtggcattatggatcctggaagggatctgggtgcagcatcaggtgaggattgcagcaatggacgaggaggcaggttcggtcaaacgaatggtcagtatcctgctgtgcgatctaccagggtttctcagcaatttggtagtgcaactgagtcatatcagtcactgcgtacttcttatgaatctatacaggatgaacgaattgaaatcataaaagatactgccactagcagtacccctacaattctgaggaaggatgtagcaacacaaacaagccctggtataagcaggtcatcttctcccagcatgaggacttcattctcccgttcgctgtcggtgcaacaagtcaaagagttggagagttgtttctcaaagcttgagatcaaggatgtgcaggtggatgatcgggtgactctgactaggtggtccaagaaacatgtcacacaaggtgctgacaagaatgcaacaaatattatagaatggaagaaaaagacagtagaatctaaatcttctgcctgggaagtaatggaagccgctaagcgtatatcaaagattgagggagaggaagcaaaaatgactgcatgggagaatatgcaaaaagcaaacgcagaagcaaccatacaaaagcttgtgataaaacttggaaagaaaagaccatactcgctggagaggattttcaacaccctcaggtctgttcctcggaaaacgcaggtggtatgcagtacatcaactgtcaatcatgatcagcatatgtccaggagtatcaaaaccgctccacacctcagcaagaatggtcaaatgagttccttgagcggatgcttcacatgtcacgctttctgaagatataagttgcacggtcaagcaccgctcttactttcaaggtggagtttagaggaaactcgaagcttcgtcagtacggaaatggggcctgccaaattttttatctaatggcctgtctgcaacagggttcatattctgttttctctctcttaagttttgattctgccagggtaacataagtagatgcaaaacgagaggagctgctgttatcatgtatgctttgtgaattgtgattattggtatctcactatatagcaataaaatggttcctcttctgctagtctccc

SEQ ID NO: 21237 - protein, 604 aa, Panicum virgatum
  misc_feature: Ceres CLONE 1815166
  misc_feature (486)..(597): Pfam Name: Remorin_C Pfam Description: Remorin, C-terminal region
MRVGDGGGGEGAAARGRREALEEGEGEASGCSASASSTSRGSSARGSSGGDSPLTRFVRRGGRLVKGPEPDERLTSSSSYASAGSTEPQEDDDEGALQEGKDNRWVSARLQEQAKNAVPRPTRECQDQRHRLGAVLFQGRKDRAQRPASVDFGSPGVAKSLTHSPGFPANGVGVINKGLGVSYSSYNRPDVLSSPGTPSYHWRGTTVVGYQKGSNSERVIPPSTGHRRHPASSTVLPYSSGRTLPSKWEDAERWIFSPNPGNALGRSIPQLWRPKSKSGPLGPPGRFGEPYSSSSSLALFLESGRVGNLTVNSPYLAGVLLPEHVCGGIMDPGRDLGAASGEDCSNGRGGRFGQTNGQYPAVRSTRVSQQFGSATESYQSLRTSYESIQDERIEIIKDTATSSTPTILRKDVATQTSPGISRSSSPSMRTSFSRSLSVQQVKELESCFSKLEIKDVQVDDRVTLTRWSKKHVTQGADKNATNIIEWKKKTVESKSSAWEVMEAAKRISKIEGEEAKMTAWENMQKANAEATIQKLVIKLGKKRPYSLERIFNTLRSVPRKTQVVCSTSTVNHDQHMSRSIKTAPHLSKNGQMSSLSGCFTCHAF

SEQ ID NO: 21238 - DNA, 729 bp, Panicum virgatum
  misc_feature: Ceres CLONE 1815170
  misc_feature: Encodes the peptide sequence at SEQ ID NO. 21239
atcgagctagcttgatcgatcagtgaattagttcagtgatagctcagttagttagctgattaacgtgctgctcgttgcaggagccctcgagcaattgagctagctagcgatggcaacctcgatggctcgccgattcgtggcggcggcgtgcgtcgcggccgtggcgttcgcgctcttggcagcgcccagcagcgggcagctggacccgcgcttctacgacaaggcgtgcccggcggcgctccccaccatcaggagggtggtggaggaggccgtggcggcggagcctcgcatgggcgcctcgctcctgcgcctccacttccacgactgcttcgtcaacgggtgcgacgggtcgatcctgctggacgacacgcccttcttcaccggcgagaagaaggcctcgccgaacgtcaactcggcccgcggcttcgacgtgatcgaccgcatcaaggccgccgtcaacgccgcctgcaggggcaacgtcgtctcctgcgccgacatcgtcgccgtcgcggcacgtgactccgtcgtcgcgctgggagggccgtcgtacaacgtgccgctgggccgccgggacgcgcgcacggcgagccaggcggcggcgaacaacagcatcccggcgccgaccttcgacctcgaccgcctcgcctccagcttcgcctcgcacggcctctcactccaggacctcgtcgtgctctcgggcggccacacgctggggcttctcccgctgcg

SEQ ID NO: 21239 - protein, 202 aa, Panicum virgatum
  misc_feature: Ceres CLONE 1815170
  misc_feature (43)..(200): Pfam Name: peroxidase Pfam Description: Peroxidase
  misc_feature: SWISSPROT Homolog: EC 1.11.1.7 Peroxidase
  misc_feature: Useful for making plants with altered carbohydrate content
  misc_feature: Useful for making plants with altered cell wall content and/or composition
MARRFVAAACVAAVAFALLAAPSSGQLDPRFYDKACPAALPTIRRVVEEAVAAEPRMGASLLRLHFHDCFVNGCDGSILLDDTPFFTGEKKASPNVNSARGFDVIDRIKAAVNAACRGNVVSCADIVAVAARDSVVALGGPSYNVPLGRRDARTASQAAANNSIPAPTFDLDRLASSFASHGLSLQDLVVLSGGHTLGLLPL

SEQ ID NO: 21240 - DNA, 2249 bp, Panicum virgatum
  misc_feature: Ceres CLONE 1815201
  misc_feature: Encodes the peptide sequence at SEQ ID NO. 21241
attatcgctttgatttctacttcagctccggcgccgccgtctcctaccttgcttttccgatgctcgcacaggcacaatgggcactactagagctcccgtagccgccattgctccccgcactcacagcaggcaccccgtcatcacggtcgggatcaagcaaaccatgctgcggcggctcctcgccgtcgccgccgtcacgatgctgatcgggccggcagccgaccggcacggcgggggcgccgtcgtcgcgagcccgccggcggaccccgtgcagtgctcgcccggcggcggcggctgcaccgtgtccagcgcctacggcgtgttcccggaccgctccacgtgccgcgccgcggcggcggcgtacccggccacggaggacgagctggtgcgcgccgtggcgcgcgtcgcggcgtccgggaccaaggtgaaggtggccacccgctactcccacagcatcccgccgctggcgtgccccgggagcggcgccggcgaggggctcgtcatcagcacgcggcggctggaccgcgtggtgtccgcggacgcggcgagcgggagggtgacggtggaggccggcgtcacgctgcgggagctcgtcgcggaggcggccagggccgggctcgcgctgccgtacgcgccctactggtgggggctcacggtgggcggcatgctcggcacgggcgcgcacgggagctcgctctgggggaagggcagcgccgtgcacgagtacgtcgtcgggatgcgcgtcgtcacgccggcgccggccgaggaggggtacgccaaggtgcgcgtgctcgccgagggcgacccggagcttgacgccgccaaggtctcgctcggcgtcctcggcgtcatctctcaggtgacgctggagctgcagcctctgttcaagcgctccgtgacgttcaccgagcggaacgacggcgacctggaggagcaggtggccaagttcgggtaccagcacgagttcgccgacatcgcgtggtacccgggccacggccgggcggtgtaccgcgtcgacgaccggctgccgctgagcgcgcccggcgacggcgtcctggacttcatcggcttccgcgccaccccgacgctgggcatccaggccaaccgcctcgccgaggacctcctcgagcgcgccggcgacggcgccggcaagtgcgcggcgtcgcggctgacccacgcggtgctgtcggcggccgggtacggcctgctgcggcggggcgggggcgcgttcgcgggctaccccgtggtggggccgcagcaccggatgcaggcctccggcgggtgcctggcggggcccgaggacgcgctgctgacggcgtgcccctgggacccgcgcgtgcgcgctggcagcttcttccaccagaccaccttcagcctgccgctgcgccgcgctgccgcgttcgtcgccgacgtgcgccgcctgcgggacctcaaccccagggcgctgtgcggcgtcgagctctacgacggcatcctcatgcgctacgtgaaggcgtccacggcgcacctcggcaagcccggggacgagggcggcggcggcggcggcatggtggacttcgacatgacctactaccgcagccgcgacccgcggcgggcgcggctgttcgaggacgtgctggaggagatagagcagatgggcatcttcaagtacggcggcctgccgcactggggcaagaaccgcaacctggccttcgtcggcgccgcgcaaaagtaccccggcctgccggagttcctgcgcgtcaaggacgccttcgaccccgaggggatcttctccagcgactggagcgacatggtgctcggcatcggcggcggctcgccgacgacggacgcgcccgggtgcgcgctggaggggatgtgcgtgtgctcgcgggacgagcactgcgcgccggagcaggggtacctctgccgccccggcaaggtgtacaaggaagccagggtctgcaccatggtgtcgtcctagaaactcagaattggtcaggcacgcctggaattcgattgtttttctagaaactgaagctgaattctaccgggaatttggttgttttctgcatgatcccaaacgaccatatgcacgtcgatcggaagtatcagtaatgacgggtaaattcattgtaaacaatataagaattcaggtgaaagttgcagaaagtgaagagattggtggatgtaacatggaacttgctgacgccagttggcactgcggcagctccgcgaaaccactcagtttcgacaagatactattactggct

SEQ ID NO: 21241 - protein, 598 aa, Panicum virgatum
  misc_feature: Ceres CLONE 1815201
  misc_feature (62)..(204): Pfam Name: FAD_binding_4 Pfam Description: FAD binding domain
  misc_feature (233)..(544): Pfam Name: ALO Pfam Description: D-arabinono-1,4-lactone oxidase
  misc_feature: SWISSPROT Homolog: EC 1.1.3.8 L-gulonolactone oxidase
  misc_feature: Useful for making plants with modulated nitrogen use efficiency
MLRRLLAVAAVTMLIGPAADRHGGGAVVASPPADPVQCSPGGGGCTVSSAYGVFPDRSTCRAAAAAYPATEDELVRAVARVAASGTKVKVATRYSHSIPPLACPGSGAGEGLVISTRRLDRVVSADAASGRVTVEAGVTLRELVAEAARAGLALPYAPYWWGLTVGGMLGTGAHGSSLWGKGSAVHEYVVGMRVVTPAPAEEGYAKVRVLAEGDPELDAAKVSLGVLGVISQVTLELQPLFKRSVTFTERNDGDLEEQVAKFGYQHEFADIAWYPGHGRAVYRVDDRLPLSAPGDGVLDFIGFRATPTLGIQANRLAEDLLERAGDGAGKCAASRLTHAVLSAAGYGLLRRGGGAFAGYPVVGPQHRMQASGGCLAGPEDALLTACPWDPRVRAGSFFHQTTFSLPLRRAAAFVADVRRLRDLNPRALCGVELYDGILMRYVKASTAHLGKPGDEGGGGGGMVDFDMTYYRSRDPRRARLFEDVLEEIEQMGIFKYGGLPHWGKNRNLAFVGAAQKYPGLPEFLRVKDAFDPEGIFSSDWSDMVLGIGGGSPTTDAPGCALEGMCVCSRDEHCAPEQGYLCRPGKVYKEARVCTMVSS

SEQ ID NO: 21242 - DNA, 1856 bp, Panicum virgatum
  misc_feature: Ceres CLONE 1815203
  misc_feature: Encodes the peptide sequence at SEQ ID NO. 21243
ctccaccctccacagaacccagcaatccgctgatctcaactgccggttcctgggcgcccccgatccgcgacgatggatggcggcggcgacgccttcgggtcctcgacggcgccgctggcctggcacgatttcctcgagcgcatgcgccagccctccgccgccgagttcgtcaggtccatcaagagctttatattgaccttctcgagcagagctcctgatccagagcaagatagtgcatctgttcaagagttcctggaaaacatggaaggtgctttcagagcacacactccttgggctggcagttcagaagaagaactagagagtgctggtgagggacttgagaaatatgttatgacaaagctgtttaatcgggtatttgcttcggtcccagaagatgtgaagagtgatgaagagctttttgagaaaatgtctttgctacaacagtttataaggcctgaaaacttggatataaaaccagagtatcagaatgaaacatcttggctgctggcgcagaaggagctgcagaagataaatatgtataaggctccaagggataagctttcttgcatcttaaactgctgtaaagtcatcaataacttactgctaaatgcttctattgtatccaatgataaccccccaggagccgatgaattccttccagtcctcatctatgttaccataaaggataatcctccacagctgcactcaaatctattatacatacagagatatagacggcaaacacgattggtgtcagatgctcaatacttttttacaaacatactgtctgctgagtctttcatatggaacattgatggggaatcactgtccatgaatgagctagatttccaaaggaagatggactgggcaagagagcgcttgttgggattatcagctgactcagaaaatcaggataatcaagccaatcctgatgtccaagagcggagatcacagaatcttaaagctaataggagttctgatgttagcttatccttgaaagaccccatccaaggctcaggacaggacatgagaagggacagtgatgtgagtgtgggtggtaaaccagttgaacgggtgcaatctgtttctgatttagagaataaaggagctactgagctcctcaatcatgatgacttgaacaaaaagttccaggagtacccgtacctatttgcccgggctggtgacctgaccattgccgatgttgaaagtctcttgaattcttacaagcatctagtagttaggtatgtagcacttgcacaaggtatgggtgtcagccctgaaaccactcttgctcagagtggtcaaacatcatctgatctggtagcatccgaagaacctgagaatgtgagtagtgtggtaaataacaatgataacagtgaaggaattagcaaaacttctgatgatgttccaagtgaaaaccatcatacggaagcatctgaacaaatgacccagaaaaccgctgttgaccccagtgatgatctgaaggtaacgaaggatgaagcattgcatcaggctgagaattcgtgagctgtttggtcaaaagaccagctgaattgggaatacaaggggtccccaagatgacaatgaccacgaaacagagtacatgtttccctgagcggtatgcagcaactcttcaagccacaaatgtgcatgctgcaagcttgaatgcatttattctgcattgtgggagataaatccattctgctgaagctgttcttagatccaaatgcttgttcattgcattatagttcttggctctgctgtaagtttgtttttggtgaacacaccttcctttttatttccttaaaactaatacttttgtaactagaatttcttaagtgaagctagttcatacc

SEQ ID NO: 21243 - protein, 484 aa, Panicum virgatum
  misc_feature: Ceres CLONE 1815203
  misc_feature (143)..(249): Pfam Name: VPS9 Pfam Description: Vacuolar sorting protein 9 (VPS9) domain
MDGGGDAFGSSTAPLAWHDFLERMRQPSAAEFVRSIKSFILTFSSRAPDPEQDSASVQEFLENMEGAFRAHTPWAGSSEEELESAGEGLEKYVMTKLFNRVFASVPEDVKSDEELFEKMSLLQQFIRPENLDIKPEYQNETSWLLAQKELQKINMYKAPRDKLSCILNCCKVINNLLLNASIVSNDNPPGADEFLPVLIYVTIKDNPPQLHSNLLYIQRYRRQTRLVSDAQYFFTNILSAESFIWNIDGESLSMNELDFQRKMDWARERLLGLSADSENQDNQANPDVQERRSQNLKANRSSDVSLSLKDPIQGSGQDMRRDSDVSVGGKPVERVQSVSDLENKGATELLNHDDLNKKFQEYPYLFARAGDLTIADVESLLNSYKHLVVRYVALAQGMGVSPETTLAQSGQTSSDLVASEEPENVSSVVNNNDNSEGISKTSDDVPSENHHTEASEQMTQKTAVDPSDDLKVTKDEALHQAENS

SEQ ID NO: 21244 - DNA, 636 bp, Panicum virgatum
  misc_feature: Ceres CLONE 1815224
  misc_feature: Encodes the peptide sequence at SEQ ID NO. 21245
accaccactacacgagagagtgacgatccccgccgcggcagcggagaatgacggccgtggctgcgctcacggtcacggactccgcggcggcggcggctgccggcgaccgctcgccgtcctcctccccgccgcaggcggcgtccgcgggcccgccgcccgcgccgccggagctgggcatggtcgcgcgcgccgtgcagcggctcgtggcgcggaacgacgcggtggcggcggcgccggacggccgcgggggcggagcagggatgaaggcgttcgaggcggccccgggcgcgcgggcgccgcggatcggcgtggccgagtacctggagcgcatgcaccgctacgcgaggctcgaccccgagtgctacgtcgtcgcctacgcctacgtcgacatggccgcgcaccgccgccccgccgccgccgtcgcgtccaggaacgtgcaccgccttctcctcgcctgcctcctcgtcgcctccaaggtccttgacgacttccaccacagcaacgccttcttcgcgcgcgtgggcggcgtgagcaacgcggagatgaacaagctggagctggagctcctcggcgtgctggacttcgccgtcgcggtcgaccaccgcacctaccgcaggtaccgcgagcacctggaga

SEQ ID NO: 21245 - protein, 196 aa, Panicum virgatum
  misc_feature: Ceres CLONE 1815224
  misc_feature (46)..(181): Pfam Name: Cyclin Pfam Description: Cyclin
MTAVAALTVTDSAAAAAAGDRSPSSSPPQAASAGPPPAPPELGMVARAVQRLVARNDAVAAAPDGRGGGAGMKAFEAAPGARAPRIGVAEYLERMHRYARLDPECYVVAYAYVDMAAHRRPAAAVASRNVHRLLLACLLVASKVLDDFHHSNAFFARVGGVSNAEMNKLELELLGVLDFAVAVDHRTYRRYREHLE

SEQ ID NO: 21246 - DNA, 1977 bp, Panicum virgatum
  misc_feature: Ceres CLONE 1815246
  misc_feature: Encodes the peptide sequence at SEQ ID NO. 21247
agcgcaggggactcccatccgtctccactgctggatcgagaaatttctcgccggatctcccccctgccctcccctttctgcctgggcctggggagagggcggccagccatggccatggcccctcgatctctcgccgctctcctcctgctcctcctcttcgccgccgccgccaccaccagcagcagcaaggacgaggaggaggacctccagtacctcatcgacgacgccggtgacatccccgacaacggccctgacggcgacggcgactacgacgacctcttcgaggaccaggacctcccggaccagcagccgcacatcgacgagacccacgtcgtcgtcctcaccgccgccaacttctcctccttcctcgccgccacccgccacgtcatggtcgagttctacgccccctggtgcggccactgccaggagcttgccccggactacgccgccgccgcctcccaccttgcggcccaccacagccagagccacctcgccctcgccaaggtcgacgccaccgaggacacggacctcgcccacaagtacgacgtccagggattccccaccatcctcttcttcatcgacggcgtcccaaaggactacaacggcgccaggaccaaggatgccatcgtcgagtggatcaacaagaagctcggcccgggagtgcaaaacatcaccgccgtcgaccaggccgagaggatactcacaggggatgacaaggccgtccttgcctttctcgactcgctatctggtgctcaaagtgatgagcttgcggctgcttcaaggctggaagatagcgtcaacttttatcagacttcaagtcctgatgttgctaagcttttccacattgacccagcagcaaagcgcccatgcgtagtattgctgaagaaggaggaggagaagttgaccttctttgatggggagtttaaagcatcagtgattgccgattttgtgtctgcaaacaagcttcctttggttactacgctaactcaggaaacttccccttcaatttttggcaattcaatcaagaagcagattttactatttgctgttgcaaataagtcctcgaaatttctgcccatctttaaggaagcagcaaagtcattcaagagaaagctattatttatctttgtggagcgagacaatgaggaagttggtgaaccagttgccaactactttggtattactggacaagagaccactgttcttgcttacactgggaatgaagatgctaggaaatttttctttgatggtgaagtgtcactggactccattaaggactttgctgaaagtttcttggaagacaagctcacaccattctacaagtctgaaccagtacctgaatctaatgatggtgatatcaaaattgttgttgggaagaatttggatctgatagttttggatgaatcgaaagatgtccttctggagatatatgcaccgtggtgtggacattgtcaatcactggagcctacttacaacaaactagctaagcatctacgtggcatcgactcccttgtgatagccaaaatggatggaactagcaatgagcatccacgtgccaagcctgatggataccccacgattctattctatccagcggggaagaaaagctttgaacctatcacttttgagggggaccggaccattgtagagatgtacaaattcatcaagaagtatgctagcatccctttcaagttgaagcgccaacaatcatcaacggcgagaaccgggagcactcagacagagggtgtgaggagctcgggtacaaatctgaaggacgaattgtagggcattaaagtaccacgcaacatagtgctggctgttagttttgaggtggatcctcccctgcaatcttccctttctggaggagggaataggagaagttatcaatcaggtagaaagtggtcaggttgagggcttggacaagtaagacgggaacaattcgggatacaatcgaataaaaagcaaatcctttccttt

SEQ ID NO: 21247 - protein, 556 aa, Panicum virgatum
  misc_feature: Ceres CLONE 1815246
  misc_feature (72)..(178): Pfam Name: Thioredoxin Pfam Description: Thioredoxin
  misc_feature (414)..(520): Pfam Name: Thioredoxin Pfam Description: Thioredoxin
  misc_feature: SWISSPROT Homolog: EC 5.3.4.1 Protein disulfide-isomerase
MAPRSLAALLLLLLFAAAATTSSSKDEEEDLQYLIDDAGDIPDNGPDGDGDYDDLFEDQDLPDQQPHIDETHVVVLTAANFSSFLAATRHVMVEFYAPWCGHCQELAPDYAAAASHLAAHHSQSHLALAKVDATEDTDLAHKYDVQGFPTILFFIDGVPKDYNGARTKDAIVEWINKKLGPGVQNITAVDQAERILTGDDKAVLAFLDSLSGAQSDELAAASRLEDSVNFYQTSSPDVAKLFHIDPAAKRPCVVLLKKEEEKLTFFDGEFKASVIADFVSANKLPLVTTLTQETSPSIFGNSIKKQILLFAVANKSSKFLPIFKEAAKSFKRKLLFIFVERDNEEVGEPVANYFGITGQETTVLAYTGNEDARKFFFDGEVSLDSIKDFAESFLEDKLTPFYKSEPVPESNDGDIKIVVGKNLDLIVLDESKDVLLEIYAPWCGHCQSLEPTYNKLAKHLRGIDSLVIAKMDGTSNEHPRAKPDGYPTILFYPAGKKSFEPITFEGDRTIVEMYKFIKKYASIPFKLKRQQSSTARTGSTQTEGVRSSGTNLKDEL

SEQ ID NO: 21248 - DNA, 1906 bp, Panicum virgatum
  misc_feature: Ceres CLONE 1815259
  misc_feature: Encodes the peptide sequence at SEQ ID NO. 21249
agtgaaactcggaggctccattattggcgagccattgagcagcccaaggagcgaggatagggtagggtcggtggagcagcgacgagcggcggccatggagggcggcgtgcacgagttcgacggctccaccttcaaggagtgcttctccctctcgtggaggaacccctacgtcctccgcctcgccttctccgccggcatcggcggcctcctcttcggctacgacaccggtgttatttcgggtgctctgctttacatccgtgacgacttccgttcggtcgacaggaacacatggcttcaggaaatgatcgtgagcatggcggtggccggcgcgatcatcggcgcggcgatcgggggctggacgacggaccggttcgggcggcggacgtcgatcctcgtggccgacttcctcttcttcgcgggcgcggtggtgatggcgtccgccacgggccccgcgcagctcgtcgtgggccgcgtcttcgtcggcctcggcgtcggcatggcgtccatgacctccccgctctacatctccgaggcgtccccggcccggatccgcggcgcgctcgtcagcaccaacggcttcctcatcaccggcggccagttcctggcctacctcatcaacctcgccttcaccaaggcgccggggacgtggaggtggatgctcggcgtcgccgcgctccccgccgtcctccagttcggcctcatgctcttcctccccgagtccccccgatggctctaccggaaggggcgggcggaggaagccgaggcgatcctgcggcggatctactcggcggaggaggcggagcgggagatcgaggagctcaaggagtcggtggcggcggagcgcgcctcgtcggagaaggtgagcctggcggcgctgctgcggacggcgacggtgcggcgggcgctggtcgccggcgtggggctgcaggtgttccagcagctggtgggcatcaacacggtgatgtactacagccccacgatcgtgcagctcgccgggttcgtgtccaaccagacggcgctggcgctgtcgctcgtcacctcggggctcaacgcgctcggctccatcgtcagcatctacttcatcgaccgcacggggcggaagaagctgctcgtgatcagcctcgtcggcgtcatcctctcgctcggcgtgctcgtcgccgtgttccacgagaccacgtcccactcgccggccgtgagcgccgccgagaccgcccgcttcgacggctcgctcacgtgccccgactaccgccagcagctgccggcggcgtcgtcggcgtcgagcggcggcttctgggactgcacccggtgcctcaaggccaggtcgacggagtgcggcttctgctcgtccggcgccggcaagctgctccccggcgcgtgcctggtctccaacgccacgacccgcgacgcgtgccacggcgaggccggccggctgtggtacacgcgcgggtgcccgagccggtacgggtggctggcgctggtggggctggcgctctacatcatcttcttctcccccgggatgggcaccgtgccgtggatcgtcaactcggagatctacccgctgcggtaccgcggtgtgtgcggcggcgcggcggcgacggcgaactgggtgtcgaacctcgccgtggcgcagtcgttcctgtcgctgacggaggccatcggggtggcgtggacgttcctcatcttcgggggcctgtccgtggcggcgctggcgttcgtgctcgtctgcgtgccggagaccaaggggctccccatcgaggaggtggagaagatgctggagcgccgggagctcaggctcaggttctgggcaaaaccgcgcgccgccgacgcggacggcaaggagacggccaagggcgccggcgtgtagctattttactagcagattgattaatggaagagaggattaatt

SEQ ID NO: 21249 - protein, 589 aa, Panicum virgatum
  misc_feature: Ceres CLONE 1815259
  misc_feature (29)..(560): Pfam Name: Sugar_tr Pfam Description: Sugar (and other) transporter
MEGGVHEFDGSTFKECFSLSWRNPYVLRLAFSAGIGGLLFGYDTGVISGALLYIRDDFRSVDRNTWLQEMIVSMAVAGAIIGAAIGGWTTDRFGRRTSILVADFLFFAGAVVMASATGPAQLVVGRVFVGLGVGMASMTSPLYISEASPARIRGALVSTNGFLITGGQFLAYLINLAFTKAPGTWRWMLGVAALPAVLQFGLMLFLPESPRWLYRKGRAEEAEAILRRIYSAEEAEREIEELKESVAAERASSEKVSLAALLRTATVRRALVAGVGLQVFQQLVGINTVMYYSPTIVQLAGFVSNQTALALSLVTSGLNALGSIVSIYFIDRTGRKKLLVISLVGVILSLGVLVAVFHETTSHSPAVSAAETARFDGSLTCPDYRQQLPAASSASSGGFWDCTRCLKARSTECGFCSSGAGKLLPGACLVSNATTRDACHGEAGRLWYTRGCPSRYGWLALVGLALYIIFFSPGMGTVPWIVNSEIYPLRYRGVCGGAAATANWVSNLAVAQSFLSLTEAIGVAWTFLIFGGLSVAALAFVLVCVPETKGLPIEEVEKMLERRELRLRFWAKPRAADADGKETAKGAGV

SEQ ID NO: 21250 - DNA, 1454 bp, Panicum virgatum
  misc_feature: Ceres CLONE 1815269
  misc_feature: Encodes the peptide sequence at SEQ ID NO. 21251
aggtccaacgaactgaactgccttccctcttctttcccgtcaggcgtcggcactttgggctctgcgccgcgctcttcttcctcccccttccctggttctgattcctcccaccaaatccgcccccttccctcacgccttgttgtgtcttgtcatcggcggcctcaccgccggcgacgggaggcagcaatcgggtaccccttccgcagcagccgtccctcgtcgaggtgcggagatccacccgtcaggtgctcgattggtttcatcgtttgctggagcaaaatggatgaggttgtccctgctttggctaccggccaagcttcaaccgatgtcttgacggagaagcctttgaaggtgtacatatgggacatggatgagacactaattttgctcaagtcgcttctggatgggtcttatgctggggcctttgatggcctcaaggaccgtgagaaaagtgttgaaattgggaaacgctgggagaacctcattcttgaactctgtgatgagcacttcttttatgaggagattgagaactacaatgaaccctatctcaatgctttaagtgaatatgatgatgggagagacttgacctcatatgattttgaggctgactgttttagttcaccctatgatgatgtgaacaaaaagaaacttgcttacaggcatcgtgctataggagagaaatatgcaaagggtctggaaaaaattctggaccaacacacggtcaaagtctgaaatgatctgtatagtttgactgataattatactgatggctggctgtcttcagctcataagttattggaagaagcattgggcaaatcagcagctacacctgctaccaactcttcaagcattaactgcatagttacatcagggtcgctgattccaagccttgccaaatgtttgctgtatcgcctggatgatgtggtctcgtctgagaatgtttacagctcatgggaagtggggaagctgcagtgcttcaaatggatcaaggagcgctttgacggtccaaatgtacgcttctgtgcgatcggagatgggcacgaagaatgcagcgccgcgcaggttatgaagtggccattcatcaagattgagttccaacccgacgcccctcacaggttcccaggcctagacatgcccacagtccagacgtacatggatgtgatatatgagtcatcaagcaaagatggttgaccaacaattcaagttggttgggttttctcctccgacctccagtgcccatggaggtctggtctgaggaaattgtaagcaaagagatgtcgtgggaagaaacatgttgtcctccctcgatctttaccctggcgaattaggaggcctggtgccataaataagagcctgattagttcgtccatgttccagaggatgtcatagattgtctgtcttgtgttgccattttactatgattcaggcaattgtttgttgttgcgtcctggcgc

SEQ ID NO: 21251 - protein, 150 aa, Panicum virgatum
  misc_feature: Ceres CLONE 1815269
  misc_feature: SWISSPROT Homolog: EC 3.1.3.48 Protein-tyrosine-phosphatase
MDEVVPALATGQASTDVLTEKPLKVYIWDMDETLILLKSLLDGSYAGAFDGLKDREKSVEIGKRWENLILELCDEHFFYEEIENYNEPYLNALSEYDDGRDLTSYDFEADCFSSPYDDVNKKKLAYRHRAIGEKYAKGLEKILDQHTVKV

SEQ ID NO: 21252 - DNA, 149 bp, Panicum virgatum
  misc_feature: Ceres CLONE 1815269-R
cccccccccccccccctgttctgcattgtcaatttgccatttaaaatctgtacatatgcgtcttagattggtggatgttaccgcttctttaaacatgaggcggtgcatatgccttattatgagagattagcaagaatcataggttgggt

SEQ ID NO: 21253 - DNA, 1471 bp, Panicum virgatum
  misc_feature: Ceres CLONE 1815273
  misc_feature: Encodes the peptide sequence at SEQ ID NO. 21254
gtcgagcgattaggatcgtgttccttttgtttcgtggatgaggggggagagcacggaggaggagggggagccgactggcgcgcgctgatcggcggatggcgcgtcggattggagctgcggagctcggcggattccgagcccctcgggagggggatcgaatgccaggagctccagtttcagctccagactgtgttcttgtcgcctcgcctgcctcagctaagctctgactttgctcagtccttgttgcaagttgctgtttgctctcccgtatcctgcctgttccgggcgtccgtctgacttgagactgcgaggagatggacgacgaggactactcgtgggtgcggcgcacaagattctcgcagtccatcgtcaggtccagctccggcagggagcagttcagtcgcgacgccgaactgaagctcaacggattgggcacggggcgcaggcttcatcgccaggatctgcagcacctggcgaagggatccgtgctctcgagctcagcaaggctgccgattcccaaagccaaatcggcaggtgctcagtcggaacggaagctgaagcatgcgtcttcagaaggccaattgaaccgagacaggagcagtgatcgttcgtcgcggcaagcatcgccgaagcaggaccggatcaagggggtcgacctgagcttggacattccacagcggcatgcggttcggccatccgacgatgagagcccaaacgcgctggatttctccttccactcggatgagcagagccagacgcttcagagagtgtgctccagccctgctcctttctactcgcgggatgcagcaccgccagctgatgatttcagagcgcgaagtgcatctatgaagggcgccggagaggtgtcgaagccgacgccaaagccgaagcgcagggcaaaatcccccatccccaagcgcgccatctctgaagtgttcaaggaggccaaggctgccaccaagcgattctccagcccgcaacggcagaggaagcccacgtctccaaggtcacctgaagacagccctccgttcggcttcgcttcgctgagaacaccgagcaagctgaagattaataggaggacctcctcatggccgaggaggaactctgatgatggaccggcaaaggttgctgcatcggatatccttgagagatggacagttgaccgctcgcagttgctcatcggccacagatttgcatccggggcgtatagccgattgttccatgggatttacaaggagcaacctgttgctgtgaagtttatcaggcagcctgatgatggtgaggatgacgagttgtctgctcggcttgagaagcagttcactgcagaggttaccattctggcaaggctccaacatcgaaatgtcatcaagcttattggagcatgcaattgtccaccggtcttctgtgtcatcaccgagttcctgtctgggggttctttgagggctttcttacgcaagttggagcgtaagac

SEQ ID NO: 21254 - protein, 385 aa, Panicum virgatum
  misc_feature: Ceres CLONE 1815273
  misc_feature: SWISSPROT Homolog: EC 2.7.11.1 Non-specific serine/threonine protein kinase
MDDEDYSWVRRTRFSQSIVRSSSGREQFSRDAELKLNGLGTGRRLHRQDLQHLAKGSVLSSSARLPIPKAKSAGAQSERKLKHASSEGQLNRDRSSDRSSRQASPKQDRIKGVDLSLDIPQRHAVRPSDDESPNALDFSFHSDEQSQTLQRVCSSPAPFYSRDAAPPADDFRARSASMKGAGEVSKPTPKPKRRAKSPIPKRAISEVFKEAKAATKRFSSPQRQRKPTSPRSPEDSPPFGFASLRTPSKLKINRRTSSWPRRNSDDGPAKVAASDILERWTVDRSQLLIGHRFASGAYSRLFHGIYKEQPVAVKFIRQPDDGEDDELSARLEKQFTAEVTILARLQHRNVIKLIGACNCPPVFCVITEFLSGGSLRAFLRKLERK

SEQ ID NO: 21255 - DNA, 625 bp, Panicum virgatum
  misc_feature: Ceres CLONE 1815273-R
  misc_feature: Encodes the peptide sequence at SEQ ID NO. 21256
atttgttaggggatgatccgggtacttatagatggatggcaccagagatgtacaagcacaagccatatggccggaaggttgatgtttatagctttggacttgtcttgtgggaattggtcagtggctcactcccttatgaagatatgacaccactccaagcagctttcgcagttgtcagtaagaacttgagaccggctattccttctagctgcccgccagcagtaaaaatccttattgagcagtgttggtcctggcaaccagagaggaggcctgagtttcgacagattggttcaatccttgaaaacctcaagacagttcttgaaagaaatggaacgctcgacaaaatcccaagcttcatctgccagccccaggaatgcaacgatcagaacaagaagaaggtttccagctggatccagaggctctcatacactcaacctgatttttccggacctccacccccgaagttactgtaattatgcgtcttcttgtcaatttttagtagcgtgttatctggtaggtagcaactctgtaaatttaattttttctccttttctgttgagagatcagaagtttttcaatggtatatactcggacacagtgcatacacatttttgaggatcatagc

SEQ ID NO: 21256 - protein, 156 aa, Panicum virgatum
  misc_feature: Ceres CLONE 1815273-R
  misc_feature (1)..(99): Pfam Name: Pkinase_Tyr Pfam Description: Protein tyrosine kinase
  misc_feature: SWISSPROT Homolog: EC 2.7.11.1 Non-specific serine/threonine protein kinase
LLGDDPGTYRWMAPEMYKHKPYGRKVDVYSFGLVLWELVSGSLPYEDMTPLQAAFAVVSKNLRPAIPSSCPPAVKILIEQCWSWQPERRPEFRQIGSILENLKTVLERNGTLDKIPSFICQPQECNDQNKKKVSSWIQRLSYTQPDFSGPPPPKLL

SEQ ID NO: 21257 - DNA, 658 bp, Panicum virgatum
  misc_feature: Ceres CLONE 1815292
  misc_feature: Encodes the peptide sequence at SEQ ID NO. 21258
actatctctcgtatatccatctcgctcctatgagtgcgggagcgggtgattatcctgcgtgtgcttgagtatattaggttattactcgctcattaacgcgcagaagtgatcgcttaccccgctctatgctctcactggacgccgccctcgccaaccaggtggccgcagctgcggactcagctatctgccggacgttctagcctgcccgtgccccgccgtgctcggcccctcaacatcgccgagagggaggccaaccagcccctcctccgcccaaggcccttcgcggtcaaggaccacatcttctgccggttcgagggtgtgctggacaacctggggcggctgaaccacccgtacgggctgtccaaggacaccaacgaggtggtcctcgtcatcgaggcctacgagacgctgcgggaccgggcgccatacccggccagcttcatgctctctcagctcacaggcagctacgccttcgtgctcttcgacaagaccaccaactccctgctcgtcgcatctgatcccgagggcaaggtgccgctcttctgggggatcaccgccgatggctgcgtcgccttctctgacgacattgacatgctcacaggatcctgtggaaagtcacttgcacctttcccgaatggttgcttctactctaacgctc

SEQ ID NO: 21258 - protein, 72 aa, Panicum virgatum
  misc_feature: Ceres CLONE 1815292
  misc_feature: SWISSPROT Homolog: EC 6.3.5.4 Asparagine synthase (glutamine-hydrolyzing)
MLSQLTGSYAFVLFDKTTNSLLVASDPEGKVPLFWGITADGCVAFSDDIDMLTGSCGKSLAPFPNGCFYSNA

SEQ ID NO: 21259 - DNA, 689 bp, Panicum virgatum
  misc_feature: Ceres CLONE 1815294
  misc_feature: Encodes the peptide sequence at SEQ ID NO. 21260
atcctttatttcgcggatccatccagtttcgaggagtgtggaggcagttgattatcaggggtgtggttgaagatgttggcggtgttcagcggcgaggtggtggaggtgccggcggagctggtggcggcaggaagccggacgccgtcgcccaagacgagggcgtcagagctggtgacccgcttcctggggagctcggagccggccgtgtccgtgcagctcgccggcctcggccacctcgcctactcccacaccaaccaggccctcctccgcccaaggtcgttcgcggcgaaggacgacatcttctgcctgttcgagggtgtgctggacaacctggggcggctgagccagcagtacgggctgtccaagggcaccaacgaggtggtcctcgtcatcgaggcctacaagacgctgcgggaccgggcgccatacccggccagcttcatgctctcgcagctcaccggcagctacgccttcgtgctcttcgacaagtccaccaactccctgctcgtcgcatctgatcccgagggcaaggtgccgctcttctgggggatcaccgccgatggctgcgtcgccttctctgacgacattgacatgctcaaaggatcctgtggaaagtcacttgcacctttcccgcaaggttgcttctactctaacgctcttggaggcttgaagtgctacgagaaacccca

SEQ ID NO: 21260 - protein, 205 aa, Panicum virgatum
  misc_feature: Ceres CLONE 1815294
  misc_feature: SWISSPROT Homolog: EC 6.3.5.4 Asparagine synthase (glutamine-hydrolyzing)
MLAVFSGEVVEVPAELVAAGSRTPSPKTRASELVTRFLGSSEPAVSVQLAGLGHLAYSHTNQALLRPRSFAAKDDIFCLFEGVLDNLGRLSQQYGLSKGTNEVVLVIEAYKTLRDRAPYPASFMLSQLTGSYAFVLFDKSTNSLLVASDPEGKVPLFWGITADGCVAFSDDIDMLKGSCGKSLAPFPQGCFYSNALGGLKCYEKP

SEQ ID NO: 21261 - DNA, 2369 bp, Panicum virgatum
  misc_feature: Ceres CLONE 1815320
  misc_feature: Encodes the peptide sequence at SEQ ID NO. 21262
ggttggattaggttgctggccctgcccaaaagcagggctgcaacgcgcagctcttttggtttcggagagaggactgggccggctgggaggggagacggggacggagagcgcggccatggcctgactgcctgagctcttccggggttggcggtggttgcgcgtcagcttccctgtctgtggcgctccgcttcgctcctgggcacgcagctcggcgctgcgggaggaggtgggatggcgtccatgaagctcggcgccaagcccgacgccttcaagaggcaaggccaggcatggttctgcacaacaggacttcctagcgatgttactgttgaggttggggatatgtcctttcaccttcacaagttccctttgctttcaaaaagtgcctttctcgcacgattgatagaagagaatgcagaccaagaagagtgtgtcataaaactaaatgacattcctgggggtgccaagtcatttgagctagtcgcaaggttctgctatggtgtgaaaatagagctttctcctgcaaatgttgtgtacctacgatgtgcatctgagcatctaaaaatgactgaagaagtagctgaggacaacttgattgcacagtcagaaatgttcctcaaccaagtggttcttcgcaactggaaagattccttgacagcattggatacatgcgatgacctactccctcatgctgaagaccttcagattgtgaagagatgcatcgagtcgttagcatccaaagctactactgatccaaacctctttggatggccgataagggaacatggcatcatgcaaagccctggtggcagtgtattatggaatgggatcagtacaggtgcaaggcccagaaacttcaatgcagactggtggtatgctgatgcttcatcattgagcttccccatgtacaagagattaatttccaccatggagtcccgaggcatccgacctgagataattgctggttctttgacgtactacgccaagaagtatctcccaggaatcaataggcgtcatagcatgggcgcggtgcctcttactgctgctctatctgaggttgaacagaaaaacttgcttgaggaaattgataggctattgcccgttcaaaagggtatagcatcaaccaatgttcttcttgggctccttcgcacagccatgattctgaaagccagccccacgtgcgtctccaacttagagaaacgaattggcatgcaactggaccaggccactctggaggatctactgctgccaaatttctcctacacaatggaaactctgtacaatgttgagtgtgttcacaggattcttgatcatttcttggcaatggaccaggctaatggtggcgagtccccatgcttggatgatgtgatggcatccccatccttgacaccgatcacaagtgttgccaagctaattgacggctatcttgcagagattgcaccagatatcaatttgaagcttcctaaattccaggctttggcgtctgctgtccctgagtatgctcggccattggatgatgggctttatcgtgccattgatatatacttgaaggcacactcctggctatcagaagctgaaagggagcagctttgccggttgttggactgccagaagctctccctggaagcatgtacccacgcggcccagaacgagaggctgccgctgcgagtggtggtgcaagtcctcttcttcgagcagctccagctacgaacctcgatcgcagggtgcctgctggtctccgacaaccttgaggggtccaggcccctgaggagcggcgttgcaacatccggcgaggccgggggctgggccacggcagtccgggagaaccaggttttgaaggtaggtatggacaacatgcggatgcgactggctgagctggagaaggagtgttcgagcatgcggcaggagatcgagaagctgggtgggcgcagcagcaagggtggtggcggcgggtgggcctcccgagtcgtgccccggcggctcggcctgaaggtgaggtcgcagatgtgcagcgcgcaggagggctctgtcagcgagcagcagcggagcatgagcgccaagctcgacaagctgcaggccaaggtgacgaagcataagaagcagctggctgcggatgcctgaagtgaagtcctggaggccccggcttcacagcctgaccttgtaatttagccttctgttaatctcttttgcatcttttgttgcctttagctgctaggctaaacgtctgaagtgcagtggttaagtccgtgggtgagaatccgaagtgctcccgtgttttgactgaagtagcagctgtgatcagtagctgtaactgtaaggacttcgtctgcttacttggcaaacgtgatctgtgcatttcagttgttactgcg

SEQ ID NO: 21262 - protein, 628 aa, Panicum virgatum
  misc_feature: Ceres CLONE 1815320
  misc_feature (210)..(466): Pfam Name: NPH3 Pfam Description: NPH3 family
  misc_feature (23)..(124): Pfam Name: BTB Pfam Description: BTB/POZ domain
MASMKLGAKPDAFKRQGQAWFCTTGLPSDVTVEVGDMSFHLHKFPLLSKSAFLARLIEENADQEECVIKLNDIPGGAKSFELVARFCYGVKIELSPANVVYLRCASEHLKMTEEVAEDNLIAQSEMFLNQVVLRNWKDSLTALDTCDDLLPHAEDLQIVKRCIESLASKATTDPNLFGWPIREHGIMQSPGGSVLWNGISTGARPRNFNADWWYADASSLSFPMYKRLISTMESRGIRPEIIAGSLTYYAKKYLPGINRRHSMGAVPLTAALSEVEQKNLLEEIDRLLPVQKGIASTNVLLGLLRTAMILKASPTCVSNLEKRIGMQLDQATLEDLLLPNFSYTMETLYNVECVHRILDHFLAMDQANGGESPCLDDVMASPSLTPITSVAKLIDGYLAEIAPDINLKLPKFQALASAVPEYARPLDDGLYRAIDIYLKAHSWLSEAEREQLCRLLDCQKLSLEACTHAAQNERLPLRVVVQVLFFEQLQLRTSIAGCLLVSDNLEGSRPLRSGVATSGEAGGWATAVRENQVLKVGMDNMRMRLAELEKECSSMRQEIEKLGGRSSKGGGGGWASRVVPRRLGLKVRSQMCSAQEGSVSEQQRSMSAKLDKLQAKVTKHKKQLAADA

SEQ ID NO: 21263 - DNA, 2423 bp, Panicum virgatum
  misc_feature: Ceres CLONE 1815333
  misc_feature: Encodes the peptide sequence at SEQ ID NO. 21264
gccttcagttcactgggtcactgcaatgtcaagctcgaagcccaagcctcccatcctcttctacctcctgctcctctccctcctggccagcctcgccgcctcccaagaattcacctacaaaggcttcgccggcggcggcggggggagcccgaacctgaccctcaacggcatcgcggaggtctggcccgacggcatccttcgcctcaccaacgagacctcccggctcctcggccacgccttctacccggccccgctccgcttcctcgaccgcaacggcaccgccgtgtccttctcgaccgagttcgtggtcacggtggtgccggagttcgcgcagctgggcggccacgggtacgccttcgtcatcgcgcccgacccgctcctccccggctcgctacccagccagtacctgggactcttcagcgccgccgtcgaagggaacgccaccaaccacgtgttcgccgtcgagttcgacaccgtgcaggacttcgagttcggggacatcaacggcaaccacgtcggcgtcgacctcaacagcctcgtctccaacaagtccgccgccgcggaccccgtcaacctcaaggccggcgacaccgtcgcgtggatcgactacgagggcgccgccaggctgctcaacgtctcgatcgcgaacggcaccggcgcgtcggcggcggtcaagccggcgacgccgctcatctccttccccgtcgacctgtccggcgtcctccgggagcagatgtacgtcggcttctcggcgtccacggggctcctcgcgagctcgcactacgtcaggggctggagcttccggctcggcggcggcgccgcccctaagctggacatctcgtcgctgccgacgctgccgcggaacatgaccggcaagaaccgcacgtcgctcatcctcgccgtggcgttctcggcgttcgtggcgctggtggtgctcgccgccgtcggcacgtacggggcctaccggtacaagaaccgcgacatcatcgagccgtgggagctcgactacggcccgcaccggttcaagtacggcgagctccgccgcgccacgcgtgggttccgcgagcgcgagctcctcggctccggcgggttcggcaaggtgtaccgcggcgtgctgccggggtccggcgagacggtggccgtgaagcgcgtgagccacgagtcccggcagggcctccgcgagttcgtggcggagatcgcctccatcggccgcctccgccaccgcaacctggtccagctccagggctggtgccgccgccgcggcgacctcctcctggtctacgactacatgcccaacggcagcctggaccagcacctcttcggcggcggcggcgacggcgaccacctcaagggggcgggggcggcgcggctgccgtggcccgtccgccgccgcatcctccgcgacgtggcagcggcgctgctgtacctgcacgaggggtgggagagcgtggtgctccaccgcgacgtcaaggccagcaacgtgctcctcgacgccgacatgtcggcgcggctcggcgacttcgggctcgccaagctccacgagcgcggggccaacccgagcacgacgcgcgtggtgggcacgctggggtacctagcgccggagctgacgcggacggggaaggcgacggcggccatcgacgtgttcgcgttcggggcgctggtgctggaggtggtcgccgggcggcggcccatcgagccgcgcgcgccgcccgaggagctcgtgctcgccgagtgggcgtgggagcggtacgcggccggggaggtggggaaggtggtggactcccggctcggtggcgagtacgacgccgcggaggtggccgcggcggtgaaggtggggctctggtgctcgcacccgtcgccggcgatgcggcccacgatgcgggaggtggcgaggtacctggacggcggggaggccggggaggttcccgagccgccgcccccgccgccgatgccgccggcatgctccggcgaggtgggcttcgacgacttcgtgcactcgtacccgtcgtcgtcgttcgagcgcgccgccgcggcgggcggcgggtgggacgccgggacccagacgtcggtggcgacgttcccgttctcgccgctgtccatgcggtcaacccacgtcagcatgtgacgagtcgtcaaccccttgggccccgctggtcaacgaggtggcctagtcaaacgaagtggacccggatgcctgtttttatacctgtgaggtctatattttttttactgcactcggtaaggctttctccaaccattccccctatccaactcccccaaaacatactatttactatattttactacctcccttcaaaagattcctccccctataactccttttctccaaccattcccccatatctattctccctatatactatcactcattaactaactatttatttaacgtttttgaattt

SEQ ID NO: 21264 - protein, 699 aa, Panicum virgatum
  misc_feature: Ceres CLONE 1815333
  misc_feature (25)..(260): Pfam Name: Lectin_legB Pfam Description: Legume lectin domain
  misc_feature (345)..(625): Pfam Name: Pkinase Pfam Description: Protein kinase domain
  misc_feature: SWISSPROT Homolog: EC 2.7.11.1 Non-specific serine/threonine protein kinase
MSSSKPKPPILFYLLLLSLLASLAASQEFTYKGFAGGGGGSPNLTLNGIAEVWPDGILRLTNETSRLLGHAFYPAPLRFLDRNGTAVSFSTEFVVTVVPEFAQLGGHGYAFVIAPDPLLPGSLPSQYLGLFSAAVEGNATNHVFAVEFDTVQDFEFGDINGNHVGVDLNSLVSNKSAAADPVNLKAGDTVAWIDYEGAARLLNVSIANGTGASAAVKPATPLISFPVDLSGVLREQMYVGFSASTGLLASSHYVRGWSFRLGGGAAPKLDISSLPTLPRNMTGKNRTSLILAVAFSAFVALVVLAAVGTYGAYRYKNRDIIEPWELDYGPHRFKYGELRRATRGFRERELLGSGGFGKVYRGVLPGSGETVAVKRVSHESRQGLREFVAEIASIGRLRHRNLVQLQGWCRRRGDLLLVYDYMPNGSLDQHLFGGGGDGDHLKGAGAARLPWPVRRRILRDVAAALLYLHEGWESVVLHRDVKASNVLLDADMSARLGDFGLAKLHERGANPSTTRVVGTLGYLAPELTRTGKATAAIDVFAFGALVLEVVAGRRPIEPRAPPEELVLAEWAWERYAAGEVGKVVDSRLGGEYDAAEVAAAVKVGLWCSHPSPAMRPTMREVARYLDGGEAGEVPEPPPPPPMPPACSGEVGFDDFVHSYPSSSFERAAAAGGGWDAGTQTSVATFPFSPLSMRSTHVSM

SEQ ID NO: 21265 - DNA, 2395 bp, Panicum virgatum
  misc_feature: Ceres CLONE 1815334
  misc_feature: Encodes the peptide sequence at SEQ ID NO. 21266
acccaaaacgagctccagaacaccaccacgaagaaacgcgcgcacggattcctcctccagtccctcctcctcctccccattgcgtgatcccgccgcgtcgcgcgcgcatttgcgccgcgcccaatccgtccccgcgcaggagccagccgggccccctccgctccggcgacccgccgctcggcgtagatcggccggaccccgggagcgcgcgccctccgcgctctggagacaggtggttgtcattccttatatagaagtgtatctgctgcggcactaactgctctgtgaccgctgcaagcaatcttgtgttctcatggctcagtctaatgacatgatgagcaggaaaccccccggccttcggttatttggaagtgccggttctctaagaacataccaaacacttgtcctggttcttacattctttgcttacacatgctttcatatgactcggaagatcacaagcattgtcaagagtgcacttgatccccagacaaaggttggtttttctcactggggacgattgcatgcaagcaacagcttaaacatgggctggttgccatttaacaccgttgatggctcagcattgcttggtgagattgatgttgcattccttgctgtatattctgttgggatgttctttgctggacatattggtgaccggatggatttaaggatctttctgacaatcggcatgcttgggaccgccatattcacaactctctttggtgctggttattggttgaatgtccacaacttctactatttcttggttatacagatgatttctggtctgtttcaatcaatcgggtggccttcagttgttgctgttgttggaaactggtttgggaagagcaagagggggttgatcatgggcatatggaatgcacacacgtctattgggaatatagctggctcattacttgctgcgttcctgctgaagtttggctggggctggtcttttgccatccccagcctgatcatggcttttgttgggttgatagtgtatattttcctgccgattaatcctgaggtaatggaaatagacattgacagtggggaatttaactgtgagaaagataccgtgaaggagcaccttttggaaccaggccaagaagtgaaacacaaggcagtaggtttcttagaggcatggaggattcctggagtagcgccatttgctctttgcctcttcttctccaaattggtagcatataccttcctgtattggctaccattctacatcagccatacacgtattggtggtaagtacctctctgatgctatggctggcagcttatctacaatcttcgatgttggtggtgtgttgggaggagttcttgctggtcacatctccgatcgcttaaatgcgcgggcaatcacagctgctagtttcatgtattgtgcgatacctgccctattcttataccgcacatatggaagcatgtcgatagtttggaatatctgcctcatgttcatcactggcatgtttgtcaatgggccttatgccttgatcacaactgctgtgtcaactgaccttggcactcacagttctttgaatggcaattcccgagcactggccactgtgacagcaatcattgatgggacaggatctgtcggcgctgccatcgggcctttgctgacaggatacatctcatcgaagagttggagtgctgtgttcacaatgttgatggcagcagctctccttgctgggctcctcttgacaaagcttgtatgtgctgagctgaaaggaaaagtgccttccaatgctagcaaggacgccactgacagtgacactcaaggtacctactcaaatgaagtgtaattgcaatctggtttccctaaggagttgttccaaacttccagtgaatgcctgctctgaagctgagtggttgctactgcctatcttgatcactttggatctcgagactgaaaaaaggcaatgagatgtggttgctgaatgctttgtgacttgctcaaccgaagcttcatcggatgatagttttcttatgttcaggtatagaggcagcagaacatagttatgtgggtgcgcagattagttttcaggtttgaaagatgaggtaaaaatacctcaaaagctctagagcccaaatataggcacgttttaggcgccttgtaaatatattgggcaataaggtcaggcctggtgctgatggcaatattagatatataattgtatgtgattgttgtttaggtcagagtagatcaaagggattgaatctctgttgtacaagatgaagccggaacggccaactctgcatttactgggaatgttggccgacttttgtatgtgtaaacagtgtgtgaaggttcggaacattttttattgtaagctctggggaagtgttgatgcacaaaacaatagagtgcgtatttgttc

SEQ ID NO: 21266 - protein, 501 aa, Panicum virgatum
  misc_feature: Ceres CLONE 1815334
  misc_feature (35)..(439): Pfam Name: MFS_1 Pfam Description: Major Facilitator Superfamily
MAQSNDMMSRKPPGLRLFGSAGSLRTYQTLVLVLTFFAYTCFHMTRKITSIVKSALDPQTKVGFSHWGRLHASNSLNMGWLPFNTVDGSALLGEIDVAFLAVYSVGMFFAGHIGDRMDLRIFLTIGMLGTAIFTTLFGAGYWLNVHNFYYFLVIQMISGLFQSIGWPSVVAVVGNWFGKSKRGLIMGIWNAHTSIGNIAGSLLAAFLLKFGWGWSFAIPSLIMAFVGLIVYIFLPINPEVMEIDIDSGEFNCEKDTVKEHLLEPGQEVKHKAVGFLEAWRIPGVAPFALCLFFSKLVAYTFLYWLPFYISHTRIGGKYLSDAMAGSLSTIFDVGGVLGGVLAGHISDRLNARAITAASFMYCAIPALFLYRTYGSMSIVWNICLMFITGMFVNGPYALITTAVSTDLGTHSSLNGNSRALATVTAIIDGTGSVGAAIGPLLTGYISSKSWSAVFTMLMAAALLAGLLLTKLVCAELKGKVPSNASKDATDSDTQGTYSNEV

SEQ ID NO: 21267 - DNA, 2084 bp, Panicum virgatum
  misc_feature: Ceres CLONE 1815335
  misc_feature: Encodes the peptide sequence at SEQ ID NO. 21268
aagcatcgcccgcatcggagagcacggcgcggccccgaaaccgaggggaaagggggggaggggaggaaaaatacagccgctgagggagggggacagctagggagactgccagaggtgcaggggcggtgggtgggcgaggcgatggagagcgagatggcggacgcgccggcggcgatccccgcccccgccgccgagccgctcgcggcgatggcggaggaaggggaaggggagggggccgaggcggtggggtccaccctcaccatggagcgtgtcgccgccgcgaagaagttcatcgagaaccactaccgctcgcagatgaagaacatccaggagcgcaaggagaggcgctttaaattggagaggcagctcgcttcttctcaagttcccaaggagcagcaaatcaatttaataaaagatctagagaggaaggaaactgaatacatgcgactaaagaggcacaaaatttgtgtggatgactttgagctgctcactatcattgggagaggtgcttttggagaggttcgactttgccgagagaagacttctggcaacatttatgcaatgaaaaaactcaagaagtctgatatggttgtcaggggccaagttgaacatgttagagccgaaagaaacttgctggctgaagtggctagtcactgcattgtgaagctttactactctttccaagacgctgagtacctttaccttattatggattacctccctggtggtgatattatgacccttctcatgagagaggataccttgactgaacatgtggcgcgattctatatcgcagaaacaattcttgctattgaatccatccataagcataactacatccacagagatattaagcctgacaacctgcttctagataagaatggtcacatgaagttgtcagattttgggctgtgcaagccaattgactgttctaagctctcaaccttgaatgaagatgaacccatgggtgatgacagtctaagggaatcaatggatgttgacagttctctgtctgacacagcaaatggtagaagatggagaagtcaacatgaacaacttcagcactggcagatgaacaggagaaaattggcattctcaactgttgggacaccagactatattgctccagaggttctgctaaagaagggatatggaatggaatgcgactggtggtccttgggagctatcatgtatgagatgcttgttgggtatccaccattttatgccgatgatccaataactacatgccgaaagattgtgcactggagaaaccatttgaagtttccagaggatgcaaggttgtcaaatgaagcaagagatctcatttgccggttattatgtgatgttgaccacaggattggcagtgcaggtgcagatcaaataaaggcgcatccttggttccgaggagttgcatgggataaactttatgaaatggaagcagcatttaagcctcaagtaaatgatgaattggatacacagaatttcatgaaatttgaggaattggaaaatcctccagctagaacaggctctgggccctcaagaaagatgatgctaaactccaaagatctgagctttgtggggtatacatacaaaaactttgatgccgttaaagcaataaaaatttcagatctgcaaaggaattcatctctaacaaggccctccattggttcgatattcggtccaccaggcatggattctcctatggaagcaaacggaagggacacacatatgcacacaatttcatctgctgatccaatgattccctaactgcagttctatttggcctatgcaaagttctgcactaaatcagcacacgaacgcctggatgatgtggttccatctggacaacctgcttgtttttagccaggtttctgatttattaatcgtgggcaagcgttttgtagaaattcaacaaagtttctagttgtaaaatagtatgtcaaggactttaacaaggtcccgaaccatcaaaggaggaacaaactccaacttcggatgtcatactagattccgaggatgatcttgttaccaaatataagaaagagaaaattagtcatgtagcattgaaaggttgctacttctgg

SEQ ID NO: 21268 - protein, 541 aa, Panicum virgatum
  misc_feature: Ceres CLONE 1815335
  misc_feature (113)..(420): Pfam Name: Pkinase Pfam Description: Protein kinase domain
  misc_feature (438)..(487): Pfam Name: Pkinase_C Pfam Description: Protein kinase C terminal domain
  misc_feature: SWISSPROT Homolog: EC 2.7.11.1 Non-specific serine/threonine protein kinase
MESEMADAPAAIPAPAAEPLAAMAEEGEGEGAEAVGSTLTMERVAAAKKFIENHYRSQMKNIQERKERRFKLERQLASSQVPKEQQINLIKDLERKETEYMRLKRHKICVDDFELLTIIGRGAFGEVRLCREKTSGNIYAMKKLKKSDMVVRGQVEHVRAERNLLAEVASHCIVKLYYSFQDAEYLYLIMDYLPGGDIMTLLMREDTLTEHVARFYIAETILAIESIHKHNYIHRDIKPDNLLLDKNGHMKLSDFGLCKPIDCSKLSTLNEDEPMGDDSLRESMDVDSSLSDTANGRRWRSQHEQLQHWQMNRRKLAFSTVGTPDYIAPEVLLKKGYGMECDWWSLGAIMYEMLVGYPPFYADDPITTCRKIVHWRNHLKFPEDARLSNEARDLICRLLCDVDHRIGSAGADQIKAHPWFRGVAWDKLYEMEAAFKPQVNDELDTQNFMKFEELENPPARTGSGPSRKMMLNSKDLSFVGYTYKNFDAVKAIKISDLQRNSSLTRPSIGSIFGPPGMDSPMEANGRDTHMHTISSADPMIP

SEQ ID NO: 21269 - DNA, 740 bp, Panicum virgatum
  misc_feature: Ceres CLONE 1815351
  misc_feature: Encodes the peptide sequence at SEQ ID NO. 21270
aagaggcagatcgcgcgcgatccgatccccgccgatcgccatggacccgcgcagcggctactgcgccgccacgcgctccttccgcagcaagcgcgcggacgtcccgctccccgccgaccgcgacctcgacgtcgtcaccttcctcgcctcccgccgccacgcggggaccgtcgcgctcgtcgacgccgccacgggccgccgggtcaccttcgccggcctctggcgcgccgtcgcgggcgcggccaccgcgctcgccgccccgccgctgtccctccgcaagggccaggccgcgctcatcctctccccgaactccgtccacttccccgtcgccgcgctcgccgccatgtccctcggcgccgtgctcaccaccgccaacccgctcaacacgcccgccgagatcgcgaagcaggtcgccgacgcgcgccccgtcctcgccttcgccacccgggacctcctccccaagctccccgccggcctccgcgtcgtgctcctcgagcccgaccgcctcccctccgaccccgccgccgtcgtcgccaccatcggggagatctccgccaccacgcccgaccccgcgcgacgcagggagcgcgtcacgcaggacgacccggccacgctgctctactcctcggggaccacggggcccagcaagggcgtcgtcgccacgcaccggagcctcatctccatggtgcagatcatcgtgacgcgattccgactcgagagctccgacagggacgaggccc

SEQ ID NO: 21270 - protein, 233 aa, Panicum virgatum
  misc_feature: Ceres CLONE 1815351
  misc_feature: SWISSPROT Homolog: EC 6.2.1.12 4-coumarate--CoA ligase
  misc_feature: Useful for making plants with altered carbohydrate content
MDPRSGYCAATRSFRSKRADVPLPADRDLDVVTFLASRRHAGTVALVDAATGRRVTFAGLWRAVAGAATALAAPPLSLRKGQAALILSPNSVHFPVAALAAMSLGAVLTTANPLNTPAEIAKQVADARPVLAFATRDLLPKLPAGLRVVLLEPDRLPSDPAAVVATIGEISATTPDPARRRERVTQDDPATLLYSSGTTGPSKGVVATHRSLISMVQIIVTRFRLESSDRDEA

SEQ ID NO: 21271 - DNA, 1308 bp, Panicum virgatum
  misc_feature: Ceres CLONE 1815352
  misc_feature: Encodes the peptide sequence at SEQ ID NO. 21272
ggatcgttccctccagcaagaactcgcttcttctcttccccacctcgacgaaaccctactccgctggcgatgtcgtcatccgccccggcggcagcgatggccgtggacgacgcggaggacgaccagctcacctccatgtccacggaggacatagtccgggcctctcgcctcctcgacaacgagatccgcgtcctcaaggacgagctgcagcggacgaacctggagctagagtcggtcaaggagaagatcaaggagaaccaggagaagattaagctcaacaagcagctgccctacctcgtcggcaacatcgttgagatcttggaaatgaaccccgaggatgaagctgaggaggatggtgctaatattgatttagactcacaaaggaaaggaaaatgtgttgttctgaagacctccacgagacaaactatattccttcctgttgttgagttagttgaccctgacaagctcaagccaggtgatctggttggtgtgaacaaagacagctaccttatactggatacactgccatcggagtatgattcacgagtgaaggcaatggaggtagatgaaaagcccactgaggattacaatgatattggaggtcttgaaaagcagattcaagagcttgtggaggcaattgtgctgcccatgacacataaagaccggttccaaaagttgggtattcgtcctccaaaaggagttcttctgtatggaccaccaggaacagggaagacactcatggctcgtgcatgtgctgcacagactaatgcaactttcctgaagttagctggtccacaacttgttcagatgtttattggtgatggagcaaagcttgtccgggatgcatttcagcttgccaaagagaaagctccctgtattatatttattgatgagatagatgccattggtaccaagcgatttgatagtgaagttagcggtgacagagaagttcagcggactatgttggaattgctgaatcaactagatgggttcagcagtgatgagagaataaaggtcatagctgcgacaaaccgtgccgacatccttgaccctgctctgatgcgatctggtcgtttggaccgaaagatcgagttccctcacccatctgaagaagcaagagctagaatcttgcaaattcattcgagaaagatgaatgtaaatcccgatgtcaactttgaagagttggctcgctcaacagatgacttcaatggtgcacagctcaaggcagtttgtgtggaagctggtatgcttgccctgaggcgagatgctacagagatgactcacaaggactttaatgaaagaattgta

SEQ ID NO: 21272 - protein, 412 aa, Panicum virgatum
  misc_feature: Ceres CLONE 1815352
  misc_feature (210)..(397): Pfam Name: AAA Pfam Description: ATPase family associated with various cellular activities (AAA)
  misc_feature: SWISSPROT Homolog: EC 3.6.4.3 Microtubule-severing ATPase
MSSSAPAAAMAVDDAEDDQLTSMSTEDIVRASRLLDNEIRVLKDELQRTNLELESVKEKIKENQEKIKLNKQLPYLVGNIVEILEMNPEDEAEEDGANIDLDSQRKGKCVVLKTSTRQTIFLPVVELVDPDKLKPGDLVGVNKDSYLILDTLPSEYDSRVKAMEVDEKPTEDYNDIGGLEKQIQELVEAIVLPMTHKDRFQKLGIRPPKGVLLYGPPGTGKTLMARACAAQTNATFLKLAGPQLVQMFIGDGAKLVRDAFQLAKEKAPCIIFIDEIDAIGTKRFDSEVSGDREVQRTMLELLNQLDGFSSDERIKVIAATNRADILDPALMRSGRLDRKIEFPHPSEEARARILQIHSRKMNVNPDVNFEELARSTDDFNGAQLKAVCVEAGMLALRRDATEMTHKDFNERI

SEQ ID NO: 21273 - DNA, 583 bp, Panicum virgatum
  misc_feature: Ceres CLONE 1815352-R
gtcgagcttgaactactatgcttaataaaatgtatgctaaatgtttgtaactgtacggtccaagatatatttttgcgttttcttggagatgtgagtttttaacaccatcaggcaggcccttgcttcagtctctggtgcgccagaaaaattgtagttttgggggtgcgccaagaatccaccgatccagcacgcttgctcgctgcctcaggctgcgctcggtggcgcggcgcctccgctccaccgcgcggcgggcggtggtagggcgcttcctcgtgcctgcggtggtgcggcacctctcctccgaacgcgacggcagcgaaactcggcgcctccgctccactcagcagcgggcggcggcagggtccgcctgcccggtcgttcgtggtggtgctgcgcacgctctctgctctttgcatgtgcccgcttggcattggaaaccatgagtggagctcactcagggcctgtttgttagggttccggctcttccaaaaacagttccgactccggctccttagatggagcggcttctctggtggagttggagccgttttagaaaatgtttagcaaaataacttcacttgtt

SEQ ID NO: 21274 - DNA, 505 bp, Panicum virgatum
  misc_feature: Ceres CLONE 1815360
  misc_feature: Encodes the peptide sequence at SEQ ID NO. 21275
atcgcgtctcctctcgctctctgttgtgtgactgagtgccaataaagctctctgcttgcttgtgttccagcctcagaatctcgtgaggatgtcgagctgcgaacgcaactgcgggtgcggctccggctgcacgtgcggctccagctgcccacggagcaagatgaacccagacatgactgaccaaggcaccaccacaaccagacaaactgtcgtcctggcctttgcaccaaccaacaaggggcacccctagagcggattagaagcccgcgacagagccgagaaccgctgcaagtgcgatgccgactgcacctgccacccctgcaccagcaagtgatcacctcatggccatggccggaccagaagatatctgaatctatgataacggcgatctatgtgcctcattcatttgactcacagtgtgtgtggcatgcttaataacagcgttgcgattactgctactatatggcactgatgctcaacaataataatgatggtgctgagatgt

SEQ ID NO: 21275 - protein, 53 aa, Panicum virgatum
  misc_feature: Ceres CLONE 1815360
  misc_feature (1)..(50): Pfam Name: Metallothio_2 Pfam Description: Metallothionein
MSSCERNCGCGSGCTCGSSCPRSKMNPDMTDQGTTTTRQTVVLAFAPTNKGHP

SEQ ID NO: 21276 - DNA, 747 bp, Panicum virgatum
  misc_feature: Ceres CLONE 1815364
  misc_feature: Encodes the peptide sequence at SEQ ID NO. 21277
acatcaggctctgagctcagaagatgcaactcaaggactcgtctccgtgcagccgtagataccacgaccagcgcagacacgttggctagtggctacgacagcctccatggccgccacggctgctcctccccggcctcgtgtcatggtgctgcccttccctgcgcagggccatgtcatgccgctcatggagctgtcccgccgccttgtcgaccatggcttcgaggtcgacttcgtgaacacggagtacaaccaagcccgcgtcctcgcggccttggaggcagcgggaggagagaccagagctgctgtccatgccgggatccatttggtctccctcccggatggcatgggcgctgactgcgaccgcaccgacattgttaagctgggccagagcttgccagcggcgatgcttggccgcctagaggagctgatcagagctaggaacactcgatgggtggtggctgacgtctccatgagctgggtgctgggtctgggcgccacagtgggcgtgcgcgtcgccttgttcctgacctattccgccgccatcttcgcgctgagtgagcaagttcccaagttgatagaggatggcatcattgacgaaagtgggaacgtgaagaggaatgagaggatccagctgaggcccaagatgccggccatcgcagcagctgagctcccatggattggtgttggtaatagccctgaggcacgaagagcagtaatacagggagcgattaagaacaccccatatac

SEQ ID NO: 21277 - protein, 213 aa, Panicum virgatum
  misc_feature: Ceres CLONE 1815364
  misc_feature: SWISSPROT Homolog: EC 2.4.1.121 Indole-3-acetate beta-glucosyltransferase
  misc_feature: Useful for making plants with altered carbohydrate content
MAATAAPPRPRVMVLPFPAQGHVMPLMELSRRLVDHGFEVDFVNTEYNQARVLAALEAAGGETRAAVHAGIHLVSLPDGMGADCDRTDIVKLGQSLPAAMLGRLEELIRARNTRWVVADVSMSWVLGLGATVGVRVALFLTYSAAIFALSEQVPKLIEDGIIDESGNVKRNERIQLRPKMPAIAAAELPWIGVGNSPEARRAVIQGAIKNTPY

SEQ ID NO: 21278 - DNA, 728 bp, Panicum virgatum
  misc_feature: Ceres CLONE 1815369
  misc_feature: Encodes the peptide sequence at SEQ ID NO. 21279
ggccatcttgctcctgctccagctccaagccgccaccgcgcagcccaccgccggagacgcggcgccgcagctgccgagggcggagctggcggccgtgttccgcgtgatggcggacctcctgggcgacccggcgtggccgcagctccacccgcggccctgcaccgacacgccgtggccggggctccagtgcgaggcggcccccgacgacgcgcgcgtgctccgcgccacgcgcctccacttcgggcccgacgtcgccaccccgccctgcaggcccggggccaggctcgacgccgcctcgctgcacggcctgccgcacctccagacgctctccctgttcggctgcttcgcctccggcggcgccggcgccggcgtcgagctgccggcggcgctgttcgcgggcgcggccacgtcgtccctcgagcagatcgtgctcaagtccaacccggggctgaggggcccgatccccgccacgctgggcggcctgcggaggctccgcgtgctctgcctgtcgcagaacgggttcggcggcgggatccccagggagctcgccggcctcgccgcgctgcagcagctcgacctcagctacaacaacatcaccggcgagatacccgaggagatcggagggatggcgagcctgacgatcctggacctgagctggaacggcatcgccggcggcgtgccagcggcgctgggccggctgcggaggctgcagaaggcggacctgagct

SEQ ID NO: 21279 - protein, 242 aa, Panicum virgatum
  misc_feature: Ceres CLONE 1815369
  misc_feature: SWISSPROT Homolog: EC 2.7.11.1 Non-specific serine/threonine protein kinase
AILLLLQLQAATAQPTAGDAAPQLPRAELAAVFRVMADLLGDPAWPQLHPRPCTDTPWPGLQCEAAPDDARVLRATRLHFGPDVATPPCRPGARLDAASLHGLPHLQTLSLFGCFASGGAGAGVELPAALFAGAATSSLEQIVLKSNPGLRGPIPATLGGLRRLRVLCLSQNGFGGGIPRELAGLAALQQLDLSYNNITGEIPEEIGGMASLTILDLSWNGIAGGVPAALGRLRRLQKADLS

SEQ ID NO: 21280 - DNA, 1051 bp, Panicum virgatum
  misc_feature: Ceres CLONE 1815393
  misc_feature: Encodes the peptide sequence at SEQ ID NO. 21281
gctcgagcgagctccagctctcaagaaagcacgcggaatcatggcgcctctccttcgcccgctcgtcctcgcgctcctggtcgcgtcctgcgccgcgcagcaggcgccgccggcgcagcccccgcagacgccgaacgccccgccgcaggcgcctccggctccccaggcgcctccagcagggaacccaccgccggctccccaggcacctccggccggcaacccgcctcccgcacccaccacccctcctccggctccgaccacgccgcccccggctccgaccacccctcctccggcacccaccacgccgccccccgccccggtgactcccccgccagcccccaccacgccgccgccgtcgccgccggcctctcccccgcccgctcccaccaccccgccgccgtctcccccggcgaccccgccacccgctcccgccaccccgcccccgtccccgcccatggcgccgcctccggccacgcctcctccccccgccaccccgcctccggccgcgcccacgccggctcccagcaccgccccgacgctcccgcccatggtgacaccggccgcgtccccgaagagccccaagaccccgagccccgccgccgagacgtccccggcgcccgcgctctcgcctgctggcacgccgccgaccgaagactcgggtgcaagcgcacgcgcggccggcttcgccacggtcgtggcgttggcgggcgcgggcctcgccctcctgctttgagtagtagatctcctcctcctcctccgatcctgtcgatgttgccatccctccccagctccccgtgcgtcgacgacgacgctgctcctccgtctccatttcatctctctttttttctttcttttttctaccgtgttgttatttaattttaccggcatgctcggaccgaccgattcttgatgtacgatgatgacgatggtgatgcattggtttctttggttccgcgggcggattattggtggttagtgttctgctccgcggcgggtgtcgcactgtacttttaccgcactacattttggttctatagagaggattttgtgt

SEQ ID NO: 21281 - protein, 230 aa, Panicum virgatum
  misc_feature: Ceres CLONE 1815393
  misc_feature: Useful for making plants with altered cell wall content and/or composition
MAPLLRPLVLALLVASCAAQQAPPAQPPQTPNAPPQAPPAPQAPPAGNPPPAPQAPPAGNPPPAPTTPPPAPTTPPPAPTTPPPAPTTPPPAPVTPPPAPTTPPPSPPASPPPAPTTPPPSPPATPPPAPATPPPSPPMAPPPATPPPPATPPPAAPTPAPSTAPTLPPMVTPAASPKSPKTPSPAAETSPAPALSPAGTPPTEDSGASARAAGFATVVALAGAGLALLL

SEQ ID NO: 21282 - DNA, 2277 bp, Panicum virgatum
  misc_feature: Ceres CLONE 1815395
  misc_feature: Encodes the peptide sequence at SEQ ID NO. 21283
atcattggccgccgccgcctccctcctgcggtcctgctcgtcgccgtccctggctccctacctcctcccagcccaaggccaccgctcccccccttaattgccgcgttcaatcccccctcaccgaccggcgagctctttcgcagcggcgccgcactgcaaagttctcccgctgcgctgctttcccgtggcgcggtgcatgggagcagggctctgagcgagggaaggaggatgaagttcatgaagctgggctccaagcccgacgccttccagtccgacgccgccgacgtcaaatatgtggtctctgatcttgcaacagatgttgtagtgcatgttggcgaagtgaaattttacttacacaagcttccccttctgtccaagagcggcaagcttcaacgattagttcttaaagccactgaggaggggactgatgaggttcacatagatgaccttcctgggggagcaaaagcatttgaaatatgtgcaaagttctgctatgggatggttgtcaccctcagtccacacaacgttgtcgcaacaagatgtgcagcagagtaccttgaaatggccgaagatatggaaaaggggaacctgatatttaaaatcgaggtctttatcaattctagcatccttcgtagctggaaggattccatcattgttctccagagcacaaaggcaatgttaccttggtctgaagagctgaaggttgtgggtagatgtatcgatgccatcgcttcgaagacatctgtggatccagccaatgtaacatggtcatacagtcataatagcaagaaaggagtagcttgtgctgaaatagttgaatcgacaggaaaagcaccactagctcccaaagactggtgggttgaggacttatgtgaattagatgttgacctctacaagagagttatggttgctatcaaatcgaaagggagaatgtcacccgaactgataggagaggccctcaaagcctatgctgttagatggctgccggactcttatgatgccttggttgctgaggattatatgaggaggaatcaatgtctggttgagacaataatatggttgttgccatctgataagagctctggttgttcgtgcagatttctcttgaagctattgaaagttgctatattagttggagcagggcagcatgtgaaggaagagcttatgagaaggatcagtttccagttgcacaaagctactgttaaggatctcttgttacctgctgcttcgcctaatgatggtacatatgattctaagttggtccataatcttgtccagagatttgttgcaagaactgcattgtctcataatggtggtttcgtagagaagtctgacgaaaagatgatcgagctcaactttgagcaagagtcaactttatctgtaggagagcttgttgatggctatctgtctgaagtagcttcagatccagacctttcattgtctacatttgttaagctagcaacagctgtgccagaaacggctagacctgttcatgatggcctatactatgcggtcgatgcatatctcaaggaacacccagacataagcaaagctgacaagaagaagatttgcagcctggtggatgtcaagaagctctccacagatgcatccatgcacgccacacaaaatgaccgcctgccgctccggctggtggtgcaggtcctctttttccagcagctgagggctggctcaagcaaagaactcgccctgaccaacaacagatcacacgattgcatacggcctatgacagatcagtgtgacccttgtgaaaggcggataccgaagcatccaaactctttgaataagcaggtgacaagcttgagcgcaagggaaagcgagcatcaccggatcagcgagcacaggggcagcaggaacagcttcaaggaccagctgggaggccttctgctgcagtcgcggtccaggaggatcttcgacaagctgtggagcaccaaggggcagggcgagcatggtggcaaaggctcagagacgtctggcagctcgcagagcccgccattgtctgcgaagcccgccgaagtgaagccctcccctcttccccctcttaggaacaggaggtattccgtttcataggggctttttttttgctatccttctaggttagctctggcttaggttgttgtacagaagaaggaatgctaatcagctgctgctcgtcctttttgtaagcagaccaaactgctgttatctatgtgatcatgctgtagcttttactgtagccaactgagagcaaagatttaccagggccttcgcccttgaacc

SEQ ID NO: 21283 - protein, 619 aa, Panicum virgatum
  misc_feature: Ceres CLONE 1815395
  misc_feature (207)..(461): Pfam Name: NPH3 Pfam Description: NPH3 family
MKFMKLGSKPDAFQSDAADVKYVVSDLATDVVVHVGEVKFYLHKLPLLSKSGKLQRLVLKATEEGTDEVHIDDLPGGAKAFEICAKFCYGMVVTLSPHNVVATRCAAEYLEMAEDMEKGNLIFKIEVFINSSILRSWKDSIIVLQSTKAMLPWSEELKVVGRCIDAIASKTSVDPANVTWSYSHNSKKGVACAEIVESTGKAPLAPKDWWVEDLCELDVDLYKRVMVAIKSKGRMSPELIGEALKAYAVRWLPDSYDALVAEDYMRRNQCLVETIIWLLPSDKSSGCSCRFLLKLLKVAILVGAGQHVKEELMRRISFQLHKATVKDLLLPAASPNDGTYDSKLVHNLVQRFVARTALSHNGGFVEKSDEKMIELNFEQESTLSVGELVDGYLSEVASDPDLSLSTFVKLATAVPETARPVHDGLYYAVDAYLKEHPDISKADKKKICSLVDVKKLSTDASMHATQNDRLPLRLVVQVLFFQQLRAGSSKELALTNNRSHDCIRPMTDQCDPCERRIPKHPNSLNKQVTSLSARESEHHRISEHRGSRNSFKDQLGGLLLQSRSRRIFDKLWSTKGQGEHGGKGSETSGSSQSPPLSAKPAEVKPSPLPPLRNRRYSVS

SEQ ID NO: 21284 - DNA, 732 bp, Panicum virgatum
  misc_feature: Ceres CLONE 1815404
  misc_feature: Encodes the peptide sequence at SEQ ID NO. 21285
tgtactggcttatatgggacaggctgcttttatttcacaacatcacaactttgagagtagttatcatattggattttatgtgtcagtaccagaatcactcagatggcctgttctggtgattgcaatactggctgctgtagttggaagccaagcaattattacaggaaccttttcaataatcaagcagtgttcttcattaaattgttttcctggagtgaagattgtgcatacatcctctacagtgcatgggcagatatacataccagaaatcaattggatgctgatggtactgtgcctggctgttactattggcttcagagacacaaagcacttggcaaatgcacaagggttggcagtaataactgttatgcttgtcaccacatgcttaatgtctcttgttattgtgctttgctggaacaagagtatcttccttgccattggtttcctgcttttctttggcacaattgaagcactctacttctcggcttctcttgtcaagtttcatgaaggtgcttgggtccctgttactctttctttcatatttatggtagtcatgtgtgtctggcactatggcacaataaagaagtacgagttcgatgtgcaaaacaaggtatcagtaaactggctcttaaaccttggtccttcactgggcattgtccgtgttcgaggcattgggctaatacatacagaactaatgtctggaattccagccattttctcccactttgtcac

SEQ ID NO: 21285 - protein, 243 aa, Panicum virgatum
  misc_feature: Ceres CLONE 1815404
  misc_feature (1)..(243): Pfam Name: K_trans Pfam Description: K+ potassium transporter
  misc_feature: Useful for making plants with modulated biomass
VLAYMGQAAFISQHHNFESSYHIGFYVSVPESLRWPVLVIAILAAVVGSQAIITGTFSIIKQCSSLNCFPGVKIVHTSSTVHGQIYIPEINWMLMVLCLAVTIGFRDTKHLANAQGLAVITVMLVTTCLMSLVIVLCWNKSIFLAIGFLLFFGTIEALYFSASLVKFHEGAWVPVTLSFIFMVVMCVWHYGTIKKYEFDVQNKVSVNWLLNLGPSLGIVRVRGIGLIHTELMSGIPAIFSHFV

SEQ ID NO: 21286 - DNA, 1769 bp, Panicum virgatum
  misc_feature: Ceres CLONE 1815429
  misc_feature: Encodes the peptide sequence at SEQ ID NO. 21287
gctttcccgatcttttctcctccccttcgcaaacccgcggctccgtccccccacccaccgcctgtggtcttccgccaggcgccgcccgccgctccccgccattggctgccgccatggacgccgcagggtacccgcccatgcaggggagcgggtccgcctccgcctccgcgtcatgccgcgccgccgactattccgccgcgtgggacgccgcgcagcagcagaagcgccagcgctgccaggattcttcttctaacgatcaaattggatcgagcacagagaataaatctctcgaagcatctggacctgagctaaaatttgagtatgggaaaaatgaggaagaagattactattttgaagatgatgattatggctgctatgataatgaggaggacgggtctgaatatgagcttgacccagttgactataatcaactgctggctgataaatttgatcacttagatctgcctccaggtgtggaggctacagtaccatggttgcagaaagttgaaagggatgtgcctggcaaatttaagtcaatgtcagaaatagaggaggaaattgctaagaagtataactttttcaaacagtttgatactgttgaggatttctcagatcatcattatactaaaacttctgtcggaaaggctaggaaagaatgggcgaaaagaatccaacatgaatggagtctcctggaaaaagatttaccagcgttaatatatgttcgtgtatcggaaaatcgaatggaccttctcagggctgtaataattgggcctcaaggaacaccctaccatgatggccttttcttctttgatgctcatttcccggcttcttatcctgctactcccccagtggtatcctaccattcaggagggctaaggctcaatccaaatttatatgcttgtggcaaagtctgtcttagcctgctaggcacctggcaggggctttcttgtgagaaatggaatccagctcagtcaaccatgcttcaggtcctaatctccattcaagctctcgtattgaatgagaagccatactttaatgagccaggatatgaacgttatgccaaaagccctgagggactgtggtctgccttggattataatgatacaacatttctgtactcatgcaggacgatgttatactcacttcgcagacctccacagcactttgaagaccttgtcgcgggccacttccgtgaacgtgggcgtgccattctagctgcatgcaaatactacatggagggccatgaggttggatccaaagtccctgaggaggacaaggacaagaaagagagccaagatggggaaggatccagcagtagcagcatggctttgacgcagcagaacaagcccgcattccgcaccaatcgcaatgcatcattcaagcccaacctggaggttctgtttgaggagctcctgatggagtttaatgtgaagggtgccgacacggcgaagttccgtgcacagaagttgaagaaccagcaggtggctgcttgaacggaatggttcgagcagcagatttcctctaacttttgaggttccataatggagtgggaagccaatgaagctgttggtttcgcttttgcctgatcataggaatgctgtgtaggtagcgctcctttcgttctcattatggtacatgtctagcgtcgagttgaactgagaacagtggacggtattagatgctaggtactgaagtaagtatccacccctaattgtggtgtgatctgaaaattgacatcgtatataagtggtatctaccccgttaagcct

SEQ ID NO: 21287 - protein, 459 aa, Panicum virgatum
  misc_feature: Ceres CLONE 1815429
  misc_feature (185)..(327): Pfam Name: UQ_con Pfam Description: Ubiquitin-conjugating enzyme
  misc_feature: SWISSPROT Homolog: EC 6.3.2.19 Ubiquitin--protein ligase
MDAAGYPPMQGSGSASASASCRAADYSAAWDAAQQQKRQRCQDSSSNDQIGSSTENKSLEASGPELKFEYGKNEEEDYYFEDDDYGCYDNEEDGSEYELDPVDYNQLLADKFDHLDLPPGVEATVPWLQKVERDVPGKFKSMSEIEEEIAKKYNFFKQFDTVEDFSDHHYTKTSVGKARKEWAKRIQHEWSLLEKDLPALIYVRVSENRMDLLRAVIIGPQGTPYHDGLFFFDAHFPASYPATPPVVSYHSGGLRLNPNLYACGKVCLSLLGTWQGLSCEKWNPAQSTMLQVLISIQALVLNEKPYFNEPGYERYAKSPEGLWSALDYNDTTFLYSCRTMLYSLRRPPQHFEDLVAGHFRERGRAILAACKYYMEGHEVGSKVPEEDKDKKESQDGEGSSSSSMALTQQNKPAFRTNRNASFKPNLEVLFEELLMEFNVKGADTAKFRAQKLKNQQVAA

SEQ ID NO: 21288 - DNA, 1092 bp, Panicum virgatum
  misc_feature: Ceres CLONE 1815434
  misc_feature: Encodes the peptide sequence at SEQ ID NO. 21289
agccagtcaccactagctagctgctagtgtcacttaattactgtgaccgaccgacccgccgtcgtcaccgtattacctgctctgattccatccatggcgatggtgctgctcgccctgctcacggtgctgctgctggcgcacgccgccgcgtacctggcgtggcaggccgtgtcgcggcgccggcgcgcgcgctgctacctgctggactacgcctgccacaagccctccgacgaccgcaaggtcaccaccgagaccgccggcgccgtcatcgagcgcaacaagcgcctcggcctctccgagtaccgcttcctcctcaaggtcatcgtcaactccggcatcggcgagcacacctactgcccgcgcaacgtcctcgagggccgcgaggagcgccccaccctcggcgacgcgctcgaggagatggacgacctgttcgccgacgccgtcgccgccgtcctcgccaagacgggcgtcgccgcgcgcgacgtcgacctggtcgtcctcaacgtcggctccttcgccccggcgccgtcgctggtgtccagggtcgtgcgccgcttcggcatgcgggaggacgtgatggcctacaacctctccgggatgggctgcagcgcggggctcatcgccgtcgacctcgcccggaacgtcatgctcacgcgcccgcgcaccatggcgctcgtcgtcacctccgagtcgtgcgcgcccaactggtacgtcggcaccgacaagtccatgatgctcggcaactgcctcttccgctgcggcggcgccgccgcgctgctcaccaacgacccggcgttccgggcgcgcgccaagatggagctccgctgcctcgtgcgcgccaacatcgccgcgcacgacgacgcgcacgccgccgccgtgcaccgcgaggacgccgacggccgcctcggcgtcagcctcagcaaggcgctccccaaggccgccgtgcgcgccttcacggagaacctccagcgcctggcgccgcgcatcctccccgcccgcgagctcgtccgtttcgcgtgccgccgcctcgcccgcaagctcctccggcgcaaggcggcggctgcggcgggcggccccaaccccaagatcgac

SEQ ID NO: 21289 - protein, 332 aa, Panicum virgatum
  misc_feature: Ceres CLONE 1815434
  misc_feature (25)..(316): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
MAMVLLALLTVLLLAHAAAYLAWQAVSRRRRARCYLLDYACHKPSDDRKVTTETAGAVIERNKRLGLSEYRFLLKVIVNSGIGEHTYCPRNVLEGREERPTLGDALEEMDDLFADAVAAVLAKTGVAARDVDLVVLNVGSFAPAPSLVSRVVRRFGMREDVMAYNLSGMGCSAGLIAVDLARNVMLTRPRTMALVVTSESCAPNWYVGTDKSMMLGNCLFRCGGAAALLTNDPAFRARAKMELRCLVRANIAAHDDAHAAAVHREDADGRLGVSLSKALPKAAVRAFTENLQRLAPRILPARELVRFACRRLARKLLRRKAAAAAGGPNPKI

SEQ ID NO: 21290 - DNA, 1545 bp, Panicum virgatum
  misc_feature: Ceres CLONE 1815457
  misc_feature: Encodes the peptide sequence at SEQ ID NO. 21291
gctttaaatccggcgcctcgccgcctccctcctcctccccgccccggccggtcaccccgcctgcctctctctctctccgccgccgcggccgtgacgtcatgcgctcgccggcgctgctgccgcctaccatccacaaccagccagccgtaggcttgtatctagccaatcagccctcgtaggtggcctgttttatagctgctgccgtcgttgtcgtcgcggctgaggcgacgtgaggattggttagagagggaaccaggatttggttgagaggaggcggcggcggcggcggcggcggcgatggggcgcgggaaggtgcagctgaagcggatcgagaacaagatcaaccgccaggtgaccttctccaagcgccgcgcggggctgctcaagaaggcgcacgagatctccgtgctctgcgacgccgaggtcgcgctcatcatcttctccacgaaggggaagctctacgagtacgccaccgacacaagtatggacaaaattcttgaacggtatgaacgctactcctatgcagaaaaggttctcatttcagcagaatctgaaactcagggcaactggtgccacgaatatagaatgctaaaggcgaaggttgagacaatacagaaatgtcaaaagcacctcatgggagaggatcttgaaactctgaatctcaaggagcttcagcaactagagcagcagctagagagttcactgaaacatatcagatccagaaagagccagcttatgatggagtcaatttcagagcttcaacggaaggagaagtccctgcaggaggagaacaagattctgcagaaggagctcgcagagaagcagaaagcccagcgacagcaagcgcaatgggaccagactcaacaacaaaccagctcgtcttcctcgtccttcatgatgagagaagctcccccagcaacaaatatcagctaccccgtggcagcaggcgggagggtggaggggccagcagcgcagccgcaggctcgcattgggctgccaccgtggatgcttagccacatcagcagctgaactgaaggctttcctctcgcccgtctcggtgtgcaagcccaaaatccagcaacgcaacggtagtatgctcacccggctgcgccaatgctccacttgatgcatcattatcgccgatcttgtcgtgatcgctaccagcagcagcagcagtaagcaggggtttatcataatttgagcagcatataagttccaatcttcgctgtgtatattttgcttttgttcatcaccatttccgctgaggggaccgtacgatgaataatttcccccatgtaatatataatatgcgcagcatgaatgtcaatcgagcggtttgtcaattgagtcctgtacaagttgcatcattgcttgttgtattcacaagacacctgtgcctccgcactcaatcctatctgtaggctttgattcttttatgtatcttctgccattctataatggccctgtttagatacgcttataatccgcttagggcatgagcaatgtattttacctatatcgatacacatgggtcatgtgtcagcc

SEQ ID NO: 21291 - protein, 243 aa, Panicum virgatum
  misc_feature: Ceres CLONE 1815457
  misc_feature (75)..(174): Pfam Name: K-box Pfam Description: K-box region
  misc_feature (9)..(59): Pfam Name: SRF-TF Pfam Description: SRF-type transcription factor (DNA-binding and dimerisation domain)
  misc_feature: The sequence is a functional homolog of SEQ ID NO 6 in US patent 7279615
  misc_feature: The sequence is a functional homolog of SEQ ID NO 731 in the 10/666,642 US patent application
  misc_feature: The sequence is a functional homolog of SEQ ID NO 2 in US patent 7273968
  misc_feature: Useful for making plants with modulated biomass
  misc_feature: Useful for making plants with modulated flowering time
  misc_feature: Useful for making plants with modulated phosphate use efficiency
  misc_feature: Useful for making plants with altered alkaloid content
  misc_feature: The sequence is a functional homolog of SEQ ID NO 46 in the 10/666,642 US patent application
  misc_feature: The sequence is a functional homolog of SEQ ID NO 1360 in the 10/666,642 US patent application
  misc_feature: The sequence is a functional homolog of SEQ ID NO 22 in the 10/666,642 US patent application
  misc_feature: Useful for biocontainment applications
  misc_feature: The sequence is a functional homolog of SEQ ID NO 730 in the 10/666,642 US patent application
  misc_feature: Useful for making plants with altered terpenoid content
  misc_feature: The sequence is a functional homolog of SEQ ID NO 203 in the 11/479,226 US patent application
  misc_feature: The sequence is a functional homolog of SEQ ID NO 40 in the 10/666,642 US patent application
  misc_feature: The sequence is a functional homolog of SEQ ID NO 1701 in the 10/412,699 US patent application
  misc_feature: The sequence is a functional homolog of SEQ ID NO 1955 in the 10/412,699 US patent application
  misc_feature: Useful for making plants with altered lignin content
  misc_feature: The sequence is a functional homolog of SEQ ID NO 1949 in the 10/412,699 US patent application
  misc_feature: Useful for making plants with modulated nitrogen use efficiency
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: The sequence is a functional homolog of SEQ ID NO 1967 in the 10/412,699 US patent application
  misc_feature: The sequence is a functional homolog of SEQ ID NO 1965 in the 10/412,699 US patent application
  misc_feature: The sequence is a functional homolog of SEQ ID NO 1963 in the 10/412,699 US patent application
MGRGKVQLKRIENKINRQVTFSKRRAGLLKKAHEISVLCDAEVALIIFSTKGKLYEYATDTSMDKILERYERYSYAEKVLISAESETQGNWCHEYRMLKAKVETIQKCQKHLMGEDLETLNLKELQQLEQQLESSLKHIRSRKSQLMMESISELQRKEKSLQEENKILQKELAEKQKAQRQQAQWDQTQQQTSSSSSSFMMREAPPATNISYPVAAGGRVEGPAAQPQARIGLPPWMLSHISS

SEQ ID NO: 21292 - DNA, 714 bp, Panicum virgatum
  misc_feature: Ceres CLONE 1815460
  misc_feature: Encodes the peptide sequence at SEQ ID NO. 21293
agcatccggatccgatcggggaggagagagagagagatggggcggtcctacgcggcgaaggggcgcaagaagaagcgcaaactccacgaggcggcggcctcggacgccggcccgcccgccgaagaggcggaggagctgccgctgccggaggaggctggcggcgaggataaggggaaggatgaagaggcggcggcgggagaggaggaggaggaggagcacgcggctgtggaggggctcccgattgtgcccaggccggtggacgggaagcggcggcccggcgccatcttcgtgctcgagagggcctgcctcgaggtcggcaaagtcggcaagactatgcaaatcttgaactcagatgatcacgctaattatttgaggaagcagaatcgcaatcctgctgactataggcctgatatcattcatcaggctctactggcgatatttgacagccctttaacaaaagctggaaggttacaggctgtttatgtgaggactgaaaagggagtactgtttgaaatcaaacctcatgtccgcatgccacgaacatttaaacgcttttgtggtttaatgtctcaattgttgcaaaagctgagcattacagcagttgggaagcgtgagaagcttcttaatgttgttaaaaatcctgttacccgctatctacctgtcagtgctgcctgttgtttaaatcggatatgcagcgccctggagcagaagtgg

SEQ ID NO: 21293 - protein, 225 aa, Panicum virgatum
  misc_feature: Ceres CLONE 1815460
  misc_feature (116)..(224): Pfam Name: Nep1 Pfam Description: Nep1 ribosome biogenesis protein
MGRSYAAKGRKKKRKLHEAAASDAGPPAEEAEELPLPEEAGGEDKGKDEEAAAGEEEEEEHAAVEGLPIVPRPVDGKRRPGAIFVLERACLEVGKVGKTMQILNSDDHANYLRKQNRNPADYRPDIIHQALLAIFDSPLTKAGRLQAVYVRTEKGVLFEIKPHVRMPRTFKRFCGLMSQLLQKLSITAVGKREKLLNVVKNPVTRYLPVSAACCLNRICSALEQK

SEQ ID NO: 21294 - DNA, 708 bp, Panicum virgatum
  misc_feature: Ceres CLONE 1815461
  misc_feature: Encodes the peptide sequence at SEQ ID NO. 21295
gggaagcgagcgagcgaccggccgattcgagcagcagcagcagccagctagccatggcgacgcaggccgctctgttcgctgggttctcgcagctcgcagcgcagccggcccgcgaccgcgctgggacgggggcgccggcgctggtgggcgtggcggcgatcgggggcgccagggcgggcggcgtgaaggcggggggcgccgggtgggcggcggcggcggcgccccgcggggtgcggtgccggaccagcctgatcgagcccgacggcgggcggctggtggacctggtggcgcccgaggagggcggccggcgcgcggcgctgcggcgggaggcggcgtccctgccgcaccggctgcgcctcggccgcgtcgacaaggagtggctccacgtcctgagcgaagggtgggccagcccgctgcaagggttcatgcgcgagcatgagttcctccaagcacttcatttcaacgccatccgcggcgcggatggcaggatggtcaacatgtccgtccccatcgtgctctccctcggggacgcgcagcggcgggccatccaggccgacggcgccacgcgcgtcgcgctcgtcgacgatcgcgaccgccccatcgccgtattgagcgacattgagatctacaagcacaacaaggaagaaagaattgcgaggacatgggggacaactgcacctggattaccttatgttgaagaggcaatta

SEQ ID NO: 21295 - protein, 218 aa, Panicum virgatum
  misc_feature: Ceres CLONE 1815461
  misc_feature: SWISSPROT Homolog: EC 2.7.7.4 Sulfate adenylyltransferase
  misc_feature: The sequence is a functional homolog of SEQ ID NO 4 in US patent 7038109
MATQAALFAGFSQLAAQPARDRAGTGAPALVGVAAIGGARAGGVKAGGAGWAAAAAPRGVRCRTSLIEPDGGRLVDLVAPEEGGRRAALRREAASLPHRLRLGRVDKEWLHVLSEGWASPLQGFMREHEFLQALHFNAIRGADGRMVNMSVPIVLSLGDAQRRAIQADGATRVALVDDRDRPIAVLSDIEIYKHNKEERIARTWGTTAPGLPYVEEAI

SEQ ID NO: 21296 - DNA, 709 bp, Panicum virgatum
  misc_feature: Ceres CLONE 1815476
  misc_feature: Encodes the peptide sequence at SEQ ID NO. 21297
  misc_feature (645)..(645): n is a, c, t, g, unknown, or other
atcacccactcctcgcgccacccaccgggagcgtacggcgccacaatgcggccgcctaccctcctcccgctcgccgccgccgccgccctcctcgtcctcctcctcctcgccgccgcgccaacgcccgccgcctcccgccaccaccaccccgcgccggcggcggcggacacggagacgctcgacgtcgccgcttccctctcccgcgcccgcgccgcgctctccaccgacgccgccgccgccgcttcgctgcaccagtccgccgcggcggccgggaagccgaagcgccgctccccgcggaagggcgcctcccccctcacgctgcggctccacgcgcgggacttcctcccgggcgagcagggccggcacgagagctaccggtccctggtgctgtcccgcctccgccgcgacgcgtcccgcgccgcggcggtgtcggcgcgcgcggcgctggcggcggacggggtgacgcgcctcgacctcgtccccgccaacgcgtcggcggtgttcgcggcctccgctgcggcgatccagggccccgtggtgtccggcgtggggcagggcagcggcgagtacttctcccgcgtcgggatcggcagccccgcgcggcagctgtacatggtgctcgacaccggcagcgacgtgacctgngtgcagtgccagccctgcgccgactgctaccagcagtcggaccccgtcttcgacccctccctct

SEQ ID NO: 21297 - protein, 221 aa, Panicum virgatum
  misc_feature: Ceres CLONE 1815476
  misc_feature: SWISSPROT Homolog: EC 3.4.23.12 Nepenthesin
  misc_feature (200)..(200): Xaa is any aa, unknown, or other
MRPPTLLPLAAAAALLVLLLLAAAPTPAASRHHHPAPAAADTETLDVAASLSRARAALSTDAAAAASLHQSAAAAGKPKRRSPRKGASPLTLRLHARDFLPGEQGRHESYRSLVLSRLRRDASRAAAVSARAALAADGVTRLDLVPANASAVFAASAAAIQGPVVSGVGQGSGEYFSRVGIGSPARQLYMVLDTGSDVTXVQCQPCADCYQQSDPVFDPSL

SEQ ID NO: 21298 - DNA, 685 bp, Panicum virgatum
  misc_feature: Ceres CLONE 1815488
  misc_feature: Encodes the peptide sequence at SEQ ID NO. 21299
agagacccagacaccacaagcaaggacgagtcgaacaccggcgttcgcctctgaaacagaaccaaccacctggtctggcctggccgtgtcgcacgccttccaaatattcttcaaactctcacggctcctcgcggcctcgcccacagcagaacagagcagggcgccgggcgggggggcgagctgatcgagaggagcagggccgacatgggtgccgcgttcctggcttcctggccgtggaacaacctcggcttctacaagtacgtgctgtacgggccgctggtcggcaaggcggcggcgtcgcgggcgtgggaggcggcgagccccgaccggtgggtcctcctcctgctcgtcctcttcggcctccgggcgctcacctaccagctctggagctccttcagcaacatgctcttcgccacgcgccggcgccgcgtcgtccgcgacggcgtcgacttcgagcagatcgacagggagtgggactgggacaacttcttgatcatgcaggccctgatggcggccacggcgctgtacgcgttcccgccgctgcgccacctcccgctctgggacgcccgcgggttcgccgtcgcgctcctcgcccacgtcgcggccaccgagccgctcttctacgcggcgcaccggacgctccacgccagcggcagcctctacgcccgctaccactcgttgcacc

SEQ ID NO: 21299 - protein, 160 aa, Panicum virgatum
  misc_feature: Ceres CLONE 1815488
  misc_feature: Useful for making plants with modulated nitrogen use efficiency
MGAAFLASWPWNNLGFYKYVLYGPLVGKAAASRAWEAASPDRWVLLLLVLFGLRALTYQLWSSFSNMLFATRRRRVVRDGVDFEQIDREWDWDNFLIMQALMAATALYAFPPLRHLPLWDARGFAVALLAHVAATEPLFYAAHRTLHASGSLYARYHSLH

SEQ ID NO: 21300 - DNA, 1936 bp, Panicum virgatum
  misc_feature: Ceres CLONE 1815497
  misc_feature: Encodes the peptide sequence at SEQ ID NO. 21301
aatcaaatggagcgaaacccgctcgcttttccgcccagaaaaccaacagcccccctctgctcctccacctccaccactcccctccccaccctcccggcgaccgaccgaccggcggctgcggcgggcgagcgaacccggcgcggattcctcccccgcccgatccggccatggacgccggctccaggccgcccccgccgaccggcgcaggggtccgcgtccgcgcgccgctggtggagtctgtctcctgctactgcagattagatacaggccttaaaactgttgttgatgctagaaagtttgttcctggtgcgaagatgtgcatgcaacctgaggtcaaacaaagcaagtgcaagtcaaggggctcaaaaaaggaaagatgcagaacacaagcaccacttttacctggccttcctgatgaccttgctattgcctgccttatacgggttcctcgagttgaacaccccaatctcaggatggtttgcaaaagatggaaccgccttttgtctaggaattatttttactccttgcgtaagaaaattggagtggcagaagaatgggtttatgtctttaaaagggaccgtgaagggaagatatcctggcatgcctttgatccactacaccagctatggaaatcactcccaccagttccatcagagtattcagaagcattgggctttggctgtgccgttctgagtggttgctatctgtacttatttggtgggaaagatcctttgaggggttcaatgaggcgtgttgtattctataatgctcggacaaacaaatggcaccgagctccagatatgctgaggaaacgacacttttttggttcttgtgtgataaacaattgtctttacgttgctggtggggagtgtgaaggaatacagaggacactgcagtctgcggaagtttatgatccaaataggaacagatgggcctgcatttctgaaatgaacaatgggatggttcctttcattggagtggtatatgatggcaagtggttcctgaaggggcttgattcccatcgccaagtgaccagtgaagtctacttaccatcatccaatgcctggtcaacaatcgatgatgagatggttacagggtggcggaacccgagcatttccttcaatggtcggctctattcagctgactgtcgggatggctgcaagcttagagtttatgatgacaacacaggaacatggacaagattcatggacagcaagcaccatttgggtagctcacgtgcctttgaagctgcagctttggtgtcactaaatgggaaactttgtattatccggaacaacatgagcataactcttgttgatgtctcggacccaacaatgagtgtcgagacagatagtgcacgtatgtgggagactgttgctcggaagggtcagcacagatcgtttgtggcaaacttgtggtctaccattgcagggcggaacttgaagagtcacatcatccattgtcaggtgcttcaagtctaacagcagattctgtgaatggaaatttgacctgatattgtaagcaggaacatgattggatcagtggaaggaccctcccagtaagaggtagttcaattcggtatcagagtcatggcaaggaatagctcattgcagcccaaacaattttgttcatttgagaactgagaacatcaattacattcggcagcattggaagacaattgtagaagggtttcgttgaaaccagaaagcgagaggaaacttccctagtgtaatggcagtctatgcggttgcagacttggaaaattagttggtgcatatatcgttgtataagttagggtctatcatactatcttgtatcgagtaacatcatgtatcttactgtgtaatgtcgatatatgttgtaggggcagactaggtagactctagaattagaaatgtagtcagaataatcctactatgcttaaaattttatttgc

SEQ ID NO: 21301 - protein, 437 aa, Panicum virgatum
  misc_feature: Ceres CLONE 1815497
  misc_feature (215)..(262): Pfam Name: Kelch_1 Pfam Description: Kelch motif
  misc_feature (167)..(213): Pfam Name: Kelch_1 Pfam Description: Kelch motif
  misc_feature (76)..(123): Pfam Name: F-box Pfam Description: F-box domain
MDAGSRPPPPTGAGVRVRAPLVESVSCYCRLDTGLKTVVDARKFVPGAKMCMQPEVKQSKCKSRGSKKERCRTQAPLLPGLPDDLAIACLIRVPRVEHPNLRMVCKRWNRLLSRNYFYSLRKKIGVAEEWVYVFKRDREGKISWHAFDPLHQLWKSLPPVPSEYSEALGFGCAVLSGCYLYLFGGKDPLRGSMRRVVFYNARTNKWHRAPDMLRKRHFFGSCVINNCLYVAGGECEGIQRTLQSAEVYDPNRNRWACISEMNNGMVPFIGVVYDGKWFLKGLDSHRQVTSEVYLPSSNAWSTIDDEMVTGWRNPSISFNGRLYSADCRDGCKLRVYDDNTGTWTRFMDSKHHLGSSRAFEAAALVSLNGKLCIIRNNMSITLVDVSDPTMSVETDSARMWETVARKGQHRSFVANLWSTIAGRNLKSHIIHCQVLQV

SEQ ID NO: 21302 - DNA, 1842 bp, Panicum virgatum
  misc_feature: Ceres CLONE 1815512
  misc_feature: Encodes the peptide sequence at SEQ ID NO. 21303
aagctgctccggcaatgtccgcccccgccccgacccccatcccgctgaccaccgtcgccgagctgcggcagcaccactcgcagctggtccgcctgggcctcgcctcccaccccgcccacgcgcgccgcctcctctccttcctcgcccgcgaccccgacgcccacttcccctacgcggcccggctcctggcgcaccatccggacccgcacccggcgctcttcaacccgctcttccccgcgctcccgccgcgccacgccgcgcggctcctggccctcatgctctccctgccactcgcccccgaccacttcaccttcccgcgcgtcctccccgccgccgccccgctccacctcgtctcccagctccacgcgctgctcctcaagctcggcttccgcgcccacacgcagtcgctcaacgcgctgctcgccgcctacctcgccaacgcgcgacccgacctcgccttccgcgccttccgcggcgggggctgcgcgctcgacgtcgtgtcgtggaccaccatggtcggcgggctctgcaggctcgggctcgtcgacgccgcgcgggaggtgttcgacgcgatgccggagcggaacctggtgtcgtggaacgcgatgatgtccgggtacgtcagggccgggcggttcctggacgcgctggaggtgttcgacgagatgcgagcgcgcggggtggacgggaacgggttcgtcgcggcgacggcggcggtggcgtgcacgggcgccagcgcgctggcgcgcgggagggaggtgcaccgctgggtggagcggagcgggatccggatggacgagaggctggcgaccgcggtggtcgacatgtactgcaagtgcggctgcgtcgaggaggcgcggcgcgtgttcgaggccctgccggccaaggggctcacgtcgtggaactgcatgatcggcgggctcgcggtgcacgggcggggcgaggacgccctcgagctgttcggccggatggagagggagggcgtggcgccggacgacgtcacgctggtgaacgtgctcgcggcctgcgcgcacgcggggatggtcggcgagggccggcgctgcttcgaccacattgttcggagatacggcatcgagcccaagatggagcactacggctgcatggtcgacttgtatggaagagcagggcggctgggcgaagccaaaaaagtgatcgacgacatgccgatggagccggacgttggcgtcctcggtgcgctcttcggtgcgtgcaggatccacggcgacgtcgaactgagcgaggcgatcgggtggcgcgtcatcgagctggatccccaaaacagtggccgctacgtgctgctggcgaacctcctcgccactgccggccggtgggaggacgtggccagggtccggcggctcatggacgagcggaacgtgagcaaggaagccgggcggtccgcgatcgaggtcgacggcgaggtctgcgagttccagtgcgggagcctgtgccatccccaggcggaggaggtgtacgccatggccagggacatgatgaggaggatcggggcagagggatacgtgcccgacacgagggacgtgctgcacgacattgcagaggaggagaaggagacgccgctgctctaccacagcgagaagctggccatcgccttcgggctgctgcgcacgaggcccggcgacacgatgcggatcacaaagaatttgagagtctgcagggattgccatgaggcgaccaagttcgtgtcccgcgtatttgagcgcgagatcgtggtcagggacaggaaccggttccatcatttcaaggatgggaagtgctcgtgtaaagattattggtagaatccattaagaagtttacgttattccc

SEQ ID NO: 21303 - protein, 599 aa, Panicum virgatum
  misc_feature: Ceres CLONE 1815512
  misc_feature (294)..(328): Pfam Name: PPR Pfam Description: PPR repeat
  misc_feature (193)..(227): Pfam Name: PPR Pfam Description: PPR repeat
MSAPAPTPIPLTTVAELRQHHSQLVRLGLASHPAHARRLLSFLARDPDAHFPYAARLLAHHPDPHPALFNPLFPALPPRHAARLLALMLSLPLAPDHFTFPRVLPAAAPLHLVSQLHALLLKLGFRAHTQSLNALLAAYLANARPDLAFRAFRGGGCALDVVSWTTMVGGLCRLGLVDAAREVFDAMPERNLVSWNAMMSGYVRAGRFLDALEVFDEMRARGVDGNGFVAATAAVACTGASALARGREVHRWVERSGIRMDERLATAVVDMYCKCGCVEEARRVFEALPAKGLTSWNCMIGGLAVHGRGEDALELFGRMEREGVAPDDVTLVNVLAACAHAGMVGEGRRCFDHIVRRYGIEPKMEHYGCMVDLYGRAGRLGEAKKVIDDMPMEPDVGVLGALFGACRIHGDVELSEAIGWRVIELDPQNSGRYVLLANLLATAGRWEDVARVRRLMDERNVSKEAGRSAIEVDGEVCEFQCGSLCHPQAEEVYAMARDMMRRIGAEGYVPDTRDVLHDIAEEEKETPLLYHSEKLAIAFGLLRTRPGDTMRITKNLRVCRDCHEATKFVSRVFEREIVVRDRNRFHHFKDGKCSCKDYW

SEQ ID NO: 21304 - DNA, 723 bp, Panicum virgatum
  misc_feature: Ceres CLONE 1815528
  misc_feature: Encodes the peptide sequence at SEQ ID NO. 21305
ccatatccattcgagctcctcaaaccgcgagagctagcactgccacaccatgtccattgccatggcaagcttggcacagcagttcatgcttgagctgaagactccacgatcatggcttctgctacttgttcctctcttcctcttgctcgtgcgctactcgctgtccacgttcagtgccaagagagggaggccgaggcagcagcaggcatcagacaaccaccacccaccgccttccccgccggcgctgcccgtcctcgggcacctccacctcgtgggctcgctcccgcacgtctccctcaggaacctcgccagggagcacggctacgatgacctcatgctgctccgcctcggcgccatgccggtcgtcgtcgtgtcgtcgccgagggccgccgaggcggtgctgcgcacgcacgacctcgcgttcgcgtcccggccgcactctctggtcgccgagatcgtcctctacggcccatccgacatcggcttcgcgccgtacggcgagtactggcgtcaggcgaggaagctcgtcaccacgcacatgctcaccgtcaagagggtgcagtcgttacgccttgcccgcgaggaggaggtgagttttgtgatggccaagatcggcgaaacggccgccgccggtgcggcggtggacatgagcgacctgctcggctcgtacatcaacgacctggcctgccgcgccgtgatgggcaagtccttccggaacaaagg

SEQ ID NO: 21305 - protein, 224 aa, Panicum virgatum
  misc_feature: Ceres CLONE 1815528
  misc_feature: SWISSPROT Homolog: EC 1.14.13.68 4-hydroxyphenylacetaldehyde oxime monooxygenase
MSIAMASLAQQFMLELKTPRSWLLLLVPLFLLLVRYSLSTFSAKRGRPRQQQASDNHHPPPSPPALPVLGHLHLVGSLPHVSLRNLAREHGYDDLMLLRLGAMPVVVVSSPRAAEAVLRTHDLAFASRPHSLVAEIVLYGPSDIGFAPYGEYWRQARKLVTTHMLTVKRVQSLRLAREEEVSFVMAKIGETAAAGAAVDMSDLLGSYINDLACRAVMGKSFRNK

SEQ ID NO: 21306 - DNA, 2609 bp, Panicum virgatum
  misc_feature: Ceres CLONE 1815537
  misc_feature: Encodes the peptide sequence at SEQ ID NO. 21307
atggatccgcgctaaatgcattgcgagtctgcaatcttgtagcattccttcctgttccatctgccgcaagatgtaagcagggtctcacttgacacaccgagtggccattcagaatatactctcagatcttctgtctgagaaaaagcaacgccctttttggtccgggaaatggaggagagcttcgtgcccctgcggggcatcaagaacgacctccatgggaggctcgcctgctacaagcaggactggactggagggttccgcgccggtatcaggatcctggcgccgaccacctacatattctttgcgtccgcgataccggtgatatcatttggagagcaattggagaggaacactgatggagttctcacagcagttcagacgttggcatccactgccctgtgtggcataatccactccattgtgggagggcagcctctgctgatccttggcgtcgccgagccgacagtgctcatgtacacattcatgttcaactttgccaaggacaggcctgacctcggccgaaatctgttccttgcctggaccggttgggtctgcgtatggactgccattctgctgttcttgctggcaatactaggcgcgtgctcgatcatcaaccgattcacccgcatcgcaggcgagctgtttgggcttctgattgctatgctcttcatgcagcaggctatcaaggagcttgttgatgagttccgcattcctgaaagggaaaaccgaaaggcactggagtttgttccatcatggcgctttgccaacgggatgtttgcaatcgtcttgtcatttggccttttgcttactgccctgcggagcaggaaggcgagatcatggcgctatggagcaggttggctgcgtggcttcatcgccgactatggtgttccactgatggtgctagtatggactggagtttcttacataccttacggaagtgtaccaaaaggaattccacgacgccttttcagccccaatccatggtcccctggtgcatatgacaattggactgttatcaaggatatggcacatgttccgctcctctatatcatcggcgccttcataccagcaacaatgattgctgttctctactacttcgatcatagtgttgcatctcagcttgctcagcagaaagagttcaatctgaggaagcctccatccttccactacgatttgcttctcttaggcttcctgactttactgtgtggccttattggtatccctccagcaaatggtgtcattccacagtcacccatgcatacaaagagcctggctactctcaagcatcagctgcttcgtaaccggctagtagccactgcacggaagagcatgggtcagaatgctagcttgagccaactgtatggcagcatgcaggatgcttatcagcagatgcagacaccacttgtttatcagcaaccgtctgtcagaagaggcttaaatgagctcaaggactcaacagttcagctagcttcaagcatgggtaacattgacgcaccagttgatgagacagtttttgacatagcgaaagaaattgatgatttgctgcctatcgaagtcaaggagcagcgcttgagcaacttgctacaggcagccatggtgggggcttgtgtcgctgcaatgccgctactcaagaagatcccaacatctgtcctctggggctattttgccttcatggccattgagagcttgcctggtaaccagttctgggagaggatcttgctgctcttcactgctcccagcagaagatacaaggtgctagaagagtaccacaccacgttcgtcgagactgtgccattcaagacgatagccatgttcacactgttccagacaacatacctgctggtctgctttggaatcacatggatcccaatagccggtgttcttttccccctcatgatcatgctcctggttccagtcaggcagtacatcctccccaagcttttcaaaggtgcacatctaactgacctggatgcagcagaatatgaggaatcacctgctataccattcagccttgctgcgcaagatatcgatgttgcattgggacgcgcccaaagtgcagagatcctagacgacatggtcacaagaagccggggcgagatcaagcgtctgaacagccctaagatcactagctcaggtggcacacctgtggcagaactgaaaaacatccgcagcccttccatttctgaaaaggcatacagccctcggctcactgagctcaggcatgagcgcagccctctgggagggagaaacagccctaggatgccatccaagttgggcgaagggtcaacaccaaagtgaataaatcaatgatgcattgcttagataagctaagcaaccactggaagtcatctatatgagtgatttcggtattataggtgttaaaagaaagagtgttttcagtgttagtatccttatatgagatgtcctctgatgaagtatgatatgaatatctctaggctctctttcttcttctctttctcatgttctcttgatttaaggagtactgtacctgtaatctctgaactagaggaatgttagagtaactacttggaaatactgagttccactagcagattatcattctttattgcttatattcattaatatgc

SEQ ID NO: 21307 - protein, 709 aa, Panicum virgatum
  misc_feature: Ceres CLONE 1815537
  misc_feature (7)..(552): Pfam Name: HCO3_cotransp Pfam Description: HCO3- transporter family
MEESFVPLRGIKNDLHGRLACYKQDWTGGFRAGIRILAPTTYIFFASAIPVISFGEQLERNTDGVLTAVQTLASTALCGIIHSIVGGQPLLILGVAEPTVLMYTFMFNFAKDRPDLGRNLFLAWTGWVCVWTAILLFLLAILGACSIINRFTRIAGELFGLLIAMLFMQQAIKELVDEFRIPERENRKALEFVPSWRFANGMFAIVLSFGLLLTALRSRKARSWRYGAGWLRGFIADYGVPLMVLVWTGVSYIPYGSVPKGIPRRLFSPNPWSPGAYDNWTVIKDMAHVPLLYIIGAFIPATMIAVLYYFDHSVASQLAQQKEFNLRKPPSFHYDLLLLGFLTLLCGLIGIPPANGVIPQSPMHTKSLATLKHQLLRNRLVATARKSMGQNASLSQLYGSMQDAYQQMQTPLVYQQPSVRRGLNELKDSTVQLASSMGNIDAPVDETVFDIAKEIDDLLPIEVKEQRLSNLLQAAMVGACVAAMPLLKKIPTSVLWGYFAFMAIESLPGNQFWERILLLFTAPSRRYKVLEEYHTTFVETVPFKTIAMFTLFQTTYLLVCFGITWIPIAGVLFPLMIMLLVPVRQYILPKLFKGAHLTDLDAAEYEESPAIPFSLAAQDIDVALGRAQSAEILDDMVTRSRGEIKRLNSPKITSSGGTPVAELKNIRSPSISEKAYSPRLTELRHERSPLGGRNSPRMPSKLGEGSTPK

SEQ ID NO: 21308 - DNA, 1765 bp, Panicum virgatum
  misc_feature: Ceres CLONE 1815554
  misc_feature: Encodes the peptide sequence at SEQ ID NO. 21309
ctgctcctcctgtccagccctaaccaaatcctgcttcccgttccccaccccgcttgggcgctggtggcggcgccgcgaagcgaggcgacgaatcaatcggcgcctccccgccgcccaggctccacaggaagcacgcggacccaccgctcttcgctgtgtcgtcggtgattcaagtaccgtatttttgccaagatgtctgacggtcaggaaattgacaagaatattgagatttggaagatcaagaagttgatcaagggattggaatctgctagaggcaatggtactagcatgatctctctgattatgcctccacgtgatcaaatctcgcgtgtgaccaagatgttgggtgatgaatatggcactgcttcaaacattaagagtagagttaatcggcaatctgttttagcagccatcacctcagctcagcagaggctgaaactgtacaacaaggttccaccaaacggacttgttctctacactggaacaattgttactgaagatggcaaggaaaagaaagttaccattgattttgagcccttcaagcctatcaatgcatccctttacctttgcgacaataagttccatactgaagctttgaatgaactcttggaatctgatgacaagtttggcttcattgttatggatggtaatggaactctttttggcacactgagtggcaacacccgcgaagtgcttcacaaattcactgttgatctaccaaagaagcatggaagaggagggcaatctgctcttcgttttgctcggcttcgaatggagaaacggcataattatgtccgaaagacggctgaacttgctacacagtttttcatcaacccatctaccagtcaacctaatgttgctggacttatattggctggttctgctgatttcaagacagaactcagccaatctgacatgtttgaccagcgtctccaggccaaaatacttaatgttgttgatgtttcatatggtggcgagaacggttttaaccaagcaattgagttgtctgctgaaattctagcgaatgtgaagttcatacaggagaaaaaactgattggaaagtattttgaagaaattagtcaagatacggggaagtatgtctttggtgttgatgatacattgaaggctcttgaaatgggtgctgtggagacacttatagtgtgggaaaaccttgatatcaacagatacgtgcttaagaacagtgcaactggagaaattattatcaaacatctgaacaaagagcaagaagctgaccagagccagttccgtgatccatctaccaatgctgagttggaggttcaggataagacctcgctcttggaatggtttgctaacgagtacaaaaagtttgggtgcacacttgagtttgttaccaacaaatctcaagagggttcacagttttgcagaggatttggtggcatcggtggcatgttgcgctatcaactggatatccgttcttttgatgagctttccgatgacgagggggtctatgaggactctgattaagcaatcaatccgtcacatgcctgtgctggaccttggaaggatgcaattgctacagtgttctaaattttgcttcagtgttgtagttttgaatactacttcagaagatgcatgtttcgtttcctctgcagcagcagcttacaattgcattgtgaaccacatcatatcaatccgttgatacctactgtcctgttgtgttgtagactatttatgacttgatttaaggtttgacttttagcaaatgctccaatgacaacatttg

SEQ ID NO: 21309 - protein, 437 aa, Panicum virgatum
  misc_feature: Ceres CLONE 1815554
  misc_feature (6)..(140): Pfam Name: eRF1_1 Pfam Description: eRF1 domain 1
  misc_feature (281)..(418): Pfam Name: eRF1_3 Pfam Description: eRF1 domain 3
  misc_feature (144)..(278): Pfam Name: eRF1_2 Pfam Description: eRF1 domain 2
MSDGQEIDKNIEIWKIKKLIKGLESARGNGTSMISLIMPPRDQISRVTKMLGDEYGTASNIKSRVNRQSVLAAITSAQQRLKLYNKVPPNGLVLYTGTIVTEDGKEKKVTIDFEPFKPINASLYLCDNKFHTEALNELLESDDKFGFIVMDGNGTLFGTLSGNTREVLHKFTVDLPKKHGRGGQSALRFARLRMEKRHNYVRKTAELATQFFINPSTSQPNVAGLILAGSADFKTELSQSDMFDQRLQAKILNVVDVSYGGENGFNQAIELSAEILANVKFIQEKKLIGKYFEEISQDTGKYVFGVDDTLKALEMGAVETLIVWENLDINRYVLKNSATGEIIIKHLNKEQEADQSQFRDPSTNAELEVQDKTSLLEWFANEYKKFGCTLEFVTNKSQEGSQFCRGFGGIGGMLRYQLDIRSFDELSDDEGVYEDSD

SEQ ID NO: 21310 - DNA, 1264 bp, Panicum virgatum
  misc_feature: Ceres CLONE 1815563
  misc_feature: Encodes the peptide sequence at SEQ ID NO. 21311
agagggggagagagagataccattgctgtagccctgtaggggagggcctgagggggagagggagggaggcgaggcggtgcagctatggcgagagcggcctgggccgcatggctgctcgtcctcctgtgctgcggcgcttggaccccgcggcgaatcttggtctccgcggccaccgacgcgaatgatgttactgccctcaacacgctgtttaccagcatgaattcaccagggcagctacagggctggaaggcaagcggcggtgacccctgcaacgaatcatggaagggaatcacctgctctggatcctcagtcactgcgattaaattgccgggattggggctctctggaactctggcctacaacatgaacaccatggattcactagtagagctagatatgagccaaaataatcttggtgctggtcaacagattccgtataatcttccaaataagaagcttgaaagactcaatctggcaggaaaccagttctctggaggtataccatactcaatttcgacaatgcctaaacttcaatacctgtgagtacattttctgtgttgtttttttggtcgaaaactggatttgtattgaattccatgcttatatttaaagttctaaatgactaaatgtatatttcaatgcatatatagaaatcttaatcataaccaactatcaggagatatcactgacatattttccaacctcccaagtttaaccacagtagacctttcctccaattctcttactggtaatctaccgcaaagtttcagttctttgccaagcctgaaaacactgtatttgcagaacaatcaacttactggctcaatcaatgtacttgccaatcttccgcttgacgatttgaatgtagcaaataaccgcttcactggttggattcctgatgagctaaagaagataaatagcctacaaaccgatggtaattcttggagcaccagcccagcaccaccaccaccaccatttacatctcctccacattctcgcagcagccgtcggagaagcccaggccagcactccaatggaagtaacaactcaagttctggtggaagctctggcataggtgctggagccatagcaggcattatcatatctgttctagttattggagcagttgttgcgttcttcttgataaagagaaaacaacgaaaaggtgcaatgccagaacactatgaacagcgccagccgtttaattcattcccttcaaatgaagttaaagagatgaagcctgttcaagaggctaccactgtag

SEQ ID NO: 21311 - protein, 152 aa, Panicum virgatum
  misc_feature: Ceres CLONE 1815563
  misc_feature (31)..(72): Pfam Name: LRRNT_2 Pfam Description: Leucine rich repeat N-terminal domain
  misc_feature: SWISSPROT Homolog: EC 2.7.11.1 Non-specific serine/threonine protein kinase
MARAAWAAWLLVLLCCGAWTPRRILVSAATDANDVTALNTLFTSMNSPGQLQGWKASGGDPCNESWKGITCSGSSVTAIKLPGLGLSGTLAYNMNTMDSLVELDMSQNNLGAGQQIPYNLPNKKLERLNLAGNQFSGGIPYSISTMPKLQYL

SEQ ID NO: 21312 - DNA, 2689 bp, Panicum virgatum
  misc_feature: Ceres CLONE 1815570
  misc_feature: Encodes the peptide sequence at SEQ ID NO. 21313
atccgattccaagaccgaggactgctccgccaccgtccaaccagcaatgccagcggtggcgttcctatcggcgccggcgtcggccgcggctgcgcggcgccgggggttcaaccccgcggcttccgcctcgctgcgccgtgtcgcgtcgggcgggggctccagctggcgcagcgagcggcggctcatgtcggagctggagcgcacggtcacggcgggcgcggccgagcgcgtcatccgcagctacgtcggcaataagtcggagcgcgccgcgctcgccgcgctctccaggctcctcatggattccgaccccctcgccatcccgttctatgaggcagtcactcaggcccggtggttcaaatggagctctattcatgctgctgcagttgctgccttgcttgaagtcaatgggagccctggagaatcaaggtccctgatctctgactccatctcacagcacctccagtccaccgatgaggtggctctcttctactgtgatctcatggttgctttctcctcgcgcgggttgaaagatcgggcgatggatttctacactgagataaggtctatgccgcacaccgggcgcaaggcctacatggccatgataaaatccttgtgcctgatgggtctggccagtgaggcagaggaagcacttagggaaatggtctctctcggctaccagcctgaagctttccagtttggattggttgcaaaatgctacggcaagtcaggctcgttagttgagatggagagggttattgcatctatgtcaaatgctggcatccgactgggcactggcgcagcgaacattgtgctttcatgctacagctcctgccgtgatcattccaagatgctagtatggttgaagaagatgaggaaattgtgcattgcaccaactgcaaaagcatacaactttatgctcaattcatgccccacacttgctttggtggttcaagagctggacccttcactcccactgtcaacagcggtgttggtcaaaaagctcaagtctgtatctacactaccatcagaagctgagctggtgcatgagcttctggcctcctcatcggtgctggacaaggcaaccgaatggtctgatgcagaggtgaaactgaatctgcatgggttcagtacaattgcagcctatgtgctgatgctgcagtgggtggatgttataaagcgtcgaacattaccgttggaggtgtctgtggtgtgtggcattgggaagcacagtgatgtccgaggtgagcccaaagtgcgggagctagcacaagaggttctgagccgaatggggagcccccttaggctatccacaaggaacaaagggcgtctcgtggcaaagcgagatagggtgactcaatggcttgccagctttccagtgcctgaggaggtcacagataaatcacctgacgcaacgagccaacaaccatttgcatttacgattttcagaaaacttggacaatttttttccaccctcgtgtaggttttcagatgaattgcaaggtagttcagcatctttgccatgctgtagaataatagaaagtctatatatggtgctcaaagaagtgttggcctaatccttgttctgatgttggagtattatgcctcaacgagctgcttgatgctgatgggactgacaaattgcgctggtccatcatagaagacaaggcccgcaaacttgtaagtagcctgggtagggtgcaggaggtcccagaagaggtacttgctgcgatcactgcagcagttggagctggggatgcaccctctctgagcgttgaacctgccaccaccacagcatgcgctcttcacctcctccaaccctgcaggcaaaaagtgagcaacgctgcagaaatactggagaaagaggcggctaagcactgctattacaatgtccggtatgtgggtttcgtatccagaatacccctgctcagtttttgcaacttaccagcagcatgcggggttttaatcagactagagacaagctcataggcgctggaaatagagtacttcatgctctgcatttctaagctgagattgctgaagaggaccctgattccatcattcaggctcttcgccaactgattcaattgctcaacgcattctccagatggtttccgacttctcaagtatggacagcacccaattagtggcacattgatcaccgcaaatttccttgctcccaaattgtacaatgtctgcagcacggcaaatatacagttacggttgataaagaatcgacttgttttgtcagtacttcaacccatgtgcctagagttctgacatgtgccttcaagcatgattaaatgaagcagcacttttggttcaaatgttcagatatggtttttttcagagttgcaaattctgatttgcatacggatttgtctgcattgaagaaaattgagtgctcttactttgacatggctatcatatgtggagatcatagcttcatagaactgctgaatggtggtggagtccggtgatttgttctgtgagaagaagtcgaaagcatcattcgccccggcacttatgaggaagattgattttgacagcaagtctgacactctagcagcaccaagtctggttgacatctcatctttgaggtctgagaagtactctatctgctgcgtcatgctgattgtagatccctggtgtaaatgccatttagaattttaattttaatgtttttgttccg

SEQ ID NO: 21313 - protein, 477 aa, Panicum virgatum
  misc_feature: Ceres CLONE 1815570
  misc_feature (180)..(214): Pfam Name: PPR Pfam Description: PPR repeat
MPAVAFLSAPASAAAARRRGFNPAASASLRRVASGGGSSWRSERRLMSELERTVTAGAAERVIRSYVGNKSERAALAALSRLLMDSDPLAIPFYEAVTQARWFKWSSIHAAAVAALLEVNGSPGESRSLISDSISQHLQSTDEVALFYCDLMVAFSSRGLKDRAMDFYTEIRSMPHTGRKAYMAMIKSLCLMGLASEAEEALREMVSLGYQPEAFQFGLVAKCYGKSGSLVEMERVIASMSNAGIRLGTGAANIVLSCYSSCRDHSKMLVWLKKMRKLCIAPTAKAYNFMLNSCPTLALVVQELDPSLPLSTAVLVKKLKSVSTLPSEAELVHELLASSSVLDKATEWSDAEVKLNLHGFSTIAAYVLMLQWVDVIKRRTLPLEVSVVCGIGKHSDVRGEPKVRELAQEVLSRMGSPLRLSTRNKGRLVAKRDRVTQWLASFPVPEEVTDKSPDATSQQPFAFTIFRKLGQFFSTLV

SEQ ID NO: 21314 - DNA, 1879 bp, Panicum virgatum
  misc_feature: Ceres CLONE 1815601
  misc_feature: Encodes the peptide sequence at SEQ ID NO. 21315
aacgactcctcacccaaatcaaaccgaaaccaatccgccgcctcccgatccacaagctcccgccgcccgtcgccaccgccgcggcctccatcccacccccggcgatcggcgcctcggcatccgggccggcgaccgcgcctcggcacctcccgcctcgatggggagcgacgcggagcccgccaaggggctgctgccctacctgcagcgcgccgacgagctgcagaagcacgagcccctcgtcgcctactactgtcggctctacgggatggagaaggggctgaggatcccgcagaaggagcgcaccaagaccaccaactccctccttatctccctcatgaaccagctcgagaaggacaagaaaaccttgactctgggaccggacgaccaccttcatgtggagggatttgcattaaatgtcttcgctaaagcagataaacaggaccgtgctggacgagctgacataaacactgctaaaaccttctatgctgcaagcatcttcttcgagattcttaaccagtttggcgagcttcaacctgatattgagcagaagcagaaatatgctatctggaaggctgctgacataaggaaagctatcaaagaaggacggaagcccgaacctggtcctcctggtggggataaagatgaagcacttttcagtaccaccacaatttcgcaggatatggggcgaaaccagtccttcaacagtatgcagcatgggactgaagcaccatctccacctgtagacaaggaatttagtaggcgggatagcttttccactgtgcagccaggaaatattgtgcatcgacaaagtacagagttcaatgataatccctctacccagtcaccctattcacccccaccaccctcacattcccagcatccttctccatctcaatcttattcctctccctcataccaagcaacagagtacccttctgatttccacaagccaccccccaaccattcatctccccactacacgagcccagactaccctaccaatgaggtccacaaaccaccatctaatttttccccacccccttacaccaggacagactatccttccaatggtagctacaatcctcatagcaatgataaaccagatgtttcggcctatcctcagacataccaacccccaccctacacaattgaacctcagcacacctcacaaaactactactccactgaagctccagctgccccatacaactaccctaattttcagtcatatccaagtttccaagacagcacgtcgccttctgtcccgacacatcaatcttcattctatcctgcaagtgatggtcctgcagctacagcacagactcccgcgtcgaatccctccgctcccacacattaccactctactgcagactctacaccccaagttactcctccagctgcgccgctagctagtcaatataagtatgatagcagttaccagccagcagtcgagaagattgctgaggcgcataagtcagcaagatttgcagttggcgctcttgcattcgacgacgtgtctgttgccgtggatcaccttaaacgtgcactggatcttttgacaaacccttctgctgaaactcattagcttttttggctgctgtgctctttctcaaaagcatcttctgtacatatacaagattggtataccaccagatggagatgtttgccaggctgcatacatacaagatacagggggcaagcacacaaatctagcagataataacggagccgttccgtgtgggcttttgaagcaataatgctattttaaggaaaccttgtaaaattgaattattagttatcagagttttgtggtaaggctttgtaacccattgtgtccagttacatattcttgaggtattctttgatatttttttttggt

SEQ ID NO: 21315 - protein, 475 aa, Panicum virgatum
  misc_feature: Ceres CLONE 1815601
  misc_feature: SWISSPROT Homolog: EC 2.7.7.6 DNA-directed RNA polymerase
MGSDAEPAKGLLPYLQRADELQKHEPLVAYYCRLYGMEKGLRIPQKERTKTTNSLLISLMNQLEKDKKTLTLGPDDHLHVEGFALNVFAKADKQDRAGRADINTAKTFYAASIFFEILNQFGELQPDIEQKQKYAIWKAADIRKAIKEGRKPEPGPPGGDKDEALFSTTTISQDMGRNQSFNSMQHGTEAPSPPVDKEFSRRDSFSTVQPGNIVHRQSTEFNDNPSTQSPYSPPPPSHSQHPSPSQSYSSPSYQATEYPSDFHKPPPNHSSPHYTSPDYPTNEVHKPPSNFSPPPYTRTDYPSNGSYNPHSNDKPDVSAYPQTYQPPPYTIEPQHTSQNYYSTEAPAAPYNYPNFQSYPSFQDSTSPSVPTHQSSFYPASDGPAATAQTPASNPSAPTHYHSTADSTPQVTPPAAPLASQYKYDSSYQPAVEKIAEAHKSARFAVGALAFDDVSVAVDHLKRALDLLTNPSAETH

SEQ ID NO: 21316 - DNA, 1402 bp, Panicum virgatum
  misc_feature: Ceres CLONE 1815604
  misc_feature: Encodes the peptide sequence at SEQ ID NO. 21317
atctacaactgacagcaaagcaaagctttgagcttttcccgaaacacgccgcccccattttctcctccctgtcaacctttttccctttaagaaattcggcctggctaatgtactcgctgcgagatcttcagctccgggccccgtgcccccgtgtggattagtcgctgtcacgttcgacgaggggcgccaattgcggtggccaccacctccaatccactccccgcagccgccgcgccgagctgttcttgctctgtcctcctaaggcggaggggtggttgcttctccgggctctgaggttggaatcttgtcccgctcacaaggtttagtcttgattggtctcatctgctcagctgtctggttgcaagcttagaactggaaggaataatttgactagagaaatgggacagtgttgcagcagagctacggccccagattctggacggggaggtgccaatgggtatggctattctaaccaggcaaagccagcacaaacacctcccagttacaatgctcctcagccacaggccgaggtacggtacacgccgccggcgatgaaccctccggtagtcccacctgtaattgtcccaccgaagcccactgcagacacaattcttggcaagccgtatgaggatgtgcgcacagtctactccctcgggaaggagcttggccgcggccagttcggggtgacgtacctctgcacagagattgctactggtaggcaatacgcgtgcaaatccatctctaaacgcaagctcaccagcaaggcagacagggaggacattcgcagggagatccagatcatgcagcacttgtctgggcagccaaacattgttgagttccggggagcgtacgaggataagagcaatgtgcatgtggtgatggagctctgcgctggtggtgaactatttgatcggatcattgctaaggggcactacacagaacgggcagctgctacaatctgcagagcagttgtgaatgttgtgaacatttgccacttcatgggagtgatgcatcgtgatctgaaaccagagaatttcttgctcgcaactaaggaggagaatgcaatgctcaaggccactgatttcggactttcagtcttcattgaagaaggaaagatgtacagggacattgttggaagtgcttattatgttgctcctgaagtccttaggcggagttatggaaaagagatagatgtttggagtgcaggagttattttgtacattctcctcagtggcgtgcctccattttgggctgaaactgagaaggggatatttgatgctattctgcatgaggagattgactttgaaagtcagccttgggcatcaatttctgagagtgctaaagacctggttagaaagatgttggcacgagatccaaagaaaagacttacttcagggcaaag

SEQ ID NO: 21317 - protein, 334 aa, Panicum virgatum
  misc_feature: Ceres CLONE 1815604
  misc_feature (83)..(333): Pfam Name: Pkinase Pfam Description: Protein kinase domain
  misc_feature: SWISSPROT Homolog: EC 2.7.11.1 Non-specific serine/threonine protein kinase
  misc_feature: The sequence is a functional homolog of SEQ ID NO 2 in US patent 7084323
MGQCCSRATAPDSGRGGANGYGYSNQAKPAQTPPSYNAPQPQAEVRYTPPAMNPPVVPPVIVPPKPTADTILGKPYEDVRTVYSLGKELGRGQFGVTYLCTEIATGRQYACKSISKRKLTSKADREDIRREIQIMQHLSGQPNIVEFRGAYEDKSNVHVVMELCAGGELFDRIIAKGHYTERAAATICRAVVNVVNICHFMGVMHRDLKPENFLLATKEENAMLKATDFGLSVFIEEGKMYRDIVGSAYYVAPEVLRRSYGKEIDVWSAGVILYILLSGVPPFWAETEKGIFDAILHEEIDFESQPWASISESAKDLVRKMLARDPKKRLTSGQ

SEQ ID NO: 21318 - DNA, 737 bp, Panicum virgatum
  misc_feature: Ceres CLONE 1815607
  misc_feature: Encodes the peptide sequence at SEQ ID NO. 21319
tctcttcaccaccctccctctcgcttcttcctctcctcccctctcttccgcgaactcagtgagaggggggatccggccacctcggttacctgcggtttccagtccctcggagttcgcgcttcttccgcggctccatttctgagctctcgggatccgatccggtacggttccggacggaagccggcgccttctccaccttgggtcgatcggctccgtgtttcgccatggggaactgctggggcgccaagatcagctccgacagcccgtcgcgcggcgccttctccccgtcaggggtaacttccaagttcgccagtaggaatggggctgccctgagcagctccagcagccatgcctcgtctgcatcaatgctgccaaccccacgtagcgaggacgagattctggagtctgcaaacgtcaaggccttcaccttcaatgagcttagaactgccaccagaaacttcagaccggacagtgtactcggtgagggtgggtttgggtctgtcttcaagggttggatcgatgagaagacactcgccccaactagaccaggcttagggatggtcattgctgtcaagaagctgaaccaggaaggttaccaggggcacaaggaatggctgactgaggtgaattaccttggaacgctgtcaaacccatatcttgtaaggctcgttggctactgtctcgaagatgaacagcggctccttgtctatgagttcatgccacgcgggagtttggag

SEQ ID NO: 21319 - protein, 170 aa, Panicum virgatum
  misc_feature: Ceres CLONE 1815607
  misc_feature: SWISSPROT Homolog: EC 2.7.11.1 Non-specific serine/threonine protein kinase
  misc_feature: Useful for making plants with modulated drought sensitivity
MGNCWGAKISSDSPSRGAFSPSGVTSKFASRNGAALSSSSSHASSASMLPTPRSEDEILESANVKAFTFNELRTATRNFRPDSVLGEGGFGSVFKGWIDEKTLAPTRPGLGMVIAVKKLNQEGYQGHKEWLTEVNYLGTLSNPYLVRLVGYCLEDEQRLLVYEFMPRGSL

SEQ ID NO: 21320 - DNA, 607 bp, Panicum virgatum
  misc_feature: Ceres CLONE 1815610
  misc_feature: Encodes the peptide sequence at SEQ ID NO. 21321
gcaccaagtaccggcgtagtaagctctacctgataattaatttagtttttggccaccgcaccggggccatggaaagaacaatattgataatgaaggccgccgccgccgccgtcccggtgctcctcgccgtcgcggtgctcgccgccgaggcggcggcgccgcaccaccagtacccgcgcggggtgacgagcacgtaccgacggaagctggaggcctcctaggacatgccgctggacgcggacgtgttcgccgtgccgccgggccgcaacgcgtcgcaacatgtgcacatcacgctgggagaccaggccggcacggccatgaccgtgtcctgggtcaccatggaggccgagggcaacagcaccgtcctctacggccgcgccgcgagccgcctctacctcgccgccgagggcaccacctcgcgctacaccttctacaactacacctccggcttcatccaccactgcacgctcactggcctggaccacgccacccggtattactacgtcgtgcggcacagagactcagtgcgctccttctggttcaccacgccgccgcgccctggtccagacgcgccgctccacctggggctcatcggctacctgtgcca

SEQ ID NO: 21321 - protein, 127 aa, Panicum virgatum
  misc_feature: Ceres CLONE 1815610
  misc_feature: SWISSPROT Homolog: EC 3.1.3.2 Acid phosphatase
MPLDADVFAVPPGRNASQHVHITLGDQAGTAMTVSWVTMEAEGNSTVLYGRAASRLYLAAEGTTSRYTFYNYTSGFIHHCTLTGLDHATRYYYVVRHRDSVRSFWFTTPPRPGPDAPLHLGLIGYLC

SEQ ID NO: 21322 - DNA, 642 bp, Panicum virgatum
  misc_feature: Ceres CLONE 1815612
  misc_feature: Encodes the peptide sequence at SEQ ID NO. 21323
gacgctcgcagtctctgcatcccttcttcttaacccgcacgcacgcgcggcgccggcgaggccacaccccacgacgagacgccgcccaccacccgccgccaccgccgccgccaccgccatgcggctccccgccggcgctcgcctcgcactcctgctcgcccgccgctccctctcctccgcatcctcctcctccgccgccgccgcccacttcccgcgcgcgcgcgcagggatatggagcgatgcggctcgcgcggcgccctctcgggcctcgcccttctcgtctccgagcaccgcccacaggttcttccacgggactaggccggtggctgcgagggactactacgatgtgcttggcgtcagcaagaatgcgagccaggccaatattaagaaggcgtattacgggcttgcaaagaagcttcatccagacacaaataaaggtgatgcggatgcagaacgtaagtttcaagaggttcaacgagcttatgagactttgaaggatgaggaaaaaagatcattctatgatcaggttggccccgatcaatatgagaaagcttctgctgctggaggtggaactggcaacccatttgagggtggttttgggaatccatttgaggatctttttcctggtggtggggctggcgg

SEQ ID NO: 21323 - protein, 174 aa, Panicum virgatum
  misc_feature: Ceres CLONE 1815612
  misc_feature (73)..(135): Pfam Name: DnaJ Pfam Description: DnaJ domain
MRLPAGARLALLLARRSLSSASSSSAAAAHFPRARAGIWSDAARAAPSRASPFSSPSTAHRFFHGTRPVAARDYYDVLGVSKNASQANIKKAYYGLAKKLHPDTNKGDADAERKFQEVQRAYETLKDEEKRSFYDQVGPDQYEKASAAGGGTGNPFEGGFGNPFEDLFPGGGAG

SEQ ID NO: 21324 - DNA, 2007 bp, Panicum virgatum
  misc_feature: Ceres CLONE 1815624
  misc_feature: Encodes the peptide sequence at SEQ ID NO. 21325
ccgcttcgattccgttgagcctagtttccgatctaaatcctcgccgccgccggagctcgcacgcgatgggcgagctagggtttcggcggaccctgccgctgctgctggcgctgctcgccgccgcggcggcggcgggggtggaggcgcgcttcgtggtggagaagaacagcctgatggtcacgtcgccgacttcgctgcgggggcgccgcgacagcgccatcggcaacttcggcatcccgcagtacggcgggagcatggcgggcgccgtcgtctaccccaaggacaacgccaacgcctgcgacgatttcgacggcaagcaccccttccgtgccaagcccggcgcgatgccaaccttcctcctcatcgaccgcggggattgcctatttgcgaaaaaggtttggaatgcgcaaaatgctggtgcctctgcagtacttgtagttgatgacaaggatgaaccgttgataacaatggatttacctcgggaagatgatgaggctgcaaattatatacagaacataaccattccttctgcactaatagataaaaaatttggtgagcagctgaagaaggctgttaaagatggggaaatggttaatgtgaatcttgattggagggaggctgttccacatccagatgatcgtgttgagtatgagttatggacgaacagcaacgatgaatgtggacctaaatgtgatatgctgatgaattttctgaaggagtttaaaggagctgctcaactacttgagaaaggcggctatagccagttcacaccccattatattacttggtactgccctcaagcatttgtgatcagtaaacaatgcaagtcccaatgcataaaccatgggagatactgtgcacctgatccagaacaagattttagcacaggctatgaaggaaaggatgtggtggtagagaacctcagacagttatgtgtgtataaagttgcaaatgaacataagaaaccatgggtctggtgggattatgccactgattttcacataaggtgcccaatgaaggagaagaaatacaacaaaaaatgtgctgaaactgtcatcaaatcactaggtctggatgtgaagaaggttgataagtgcatgggagacccaaatgctgattatgaccacccattgcttaaaatggagcaagatgctcagattgggaaaggttcaagaggagacgttactatattgcctactcttgttgtgaacaaccggcaatatcgagggaagcttgagaggaaagctgtcctcaaagctatttgtgctggttttgaggaaactactgaacccaatgtttgcctgagtgatgatatagaatctaatgagtgcctgaatgacaatgggggttgctggcaagacaaggctgctaatgtaacagcctgcagggacaccttccgtggcagagtgtgtgaatgccccatgttcaatggtgtacaattcaaaggcgatggctacagcaattgtgaacctgctgggccaggaaaatgcttgataaaccatggagggtgttggcatgaaactcgcaacggaaaaacattctctgcttgtcaggaatctggagatgggaattgccaatgtccagctggtttccaaggggacggtgttaaaaaatgtgaagacattgatgagtgcaaggagcgaaaagcttgtcagtgtcctgaatgcaactgcagagatacatggggtggctatgactgtacttgcagcggtgaccttttatacatcaaagagcatgacacatgcataagcaagacagcagttcaggctaaagcagcatgggctgcagtgtggggtatcttgatagttatcattgttgtggctgtgggaagttacattgtatacaaatacaggctaaggtcatacatggactctgagatcagagctatcatggcacaatatatgccactggacaatcaaggagaggttccaaatcatacacgagaagaagatcgttcataaaaaaatctgctttatgcgcacactgttgcatggtaggcccgtagga

SEQ ID NO: 21325 - protein, 631 aa, Panicum virgatum
  misc_feature: Ceres CLONE 1815624
  misc_feature (59)..(170): Pfam Name: PA Pfam Description: PA domain
MGELGFRRTLPLLLALLAAAAAAGVEARFVVEKNSLMVTSPTSLRGRRDSAIGNFGIPQYGGSMAGAVVYPKDNANACDDFDGKHPFRAKPGAMPTFLLIDRGDCLFAKKVWNAQNAGASAVLVVDDKDEPLITMDLPREDDEAANYIQNITIPSALIDKKFGEQLKKAVKDGEMVNVNLDWREAVPHPDDRVEYELWTNSNDECGPKCDMLMNFLKEFKGAAQLLEKGGYSQFTPHYITWYCPQAFVISKQCKSQCINHGRYCAPDPEQDFSTGYEGKDVVVENLRQLCVYKVANEHKKPWVWWDYATDFHIRCPMKEKKYNKKCAETVIKSLGLDVKKVDKCMGDPNADYDHPLLKMEQDAQIGKGSRGDVTILPTLVVNNRQYRGKLERKAVLKAICAGFEETTEPNVCLSDDIESNECLNDNGGCWQDKAANVTACRDTFRGRVCECPMFNGVQFKGDGYSNCEPAGPGKCLINHGGCWHETRNGKTFSACQESGDGNCQCPAGFQGDGVKKCEDIDECKERKACQCPECNCRDTWGGYDCTCSGDLLYIKEHDTCISKTAVQAKAAWAAVWGILIVIIVVAVGSYIVYKYRLRSYMDSEIRAIMAQYMPLDNQGEVPNHTREEDRS

SEQ ID NO: 21326 - DNA, 755 bp, Panicum virgatum
  misc_feature: Ceres CLONE 1815624-R
  misc_feature: Encodes the peptide sequence at SEQ ID NO. 21327
agtacaggcagtggaggcaagaagagaggtccggcgccattcaggacatacaatttggggaacacctctcctgtgcctgttacacagctagtggatttgctggagaagctgctgaaagtgaaggctgtgaggaaggttgtcaagatgccaaggaatggagatgtgccatatacacatgctaacgtaagccttgcacagcgggagcttggctatcggccgtccacagatctccaaacagggctcaagaagtttgtgcggtggtatcttgagtactaccatcctgacttggctgagaagcagaagcagcatgctggtagcaatggcaagggttcacgtggtcggaacggcagcttgagtagtgcaagatgactgtttattcagtgtcttcgtggcctttcctgacggtgtgtatcagaattctacctccattgcttacttcatcagattgggaggttcattttgctcagcatgttctggatgtgaaacagaagttaagaaacactcattaggtagtcataattcaaacacctggtgcttctctttgctaccttttgctgggcatttaattcctagttccagtagttggttcttaggatggcactgtttggaagatgtttcatgggtttggggggaaggcattctgttgcaaagactacaatagattcttttagtgacattttgtaccacgggagagaactaagtatatcatgacttgttcttgttcaatttaattcgtgatgatcgacagttggcct

SEQ ID NO: 21327 - protein, 122 aa, Panicum virgatum
  misc_feature: Ceres CLONE 1815624-R
  misc_feature: SWISSPROT Homolog: EC 5.1.3.6 UDP-glucuronate 4-epimerase
  misc_feature: Useful for making plants with altered carbohydrate content
  misc_feature: Useful for making plants with altered cell wall content and/or composition
STGSGGKKRGPAPFRTYNLGNTSPVPVTQLVDLLEKLLKVKAVRKVVKMPRNGDVPYTHANVSLAQRELGYRPSTDLQTGLKKFVRWYLEYYHPDLAEKQKQHAGSNGKGSRGRNGSLSSAR

SEQ ID NO: 21328 - DNA, 1365 bp, Panicum virgatum
  misc_feature: Ceres CLONE 1815645
  misc_feature: Encodes the peptide sequence at SEQ ID NO. 21329
aatgtattggccatgtggctagaggccgctattctatttggcgtatatattccctccatgcggtgattcccccttcttcctcatcgaccgacctctcgctgtccatccatccatccgtcgccttcctcctccgattctcccctccgatccccgcggccttcatattcgctgccccaggagctagctctggtgcttagttccttggcgcgccattgctccttcacgccccggctccccccacccacgagctttacacagctagcagcagactagtagtactagtagcttggaaagggagcaggaggaggggacaggatgctgggactgggagcgacccccaaggcgaggaaaggcgcgccggcgaagctggggtcggtgaagggggcaccgccggcggtggcggtggcgccggcggggaacaaggtgccggcggaggaggtgtgggaggtgcggccgggcgggatgctggtgcagaagcggggcggcggggtgtcggacgacgagccgtcgcccaacgtgaagccggtgcccaccatccgcgtcaaggtcaagcacgccggcgtcacgcatgagatctacatcagctccgaggcgtccttcggggagctgaagaagctggtggcggccaagacggggctgcacccggacgaccagaaggtgctgtacaaggacaaggagcgcgactccaaggcgttcctggacatggccggcgtcaaggaccggtccaagctcgtcgtcgtcgaggaccccgaggccaaggcgcgccggctcatcgaggagcgccgccacgggcacctcgagaaggccgccaaggccgtcgccgcggtcaccgccgaggtcaacaagctcgcgcccaaggtggcggcgctggacgcgtcggtgcgcaagggggagaaggtggcggagaacgacgtggtgcaggtgacggagctgctgatgaacgagctgctcaagctcgacgcggtggtcgccgacggcgacgtcaaggcgcagaggcggatgcaggtgaagcgcgtgcagaagtacgtggagacgctcgacgcggtggcggccaagaacgccgccatcatccgcaaatccggcgagaaggccgccgcccccaagcagcagcagatgccggcgcagcagcagccaaggcagcagcagcaggcgccggtggcggggcagacgcggtgggagatgttcgacctgctgtcgtcgctgccgtccacatcctcggcgtcttccacgaccacggtgagctcgacggcgtcctccggcgcgccgccgacgaaccggctggactggatgctcttctgacgggccccgacgagcgatcgatcaccagcgcaaaagacgagggaaatcgtggaaagcgaaagggga

SEQ ID NO: 21329 - protein, 327 aa, Panicum virgatum
  misc_feature: Ceres CLONE 1815645
  misc_feature (164)..(245): Pfam Name: BAG Pfam Description: BAG domain
MLGLGATPKARKGAPAKLGSVKGAPPAVAVAPAGNKVPAEEVWEVRPGGMLVQKRGGGVSDDEPSPNVKPVPTIRVKVKHAGVTHEIYISSEASFGELKKLVAAKTGLHPDDQKVLYKDKERDSKAFLDMAGVKDRSKLVVVEDPEAKARRLIEERRHGHLEKAAKAVAAVTAEVNKLAPKVAALDASVRKGEKVAENDVVQVTELLMNELLKLDAVVADGDVKAQRRMQVKRVQKYVETLDAVAAKNAAIIRKSGEKAAAPKQQQMPAQQQPRQQQQAPVAGQTRWEMFDLLSSLPSTSSASSTTTVSSTASSGAPPTNRLDWMLF

SEQ ID NO: 21330 - DNA, 337 bp, Panicum virgatum
  misc_feature: Ceres CLONE 1815645-R
ttttgggggggggggggctccgatccttgatgaggcgatgattgggctaggctagcgaccgagctagtaccttgcttgctttgcttggccacgcatcgcgtcgcgtcgcatggtatggtacgggtgggtagtagttcatcatgtgaggatgcatcgtgcatgtgagagttcgttttttttcttctttttctgttcttcttcttcttgttcaccataatgtttttgagattcttttgtgtgcatattattcagagagggagagagggttggttagagcaagttaaagtgtattcaaacagattgggaataagtcgagtcaaaagggttgtccgtctcc

SEQ ID NO: 21331 - DNA, 696 bp, Panicum virgatum
  misc_feature: Ceres CLONE 1815650
  misc_feature: Encodes the peptide sequence at SEQ ID NO. 21332
atcgagttcccaaatccaatcccctcgtgaagctctcccccttcgcccctagaggtcgagaccggcgcaggcgtcccctccgggatgggatcaggaacggggtggctccccgtggccctcctgctgctggccgcctgcgtcctctcgccgcgggtcgcagcagccgccgccggggaggccgagcacgccgttcagcagcacagcgagcgcatctcagggagtgctggtgatgtgttagaagataatcctgtggggaggttgaaggttttcatttatgacttgccgaggaagtacaacaagaagatggtcaccaaggatccacggtgcctcaatcacatgtttgctgcagaaattttcatgcatcgtttcttgctctcaagtgctgtgcggactctaaatcccaaggaggcggactggttctatacgccagtttatactacttgtgatttaactaatgctggactgcccttgccatttaaatcaccacgggtgatgaggagtgcaatccagtatatttcaaacaaatggcccttctggaacagaactgatggagcacatcacttctttgttgttccacatgattttgcagcatgcttccactaccaggaagaaaaggctattgagcgtggaattcttccattgctgcgacgtgctactttggttcaaacttttggacaggagaatcacgtctgtctg

SEQ ID NO: 21332 - protein, 203 aa, Panicum virgatum
  misc_feature: Ceres CLONE 1815650
  misc_feature: Useful for making plants with altered carbohydrate content
  misc_feature: Useful for making plants with altered cell wall content and/or composition
MGSGTGWLPVALLLLAACVLSPRVAAAAAGEAEHAVQQHSERISGSAGDVLEDNPVGRLKVFIYDLPRKYNKKMVTKDPRCLNHMFAAEIFMHRFLLSSAVRTLNPKEADWFYTPVYTTCDLTNAGLPLPFKSPRVMRSAIQYISNKWPFWNRTDGAHHFFVVPHDFAACFHYQEEKAIERGILPLLRRATLVQTFGQENHVC

SEQ ID NO: 21333 - DNA, 716 bp, Panicum virgatum
  misc_feature: Ceres CLONE 1815658
  misc_feature: Encodes the peptide sequence at SEQ ID NO. 21334
gtcgcgtcgaggggaagagatggtgctgatcgagctggagccggagccggagcccgagaaggcgacgcgcccctccccgccggttcccgaggagcagggggccgccgaggccgccagggaggcggcgcgcgcctcgtcgccgccggcgcctggcgagcaggcgggggccgcggccggcggggaggccccgagggcggaggaggaggaggaggccttcgaggacgcgctcaccgacgagcagctgcgggagaaagctagaaaccaagcaaatgatgcaaaagcagaaggaaacaagctttttggtgctggacgatatgaggaagcattatctcaatatgaaattgctttgcaaattgctgctgagctggaatcttccgaggatatacgttctgcgtgccattcaaatcgtgctgtatgcttcttgaagttggggaaacatgatgagacgattaaagaatgcacaaaagcacttgagctcaatccatcatacatgaaagccttgctccggagagcagaagcacacgaaaagctggagcactatgatgaagctattgctgatatgaaaaaggttattgaattggatccttcaaatcaacaagccacgaggtcactgctccggcttgagcccctggcagctgagaaaagggaaaagatgaaggaagaaatgattgcgaagttgaaagatctgggggaattcggtgctggggcgcttcggg

SEQ ID NO: 21334 - protein, 232 aa, Panicum virgatum
  misc_feature: Ceres CLONE 1815658
  misc_feature (124)..(157): Pfam Name: TPR_1 Pfam Description: Tetratricopeptide repeat
  misc_feature (158)..(191): Pfam Name: TPR_1 Pfam Description: Tetratricopeptide repeat
  misc_feature: SWISSPROT Homolog: EC 5.2.1.8 Peptidylprolyl isomerase
  misc_feature: Useful for making plants with altered alkaloid content
  misc_feature: Useful for making plants with altered terpenoid content
MVLIELEPEPEPEKATRPSPPVPEEQGAAEAAREAARASSPPAPGEQAGAAAGGEAPRAEEEEEAFEDALTDEQLREKARNQANDAKAEGNKLFGAGRYEEALSQYEIALQIAAELESSEDIRSACHSNRAVCFLKLGKHDETIKECTKALELNPSYMKALLRRAEAHEKLEHYDEAIADMKKVIELDPSNQQATRSLLRLEPLAAEKREKMKEEMIAKLKDLGEFGAGALR

SEQ ID NO: 21335 - DNA, 2201 bp, Panicum virgatum
  misc_feature: Ceres CLONE 1815663
  misc_feature: Encodes the peptide sequence at SEQ ID NO. 21336
aagcggcattggagtcgggagtccttgccattggtacaagagcaagaagcaaggacaaggagggaagaggagggagagagtgaggggcactagaaaggtgcctccttcgcttccagttgcttcttctctctccttgcgcgggggagagggtcatggccggttatggcctggacaaggcggtgcgggccagcgtcagctttgacacgccgtgcggcgcgcttctgcgcgagctcgagcaaatatggacagagattggggagcgtgaacaagataaagatcgtatgttccttgaactcgaaaaagagtgcatgcgtgtgtaccgtcgaaaggtagatagtgccagtgccgagagagctcagctccatcagtcattgatggccaaagaagcagagcttaaagctctagttgcttctataggggaaaacaccacacaattcaaggtggatgaaaagcacacatcattgaaagatcaacttgctgcagtgacgcctctgttagaagagcttaggacaaagaaagaagaaagaatcaaacagatctcaaatgtgcaatctcaaattgagaagataaaagcacaaatttctgatcatggttatcagaactatgatggttgtgtcaaacaacttagtgatgatcatgacttatcgacgagaagaatttctgatcttcaaatgcaattgcggaatctacagaaggaaaagtctgatcgccttcagaaagtcttcatatatgtggatgaagtgcacggcctatgtgcggtgcttgggatggattttgcagagactgtaaaagaggtgcatccaagtttgcacggaaccaactcagaaaattcaacaaatatcagtgatagcactcttgaaggtcttactcagactatcctgaagctcaaagcagaaaagaagacaagagttttcaagttgcaagagattgtggaaaagcttcacaaattatggaatctcatggagtcagctgaacaagagaggagacaatttgccaaagtagcagctgttcttggatcttctgaggaagagataacttctcctggcattctgtcattggacacaattcaggagacagaagaggaagttgaaaggctaactaaacaaaaagctagtagaatgaaggagcttgttctcaagaaaaggttagaactagaagacgtctgcagaaatgcacatatggagcctgatatgaacacagcaccagagaagatcattgcattgattgattctggtttagtagatccttgcgaactcctttccagcattgaagtacaaatagcaaaagcaaatgaagagtccttaacaaggaaagatatcatggacagagtggataaatggctatcggcttgtgatgaagagacttggcttgaggaatataaccaagatgataacaggtatagcgctggcaggggtgcccacttgaatctcaagcgtgcagaaaaggcaaggatacttgtccaaaagattccaagtatgattgacagcttgatagccaaaactttcgcgtgggaggatgaaagaaatgtgccatttttatatgatggagttcgtttggttgccattttggaagagcaaaaactcagaagggcacaaagggaggaagacaagagacgctgtcgggaccagaagaagctgcagagtttattgcttaaagagttgattttcgggtctaaacctagtcccagaaagacaaacagcttcaatagaaggatgagcaaccaccattcaaatggaaatggaactggattcatgaccccagtgccccgccgagtttcagctggcagtgcgaccccggagcttctaaccccacgctcatattctgggcggtataataactacttcaaggagaataggcgtctgacagcagcagcactgaacttctcagcggtttccaaagaggatagcatgtcatccttcgcctccattagcggctcggagcctgattcgccattgtatttgcactaagtgttggttagggaagagacttcttggtgagaaggatggatagcatcaagattggaccagtgtgtggtagctattaacattgctgatgagtgacgacaggttgtgacaaaatttaggtgaatttgattgtagatataatttctaacattcatggttttgctctatttccaaatttaggcaactcgtttggttaggaaacatgtgaaattgtgaatgggataagctgtgcaatgc

SEQ ID NO: 21336 - protein, 604 aa, Panicum virgatum
  misc_feature: Ceres CLONE 1815663
  misc_feature (40)..(601): Pfam Name: MAP65_ASE1 Pfam Description: Microtubule associated protein (MAP65/ASE1 family)
MAGYGLDKAVRASVSFDTPCGALLRELEQIWTEIGEREQDKDRMFLELEKECMRVYRRKVDSASAERAQLHQSLMAKEAELKALVASIGENTTQFKVDEKHTSLKDQLAAVTPLLEELRTKKEERIKQISNVQSQIEKIKAQISDHGYQNYDGCVKQLSDDHDLSTRRISDLQMQLRNLQKEKSDRLQKVFIYVDEVHGLCAVLGMDFAETVKEVHPSLHGTNSENSTNISDSTLEGLTQTILKLKAEKKTRVFKLQEIVEKLHKLWNLMESAEQERRQFAKVAAVLGSSEEEITSPGILSLDTIQETEEEVERLTKQKASRMKELVLKKRLELEDVCRNAHMEPDMNTAPEKIIALIDSGLVDPCELLSSIEVQIAKANEESLTRKDIMDRVDKWLSACDEETWLEEYNQDDNRYSAGRGAHLNLKRAEKARILVQKIPSMIDSLIAKTFAWEDERNVPFLYDGVRLVAILEEQKLRRAQREEDKRRCRDQKKLQSLLLKELIFGSKPSPRKTNSFNRRMSNHHSNGNGTGFMTPVPRRVSAGSATPELLTPRSYSGRYNNYFKENRRLTAAALNFSAVSKEDSMSSFASISGSEPDSPLYLH

SEQ ID NO: 21337 - DNA, 727 bp, Panicum virgatum
  misc_feature: Ceres CLONE 1815665
  misc_feature: Encodes the peptide sequence at SEQ ID NO. 21338
ctcttcactctctcccttgcatcaccaacaagaaggctaacgcacaccaacccaagaacaaggaggggaagagaaggaaagggaaaaaaaaaaaggaattttgatcgcccagagtgtggtagtagaatagcaatttgatctctcctcgttcgaggtcagtgcgcgaggcaataatggtggccgtggaggctgcgacggcggcggcggcggcggcggcggtggagggctcgatccgggcggaggccaaggtggcgccggagccggaggccgaggtggaggtgaagggcgatgccccggccgcgggggaggccgaggaggaggaggagaaggagtacaagagcgacatgaggaagctggaggagctcatgtccaagctcaacccctgcgcgcaggagttcgtgccgtcgtcgcgccgcgccgcggcgccggcggcgaagccggcggggggaggcgtgctctccgccgacgcgccggtgttcgtctccgccgccgagtactacggcgctgccggagggcacctgcaggtggccggcggcggcgctgccggcggcgggagccgggactccagcagcgacggatccagcaacggcagcggccaccctctgaatcgccggagaaggagtagcttcaaccaggggaggcggaggatggggggccgaccccgacgggctgatagggaggatagtgtgcggcgaaccgtctacgtctctgacattgatcagcatgt

SEQ ID NO: 21338 - protein, 184 aa, Panicum virgatum
  misc_feature: Ceres CLONE 1815665
  misc_feature (63)..(80): Pfam Name: PAM2 Pfam Description: Ataxin-2 C-terminal region
MVAVEAATAAAAAAAVEGSIRAEAKVAPEPEAEVEVKGDAPAAGEAEEEEEKEYKSDMRKLEELMSKLNPCAQEFVPSSRRAAAPAAKPAGGGVLSADAPVFVSAAEYYGAAGGHLQVAGGGAAGGGSRDSSSDGSSNGSGHPLNRRRRSSFNQGRRRMGGRPRRADREDSVRRTVYVSDIDQH

SEQ ID NO: 21339 - DNA, 1853 bp, Panicum virgatum
  misc_feature: Ceres CLONE 1815670
  misc_feature: Encodes the peptide sequence at SEQ ID NO. 21340
aaaagggaaatctttcttcaaccagctcgctctaccagcctatccctcctccagcagctagctagcgcggcccgccccattgagtcagggcctcgccggaggcgcggcgatggaaggcaccgtgctgtgcgccgccaaccacgcgccgctcacgcccatcagcttcctggagcgcgccgcgctcgtgtacccggaccgccccgccgtcgtcgccgccggctccgccgccgcgccgccgcgcacctggcgggagacccgggcgcgctgcctccgcctcgccgccgccctcgccgggctcggcgtcgcgcgccacgacgtggtcgctgtgttcgcgcagaacatccctgccgtgtgcgagctccatttcggcatccccatggccggcgccgtgatctgcgcgctcaactcgcgcctcgacgccggcatggcgtccgtcctcctccagcattccgaggccaaggtggtgttcgtcgacgccgcgctgctgggcaccgcccgagaggctctccgccgcatgtccaggccccccaccgtggtgctgatcgaggaggtcctcaacgagccagccgttccggcggctgatctccagtaccacgagtacgaggccctgatcctgagcagcagcagcgcctcacctgcggacatggcgatccggtggccggccgacgagaacgagccgatcgcgctcaactacacgtcgggcacgacgtcgcggcccaagggcgtggtgtacagccaccgcggcgcctacctcaacagcctcgcgtccgtgctcctcaacgacatggcggcgctgcccgtgtacctgtggacggtgcccatgttccactgcaacggctggtgcctcgtctggggcgtggcggcgcagggcggcaccaacgtgtgcctacgcaaggtgaccccggcggccatcttcgacgccgtggcgcgccacggggtgacgcacatgggcggcgcgccgacggtgctgagcatggtcgtcaacgccacggcggaggagcggcgcccgctgcccgggggcaggccggtcaccgtgatgaccggcggcgcgccgccgccgccgcaggtgctgttccagatggaggagctcgggttcctggtgatccactcatacgggctgacggagacgtacggcccggcgacggtgtgcacgtggaagccggagtgggacgcgctgccggcggcggagcgcgcggcgatcaagtctcggcaggggctccaccacctggggctggaggtgggcgtcaaggaccccgccacgatgcggagcgtgccagcggacgggcgcaccatgggggaggtcatgttccggggcaacacggtgatgctcgggtacctcaaggacggcgcggcgacggcggaggccatggccggcgggtggctgcggtcgggggacctggcggtgcggcacgccgacgggtacgtcaagatcctggaccggtccaaggacatcatcatctcaggcggggagaacatcagcaccatcgaggtggaggcggcgctgttcgcgcacccggcggtggccgaggcggccgtggtggggcggcccgacgagtactggggcgagacgccgtgcgccttcgtcaggctcaaggacggctccgggagcgtgggcgccgaggaggtgatggccttctgccgggcgcggctgccgaggtacatggcgccgcggacggtggtgttcgtcgacgagctgcccaagacggccacagggaaggtgcagaagttcacgctccgggacaaggccaaggccatgggcagcatctccagctccaggagcaagctctagcatcaatgcatcatgctgtgattcatgtaaattaaataaaatcagttggttggtggcaggcggt

SEQ ID NO: 21340 - protein, 559 aa, Panicum virgatum
  misc_feature: Ceres CLONE 1815670
  misc_feature (45)..(476): Pfam Name: AMP-binding Pfam Description: AMP-binding enzyme
  misc_feature: SWISSPROT Homolog: EC 6.2.1.26 o-succinylbenzoate--CoA ligase
MEGTVLCAANHAPLTPISFLERAALVYPDRPAVVAAGSAAAPPRTWRETRARCLRLAAALAGLGVARHDVVAVFAQNIPAVCELHFGIPMAGAVICALNSRLDAGMASVLLQHSEAKVVFVDAALLGTAREALRRMSRPPTVVLIEEVLNEPAVPAADLQYHEYEALILSSSSASPADMAIRWPADENEPIALNYTSGTTSRPKGVVYSHRGAYLNSLASVLLNDMAALPVYLWTVPMFHCNGWCLVWGVAAQGGTNVCLRKVTPAAIFDAVARHGVTHMGGAPTVLSMVVNATAEERRPLPGGRPVTVMTGGAPPPPQVLFQMEELGFLVIHSYGLTETYGPATVCTWKPEWDALPAAERAAIKSRQGLHHLGLEVGVKDPATMRSVPADGRTMGEVMFRGNTVMLGYLKDGAATAEAMAGGWLRSGDLAVRHADGYVKILDRSKDIIISGGENISTIEVEAALFAHPAVAEAAVVGRPDEYWGETPCAFVRLKDGSGSVGAEEVMAFCRARLPRYMAPRTVVFVDELPKTATGKVQKFTLRDKAKAMGSISSSRSKL

SEQ ID NO: 21341 - DNA, 1931 bp, Panicum virgatum
  misc_feature: Ceres CLONE 1815671
  misc_feature: Encodes the peptide sequence at SEQ ID NO. 21342
aacccgaccaccccgccgcgtcaagcaacggcgcaacgcagcccatggccttcacctcccaatccctaatcttccgggcacccgtctccctccccagcggccgcctcgccgccccaggtcgcgttgccctccggggccgcggtgccgcgtttccttccgtcgcggccgcctccactccgatggcgaagtcggatggcgacgagaaggagatgaagctttggggcgggcgcttcgaggagggcgtcacggacgccgtggagcgcttcacggagtccatctcctacgactggcagctctacaagtacgacatcatgggcagcaaggctcatgccaccatgctcgcctcccagggtttgataactgctggcgatagggatatcatcttgtagggtctcgatcagattgagacgcttattcaagaaggcaagtttgagtggagaaaggatcgggaggatgtgcatatgaacattgaagcagctctgattgagagggttggtgagccggcgaagaagctgcacactgctaggagccgcaatgaccaaattgtgacggatctaaggctatggtgccgtgatgctatcgataagattttgattcgtatcaagcagtttcaggtgtctttggttacattagcttcaaaatatgttgacttgatagtccctggttatactcatctgcaaagggcacagcctgttttgctgccccatcttctcttatcatatgttgaacagctggagcgtgatgctggtcggctggccaactgcagggagagagtgaatttctgccctcttggtgcttgtgctttggctggaaccggacttcccattgacaggtttcagaccgctaaagatttgaagtttacagctccgatgaagaacagcattgatgcagtatcagaccgtgacttcgtattggagtttcttgctgccaattcaatcgctgctgtgcatctttctcgaattggtgaagaatgggttctttgggcatcagaggagtttgggttcctgacaccaagtgacaaagtttcaacaggaagcagcattatgccacagaagaaaaatccggatccaatggagcttgttcgtgggaagtctgctagggttgttggagatctcatgactgttctaatcctctgtaagggccttccacaggcctacaatcgtgatcttcaggaagacaaggaaccgttgtttgatagcgtgaaggccatattaggaatgcttgaagtttgcactgagtttgctcagaacatttcttttaattctaaaagaatacaacgttccttgccagctggttatctggatgcaacgacattagcggattatcttgtgaagaagggagttccattcagaacttctcatgagatagtcggaaggtctgttcaactgtgcgtcaccaagaactgtcaactagctgaacttcaactggatgacctaaaagccgttcatccagcgttcgaggctgatgtgtacgagtacttgggggttgaaaatgctgtaaacaagttcatatcttatggctccactggttcaaatcaagtaaagaagcagctcgaggattggcgcaaccagctcgggatcagctcataaggattggtatgaaacaagaaataagctcgcaaatcagtgcttgcaagttttgaacgtgtatctgaatgtcatggactttcttctctgcgtatcagtccgtgccttgtgggaactggaatgagtgattcaattctcaattgtgttgagtagccctgagccctaacgcttagtcaccattgcacccagctttgttttcagcgaagtaatctgattctgttccatgactccatgtgaaaaaatggggattaatgtagctcatctctccactcgccagtccagtaatggttgtaatgctcgtcacaagctaagctatcaaagatgctaacaagcgactttttccgc

SEQ ID NO: 21342 - protein, 69 aa, Panicum virgatum
  misc_feature: Ceres CLONE 1815671
  misc_feature: SWISSPROT Homolog: EC 4.3.2.1 Argininosuccinate lyase
  misc_feature: Useful for making plants with modulated salt sensitivity
MAKSDGDEKEMKLWGGRFEEGVTDAVERFTESISYDWQLYKYDIMGSKAHATMLASQGLITAGDRDIIL

SEQ ID NO: 21343 - DNA, 1711 bp, Panicum virgatum
  misc_feature: Ceres CLONE 1815676
  misc_feature: Encodes the peptide sequence at SEQ ID NO. 21344
cctaaaccctagcaaacagacgaaaccaccgcccgccagcctccctcacccgtggattcgccatggcgatgcccgccaccacctccgcctcctccccatgccaggcgccgttgccagccgtcctgggcctccctctcctcagttcccctggcgcccgcgccagaatcctcaccttcggcagccgccgcctccgcctccgtggcgccgccgcggctgcgcccacaggtcatctgtttcttggtcttcccaagccacgatgctcatcaatcacagccattggcgatgtggcagcagtttctgatgattatatagaaagctcaccatcaagcagtggatatccaaatagttctatgggttcttcatctcatgaagataatcaatcgcaaagggttgttaagatgaaccaaaactctagagacaacaacaaaatgattaaaatatgtgataagttaattggtgtatttatggttgataaacctacaccaacggattggagaaaattactggcatttagcagggaatgggacaacataaggccacatttctttaaacgctgccaggaaagagcagatgcagagtcaaaccctgagatgaagcataagcttctaaggcttggtagaaaattgaaagagattgatgaagatgtacagaggcataatgaacttcttgaagtagtaaaatccacaccatctgataaaattggtgctattgttgctaagcggcggaaagatttcacagtggaattttttaaccacctttactatgttgcggagtcttatcatgatgaacctgaaaagcaaactgagttggcaaagcttggaaatgattgtgtagatgctctacaagctcatgatgataccactgggagtcttgaggctctgaatgctgcagaattgaagttaaaagatatacttaattcaccttcagtggatgctgcttgcagaaagattgatgacttggctgagaagaaggaactggactctgcattagtgttgatgctttcaaaagcttggtcagctgcaaagggcactgacatcacaaaatctgaggcaaaggatataatgtttcatttatacatgactgctgtggctaatctccagagacaaatgccaaaggatatcagaatactgaagcatcttataatgatagatgatccagaagagcggttgagtgcactgaatgatgctttcactcctggtcctgaacttctaggggacaatgtcgatacattatacacgagtccagaagctttgcacacttgggcaagagctatagtagatgcatattataacagcagagaaggcactctccttggacaagcaagagacttgatgaaccctaaaatcatcaagaaagttgaagagatagtgaagctaatcaaggacaaatacctttaagttttgatcatcagaaatttgggtttggaggtttctactggttgcccaagtcttgcacagtgatcacaggatatggcacggattgcacccttgtcctgtaaaactaccggtgtcatttcagtgtaactcttcgccactgcggacacctcatagatgaaaggaaattcagattgttgtaactcattacatgaaaaggtgattgtagcatgtgatgtaccaatgtagctttcacttagatattaggggagtatctacgtgtcatatacactaacagtgttgtaacttgcctgattagtagaataaagtcagaagtc

SEQ ID NO: 21344 - protein, 444 aa, Panicum virgatum
  misc_feature: Ceres CLONE 1815676
  misc_feature: Useful for making plants with modulated salt sensitivity
MAMPATTSASSPCQAPLPAVLGLPLLSSPGARARILTFGSRRLRLRGAAAAAPTGHLFLGLPKPRCSSITAIGDVAAVSDDYIESSPSSSGYPNSSMGSSSHEDNQSQRVVKMNQNSRDNNKMIKICDKLIGVFMVDKPTPTDWRKLLAFSREWDNIRPHFFKRCQERADAESNPEMKHKLLRLGRKLKEIDEDVQRHNELLEVVKSTPSDKIGAIVAKRRKDFTVEFFNHLYYVAESYHDEPEKQTELAKLGNDCVDALQAHDDTTGSLEALNAAELKLKDILNSPSVDAACRKIDDLAEKKELDSALVLMLSKAWSAAKGTDITKSEAKDIMFHLYMTAVANLQRQMPKDIRILKHLIMIDDPEERLSALNDAFTPGPELLGDNVDTLYTSPEALHTWARAIVDAYYNSREGTLLGQARDLMNPKIIKKVEEIVKLIKDKYL

SEQ ID NO: 21345 - DNA, 1453 bp, Panicum virgatum
  misc_feature: Ceres CLONE 1815686
  misc_feature: Encodes the peptide sequence at SEQ ID NO. 21346
atctgcttgtgcaggacacgtcgtgacgctcggaactgaatgtagcgagagaaagcagcggtgtcgggccgccccggcggcggcggcatggacagccctaggagcagcgcggccgcggtggccttgctgcccgacgacgccatcctcgagatcctctcccgcgtccccgccagatccctctgccggttcaagtgcgtgtccaaggcctggcgcgacctcatcgccgaccggcaccaccgcgagaagctcccccaaaccctcgagggcttcttctgcgcctacgacggcgaaatacacggcagcaaccgcggcgatggcggcggcgaggggggtcgcgttgtccacgggcgcttcatcaacacgctgggtagatccgtgcccctcccgtctttctccttcccgggggagcagccgggaatcgaggaactcgatctcgtgcattcctgcaacggccaaatcctcttcaggcacagaagggctttggacacctacgattcactgggctttgtcgtgtgcaaccccgccaccgagcaatgggtggccgtgcccaactccggcttggaccttgatttgtttcaccattgtgattgtgctgcctatttaattttcgatcctgctgtgtccgcgcactttcagttggtccagctcgggatttacgaaggggcattcgtggaagaggtgcacacctactcgtctgaaactggggtgtggtctcagaggacaagcgagtggagttcagatgaggccttatctgtctacgcaagtggtgccttcgttaatggcatgctacatttcaatgtcacccactttgatgatatagaccaagagctaatagttgcagttgatggggaagggaacaagcgtaggatcatcagcgggctggacaattctagtgatgttgtttttgttggtcaatcccaaggacagctgcattacatgagtcaacatagagatgaccctcgcttgatgactcaactgtccatttgggttcttcaggactacaatacagaagactgggttctgaagcacagtgtgccctttttgcagctgtttggaagagcgtattgccatgttgaaaatgactacaatttggttgccattcaccccgaccgcaatatgatcttctttgttcagcactgggacctgaaactgaaatcatatgacatggatagcaaggaagtgcacactctctgcactctagaggttagccatcagaatattttaccatatgttccctgtttcacggagtcatcggtgcttgctagtaagcactgaaattgtgtcctgtgaggtactagtcaaatttgatgttccaagtaatgtgttccagcacaggagcatcgagcaacatatatatatatatatatatatatatatatatatatatatatatatatatatatatatatatatatatatatatatatatatatatatatatatatgtatatgg

SEQ ID NO: 21346 - protein, 395 aa, Panicum virgatum
  misc_feature: Ceres CLONE 1815686
  misc_feature (9)..(56): Pfam Name: F-box Pfam Description: F-box domain
MDSPRSSAAAVALLPDDAILEILSRVPARSLCRFKCVSKAWRDLIADRHHREKLPQTLEGFFCAYDGEIHGSNRGDGGGEGGRVVHGRFINTLGRSVPLPSFSFPGEQPGIEELDLVHSCNGQILFRHRRALDTYDSLGFVVCNPATEQWVAVPNSGLDLDLFHHCDCAAYLIFDPAVSAHFQLVQLGIYEGAFVEEVHTYSSETGVWSQRTSEWSSDEALSVYASGAFVNGMLHFNVTHFDDIDQELIVAVDGEGNKRRIISGLDNSSDVVFVGQSQGQLHYMSQHRDDPRLMTQLSIWVLQDYNTEDWVLKHSVPFLQLFGRAYCHVENDYNLVAIHPDRNMIFFVQHWDLKLKSYDMDSKEVHTLCTLEVSHQNILPYVPCFTESSVLASKH

SEQ ID NO: 21347 - DNA, 448 bp, Panicum virgatum
  misc_feature: Ceres CLONE 1815686-R
cacacaaaaaaacacacacacacacacacacacacacacacacacacacacacacacacaaaaacaacacacacacacacccccctctctctctctctctctctctctctctctatatatatacacacacacacacacacacacacactccatatatatatatatatatatatatatatatatatatatatatatatatatatatatatatatatatatatatatatatatatatatatatatatatatatgtagaattaggtaatgtgttctgatggtgcttcgatgtattactgctcatgcattttgtgtgctagatactgcaaacaaatactcgaggcacacgtgtaagtttccattacatttgtatgcaattgcctaagttgcagaatgtatggtgtttgaacttaaagttcctaagctatgtttttcctgtttccagaatcat

SEQ ID NO: 21348 - DNA, 1416 bp, Panicum virgatum
  misc_feature: Ceres CLONE 1815692
  misc_feature: Encodes the peptide sequence at SEQ ID NO. 21349
acccccacaaattccacttttttatttgtataagcgccgcgaacgggagctcggcgctccgaggtttctttccccaccgaaaggagaggacaggaacagcagaaagagggggagggaggcggaggggaagcaaggaaggatccggaatctcgccggcggggccgggtgatgccggtgggggaggtggcggcgcggccaggaggagaagtgggcgggatggtgctgggaggcggcgcggccgcggccgcggcggttggaggggatgacgccgtcgtcatgcagctggccgcagccgagggggaggagaccgccatcaccgtcaactgccccgaccaggccggcctcggctgcgacctctgccgcaccatcctcgagttcggcctccgcatcacccgcggcgatgtatccaccgacggacactggtgttttgtggtgttctgggtcgtgccccgctcctcatccatcaaaatccggtgggcgagcctcaagaaccgcctcatgtccatgtgcccttcctcatactcagtccctttctaccctgaaatcagccagccagggccccccaagttctacctcctcaagctcatgctacctgaccgcaaaggactgttacatgacgtgacacatatactatcggagctggagcttttaatccacagagtgaaggtgtccaccacgcctgatggaagagttgtggatctcttctttatcactgacggcatggagctgttacatacgaaagaaaggcaagaagagacttgctcaacgcttattgctaccttgggtacttccataagctgtgaggttctgtcagcagaagggttccagcaaggattctcttctcttcctccgaaaactgctgaggaactgttcagggtggaactagctgacagtgagatctgctcaagttcacttagtgcagagttgaaaagggttcagacggccaccattaactttgacaattccctgagcccctcacacacactggtccagattatttgcgctgatcagaaggggctcatttatgacatcttgagaaatatgaaggactgcaacattcagatattttacgggcggttcagatcagacaagaaagggtcagttaataaaggttgtcgagaggttgatctttttgtcaaacaagtagatggcaagaaagttatagatcctgagaaacaggaggctctgtggtcacgcctgaggtctgagatgctccatcctcttagagtgatgatcgtcagtcgtggacctgacacagaactccttgttgcaaacccggttgagctatccgggaagggacgaccacgcgtattctatgatactactcttgctcttaaagcgcttggaatctgcattttctctgctgaaattgggagacaggcagcatctgagcgtcaatgggagtctacagattcc

SEQ ID NO: 21349 - protein, 415 aa, Panicum virgatum
  misc_feature: Ceres CLONE 1815692
  misc_feature (135)..(199): Pfam Name: ACT Pfam Description: ACT domain
MPVGEVAARPGGEVGGMVLGGGAAAAAAVGGDDAVVMQLAAAEGEETAITVNCPDQAGLGCDLCRTILEFGLRITRGDVSTDGHWCFVVFWVVPRSSSIKIRWASLKNRLMSMCPSSYSVPFYPEISQPGPPKFYLLKLMLPDRKGLLHDVTHILSELELLIHRVKVSTTPDGRVVDLFFITDGMELLHTKERQEETCSTLIATLGTSISCEVLSAEGFQQGFSSLPPKTAEELFRVELADSEICSSSLSAELKRVQTATINFDNSLSPSHTLVQIICADQKGLIYDILRNMKDCNIQIFYGRFRSDKKGSVNKGCREVDLFVKQVDGKKVIDPEKQEALWSRLRSEMLHPLRVMIVSRGPDTELLVANPVELSGKGRPRVFYDTTLALKALGICIFSAEIGRQAASERQWESTD

SEQ ID NO: 21350 - DNA, 579 bp, Panicum virgatum
  misc_feature: Ceres CLONE 1815692-R
gcagtatatttttaaagaagcaatgcaagacttttggcaagtgatgctcactggagttgatcaatgtagacgctatggttgctggcaatggagaaactggagatggtgttaatctcccatacacatgttgcaaaagaaagatgtgagaagatcgaaaaaggagcatgtttggtgggaggtacaaatcgctggagcaatgattgagcttttgtttgattcaggggattactggatgctgacacagatacatgcacgagccggtttgttgtaaattattttagtggagatgctgtcctcctacatctgcttcacctccttgtcttgttttcctgcctccttcctaccttcttgtatgattgctgctagtactttcagaatagagtgtaatgtaaagcatgtctcctcatgtaagcgcaatttgtacttgtttgtaaggatgcataaatgtaaatgacatggtgcacaagtgcaattggttatccggaaaggcatatatgtatttaagtcggaaagtaggcagatgatggatgctgttgtacctgactaattctatgaggtattctgaaagccacttgtttc

SEQ ID NO: 21351 - DNA, 2369 bp, Panicum virgatum
  misc_feature: Ceres CLONE 1815694
  misc_feature: Encodes the peptide sequence at SEQ ID NO. 21352
gtggcccatctgcgcgcctagctctcctccatcctccacttctttaccaaaaatatggcggccgttctccgcgccgccgtccgccggtgccgtccggctgctgcggccctgctgcatcaccctcgtatcccttccgctcggagcctcccgtcgtctccgcctctcggtcgagcgcttcctccgctcccgctgcttccgttctccgccggactcggctactccactgcctccgaggagttggtgccccccgtgacgcccaagggtaaggccaaggccaaggccaggaagaacccaatgaagcagtcgcacttcgacttcaccaaggtggacgccgcgcttctgcccaccgtcatcctcgtcggccgccccaacgttggcaagtcagccctcttcaacagatttatacggaggagggaggccttggtgtacaatactcctggggatcatgtcactcgtgatatccgtgaaggaattgcgaagctaggagatctccgtttccgcgtgcttgactcagctgggctcgagacagcagcaacttctggaagcattctcgctcggacagcggacatgacagggaatgtgttagctaggtcccaatttgccattttcttgattgatgtgagggatggcctacagccgctggatcttgaggttgggcaatggctgcgtaagcatgcatctgggatacatacccttgttgcaatgaacaagtccgagtcacttgatgagcatggagttctgactgctgctgctggagaagcacacaagttggggtttggagatcctgttgcaatatctgcagagactaggctggggatggcagaactttatgaggtactcaggccattgtttgaggagtacatgtctcagcttccaaacaatggactcgacccagctgatcctaccactgagcttgaaactgaggcccatgaaggcgatgagagcaagttgcctttgcaattggcaattgtgggacgtcctaatgttgggaaatctactcttttgaataccttgctgcaagaacaaagagttctggttggtccagaggcaggtttaacaagggactctattcgggctcagtttcagtttgataaccgaactgtgtatttagtggacactgcaggttggatggaaagatcagggaaggagaaagggccagcttctttgagtgttgtgcagtcaagaaaaaaccttatgagagctcacattgttgctcttgtcctggatgctgaaaagattgcgaagtccaaaaatagtatgaatcatccagaagttgtgatagcacgacaggcaatagaagagggccgtggacttgttgtggttgtcaataaaatggatctccttagagataaccaacggctatttgagaaggtgatggatgctgttcctagagaaattcagactgtcattcctcaggttacaggaataccagttgtttttgtgtcagcattggaggggagagggcggattgctgtcatgcgccaggttatagatacttatgaaaactggtgtttaagattgtcaacctctcgactcaaccgttggttgcgtaaggttatgagccgacactcgtggaaagattcagccgcacagccaaaagtcaagtacttcactcaagtgaaagcgcggccaccaacatttgttgcctttgtgagtgggaagactcagctatccgatacagatatcaggttcttgacaaagtctctcaaggaagatttcaacattggcggaataccaatccggattgtgcaacgctctattccaagaaaagcgtctgcaaagagcaataccaggaatgtcgggcctagggttgccaggatgagaacagacaagagaataacggtatctgatccgtctctgtcgtagagtgggtatcacaccagtatcagcctcacctgcagaaggggtgtttttctttcgtgtttgaactgtatgcttctggggagttaacgttactgaggaaacagaaacggccagccgaacttcaattctgagttcggagagaggaaagaagtatgtcggtggtccaggaagtgatggaaacacgttgactgcaagcttgaaagaaacaattactgcaataaacaaggccagcaatctgatcgaggaggaaaaacctaccttctgacttttttctgagcgaaggggtaaagcctcagatgaagtgtttccaaggaaggcagcactattcaatactcggtgcaaggcagtactgttgggcaagttcctccggacctgacaaaatgacgtttttttttgtatgtcgtgcaccctcctcttttgtacagaaaaatagttgagaatgatttcagatgataactcctctaattttccgttttcaggggattgctgtaattctgcttggtccc

SEQ ID NO: 21352 - protein, 523 aa, Panicum virgatum
  misc_feature: Ceres CLONE 1815694
  misc_feature (17)..(141): Pfam Name: MMR_HSR1 Pfam Description: GTPase of unknown function
  misc_feature (221)..(348): Pfam Name: MMR_HSR1 Pfam Description: GTPase of unknown function
MKQSHFDFTKVDAALLPTVILVGRPNVGKSALFNRFIRRREALVYNTPGDHVTRDIREGIAKLGDLRFRVLDSAGLETAATSGSILARTADMTGNVLARSQFAIFLIDVRDGLQPLDLEVGQWLRKHASGIHTLVAMNKSESLDEHGVLTAAAGEAHKLGFGDPVAISAETRLGMAELYEVLRPLFEEYMSQLPNNGLDPADPTTELETEAHEGDESKLPLQLAIVGRPNVGKSTLLNTLLQEQRVLVGPEAGLTRDSIRAQFQFDNRTVYLVDTAGWMERSGKEKGPASLSVVQSRKNLMRAHIVALVLDAEKIAKSKNSMNHPEVVIARQAIEEGRGLVVVVNKMDLLRDNQRLFEKVMDAVPREIQTVIPQVTGIPVVFVSALEGRGRIAVMRQVIDTYENWCLRLSTSRLNRWLRKVMSRHSWKDSAAQPKVKYFTQVKARPPTFVAFVSGKTQLSDTDIRFLTKSLKEDFNIGGIPIRIVQRSIPRKASAKSNTRNVGPRVARMRTDKRITVSDPSLS

SEQ ID NO: 21353 - DNA, 692 bp, Panicum virgatum
  misc_feature: Ceres CLONE 1815700
  misc_feature: Encodes the peptide sequence at SEQ ID NO. 21354
agaaatacagcacgctcccgtcggagggtttcagcatcggacccatggctctcgttcctccgctcctcgtcgtggcggcgctgctgccgctggctctgccgctcgggggcgccgccggggacctgcacccggtcgtgctcgtgccgggctacgcctccaaccggctcgaggcgacgctgacggcggcgtacgagcccccggcgcccgcgtgcgcgggccgacaggggttgtggttcccgctgtggcccaaccacacggcgacgcgcgacgccagccaggtcccctgcttcgcggaccagatgagcctcgtctacgacgccggcgccgacgactaccgcaacgccgacggcgtggtcacccgcgtcccgtccttcggctccgcgcgcgccctcatcgggtgggaccagctggtgcggcagctggagggcatgggctaccgcgacggcgagaccctcctcgccgcgccctacgacttccgctacgccgtcgcgccgcggggccacccgtcggcggtgggcggccgctacttccgcgacctcgggcgcctcatccgggcgagcggcctccgccggggccgcccggccgtcctcgtcgcgcacagcttcggctgcgcgctcacgtaccagttcctcctctcccgcccgctcccctggcgccaccgccacgtcaagcacgtcgtcttcctgggctcc

SEQ ID NO: 21354 - protein, 215 aa, Panicum virgatum
  misc_feature: Ceres CLONE 1815700
  misc_feature: SWISSPROT Homolog: EC 2.3.1.43 Phosphatidylcholine--sterol O-acyltransferase
MALVPPLLVVAALLPLALPLGGAAGDLHPVVLVPGYASNRLEATLTAAYEPPAPACAGRQGLWFPLWPNHTATRDASQVPCFADQMSLVYDAGADDYRNADGVVTRVPSFGSARALIGWDQLVRQLEGMGYRDGETLLAAPYDFRYAVAPRGHPSAVGGRYFRDLGRLIRASGLRRGRPAVLVAHSFGCALTYQFLLSRPLPWRHRHVKHVVFLG

SEQ ID NO: 21355 - DNA, 115 bp, Panicum virgatum
  misc_feature: Ceres CLONE 1815700-R
gagccagaagaagcatgaaagggggcttgaatccagatacgcatgagtcgacgaccccggcgggcaggcggatccccgtgagatgtccgccgccctcaaagcaaagggggccgac

SEQ ID NO: 21356 - DNA, 677 bp, Panicum virgatum
  misc_feature: Ceres CLONE 1815713
  misc_feature: Encodes the peptide sequence at SEQ ID NO. 21357
caaccgcctccgcaaccccatcccggccaacctcggcaactcgccggcctccgtcgtcgtgctcgcgcacaacaggctcgggggatgcatcccgcccagcatcggcaagatggccgagacgctgaacgagatcgtcctcatcgccgacgagctcaccgggtgcgtcccgccccaggtcgggctgctcaggaaggtcaccgtgttcgacgtcagcgacaaccacctccagggccagctcccggccgccattggcgggatggccgccgtcgaggagctcgacgtcgccaggaaccgcttcgagggcgccgtgccggccggcgtctgcggcctcgccagcctcaagaacttcacctacaccgacaacttcatcacctcgcgcccgccctgcaccaaggccgccgccgacggcgcgtggaactgcatccccggcgcgccggcccagcgcccgccgtcccagtgcgcggccgccgcggcgcacccgttcgactgcagcaaggaccagtgccaggccccgtcctacaccccaacgccgggtggtggtgggtacaccccgacgcccggtgctggtggccgtggcggccatggtcggcgcggaggcggcaagcagccgcccgcgccggtgggatcgcctccgagacgccccaaggttggaaacccgccgccatccagctctccta

SEQ ID NO: 21357 - protein, 225 aa, Panicum virgatum
  misc_feature: Ceres CLONE 1815713
  misc_feature: SWISSPROT Homolog: EC 2.7.11.1 Non-specific serine/threonine protein kinase
NRLRNPIPANLGNSPASVVVLAHNRLGGCIPPSIGKMAETLNEIVLIADELTGCVPPQVGLLRKVTVFDVSDNHLQGQLPAAIGGMAAVEELDVARNRFEGAVPAGVCGLASLKNFTYTDNFITSRPPCTKAAADGAWNCIPGAPAQRPPSQCAAAAAHPFDCSKDQCQAPSYTPTPGGGGYTPTPGAGGRGGHGRRGGGKQPPAPVGSPPRRPKVGNPPPSSSP

SEQ ID NO: 21358 - DNA, 701 bp, Panicum virgatum
  misc_feature: Ceres CLONE 1815723
  misc_feature: Encodes the peptide sequence at SEQ ID NO. 21359
atgggataaaaaatattttatcgttctgctttgctgcttgtgttgggagagcgagtggaagctggaaggcatggcgatggggctggaggccggggactacggcgccttcatggagaaattcgagctgctccctccgcaatctcagcagcagctcccgctgcacggcctcaccttcgccatcaaggacatcttcgacatcagcggccgcgtcaccgggttcggcaacccggactgggcgaggacgcacgcccccgccgccgccacctcccccgtcgtcctggccacgctggccgccggcgccaccagcgtcggcaagaccgtcatggatgagatggcctacagcataaatggggagaacgcgcactacggcacgccgacgaatccgtgcgctcccgatagagtccccggaggatcctccagtggatcagctgttgcagttggcgcgaaactcgtggacttcgctctgggaactgacaccggcggcagtgtgagggtacctgctgcctattgtggcatatttggactcaggccttcccatggattggtttcgactgaaaatgtcattccgatgtcgcagatgttcgatactgttgggtggtttgctagagacctctctacattttctcgtgtaagcaacgtgttgttgccgctgcctgctgacaacattatcaagcaaccaactcaattttcgattcctaagg

SEQ ID NO: 21359 - protein, 210 aa, Panicum virgatum
  misc_feature: Ceres CLONE 1815723
  misc_feature (1)..(208): Pfam Name: Amidase Pfam Description: Amidase
  misc_feature: SWISSPROT Homolog: EC 3.5.1.4 Amidase
MAMGLEAGDYGAFMEKFELLPPQSQQQLPLHGLTFAIKDIFDISGRVTGFGNPDWARTHAPAAATSPVVLATLAAGATSVGKTVMDEMAYSINGENAHYGTPTNPCAPDRVPGGSSSGSAVAVGAKLVDFALGTDTGGSVRVPAAYCGIFGLRPSHGLVSTENVIPMSQMFDTVGWFARDLSTFSRVSNVLLPLPADNIIKQPTQFSIPK

SEQ ID NO: 21360 - DNA, 696 bp, Panicum virgatum
  misc_feature: Ceres CLONE 1815734
  misc_feature: Encodes the peptide sequence at SEQ ID NO. 21361
actagccatcaggattcagggcgtcgcttccactcgtcgtaacggcacgacacgagcaaaggaggcagcaaagcgtaggcggcctttgcgcaagtgcgctctcttttcttagctcggcctagaggtgggatgccgacgaggcggcgcggggggttcaggctcggccggaagctgctcagcgtctggcgctgggcgctctgccaccgccggcgcggccgcggccgtgggtacctccgcctgcggccgtgccagggaggcggtggcagcgacggcggcaggtcgcccctgctggcggccgccacggtgtgcgccgccaggaagcaccagcagcagttggtggcgggggcgcgcgacgacgggtacgcctcctcgccgcggatgctgacgtgggggcggtcgctggcgcggcggatgaggctcctgcggcggggtggcggcgggagggaggaccggctgctggaggacgcggcggcggaggccaccacgcccaaggggcaggtggcggtgtacgtgggcggcgccaaacccgggggcgagtcgatgcggtacgtggtccccgtggtgtacttcaaccacccgctgttcggggagctgctgcgcgaggccgaggaggagttcggcttcgagcaccccggcgggatcaccatcccgtgcgcggcctcgcggttcgagcgcgccgccgccgtggccgccgcg

SEQ ID NO: 21361 - protein, 188 aa, Panicum virgatum
  misc_feature: Ceres CLONE 1815734
  misc_feature (71)..(188): Pfam Name: Auxin_inducible Pfam Description: Auxin responsive protein
MPTRRRGGFRLGRKLLSVWRWALCHRRRGRGRGYLRLRPCQGGGGSDGGRSPLLAAATVCAARKHQQQLVAGARDDGYASSPRMLTWGRSLARRMRLLRRGGGGREDRLLEDAAAEATTPKGQVAVYVGGAKPGGESMRYVVPVVYFNHPLFGELLREAEEEFGFEHPGGITIPCAASRFERAAAVAA

SEQ ID NO: 21362 - DNA, 711 bp, Panicum virgatum
  misc_feature: Ceres CLONE 1815736
  misc_feature: Encodes the peptide sequence at SEQ ID NO. 21363
accaccgcagcagcacaggcacagcagcagtgccaccgccgccgccaccagcagccatggcctcctccgcgtccctgcagcgcttcctcccgccgtccgcgcacgcggcgtcgtcgacctcgtcccgccggcgccccggcctcgccagggcggccgtctccgtgccgtcgcccgcgccggcggcgggcgaggtccccgcggagcggctggagccgagggtcgaggagcgggcgggagggtactgggtgctcaaggagaagtaccgcacggggctgaacccgcaggagaaggtgaagctggagaaggagcccatggggctgttcatggaggacggcatcaaggacctctccaagatccccatggaggagatcgacgccgccaagctcaccaaggacgacgtcgacgtccgcctcaagtggctcggcctcttccaccgccgcaagcaccagtacgggcggttcatgatgcggctgaagctgcccaacggcgtgacgacgagcgagcagacgcggtacctggcgagcgtgatcgaggcgtacggcgcggacgggtgcgcggacgtgacgacccggcagaactggcagatccgcggggtgacgctcccggacgtgcccgccatcctggaggggctccgcgccgtcggcctcaccagcctgcagagcggcatggacaacgtgcgcaaccccgtcggcaacccgctcgccggcgtcg

SEQ ID NO: 21363 - protein, 218 aa, Panicum virgatum
  misc_feature: Ceres CLONE 1815736
  misc_feature (125)..(195): Pfam Name: NIR_SIR_ferr Pfam Description: Nitrite/Sulfite reductase ferredoxin-like half domain
  misc_feature: SWISSPROT Homolog: EC 1.7.7.1 Ferredoxin--nitrite reductase
MASSASLQRFLPPSAHAASSTSSRRRPGLARAAVSVPSPAPAAGEVPAERLEPRVEERAGGYWVLKEKYRTGLNPQEKVKLEKEPMGLFMEDGIKDLSKIPMEEIDAAKLTKDDVDVRLKWLGLFHRRKHQYGRFMMRLKLPNGVTTSEQTRYLASVIEAYGADGCADVTTRQNWQIRGVTLPDVPAILEGLRAVGLTSLQSGMDNVRNPVGNPLAGV

SEQ ID NO: 21364 - DNA, 1636 bp, Panicum virgatum
  misc_feature: Ceres CLONE 1815743
  misc_feature: Encodes the peptide sequence at SEQ ID NO. 21365
ggggggaagagtcggagagagagcacaggggaattattttaagggcaaggcgccgctcttgtccctctccttcgccacctccctctctttcctccctcttggaggagaggagagaagagggggccccaagaaccaccaccaacaccgccgccgttgcggctgcggtctcgtcatcgccgccgcgcgcttcgttcgtttcgcgccgcggggacggggactcgagggccgggggcagcaatggaggctgccagtgccggcggcagcggcggcgggggcggggacgaccacctgcacgggctcaagttcggcaagaagatctacttcgaggacgccggcgccagcggcagcggcagcggcagcagcggtggcagtgccagcggcgcgagcgagcctctgccgccgccgtccgcctcgccgcccagggcggccgccggcaggagggggaggggcgcggccggcggggcggccggctcgtcggcgcccccacggtgccaggtggaggggtgcaacgtggatcttaccggcgccaagacctaccactgccgccacaaggtgtgtgccatgcactccaaggctccccttgtcgtcgtcaacggcatcgagcagcgcttctgccagcagtgcagcaggttccaccagttgcatgaatttgaccaacaaaaacgcagttgccgcagacgccttatgggccacaatgaacgccggaggaggccgcctgctggacctcttgcatcacgctatggtcgtcttgctgcatccttgggagagcctggcaggttcagaagctttctgttggatttctcatacccaagggttccaagcagcatgagggatgggtggcaggcggctcagcctggggaaagggtgcctggtagtatgcagtggcaatcaagcttagatcctcatcatcacagtgcaatagcaggatatggtgcccactcatatggcagccagggtagcccctcatcagggccaccggtgttccctgggccggagctcccacctggtggatgtcttgcaggagtccccgctgactctagctgtgctctctctcttctgtcaactcagccatgggatactacccaaagcgctggccacagccgtgctgcgtcaatgcccgcaacagcgggctttgatggcaaccctgtgtcaccctccgtcatggcgagtagctacattatgccgagcccctggatgggctctcagggccacgcaggtgggcgcaacgtgacacctcagttgccacctgaagtcccccttgatgaggtgcattctggctctagcagccatcatggccagttctcaggtgagctcgagcttgccctgcagggaagcaggccagcgccagcgccgcgcatcgatcggggctccacaagcacattcgaccaggccagcaacacatcggactggtcgctctaggaggccaaataaaccaccaccgatcatagtcgctcagagagatggaactggtgaaagcctgatgctgcatgcggtttgctagcttcaagcttccaatatgatgtgtaagaaactcctgtaacgtcaggcaactaatatcttttgtggttgtccatgaactcatctgttgcggcatgtagacctccataatttgaagttatcagtatgcttgttgcgg

SEQ ID NO: 21365 - protein, 393 aa, Panicum virgatum
  misc_feature: Ceres CLONE 1815743
  misc_feature (84)..(162): Pfam Name: SBP Pfam Description: SBP domain
  misc_feature: Useful for making plants with altered terpenoid content
  misc_feature: Useful for making plants with modulated flowering time
  misc_feature: Useful for making plants with altered lignin content
  misc_feature: The sequence is a functional homolog of SEQ ID NO 1120 in the 10/225,066 US patent application
  misc_feature: The sequence is a functional homolog of SEQ ID NO 1912 in the 10/412,699 US patent application
  misc_feature: The sequence is a functional homolog of SEQ ID NO 432 in the 10/374,780 US patent application
  misc_feature: The sequence is a functional homolog of SEQ ID NO 958 in the 10/412,699 US patent application
MEAASAGGSGGGGGDDHLHGLKFGKKIYFEDAGASGSGSGSSGGSASGASEPLPPPSASPPRAAAGRRGRGAAGGAAGSSAPPRCQVEGCNVDLTGAKTYHCRHKVCAMHSKAPLVVVNGIEQRFCQQCSRFHQLHEFDQQKRSCRRRLMGHNERRRRPPAGPLASRYGRLAASLGEPGRFRSFLLDFSYPRVPSSMRDGWQAAQPGERVPGSMQWQSSLDPHHHSAIAGYGAHSYGSQGSPSSGPPVFPGPELPPGGCLAGVPADSSCALSLLSTQPWDTTQSAGHSRAASMPATAGFDGNPVSPSVMASSYIMPSPWMGSQGHAGGRNVTPQLPPEVPLDEVHSGSSSHHGQFSGELELALQGSRPAPAPRIDRGSTSTFDQASNTSDWSL

SEQ ID NO: 21366 - DNA, 527 bp, Panicum virgatum
  misc_feature: Ceres CLONE 1815760
  misc_feature: Encodes the peptide sequence at SEQ ID NO. 21367
gaacgctcgcccctcccggctcccctcttcccaggtgccgccgtccggcgtagctccccgccgtcgggttgcgggacctgcagcgatgagcccctaggaggcggcacagccgtcgcaccccgtgctcatcccgcctccggtgcagggccacttcacgccgatgctcgccctcgccaaggtgttgcacgcctgggggttccacatcactctcatctactcccagtaccaccaccgtcgtctgctccggtcccgcggccctgcgtcgctcgacggcgcccccggcttccgcttcgagggcgtgccggacggcctgccgccgtccgacaacgacgacgtcacgcaggacatcgccgcgctctgcctctcccccacgaaggctcgcgccgcgccgttcagggacctgctggcgaggctcacctccacgccggggggcccgcttgtcacctgcgttgtagccgacggcgtgatgagcttcgctcagacggtcgccgaggagatggccattctggccttggtattctggaccc

SEQ ID NO: 21367 - protein, 122 aa, Panicum virgatum
  misc_feature: Ceres CLONE 1815760
  misc_feature: Useful for making plants with altered carbohydrate content
MLALAKVLHAWGFHITLIYSQYHHRRLLRSRGPASLDGAPGFRFEGVPDGLPPSDNDDVTQDIAALCLSPTKARAAPFRDLLARLTSTPGGPLVTCVVADGVMSFAQTVAEEMAILALVFWT

SEQ ID NO: 21368 - DNA, 636 bp, Panicum virgatum
  misc_feature: Ceres CLONE 1815763
  misc_feature: Encodes the peptide sequence at SEQ ID NO. 21369
atagcatgcatcacacaaagacacaccctttcgcgcccctcccagcatggcttgctgcaagctctaccattccgtggtgctcgccgtcgccgttgtcatcctccccgtcggaccggccgcgcggcccgtttcagccgcgtcggcgcaccttcacttgtacatgcacgacgtgctgacgggcccggcgccgacggcggtgcaggtgctgaacggcccccggggccacttcggcgacacggtggtgatcgacgacgtgctcacggaggacgcgtcgcgggcgtcggccgcggtcgggcgcgcgcaggggcactacatctgggcgtcgactttttttccggagctgctggtgaccatgaacgtggtgctcgatcacgggccctacgccggcagctccgtcaccgtggtggggcgggacgacatcggcgcgccggtgcgggagctgtcggtggtcggcggcaccgggcagttcaggatggcgagagggtacgtgctgtggaagaccgtcagcctcgaccaccccaacgccgtgctcgagctcgatgtcttcgtcagcgcctgagcaagcctgaactgcgcacacgtggtgggaagttccgcacatcgccgtgtacggtgtaccgccaaataagcttctag

SEQ ID NO: 21369 - protein, 170 aa, Panicum virgatum
  misc_feature: Ceres CLONE 1815763
  misc_feature (14)..(170): Pfam Name: Dirigent Pfam Description: Dirigent-like protein
MACCKLYHSVVLAVAVVILPVGPAARPVSAASAHLHLYMHDVLTGPAPTAVQVLNGPRGHFGDTVVIDDVLTEDASRASAAVGRAQGHYIWASTFFPELLVTMNVVLDHGPYAGSSVTVVGRDDIGAPVRELSVVGGTGQFRMARGYVLWKTVSLDHPNAVLELDVFVSA

SEQ ID NO: 21370 - DNA, 1767 bp, Panicum virgatum
  misc_feature: Ceres CLONE 1815774
  misc_feature: Encodes the peptide sequence at SEQ ID NO. 21371
gcttaggagcggaacggactggagcaagccggcggcgatggcgacgatggcagcggatggattgccggtcgagccgcagtcgttgaagaagctgagcctcaagtcgctgaagcgctcgctggacctcttcgcccccgcccaaaccctcctcttcgcgcccgacgccgagagcaagaggatccgcaccgggtgcaaggtgagggccgagtacggggcggtgaaggatctgtctgctgagcaggggcgcgggcagggcaaggggacttcggcgccgtctacagcgttggcgttgccaggcacacaagatacaaaagatgctcacagagaaggcactagtaatgccattgtccctgcacctcttatgctaccaaaagcacctgaatctacaattcctggcaaaaatacaactttgtcaatttctggatcatctgacagattttctacatcggcactgatggaaaggataccaagtagatggccacggcctgtgtggcatgctccttggaagaactatcgggtcatcagtggccacttgggttgggtacgttctatagcgtttgatccgggcaatgagtggttctgtacaggttcagctgataggacaataaagatatgggatcttgcatcaggaacactgaagcttactttgactggtcatattgaacaagttcgtggacttgctgtcagccaacggcatacttatttattttctgctggtgatgacaaacaagtaaaatgttgggaccttgaacagaacaaggttattaggtcttaccatgggcatctgagcggtgtttactgccttgctctccatccaactattgatatattactgactggcggtcgagattcagtttgcagggtgtgggacatccggacgaaagcgcatgtttctgctttgacaggtcatgataacaccgtttgttcagtgtttgcgcggcctacggatcctcaagttgtaactggctcacatgatacaactatcaaactctgggatcttgttgctgggaggactatgtgcactcttacacaccataagaagtctgttcgggctatggcaatgcatccaaaggagaaatcatttgcatcagcatcagcggacaacataaagaagtttagcctgcccaaaggggaattcctccacaacatgctgtctcagcagaaaactatcataaattctatggctgtaaatgaggatggtgtcatggcaactggaggggacaatggaagcctgtggttttgggactggaagagtggccataactttcaacaagaacagactatagtccaaccgggatcattggagagtgaggcatgcatatacgccctttcttacgatgtcagtggatctaggcttgtgacttgtgaggcagataaaactataaaaatgtggaaagaggatctaactgcaacaccagaaacccatcccatcaacttcaaaccaccaaaggacatccggcgatattgattttccaggctgcaagtgacaggattgttgtttttttggaacaaaacgttacaggattgttgtagatgccctgattctgcccaaccggttagtttgctggacccagttcaaatttgggtacactttcccctatgcacgttgctggggatgtatggatgatgaaccaaacatctccgtagctgtacaagtagatatgctgctgctgtaattgtcatgctgaatttgtatcacttgacatggctacctcaattctgtggattaaacctaattgcttcgcggaattacatctggaatttgtt

SEQ ID NO: 21371 - protein, 476 aa, Panicum virgatum
  misc_feature: Ceres CLONE 1815774
  misc_feature (156)..(194): Pfam Name: WD40 Pfam Description: WD domain, G-beta repeat
  misc_feature (240)..(278): Pfam Name: WD40 Pfam Description: WD domain, G-beta repeat
  misc_feature (198)..(236): Pfam Name: WD40 Pfam Description: WD domain, G-beta repeat
  misc_feature (282)..(320): Pfam Name: WD40 Pfam Description: WD domain, G-beta repeat
  misc_feature: SWISSPROT Homolog: EC 2.7.11.7 [Myosin heavy-chain] kinase
MATMAADGLPVEPQSLKKLSLKSLKRSLDLFAPAQTLLFAPDAESKRIRTGCKVRAEYGAVKDLSAEQGRGQGKGTSAPSTALALPGTQDTKDAHREGTSNAIVPAPLMLPKAPESTIPGKNTTLSISGSSDRFSTSALMERIPSRWPRPVWHAPWKNYRVISGHLGWVRSIAFDPGNEWFCTGSADRTIKIWDLASGTLKLTLTGHIEQVRGLAVSQRHTYLFSAGDDKQVKCWDLEQNKVIRSYHGHLSGVYCLALHPTIDILLTGGRDSVCRVWDIRTKAHVSALTGHDNTVCSVFARPTDPQVVTGSHDTTIKLWDLVAGRTMCTLTHHKKSVRAMAMHPKEKSFASASADNIKKFSLPKGEFLHNMLSQQKTIINSMAVNEDGVMATGGDNGSLWFWDWKSGHNFQQEQTIVQPGSLESEACIYALSYDVSGSRLVTCEADKTIKMWKEDLTATPETHPINFKPPKDIRRY

SEQ ID NO: 21372 - DNA, 1686 bp, Panicum virgatum
  misc_feature: Ceres CLONE 1815821
  misc_feature: Encodes the peptide sequence at SEQ ID NO. 21373
ctctcttccgtcgcaagccggccacccctacaaagtctcctccccccgcctcagatgctctatccgaggcgagctgcgggaaaatccttgggcttgccgggagtctggtcgcggcggctgctctgggaatgaggttctgattgttctcgcggctgcaagttcgttgaattcaacaggagctggcggtcatccaaccgcccccgaccggatagaggagaaaggcgtccacgcattggagcgggggtcgaggaaacggcgcaactctccctcgcattgctcgcggcgaaattttgcaatttggatgggggcgggggcgtcgagcatggtggggccggaggggtacggccgcgggtgggggcagacgtcgctgggcgacatgccggagagctgcgtggcggcggtgctgctctacctcgacccgctggagatctgccaggtggcctgcctcaaccgggcgttccggggtgcggcctccgcggactgcatctgggcctccaagctgcccgccaaccaccggtacctcgccgcgctggccgccgcggccgacgacgactgcggctacgacggcgcggccgagggcaatggcaggtgctgctcctcggccgcgatcaagaaggagatatacgcgcgcctgtgccggcccaccccattcgacggcggcaccaagttatgtgagtaggaattttggattgagaaggacaagggaggtttttgcatgtccatctcctcaagggctatgtcgatcactggcagagatgatcggaggtattggagccacctatccacggaggaatcaaggtgaaagttcgttcccacggcgcatagacgttcggcgcggaggccatggccacgagcgccccccctccccagtctctctccctgagctccggcggcggcgcctggccggcacgccagatccggcggcctcgaggtcggctcatggcggcggcggcccgacggctggcgcggaggccatggccacgagccgctcaaccccccccccccccccgcggtctccctccctgagctcggcggsggcgcctgcgcmgcacsccagatccggcggcttccatctcggcccatggcggcggcggcccsatccccgtggggctwccgscggtgttggagacccstggagctcggcgtggggaggcggtatgcggcgcttcstgtcgcacatgtcgccstcggartcggcctgtgctcgctcstcggcgcaccggccttytccgcgccacgggggcagcgtctccctcgagctcggcgggggcggtggcgtctccccggcctcctccacctgcagagggaggtgatcaagacccacgacgccgtcgtctccgaccgacccttytacgtcaccgcgaacatcctctcctacggcggaagaagararcatggctggccccggatgggagcaagcgccsgggaagccttcttyctgcttcacagaccgggagggcttcttcctgctccacaggscttcctgggaaacgttcttcgtcttctgcaacgacggcagatctcagccgcactgtttcattggaacctgcggaaatagcagcaagcaggatgccgcttggattatctacagctctgattttgtgaactaatactagcaggttttacctattatatggataagagcaaacatatatggatggtggcttcccataggtgggggttgcc

SEQ ID NO: 21373 - protein, 125 aa, Panicum virgatum
  misc_feature: Ceres CLONE 1815821
  misc_feature (21)..(68): Pfam Name: F-box Pfam Description: F-box domain
MGAGASSMVGPEGYGRGWGQTSLGDMPESCVAAVLLYLDPLEICQVACLNRAFRGAASADCIWASKLPANHRYLAALAAAADDDCGYDGAAEGNGRCCSSAAIKKEIYARLCRPTPFDGGTKLCE

SEQ ID NO: 21374 - DNA, 778 bp, Panicum virgatum
  misc_feature: Ceres CLONE 1815821-R
ggtggctatcactcttatctgatatgcattctgggaagaggaggatcgccagttttggcccccgtgtgtataagaactacgatccttgtgctaaagtcatccggaattaggcagaggaggtttccccaattgtgggtcgggatccactttttgagtcgtctgtcatgccttgcactcccatgcatacccgctatggtggctatgtgcctacactcatcaagaacacgaagctctgcctgacaacgggcacgctgatctggaccattacgttcctatgcactctgcccaacaatgcaaattccatcagaagactagccacaaacaacgtcctgtaccagctccttcctccggctatgctcacccttgccggcgcaatcaaactcaccctcgacttcgctaagcgccatgtggtggctgcctgctcctacatcagacgttgtgccctcaagaactagaccagcggtaataggcccgcatggtcgtccttgtcatcacagattccgattcatgcgcggcaaagaggcctcctcctcaggcttcggcaacaagaaggctgcagcttttgaagccatgccctgcaacgcaatgcaggctaaatagcttatcgtttctacagctgtgtgcgctcgcctgtcagccgtttccattgactatttcctgtgtatttcggcagttcttagcgttgtttccaaaatttatgtaacggacaagtctatcccttccaattaaaaccaccgccgaatccgccgcatccctttcttttgcaagatttcaatcc

SEQ ID NO: 21375 - DNA, 1098 bp, Panicum virgatum
  misc_feature: Ceres CLONE 1815825
  misc_feature: Encodes the peptide sequence at SEQ ID NO. 21376
acgcaaacacagcctcgcgcgagcgccccccccccccccccccgatccgagatctgggccggccagccatggcgactagggtttggctccccgccctcctcctcgccttcctcctcgcctcctcacccttcacccaagttgctagagctcagtcggactccgactcggaggaagatgctgctacagctgaggttgtcgaaggggctgatttaggaattgtgggtgatgatactcaggtttccagtgatggacctttgagtcctgctcctggtgtagagacagtatgtgtattccccaaaaatgctggcaaaattgtaccagcaggtgaagaaactgaattactcgttggcctgcaaaatgagggtgaatcaactttgaatgttgttgctgtccattcaactctccatcttccttatgaccatcgaatgtatggccaaaaccttactgttcagaaattcttcaatgcatcagttcctgtttctgtgcaagcaactttcccgtatacattcgttgtgagcaagttcttgcagcctggagcctatgatctagttggttacatagtgtatgagattgatcagcacccttaccagaatgtattctacaatggcacgattgaggttgtcgaggctggaggcttactcagtgttgaatctgttttccttattacccttggaattgcacttcttggtctctttggattgtgggcatatggccaggttcagcagctgtcgaagaaaacaaagaaggcccccaaggtcgagctcggaactggaacaactgatgccaacatcgatgagtggctggagggcacttcgtttgcacagagaagcaaatccaagaagaagcagacctgaggcttccgagtctagctcatcatttgaggatctagaatgaggcaaagtgagggtagcacctcacaatcacaagtgactttgcagaagatagatgtgaagggaggttttgaaaactgtagtttcgtggtggcacatctttgttaacaccattttcggccttgtgtactttacatgggaacttttcttcaaacaaaattttgttaaaaaaaaggtatatgctatcgctgctgggatttctgatctt

SEQ ID NO: 21376 - protein, 261 aa, Panicum virgatum
  misc_feature: Ceres CLONE 1815825
  misc_feature (6)..(260): Pfam Name: TRAP_alpha Pfam Description: Translocon-associated protein (TRAP), alpha subunit
MATRVWLPALLLAFLLASSPFTQVARAQSDSDSEEDAATAEVVEGADLGIVGDDTQVSSDGPLSPAPGVETVCVFPKNAGKIVPAGEETELLVGLQNEGESTLNVVAVHSTLHLPYDHRMYGQNLTVQKFFNASVPVSVQATFPYTFVVSKFLQPGAYDLVGYIVYEIDQHPYQNVFYNGTIEVVEAGGLLSVESVFLITLGIALLGLFGLWAYGQVQQLSKKTKKAPKVELGTGTTDANIDEWLEGTSFAQRSKSKKKQT

SEQ ID NO: 21377 - DNA, 1217 bp, Panicum virgatum
  misc_feature: Ceres CLONE 1815841
  misc_feature: Encodes the peptide sequence at SEQ ID NO. 21378
acccatcagcgcctcactcacctcacctgcagatcatcaaagcattgctcgctcgctcgccgaggaagcaaggaaccagcaatggcggcggcagggctgcaggtgttcggacagccggcgtccaccgacgtggcgagggtcctgacctgcctcttcgagaagaacctcgagttcgagctcgtccgcatcgacaccttcaagaagtcgcacaagctccccgagttcatcaagctacgggatccaactgggcaggtgacattcaaacatggtgataaaaccattgtcgattcgagggccatctgccgctacctgtgcaccactttccccgaggacggcaacaggacgctctacggcacgggctccctggagcgggcgtcgttagagcagtggctgcaggccgaggcccagagcttcgacgccccgagctcggagctcgtcttccagctcgcgttcgcgccgcacctcaaggacgtgcaccccgacgaggcccgcatcgcggagaacgagaagaagctccagagcatgctgggcgtgtacgacgagatcctgtccaagcacaagtacctggccggcgacgagttcaccctggccgacctgtcccacctccccagctcgcactacatcgtcaactcctccgagaggggccgcaagctcttcaccgccaagaagcacgtggccaagtggtacgagaagatctccagccgcgactcgtgaatgcaggtggtcaagatgcagaaagagcaccccggctcgttcgagtgatgggcagctcggtcggcggcttcgattggatcgtcaggcttcataccgtgatgtggttgtcaccagcaagttcgtcgtatcatcgtacgtcctgtgggctaaaataacatgaagcctgccttacggtgtctcaatgtctgattgtcttcctttcgctgcatatgcacgcgatgtctttctttatgggtattgtattggtcagttcctttttgttgattcaataaaaatgcgtccgagcctttttgctcgtttgcagtagctttggcttgtcgagatcaaattggaaagagcacacaacatgtacttgcaaaccattgattcacacgccgttttgcatagttcgtagtgttcttcagtgatctgaatccacgtgctcatgtacttgtacgattgttgcaccgtggccgacatttccataaagaaattttttgaaataatggagagaacatcaattg

SEQ ID NO: 21378 - protein, 210 aa, Panicum virgatum
  misc_feature: Ceres CLONE 1815841
  misc_feature (111)..(209): Pfam Name: GST_C Pfam Description: Glutathione S-transferase, C-terminal domain
  misc_feature (4)..(79): Pfam Name: GST_N Pfam Description: Glutathione S-transferase, N-terminal domain
  misc_feature: SWISSPROT Homolog: EC 2.5.1.18 Glutathione transferase
MAAAGLQVFGQPASTDVARVLTCLFEKNLEFELVRIDTFKKSHKLPEFIKLRDPTGQVTFKHGDKTIVDSRAICRYLCTTFPEDGNRTLYGTGSLERASLEQWLQAEAQSFDAPSSELVFQLAFAPHLKDVHPDEARIAENEKKLQSMLGVYDEILSKHKYLAGDEFTLADLSHLPSSHYIVNSSERGRKLFTAKKHVAKWYEKISSRDS

SEQ ID NO: 21379 - DNA, 525 bp, Panicum virgatum
  misc_feature: Ceres CLONE 1815864
  misc_feature: Encodes the peptide sequence at SEQ ID NO. 21380
attctccctcctctttctcttgaagtcccccccataaggcttggagggaagaagagaaagcttagccccgaacaaaggcccgccagcaaaaatggcgatccgcagcccgcccacccccccctccctgcactccccatgccccaccgtctcaaacgcaggcttcaggcacaagccagtcctccttctcacccgcaaccggagaagccgccgaaggcatggaggggcaagaacctttcaggtttcatgctccgtcgagaagccagtggtgatcggcctggcggcagactcaggatgcgggaagagtaccttcatgcgccgtctcaccagtgtgtttggtggtgctgcagagccacccaagggtggccacccggactccaacaccctcctcagtgacaccacgacagtgatatgccttgatgactaccactccttggacacaaccgggagaaaggagaagggtgtgaccgccctcgaccccagggccaacaactttgatctcatgtatgagcaggtgaaggcaatcca

SEQ ID NO: 21380 - protein, 144 aa, Panicum virgatum
  misc_feature: Ceres CLONE 1815864
  misc_feature (59)..(144): Pfam Name: PRK Pfam Description: Phosphoribulokinase / Uridine kinase family
  misc_feature: SWISSPROT Homolog: EC 2.7.1.19 Phosphoribulokinase
  misc_feature: Useful for making plants with altered lignin content
MAIRSPPTPPSLHSPCPTVSNAGFRHKPVLLLTRNRRSRRRHGGARTFQVSCSVEKPVVIGLAADSGCGKSTFMRRLTSVFGGAAEPPKGGHPDSNTLLSDTTTVICLDDYHSLDTTGRKEKGVTALDPRANNFDLMYEQVKAI

SEQ ID NO: 21381 - DNA, 2267 bp, Panicum virgatum
  misc_feature: Ceres CLONE 1815875
  misc_feature: Encodes the peptide sequence at SEQ ID NO. 21382
tcctacaaggttgagcacaacacaacacactagctccttagtgtgctctagctggtaagggtaccaagaaggtctgtaaccatatagacttgtagtatcactagagcagagggacatagagaggaaacactggaagccagggagcagagatcactgtaggagggagtggtgttcactagtgcaagctgcaaactcgagtacaataaggtgaacgatggatatcgagtccaggcaaggttccaaaggggactccatggctgctgctgcctctgaggtctctgttgactggagaggcaggccatgcgaccacctgaagcatggcggcatgaaagccgccgtcttcgtcctagggatccaggcgttcgagatgatggcgattgcggcggtggggaacaacctgatcacttacgtgtttggggagatgcacttcccgctgtcgcaggcggccaacatcgtcaccaacttcatcggcaccgtcttcctcctctccctcctcggcggcttcctctccgactcctacctcggcagcttctggaccatgctcatctttggattcgtcgagctctccgggttcatacttctggcggtgcaggcgcacctgccgcagctgcggccgccgccgtgcgacatgatggcggcgggggcggcggcgtgcgaggaggccggcggcgtgaaggcgggcatcttcttcgcggcgctgtacctggtggcggtgggcagcgggtgcctcaagcccaacatcatcgcgcacggcgcggaccagttccggcggggcggcgccggcggcggcgacgcccggcggctgtcgagctacttcaacgcggcctacttcagcttctgcgtgggcgagctggtggcgctcaccgtgctcgtctgggtgcagacgcgctccgggatggacgtcggcttcggggtctccgccgccgccatggctgtcggcttggtcagcctcgtcgccggcgtcgccttctaccgcaacaagccgccccagggcagcatcttcactcccatagctaaggtatttgtcgctgccgtgacaaagaggaagcaggtgtgcccgtcgaccgccaccgtgcaggccattgcaagggttaccggtaccgcccatgagatgttggttaaccccacaaacattcgccacatcaacaagtttaggttcttggacaaggcatgcgtcaaggcgcaggacggccccggcggcggggcgtcgtcggcgatggggaagcaggagagcccgtggcgcctgtgcacgccggcggaggtggagcaggtgaaggtgctgctgtgcgtggtccccatcttcgcgtgcaccatcgtcttcaacaccatcctggcgcagctgcagaccttctccgtgcagcagggcggcgccatggacacccgcctcgccgcctccttccacgtcccgccggcctcgctgcaggccatcccctacgtcatgctcgtcgcgctggtcccggcctacgaggccgccttcgtgcccgccgtgcgccgcctcaccggtgtccccacggggatcaccccgctccagcgcatcggcgtggggctcttcgcggccaccttctccatggtcgccgccgcgctcgtcgaggcccggcgccgccaagccgcgaccgccggcggcggcggccgtctcctctccatcttctggatcgcgccgcagttcctcgtgttcgggctctccgagatgttcaccgccgtgggcctcatcgagttcttctacaagcagtcgctcgccggcatgcaggccttcctcacctccatgacctactgctcctactccttcggcttctacctcagctccgtgctcgtgtccctggtcaacagggtcaccagcaccaccgccggcgccggcgccggcggcggctggcttgccaacaacgacctcaacaaggacaggctcgacctcttctactggctcctcgccgggctcagcatcctcaacttcttcaactacctcttctgggcgaggtggtactccaagagcgtagagacggtgcaggtcgccggagtccggaccggcggtgagcaggatgaccagaaggacgcttccgagtgctgagatcattaacatgggtccctgaaatttgggcccaggaaatgtcgggcatatcagtcaattaatcaattaacctagtgctaagtgtagttaaccttttgtatttctttttattttgtttcttttattatggttttgctttgcatttgggaagatatgtactatgtgagtatgagttaaattaatcacaaagggtggtaggtgactg

SEQ ID NO: 21382 - protein, 615 aa, Panicum virgatum
  misc_feature: Ceres CLONE 1815875
  misc_feature (106)..(522): Pfam Name: PTR2 Pfam Description: POT family
MDIESRQGSKGDSMAAAASEVSVDWRGRPCDHLKHGGMKAAVFVLGIQAFEMMAIAAVGNNLITYVFGEMHFPLSQAANIVTNFIGTVFLLSLLGGFLSDSYLGSFWTMLIFGFVELSGFILLAVQAHLPQLRPPPCDMMAAGAAACEEAGGVKAGIFFAALYLVAVGSGCLKPNIIAHGADQFRRGGAGGGDARRLSSYFNAAYFSFCVGELVALTVLVWVQTRSGMDVGFGVSAAAMAVGLVSLVAGVAFYRNKPPQGSIFTPIAKVFVAAVTKRKQVCPSTATVQAIARVTGTAHEMLVNPTNIRHINKFRFLDKACVKAQDGPGGGASSAMGKQESPWRLCTPAEVEQVKVLLCVVPIFACTIVFNTILAQLQTFSVQQGGAMDTRLAASFHVPPASLQAIPYVMLVALVPAYEAAFVPAVRRLTGVPTGITPLQRIGVGLFAATFSMVAAALVEARRRQAATAGGGGRLLSIFWIAPQFLVFGLSEMFTAVGLIEFFYKQSLAGMQAFLTSMTYCSYSFGFYLSSVLVSLVNRVTSTTAGAGAGGGWLANNDLNKDRLDLFYWLLAGLSILNFFNYLFWARWYSKSVETVQVAGVRTGGEQDDQKDASEC

SEQ ID NO: 21383 - DNA, 703 bp, Panicum virgatum
  misc_feature: Ceres CLONE 1815886
  misc_feature: Encodes the peptide sequence at SEQ ID NO. 21384
aagacgtacacagccgtcacaagttcaccagcacggctgcacacccattactgcacgggcgcagataggcatgggctctgtcgccgccgaccggccgcacgtcgtgtgcgtgccgttcccggcgcagggccacgtcacgccgatgctgaagctggccaaggtcctccactgccggggcttccacgtcaccttcgtgaacacggagtacaaccaccgccgcctcctccgctcccgcggcgccggcgcgctcgacggcctcccgggattccgcttcgccgccatcccggagggcctgccgccgtccgacgtcgacgccacccaggacgtgccgtcgctctgccgcgccaccatggagaactgcctcccgcacttcaggggcctcctcgccgagctcaacgcctccccggacgcgccgccggtcacctgcgtcgtcggcgacgacgtcatgagcttcaccatggaagccgccagggagatcggcgtgccgtgcgcgctgctctggacgtccagcacctgcggctacgcaggctaccgttactactgcaccctcatcgaccagggcgtcttccctctcaaagaggagcagctgacgaacgggttcttggacacgccggtggagagtgcgcccgggttgagcaagcacatccggctcaaggacctccccagcttcatccgctcaacggaccccgacgacttcatggtc

SEQ ID NO: 21384 - protein, 210 aa, Panicum virgatum
  misc_feature: Ceres CLONE 1815886
  misc_feature: SWISSPROT Homolog: EC 2.4.1.115 Anthocyanidin 3-O-glucosyltransferase
  misc_feature: Useful for making plants with altered carbohydrate content
MGSVAADRPHVVCVPFPAQGHVTPMLKLAKVLHCRGFHVTFVNTEYNHRRLLRSRGAGALDGLPGFRFAAIPEGLPPSDVDATQDVPSLCRATMENCLPHFRGLLAELNASPDAPPVTCVVGDDVMSFTMEAAREIGVPCALLWTSSTCGYAGYRYYCTLIDQGVFPLKEEQLTNGFLDTPVESAPGLSKHIRLKDLPSFIRSTDPDDFM

SEQ ID NO: 21385 - DNA, 1484 bp, Panicum virgatum
  misc_feature: Ceres CLONE 1815887
  misc_feature: Encodes the peptide sequence at SEQ ID NO. 21386
tccgctcttgaacccaatcgccgccaccgccatgactcttgcatccacctcccctctcgcagccgcccccgcgcgtcccacgaaactccctcccttctcgcgctgcccctctcgccgcctcctgcgcgtctcctgccaggcgacgccggccgaccccccggcctgcgggggcggcaatgcgtcgaacgcctcgccggcgccgcagcagccgaggtggcgcgccgcgctctccgccgcgctcgccgcggccgtggtcgccgcagcggtgccggcctacgcggacctgaacaggttcgaggccgagcagcggggcgagttcggcatcggctccgccgcgcagttcggctcggccgacctcaagaaggccgtccatgttaacgagaacttcaggcgtgccaacttcacatctgctgacatgagagagtcagatttcagtggttcgacattcaatggtgcttatcttgaaaaggctgttgcttacaaagcaaatttcactggtgctgatttgagtgatacattaatggaccgcatggttctcaatgaagccaaccttacaaatgctgttcttgtacggtcagtcctcacacgtagtgaccttggaggagcgatcattgaaggggctgacttcagtgatgctgttattgacctaccacagaaacaggcattgtgcaaatatgcaagcgggaccaaccccataacaggggtaagcacccgaaaaagccttggatgtggcaatagccgtcgaaatgcatacgggagcccttcatcccctctgttgagtgccccaccacagaaacttcttgaccacgatggtttctgtgatgaagctactggtatgtgcgatgcaaagtgagacatgattgatccagcatggaaactagtcatggatgcgtatatacattggagatcgagtgaaagagcagaatagtgcagagaactcgtcatttttcttctcctgatgcaattgttgtaagtttgcagcagaatcaggtaaacttcaggatgcagatgagaatatgagatatgggcactgagcactgaacgccatatatagcatagtaagtatatgacatagatcatgtcctgtgttttcagaagccagtatatccaaaacagaagtccaacacgggagtgtctctgtaaataaacttcccactccatttcacaaatattgctgatgcatcggcagcgaccagagagccgcagcgaccagagagctgccgttctggacgatggaccgcacaaatagacgtccatcgacagcttgactatttttacaaattgtcaagtcagttactgaagctccttagcttcagctttcagctagctacataccttattaacatcagatcctgagacctgatgtcaaacaatatatatatatatatatatatatatatatatatatatatatatatatatatatatatatatatatatatatatatatatatatatatatatatatatatatatatatatat

SEQ ID NO: 21386 - protein, 273 aa, Panicum virgatum
  misc_feature: Ceres CLONE 1815887
  misc_feature (117)..(156): Pfam Name: Pentapeptide Pfam Description: Pentapeptide repeats (8 copies)
  misc_feature (167)..(206): Pfam Name: Pentapeptide Pfam Description: Pentapeptide repeats (8 copies)
MTLASTSPLAAAPARPTKLPPFSRCPSRRLLRVSCQATPADPPACGGGNASNASPAPQQPRWRAALSAALAAAVVAAAVPAYADLNRFEAEQRGEFGIGSAAQFGSADLKKAVHVNENFRRANFTSADMRESDFSGSTFNGAYLEKAVAYKANFTGADLSDTLMDRMVLNEANLTNAVLVRSVLTRSDLGGAIIEGADFSDAVIDLPQKQALCKYASGTNPITGVSTRKSLGCGNSRRNAYGSPSSPLLSAPPQKLLDHDGFCDEATGMCDAK

SEQ ID NO: 21387 - DNA, 484 bp, Panicum virgatum
  misc_feature: Ceres CLONE 1815887-R
gctatttttgtgtgtgtgtcacagaaacagatatatataagtataaatataagaaaaagagaaatagagatggcccccccacacacatatataaatatataaatataaaaaagagatatttttttttttttttatatatctatatctatatatcaaaatcaaaatatgtgtgtgtgtgtatctatatctctctctctctctctctccctcacagagagcgcgcgcgcgcgcgcgcgagcgcgcgcgcgcccgcactctcgcgcgcgcgctcgctctctctctctctttctttctttctttttttctctctctctcacacacacacacacacacacacacatatatatatatatatatatatatatatatatatatatatatatatatatatatatatatatatatatatatatatatatatatatatatatatataaccactttggttacttgtttattgtgtataagtatatcttcatgcgcc

SEQ ID NO: 21388 - DNA, 692 bp, Panicum virgatum
  misc_feature: Ceres CLONE 1815889
  misc_feature: Encodes the peptide sequence at SEQ ID NO. 21389
atcaaaaagcaacaagcacacatagtttcggagagacgtgtaagcataaaccagaagactcaacagtgtcgccacttgaagacgggcagggttttgagaggagagaggatggcacggcaagacgcagcctccatgttcgctacggctttgctcctcgtggtctttgccaacatctcaccaagcgtggagtccgtcggggtgtcctacggcatgagcggcgacaacctgccgccggcgagcaccgtcgtcggcatgtacaaggccaacggcatcccgctgatgcggatctacgcgccggaccaggcggccctccaggcggtgggcggcacgggcatccgcgtcgtcgtcggcgcgcccaacgacgtgctgtccagcctcgccgccagccccgccgcggccgcctcctgggtccgcaacaacatcgaggcctacccggacgtcaccttccgctgcgtctgcgttggcaacgaggtggagggcggcgcggcgcaggacctggtcccggccatggagaacgtccgcgccgcgctcgccgccgccggcctggacggcatcaaggtcaccacgtcggtgtcgcaggccatcctgggcgggtacaagccgccctccgccgccgacttcaccgccgaggcccaggggttcatgggccccgtcctcgccttcctggcccgcaccggcgcgcccctcatggc

SEQ ID NO: 21389 - protein, 194 aa, Panicum virgatum
  misc_feature: Ceres CLONE 1815889
  misc_feature (29)..(194): Pfam Name: Glyco_hydro_17 Pfam Description: Glycosyl hydrolases family 17
  misc_feature: SWISSPROT Homolog: EC 3.2.1.39 Glucan endo-1,3-beta-D-glucosidase
  misc_feature: Useful for making plants with altered carbohydrate content
MARQDAASMFATALLLVVFANISPSVESVGVSYGMSGDNLPPASTVVGMYKANGIPLMRIYAPDQAALQAVGGTGIRVVVGAPNDVLSSLAASPAAAASWVRNNIEAYPDVTFRCVCVGNEVEGGAAQDLVPAMENVRAALAAAGLDGIKVTTSVSQAILGGYKPPSAADFTAEAQGFMGPVLAFLARTGAPLM

SEQ ID NO: 21390 - DNA, 2673 bp, Panicum virgatum
  misc_feature: Ceres CLONE 1815896
  misc_feature: Encodes the peptide sequence at SEQ ID NO. 21391
ttttttccactccgccggccgccggagtcgtctcctctccctcggctcgctcgcctcctccgtctctcctcctcctccccccacggcacgctagacgacgaccggcccttgggctgcaccttgccccaggcatcgggcgggttttcatggagacagcataaaccctccttctcctcagtttctctctgctgcgcggcaagcccctcttccctgcatcggccatggcccgcaacaaggaagcattggttttgctactggatgttggtccttcaatgcatggggtgctgcaggaggtcaagaacatatgctcaactctggtgcataagaagttagtttataatagaagtgatgaggttggtattgtcctctttggaactaaagaaacatgcaatgagcttgcgaaggagcttgggggctataagcatgtgacagttgcgcatgatattaaagttgtagacgaagggacatcacaggctctgcaaaaccttccagcaggatctgtccctggtgattttctggatgctattgttgttggcttggatatggtaattaggaaatttggaaataccaaaggaaagcggcgcctctgtctaatcaccagtgcacagtatccgttaagagatccacctgaggggactaaagaagatcaggtggacaccattgcagaccagatgaaaagacatgatatcaagatggagtgcattgtcttcagagaaccaggagttcatcataattctgtaatggaagaaaatgaccgactattgtatcaattcagaaatagatcagtagcaaaggtagtccaggttgacagcccaacatccctgttgggtgctctgaagacaagaaatgtgcttccagttactgtcttcaggggagacctggaagtgagccccaattttaaaattaaggtgtgggtctataagaaaacagccgaggaaaagttccccactttgaagaagtattcagacaaggcacctccgagtgataaatttgcctctcatgaagtcaaagtggattatgagtataaaagcgttgttgaaccagacaaagttgttccaccagatcagaggattaagggatatctttatggtcctcaagttgtcccgatatcatctgccgaatgggaggcggtcaagttcaagccagagaaaggtgtgaagcttctgggatttacagatagatccagcatatcacggcaccattttatgaaagatgtatgcttgtttatacctgaacctggtaacacgaaagcaactcttgcagtttccgccgtagcaagagcaatgcatcaaatgaacaaggttgcaattgtgcgatgtgtgtggaggcaaggtcaagggaatgttgctcttggtgtattgacaccaaacatttcatcagttaacaatgtccaagattcattttacttcaatgtgctcccatttgctgaggacatcagagagtttcagttccgatcctttagcagtctgccatcatcatctcagcccactgaagaacaacaagaagctgcagataacttggtgaagatgctagacctagcaccacctggaagagaagtcctcaagcctgagtttacaccaaatcccatgttggagagattttacagttaccttgatctgaaggcgaagcagacagatgcaaatgtaccacctcttgaaagatgtctaaggaggataaccgaacctgatcctgatgtcattgaccaacaaacaccattaatccaaaatctaggcaaagcctttgagctgaaagagaatcccaagaaaaagaaggcacgaacacaggagaggctggcatatgttgatgcaggtgatcaagctaaatcagaagcagagacctctgcagagaaggatggggttttggaggctttgtatcctccatcagagaacgctgggcagatcagagatttaaatcctgtccaagattttgaagccatgctggcaaagagatctagctcaacttgggttcagaaggcaattgaggagatgcagaaatacacagcagctttgttagaaaactcacgtgagggggataattaccaaaaagcacttgaatgttttgctgccctgcggaaggcctgcattattgaacaggaaccagaggaattcaaccagttcttaacaaagacttacgagagattgaagggtaatgctgctaacttctttcagcttttgtcgtcgaaaaatatttcacttatcagcaaacaggaagcgcctgacagtgatgtgactgaagagatggcaagaagtttctatctgaaacaagaagcggcttctcagtagcagctgaaagaaactggaagcacctttgtgggcttggagatcctcgaactggattgcgctaactatagcttagcctagccctttgcatgtgtctggcatgttttgaggctttctacatggatggaactgcaactaatcctcaactctctggatttagtcactgtcttgcagcacaatttatttgagtttgtttcctgctgctgctgctgctgtgtcgaggagactgctgcactgtgggtattttctttcggcctttggtaggtgctgtggagctggggcggtttagtaggagaaaccgagaaaggaatagctgaataggaattccccgggatgtgctcatgggctgcacgcctgaatggctgaatcgagaaatgaatgaatttgctttgac

SEQ ID NO: 21391 - protein, 686 aa, Panicum virgatum
  misc_feature: Ceres CLONE 1815896
  misc_feature (562)..(682): Pfam Name: Ku_PK_bind Pfam Description: Ku C terminal domain like
  misc_feature (220)..(430): Pfam Name: Ku Pfam Description: Ku70/Ku80 beta-barrel domain
  misc_feature (7)..(212): Pfam Name: Ku_N Pfam Description: Ku70/Ku80 N-terminal alpha/beta domain
MARNKEALVLLLDVGPSMHGVLQEVKNICSTLVHKKLVYNRSDEVGIVLFGTKETCNELAKELGGYKHVTVAHDIKVVDEGTSQALQNLPAGSVPGDFLDAIVVGLDMVIRKFGNTKGKRRLCLITSAQYPLRDPPEGTKEDQVDTIADQMKRHDIKMECIVFREPGVHHNSVMEENDRLLYQFRNRSVAKVVQVDSPTSLLGALKTRNVLPVTVFRGDLEVSPNFKIKVWVYKKTAEEKFPTLKKYSDKAPPSDKFASHEVKVDYEYKSVVEPDKVVPPDQRIKGYLYGPQVVPISSAEWEAVKFKPEKGVKLLGFTDRSSISRHHFMKDVCLFIPEPGNTKATLAVSAVARAMHQMNKVAIVRCVWRQGQGNVALGVLTPNISSVNNVQDSFYFNVLPFAEDIREFQFRSFSSLPSSSQPTEEQQEAADNLVKMLDLAPPGREVLKPEFTPNPMLERFYSYLDLKAKQTDANVPPLERCLRRITEPDPDVIDQQTPLIQNLGKAFELKENPKKKKARTQERLAYVDAGDQAKSEAETSAEKDGVLEALYPPSENAGQIRDLNPVQDFEAMLAKRSSSTWVQKAIEEMQKYTAALLENSREGDNYQKALECFAALRKACIIEQEPEEFNQFLTKTYERLKGNAANFFQLLSSKNISLISKQEAPDSDVTEEMARSFYLKQEAASQ

SEQ ID NO: 21392 - DNA, 772 bp, Panicum virgatum
  misc_feature: Ceres CLONE 1815918-R
  misc_feature: Encodes the peptide sequence at SEQ ID NO. 21393
ggtgtcaggagctgttacgatgagggcaagcgtacagctgaaacgttgaccatggactaccaccgtggtgccaaccttcaggttaggattgcgcgtatcttcaacacatatggccctcgcatgtgcattgatgatggccgtgttgtcagcaactttgttgctcaggcacttaggaaggagcccttgactgtttacggtgatggcaagcaaaccaggagcttccaatatgtttctgatctggttgagggtctgatgaagctgatggaaggggatcacgttggtccattcaaccttggaaaccctggcgagttcaccatgcttgatctcgccaaggttgtccaggacaccattgacccgaatgcacggattgagttccgtcaaaacacccaggatgacccgcacaagcgcaagcctgacatcagccgcgccaaggagcttcttggctgggagccaaagatccccctgcgcgagggacttccccttatggtcactgacttccgcaagcgcatcttcggggaccaagacagcgctgcgaccaccggaaaccaacaaggttaggacgaaggagcatgagacttggaaaaattttggtggcctgcttctagctgcttggttactctcctcactgacaaaggctatggccgtgtagttcgttgggaacatgttactgaaatacctttggttgctgctgtaatgctattctttttccatgtaattgttttatcagttatctcagtcagctatacaaaattttcagttgaattttggagat

SEQ ID NO: 21393 - protein, 185 aa, Panicum virgatum
  misc_feature: Ceres CLONE 1815918-R
  misc_feature: SWISSPROT Homolog: EC 4.1.1.35 UDP-glucuronate decarboxylase
  misc_feature: Useful for making plants with altered carbohydrate content
  misc_feature: Useful for making plants with altered cell wall content and/or composition
GVRSCYDEGKRTAETLTMDYHRGANLQVRIARIFNTYGPRMCIDDGRVVSNFVAQALRKEPLTVYGDGKQTRSFQYVSDLVEGLMKLMEGDHVGPFNLGNPGEFTMLDLAKVVQDTIDPNARIEFRQNTQDDPHKRKPDISRAKELLGWEPKIPLREGLPLMVTDFRKRIFGDQDSAATTGNQQG

SEQ ID NO: 21394 - DNA, 394 bp, Panicum virgatum
  misc_feature: Ceres CLONE 1815918
  misc_feature (140)..(140): n is a, c, t, g, unknown, or other
  misc_feature (142)..(142): n is a, c, t, g, unknown, or other
  misc_feature (144)..(144): n is a, c, t, g, unknown, or other
  misc_feature (145)..(145): n is a, c, t, g, unknown, or other
  misc_feature (157)..(157): n is a, c, t, g, unknown, or other
atccaaacgcgccacagtgccaaaaaccagcagctgagtcggggacgtttctcccagcttctgccacagtgccacccccgacacccccggcgcgccgacctccagatccatcgacgccggttcccccccccccaccaccncntnnggatgattgagngtaaggttgtatgcatgcatgcggtcccacaatcgattagtaaatttcgatatgtgtccaagcactttgaaaatattgagtatggttccgtagcctttgttttgcacaatgcataagtgcaaacccttcccctaccttatctgtctttatagtttcaaagaggtgaaaattagaagaggaccaaataaatattttcattttgcctgctgtatctatatctgaaagcactcctggtcc

SEQ ID NO: 21395 - DNA, 2223 bp, Panicum virgatum
  misc_feature: Ceres CLONE 1815930
  misc_feature: Encodes the peptide sequence at SEQ ID NO. 21396
gagacgggagtcctcttcttccccagttcacgtctacggtcccgtccatttccacggctccgaccaaccccccaatgccctccaaaccctaacccacagtccctgccccctggtggcgatgccggatctgagcaccgtctacctccctccttccccggaacttcctgtcgacgcctcgggggacctcgccgacgaccacgccggagatgccgccgccgcatcgatcgacgcggcgcccgcgtcttcatctgcctctgtggaggacggcggcggcggcggtggcggccccctcatgctcccagtggaatgccggtggagcggccgtgtccgcaccttcgacatgtcgggcgcgggcggtgcggccgcctgccccgccgcgcggcgcggcggcggcggggggaagaagccgtcctttgctccgtcacccgggccgtcacgggcgcaggatccagcgccgggtaagacgctcgaggaacgcgtgagcgagtgggcagctaggaaggcagcggccggcatccctgcccaccactgcgtgctgcctttcctcactggcgcgccaaaggcggtcgaatgctgtttgtgctccaggattatttatgctggagaaaaaataaattgttcagttagtcgctgtcaagaggtcttccatcttaactgtgctgcgaaaggcacttcaaacttcaccgcggaaagcttcaggtgccctaaacatgcctgtatggtttgtaagcaaaagatgttcttttggcgctgtgggcgttgtacagttgcagcacatacaaaatgtgcaccatggccagtgattcatctaaaagatgatcaaggaagtgcaatttgctggaggcatccttctgactggcttctgcaaaatgagaatactgactttaccaacagcatagaggaagtgtttcaccggttaccacttccatatgttaatgaagacttcaatattgattcgaccattagggattttgctgaggctgtttacaagccacccccctatacatccatcaggcgcaatgtatatttgataaaaaagaagcgcattggtgttcgtgcggatactgggtgcacgaactgccgagctgattctacatgtaaagaagactgtgaatgcagaggtctttcgatgagttgttccaagaattgccgctgctcagatctctgtaccaacaggccattccgtaaggataagaaaattaaaattgtgaagacagagcgttgtggatggggtgctgttgcattggagccattggagaaaggtgattttgtaattgagtatgttggtgaagtcattgatgacgcaatatgtgaacgaaggctttgggatataagagatcgcggtgacaaaaacttctacatgtgcgaaatcagcaaagattttacaatagatgcaacatttaaaggaaatgcatcacgttttctaaaccacagttgtgagcccaactgtaaactcgaaaaatggcaggttgacggtgagacaagagttggtgtgttcgcctctcgttccatcaaagttggagagcccttaacttatgactacaggtttgtgcattttggagagaaagtggagtgccactgtgaggcaccaaactgccagggatacctgggcaaccaaataaagaacccaactcagaacgctcttgcaattaaagaagagcaagaaaagtcatgtgaacattcgcccatacaacacggcagctctgcttcaatattacactcaatgactcatttgttaccttggaccaaccccaactgtatagaggtctcttttaacctgagaagcaaaagcaaaataacccggatatgctgggtcggcaagaggaagagaacatccctcgtggcatcttacaacaagcatgccaacgttggtgagtgaagttcctgctgcggatatctgattgccaatcccttggagctcctgctgaaacagcaggcataggcttgcctgtacaataattggtacattctttatgtgcaattggttggaaacaattctttcacattgctctatgtgttgttacctgcaacattctttcttcaatctcatagggaattcagtctgttcacagttcagtttgctgaaaccatgtactcagatttttttcatgcaacttattgtggttgtggctcgctatccttgtatatgagatgatgttgcaaaacttgaaaccctttgaggatgttacaagtagcatgcaacattagccgaatgtttatttc

SEQ ID NO: 21396 - protein, 586 aa, Panicum virgatum
  misc_feature: Ceres CLONE 1815930
  misc_feature (353)..(482): Pfam Name: SET Pfam Description: SET domain
  misc_feature: SWISSPROT Homolog: EC 2.1.1.43 Histone-lysine N-methyltransferase
MPDLSTVYLPPSPELPVDASGDLADDHAGDAAAASIDAAPASSSASVEDGGGGGGGPLMLPVECRWSGRVRTFDMSGAGGAAACPAARRGGGGGKKPSFAPSPGPSRAQDPAPGKTLEERVSEWAARKAAAGIPAHHCVLPFLTGAPKAVECCLCSRIIYAGEKINCSVSRCQEVFHLNCAAKGTSNFTAESFRCPKHACMVCKQKMFFWRCGRCTVAAHTKCAPWPVIHLKDDQGSAICWRHPSDWLLQNENTDFTNSIEEVFHRLPLPYVNEDFNIDSTIRDFAEAVYKPPPYTSIRRNVYLIKKKRIGVRADTGCTNCRADSTCKEDCECRGLSMSCSKNCRCSDLCTNRPFRKDKKIKIVKTERCGWGAVALEPLEKGDFVIEYVGEVIDDAICERRLWDIRDRGDKNFYMCEISKDFTIDATFKGNASRFLNHSCEPNCKLEKWQVDGETRVGVFASRSIKVGEPLTYDYRFVHFGEKVECHCEAPNCQGYLGNQIKNPTQNALAIKEEQEKSCEHSPIQHGSSASILHSMTHLLPWTNPNCIEVSFNLRSKSKITRICWVGKRKRTSLVASYNKHANVGE

SEQ ID NO: 21397 - DNA, 671 bp, Panicum virgatum
  misc_feature: Ceres CLONE 1815938
  misc_feature: Encodes the peptide sequence at SEQ ID NO. 21398
gccttctccgcctccgcgcagcgacgctccccggctaccccgccccatccgccagcccgctgccggcagcagcctcccctcccccgccgtcgcgcttccggaggaagcagatcggagaaggtgatcggctgcgatggcccgcttgtacgtcgggaacctggatcctcgggtgacggcacgggagctcgaggacgagttccgcacctttggagttcttcggagtgtttgggttgctcggaaaccaccaggctttgcatttgttgattttgatgacaagagggatgctgaggatgcaatccgtgatcttgatggcaagaatggatggagagttgagctatcacgtagtgccagcagtggtcgtggtggtcgtgatcgggggtatggtggatctgattctaagtgctacgagtgtggtgagactgggcactttgctcgtgagtgtcgtttgaggattggttctggaggtctaggcagtggaaggcgccgaagcaagagccgcagccgcagccgcagccgtagtcccagataccgccggagtccaagttatggaagaagaagctacagtcctgcagcgcgctctccaaggcgtcgtagtgtgtcaccagccccagctcgtggacgcagctatagcaggtcaccgcagtacaaccgtgcacgggagacatctccct

SEQ ID NO: 21398 - protein, 179 aa, Panicum virgatum
  misc_feature: Ceres CLONE 1815938
  misc_feature (4)..(70): Pfam Name: RRM_1 Pfam Description: RNA recognition motif. (a.k.a. RRM, RBD, or RNP domain)
  misc_feature (88)..(105): Pfam Name: zf-CCHC Pfam Description: Zinc knuckle
  misc_feature: SWISSPROT Homolog: EC 5.2.1.8 Peptidylprolyl isomerase
  misc_feature: Useful for making plants with modulated flowering time
MARLYVGNLDPRVTARELEDEFRTFGVLRSVWVARKPPGFAFVDFDDKRDAEDAIRDLDGKNGWRVELSRSASSGRGGRDRGYGGSDSKCYECGETGHFARECRLRIGSGGLGSGRRRSKSRSRSRSRSPRYRRSPSYGRRSYSPAARSPRRRSVSPAPARGRSYSRSPQYNRARETSP

SEQ ID NO: 21399 - DNA, 1214 bp, Panicum virgatum
  misc_feature: Ceres CLONE 1815961
  misc_feature: Encodes the peptide sequence at SEQ ID NO. 21400
acatcttctcttcgactacctcgtgccctccctctgaccgctgttgatcccttcaacacctgccctattctaacattaatcaatcgaatcaatcacaccgcttgactacttctactcccgataacaatccgcctgctcctccttttctccaaccttgtgatcctaaaaagtagaaatcaagaaacccccgctctcgatgccaagatcctagttggattgatcgagggaggtcgggcatcctacttggataggagaaaagaatcctagagagtgaaaaggctagaagaatcgcgtccatctgtgagattggggacgaacggggagacgacggggcgaggagatgtctcggggcgggagccacggggagctggggcagaggatcgactacgtcttcaaggtggtgctcatcggcgactccgcggtgggcaagtcgcagctgctcgcgcgcttcgcccgcaacgagttcaacctcgactccaaggccaccatcggggtcgagttccagacgcgcaccctcaacatcgacaagcgtaccgtcaaggcgcagatctgggacaccgctggacaggagaggtatcgagctgtaacaagtgcctactacagaggtgcagttggagctatgttagtatatgacataaccaagcgccagtcctttgatcatgtggctaggtggcttgaggaactacgtggccatgcagataataacattgttatcatgcttattggtaacaaatccgatctaggcacgcttcgtgccgtgccaacggaggatgctaaggagtttgctgagcgagaaaaccttttcttcatggagacctctgcccttgaggctgtcaatgttgagggtgccttcacaactgtcctgacagagatttaccggattgtcagcaagaaaaaccttattgccaatgaggagtctgattctagtggaagttcaagtctactgaaaggaaccaagattattgtccctggtcaggagccaccccctgcatccaaggcaacatgttgtatgtcctcctaggaatgatgttgtaccatgctgtttctggtagctggagtttctgattactccctaccgaatctgcagactgaatggctgggattcttgggagtaaagatgagaaggtctacaggaatatttaactcatatgcattgtaattttctcgcgactgcccttcttttttgtctgatcatgtgatatagtgcagtcatt

SEQ ID NO: 21400 - protein, 226 aa, Panicum virgatum
  misc_feature: Ceres CLONE 1815961
  misc_feature (19)..(180): Pfam Name: Ras Pfam Description: Ras family
  misc_feature (19)..(133): Pfam Name: Miro Pfam Description: Miro-like protein
  misc_feature: SWISSPROT Homolog: EC 2.7.11.1 Non-specific serine/threonine protein kinase
  misc_feature: Useful for making plants with altered lignin content
  misc_feature: Useful for making plants with altered alkaloid content
  misc_feature: Useful for making plants with altered terpenoid content
MSRGGSHGELGQRIDYVFKVVLIGDSAVGKSQLLARFARNEFNLDSKATIGVEFQTRTLNIDKRTVKAQIWDTAGQERYRAVTSAYYRGAVGAMLVYDITKRQSFDHVARWLEELRGHADNNIVIMLIGNKSDLGTLRAVPTEDAKEFAERENLFFMETSALEAVNVEGAFTTVLTEIYRIVSKKNLIANEESDSSGSSSLLKGTKIIVPGQEPPPASKATCCMSS

SEQ ID NO: 21401 - DNA, 313 bp, Panicum virgatum
  misc_feature: Ceres CLONE 1815991
  misc_feature: Encodes the peptide sequence at SEQ ID NO. 21402
acctctgcacaaccgcgtccgcttcccccccgccacaggagatcccctgcgcccgccgcatccctgtagccgcccctgctgccgccggcgagcccgatccgcagccgccatgtcgccgtcggagccgacgcgtgaggagagcgtgtacatggcgaagctggcggagcaggcggagcggtacgaggagatggtggagttcatggagcgcgtggcgcgctcggcgggcggcgccggcggcggggccgtgctctccgtcggggtgcgcctcctgctgtccgtcgcctccgccgcgtcgtcgctgcccgccgggcct

SEQ ID NO: 21402 - protein, 67 aa, Panicum virgatum
  misc_feature: Ceres CLONE 1815991
  misc_feature: The sequence is a functional homolog of SEQ ID NO 2350 in the 10/374,780 US patent application
  misc_feature: The sequence is a functional homolog of SEQ ID NO 344 in the 10/412,699 US patent application
  misc_feature: The sequence is a functional homolog of SEQ ID NO 790 in the 10/225,066 US patent application
  misc_feature: The sequence is a functional homolog of SEQ ID NO 805 in the 11/479,226 US patent application
  misc_feature: The sequence is a functional homolog of SEQ ID NO 786 in the 11/479,226 US patent application
  misc_feature: The sequence is a functional homolog of SEQ ID NO 789 in the 11/479,226 US patent application
  misc_feature: Useful for making plants with modulated water use efficiency
  misc_feature: The sequence is a functional homolog of SEQ ID NO 809 in the 11/479,226 US patent application
  misc_feature: Useful for making plants with modulated drought sensitivity
  misc_feature: The sequence is a functional homolog of SEQ ID NO 801 in the 11/479,226 US patent application
  misc_feature: The sequence is a functional homolog of SEQ ID NO 342 in the 10/412,699 US patent application
  misc_feature: The sequence is a functional homolog of SEQ ID NO 782 in the 11/479,226 US patent application
  misc_feature: The sequence is a functional homolog of SEQ ID NO 797 in the 11/479,226 US patent application
MSPSEPTREESVYMAKLAEQAERYEEMVEFMERVARSAGGAGGGAVLSVGVRLLLSVASAASSLPAG

SEQ ID NO: 21403 - DNA, 181 bp, Panicum virgatum
  misc_feature: Ceres CLONE 1816003
  misc_feature: Encodes the peptide sequence at SEQ ID NO. 21404
cttgcctgtgcccgacgggacccgtccggagctccccatgctttgacatggcggagtccctgtaccggcctgggtcgacccccctgttcctcccgggcccggtgaacatcccggacctcgtcctccccgccctgaaccgcccgaacaaggactaccgctccccggcctgtgcctgccctca

SEQ ID NO: 21404 - protein, 44 aa, Panicum virgatum
  misc_feature: Ceres CLONE 1816003
  misc_feature: SWISSPROT Homolog: EC 2.6.1.45 Serine--glyoxylate transaminase
  misc_feature: Useful for making plants with modulated nitrogen use efficiency
MAESLYRPGSTPLFLPGPVNIPDLVLPALNRPNKDYRSPACACP

SEQ ID NO: 21405 - DNA, 474 bp, Panicum virgatum
  misc_feature: Ceres CLONE 1816004
  misc_feature: Encodes the peptide sequence at SEQ ID NO. 21406
agggctccatccggtctgcctctgctccccttaaccgcccccgccctggcgacctgctccagaatccccttcccctgcttcctcgtggcgcccctgctgctgctgctgcttccgtcgtcctccaccgcccgcccggaggaggcggcggcggtgctgaccccggaccccggccacttctcggaggtggtggccgcccccccgttcatcatcgttgagttctccgccccctggtgtggcccctgccagccactagctccagagtacgataaggccgcgtccctcccgagcacacatgacccaccggtcgttcttgccaaggttgatgcccgcgactagacaaataaggatctcaccggcaagtacgatgtgaaggggttccccaccatgcagatcttgacgaaccagggggagaatgtgcaggagtacaatggcccccgggacgcagatggcatagtggagtacctgaagaagcag

SEQ ID NO: 21406 - protein, 111 aa, Panicum virgatum
  misc_feature: Ceres CLONE 1816004
  misc_feature: SWISSPROT Homolog: EC 5.3.4.1 Protein disulfide-isomerase
RAPSGLPLLPLTAPALATCSRIPFPCFLVAPLLLLLLPSSSTARPEEAAAVLTPDPGHFSEVVAAPPFIIVEFSAPWCGPCQPLAPEYDKAASLPSTHDPPVVLAKVDARD

SEQ ID NO: 21407 - DNA, 640 bp, Panicum virgatum
  misc_feature: Ceres CLONE 1816024
  misc_feature: Encodes the peptide sequence at SEQ ID NO. 21408
ccccgccccccctgatcgcctgagccatcgccttcctccaccccacctctctccgccgccgccgccgccgccgccgcctccgggagaccgggacccgatcacgcgcgcagaccccacgcgcggccggctgccccccgtccctccgtcgtactacgccgcttctgctccgccccctccggttcaagggagatttagggcggagggggacctgaggagcgtcggccatgccgggaggggaggacgtccgcaaggtctcgcggcaggacatacagcttaatctcattgaacgttttcttcagctctatatgaaccagaaagaagtggttgatactctatctttgcaggcaaaaatagaacctagtttcactgaacttgtgtggcagaaacttgaggaagagaatcgtgagttttttaaggcatactatgtcaggctaatgcttatgaatcaaatagtagccttcaataagctccttgagcagcagtatcaaattatgagtaaagatcatccttctggagtaccttctatgcctcccactgctcctaatggctcaaactctagcgcattgaacccacatgtgccctttctgccagacactatcccccgtactgcaatgcaagatagcttgctgcctaatggagg

SEQ ID NO: 21408 - protein, 138 aa, Panicum virgatum
  misc_feature: Ceres CLONE 1816024
  misc_feature: Useful for making plants with modulated water use efficiency
  misc_feature: Useful for making plants with modulated drought sensitivity
MPGGEDVRKVSRQDIQLNLIERFLQLYMNQKEVVDTLSLQAKIEPSFTELVWQKLEEENREFFKAYYVRLMLMNQIVAFNKLLEQQYQIMSKDHPSGVPSMPPTAPNGSNSSALNPHVPFLPDTIPRTAMQDSLLPNG

SEQ ID NO: 21409 - DNA, 1724 bp, Panicum virgatum
  misc_feature: Ceres CLONE 1816039
  misc_feature: Encodes the peptide sequence at SEQ ID NO. 21410
gaccaagcagcaaaggaaagggaaacgtgaaaaatcgcggaacacacccttccagccttcctccactagcgccagtgcgccaccgcactagcaagtagcaacccccctccctccctgctcggcgggacggcggctctcaattcgacccctcccctcccccaactcgctcgtccctccagcactggcgcgctgagggccgcctccgcacgacgcgcaccggtcgtccccccgcctcggtgccgtctctacctatctcgcagccgcggcggcgcggcgcgctcctccgccggctggcctgcccctagtggctccaccggacaggcccttgcaactgccaaggtgggggagcatgtcgagtgcggcggtgaacgggctggccggtgccggcggtggcatcatcgcgcagatcatcacctaccctctccaaacagtgaacacccggcagcagacagagcggtcggcgaagaagaggaagcccgggggcggccccaccgatacctctaccctcttccaattgctccagctgatccaaacggaagggtggggtgggctgtacagcggcctcaagccctctctcgttggcaccgccgcatcgcagggaatctattactacttctaccagattctgaagaacaaggttgaacatgtagcagttgctcgtggtaagaaaggcctcggggatggtactgttgggatgctctcttggcttggtattgctgctgttgctgggtcaatcaatgttcttcttaccaatccaatatgggttattgtgacacgcatgcagacacatacacaagcagaaaggaagatcttggagtctaagaaggaccttttactgaatgaaatatatagggccaattcattggaggtttcaattctgaaggataggttggttaaattggagtctgaaaaacctcatccatacggtacacttcaagcgatccgggaggtttatcgtgagtctggcataagaggattttggaaaggacttgttccaacgttaatcatggtatgtaacccatcgattcagtttatgatatatgaaacaatggcaaagcgtctccagtcaaagggttctggaaagcagctacctaaaaggaacctcactgctatggaggtattcttgttgggtgcaatagcaaaactgggagctactgttatcacttacccattgctagttgtcaagtctaggttgcaagcaaaacaagaaataggcaggaatgtgatgtccagatacacaggtacaatagatgcgataataaagatggtccgttacgaaggatttcatgggttttacaaaggaatgggtacaaagattgtgcaaagtgtctttgccgcctcagttctctttatggtaaaagaagagttggttaagttagcagtgcttttagttgccaggagtaggactatgcttcttactacgtccaagaaaagataggtgtattccatgacgaatttttttttttagaaatgatatccccttcatcatctcttgttgacctctttttgcctcgataaagttgcagtccaagactccaaacgcgagttggttcccgctcatagtgttatgtatggagaaatagaagtcagtcgattagtttctttgttctgtgttataccccttgcatagctgcctatatatgtcaaattgtcaatcaaggataacatcatcaggaatttattgcagattttggggtttactggtagcgcaagctatatgtttt

SEQ ID NO: 21410 - protein, 362 aa, Panicum virgatum
  misc_feature: Ceres CLONE 1816039
  misc_feature (253)..(348): Pfam Name: Mito_carr Pfam Description: Mitochondrial carrier protein
  misc_feature (118)..(242): Pfam Name: Mito_carr Pfam Description: Mitochondrial carrier protein
  misc_feature (3)..(101): Pfam Name: Mito_carr Pfam Description: Mitochondrial carrier protein
MSSAAVNGLAGAGGGIIAQIITYPLQTVNTRQQTERSAKKRKPGGGPTDTSTLFQLLQLIQTEGWGGLYSGLKPSLVGTAASQGIYYYFYQILKNKVEHVAVARGKKGLGDGTVGMLSWLGIAAVAGSINVLLTNPIWVIVTRMQTHTQAERKILESKKDLLLNEIYRANSLEVSILKDRLVKLESEKPHPYGTLQAIREVYRESGIRGFWKGLVPTLIMVCNPSIQFMIYETMAKRLQSKGSGKQLPKRNLTAMEVFLLGAIAKLGATVITYPLLVVKSRLQAKQEIGRNVMSRYTGTIDAIIKMVRYEGFHGFYKGMGTKIVQSVFAASVLFMVKEELVKLAVLLVARSRTMLLTTSKKR

SEQ ID NO: 21411 - DNA, 1879 bp, Panicum virgatum
  misc_feature: Ceres CLONE 1816042
  misc_feature: Encodes the peptide sequence at SEQ ID NO. 21412
aaaccgcgccagagcgcctcccttgctctgtttgctggctaggctagcctggctctcttccatgcatgctcaagatcgacctccatggctccattccacccatcccccaaaatccagaaacagtaatcaaacgaagagggcagaaacatcctttgcatctcatacagaactcatcagagagaggccgaccagatttctttacaaggtttcttgagccctgatcgagtggccatcaatttaaggttcatgattctcgacgtcaggggcaacccgcgaggagttgatgatgtcgcgtaagaagagcgccggcgcgccgtggcggcggaacagtgacgagtccgtgtccccgaggtgtgtcctggacgacggctacacgacgagcagcaacagcagcggcaccatgggcaccagcagcgcgggagcggcgacgacgacgttcccggccgccacggcggcgacgacgacgtacgccgccgacgcggccgcgtcggcgcggcaggacgggccgccgccgtggaaggccgtggcggaggcgtggcgctcccgggccaagcgccagctctccgggcgcatcccgccgctgggccccgcggtgtcgtcgacgctccggcgcctgagcgtccgccggccgccggccgaggaggaggtggcgcgcgagttctgcgtcctcaagccgtccctccgcaccttctccctcgccgagctccggaaggccacccgcaacttcagcaaggagaacgtggtgggccggggcgggttcgccaaggtgtaccggggcagcctccccggcggcgagctggtggcggtgaagaagctgacggcggcgcagggcgcggagcggatggaggggttcctggcggagctggggcacgtggtgaacgtgagccaccccaacatcgccaggctcgtcggcgtgggcgtcgacggcggcgagcacctcgtgttccccttctcccgcctcggctgcctctccgggatgctccacggcggcggcggcgccgagccgatgccgtgggaggccaggtaccgggtggcggtgggcacggcgcgcgggctcgagtacctgcacgagcgctgcgcccggcggatcgtccaccgcgacatcaagcccgccaacatcctcctcatggacaactacgagccactgatctgcgacttcgggctggcgaggtggctgccggcgaagctgacgcacctgcaggtgacggtgttcgagggcaccttcgggtacgtgccgccggagtacaccacgcacggcgtgttcagcgagaagaccgacgtgtacgcgctcggcgtcgtgctgctggagctcctcaccggccgccgcgccatcgacgccgccaagctcagcctcgtctcatgggcgaagcagtacttggtcgacggcgaggaagacgagatgctcaagatagccgacccggcgctgggcggccggtacgacgccgagcagctccggaacgtggcgtgggcggccaagctctgcgtccaagcctccccagaccacaggccgcagatgagcaaggtggcgcagatactagtaggggagaggacgaaggtgcatccatggggagaacggcatagggggagccaccatccagcaggagagctgcacgatgaaacggacggctacgatgcagccccgggatacctggatgatctgagccgccataaggcgctcgccttcgacttcgacggggaatccacaccacggacacatgttggtccttattcttgaagtctaggcaagaccttttattgtgcttgaagtgtatattttgtacatacacgttaattaagttgtgcattgtaaatgatttgatgagaaaggtctgtacatttcgtcgtgcactgggaataaaattaaaatttagatcttgtc

SEQ ID NO: 21412 - protein, 483 aa, Panicum virgatum
  misc_feature: Ceres CLONE 1816042
  misc_feature (148)..(396): Pfam Name: Pkinase Pfam Description: Protein kinase domain
  misc_feature: SWISSPROT Homolog: EC 2.7.11.1 Non-specific serine/threonine protein kinase
MMSRKKSAGAPWRRNSDESVSPRCVLDDGYTTSSNSSGTMGTSSAGAATTTFPAATAATTTYAADAAASARQDGPPPWKAVAEAWRSRAKRQLSGRIPPLGPAVSSTLRRLSVRRPPAEEEVAREFCVLKPSLRTFSLAELRKATRNFSKENVVGRGGFAKVYRGSLPGGELVAVKKLTAAQGAERMEGFLAELGHVVNVSHPNIARLVGVGVDGGEHLVFPFSRLGCLSGMLHGGGGAEPMPWEARYRVAVGTARGLEYLHERCARRIVHRDIKPANILLMDNYEPLICDFGLARWLPAKLTHLQVTVFEGTFGYVPPEYTTHGVFSEKTDVYALGVVLLELLTGRRAIDAAKLSLVSWAKQYLVDGEEDEMLKIADPALGGRYDAEQLRNVAWAAKLCVQASPDHRPQMSKVAQILVGERTKVHPWGERHRGSHHPAGELHDETDGYDAAPGYLDDLSRHKALAFDFDGESTPRTHVGPYS

SEQ ID NO: 21413 - DNA, 606 bp, Panicum virgatum
  misc_feature: Ceres CLONE 1816055
  misc_feature: Encodes the peptide sequence at SEQ ID NO. 21414
agctcctgctcttgcacctactcccctcgctctctgtgtctctcgcccccccccccgaggcccgagcggtcggtgatggcagccccggcgtggctgtgcgggctcgtctcgctcctggcggtagccgccgccgcggcggcggatggggagtgggagccgctgatacggatgccgacggaggaggggggcgacgctgctgctgctgctccggcggccgaggatgaagtggggacgaggtgggccgtgctcgtggcgggatcctccggctacggcaactaccggcaccaggccgatgtatgccatgcataccagatactgcagaagggaggagtgaaggaggagaatattgtggtgttcatgtacgatgatattgcccataacattctgaacccaaggcctgggattatcattaaccatcctaaaggtgaaaatgtatataccggtgttccaaaggactatacaggtgatcaggtcactactgaaaatttctttgctgtgctcttgggcaataaaagtgcaattactggagggagtaagaaggttatagacagtaaaccaaatgaccacatatttatctattactcagatcatggtggtcctggagtt

SEQ ID NO: 21414 - protein, 176 aa, Panicum virgatum
  misc_feature: Ceres CLONE 1816055
  misc_feature (54)..(176): Pfam Name: Peptidase_C13 Pfam Description: Peptidase C13 family
  misc_feature: SWISSPROT Homolog: EC 3.4.22.34 Legumain
MAAPAWLCGLVSLLAVAAAAAADGEWEPLIRMPTEEGGDAAAAAPAAEDEVGTRWAVLVAGSSGYGNYRHQADVCHAYQILQKGGVKEENIVVFMYDDIAHNILNPRPGIIINHPKGENVYTGVPKDYTGDQVTTENFFAVLLGNKSAITGGSKKVIDSKPNDHIFIYYSDHGGPG

SEQ ID NO: 21415 - DNA, 1490 bp, Panicum virgatum
  misc_feature: Ceres CLONE 1816083
  misc_feature: Encodes the peptide sequence at SEQ ID NO. 21416
atctgcccgccaaagtagccaccacaagaggccgtgccccgcgcgccccctgcccccgccgcgccatgtcccgcctcgacgcggcctcgctcctcgcccccgcctggccgccgcgggccaagccccgcccccgcggccgcctcctgtgcctcggcctctccgccacgctcgcctccctctcgctgctcctcttcttcgcgctccgtcccgcgcccagcccggcccccaactacggcgcactcttcctctccctcggttccaacgacaccgccgccgcgcacctccgcgcgctcaccctccacccgcacgtcgcggggaccagggccaactccctcaccgcccgctacgtgcgcgacgcgctctccttccccgcccacgtcacgccctactccgtgctcctctcctaccccgtccaccgctcgctctccctctcggcgccgggccgcggcgccgccgccacctccttcgccctgaggcaggagacctaccggggcgacccctacgcggccgccgcggcggaggccgtcccgacgttctacgcgtacgccgcgtccgggtcggtctccgcggaggccgtgtatgccaactacggccgcgaggaggacttcgcctacctcgccgcccgcggcgtcgacgtcgcgggcaaggtcgcgctcgcgcggtacgggaggatccactgcgaggacatcgcgcacaacgcgcgcgccgcgggcgccgcggccgccgtggtgtacacggacccgctccagtacggcggcgcccccggggaggcgccgttccccgactcccggtggctgccgcccagcggcgtgcaggtgggcagcctgttccgcggcgtgggcgacccgacgacgccgatgtgggcgtcgtccgagggctgcgagcgcctcagcgtcgaggaggccatgcgcaccgacgacatgccgctcatcccggcgctgccggtgtcggcgcgcgacgcgatggagatacacggcgccatcggcggggccgtggcgccggcgggctggcagggccgggaggacagccccgtgtaccgcctcgggcccgggccggcggttctgaacctgacgtatcttgggaacgatacgatggcaacgatcgagaatgtctttgccgtcatcgaaggcgctgaagagccagataggtatgttattctgggtaaccatcgtgatgcttggacgtttggagcatccgaccccaacagcggaaccgcagctatgattgaggcaacttattacgtatcgcgcgccaagaggaaggcgctgctggcggggtgaggtgacagcacgagatggagctcacatggccgcagtatctccccggagaacctagggtgtgtttagttcgcgaaaaagttaatgtagtatgtttcggttttatttggtaattattgtccaattataaagtaattagtctcaaaagattcgtctcgtcatttacaacaaaactgtgtaattagttatatttttaactatatttaatactct

SEQ ID NO: 21416 - protein, 404 aa, Panicum virgatum
  misc_feature: Ceres CLONE 1816083
  misc_feature (161)..(266): Pfam Name: PA Pfam Description: PA domain
  misc_feature: SWISSPROT Homolog: EC 3.4.17.21 Glutamate carboxypeptidase II
MSRLDAASLLAPAWPPRAKPRPRGRLLCLGLSATLASLSLLLFFALRPAPSPAPNYGALFLSLGSNDTAAAHLRALTLHPHVAGTRANSLTARYVRDALSFPAHVTPYSVLLSYPVHRSLSLSAPGRGAAATSFALRQETYRGDPYAAAAAEAVPTFYAYAASGSVSAEAVYANYGREEDFAYLAARGVDVAGKVALARYGRIHCEDIAHNARAAGAAAAVVYTDPLQYGGAPGEAPFPDSRWLPPSGVQVGSLFRGVGDPTTPMWASSEGCERLSVEEAMRTDDMPLIPALPVSARDAMEIHGAIGGAVAPAGWQGREDSPVYRLGPGPAVLNLTYLGNDTMATIENVFAVIEGAEEPDRYVILGNHRDAWTFGASDPNSGTAAMIEATYYVSRAKRKALLAG

SEQ ID NO: 21417 - DNA, 1769 bp, Panicum virgatum
  misc_feature: Ceres CLONE 1816088
  misc_feature: Encodes the peptide sequence at SEQ ID NO. 21418
agctcgcggccgtacgcttccgagctgcacgcgtctcacctcgcccgaccgacctcgtcgccggcgatggcttccgcggtggccgcttcgaccgccgctcggttcctaccgcagcttggggcctcgtggctgcgtcgcgcacgcgtggcgctccttccgtcgccgctcccatggcggcctctcgcggtcacggtggccgccgcgtcgcggcgccctcgggatggggaaggcggggggcggaggagaacgcggaggcggcgcgccaggggtgcggagcaggaggaaggcgtctcgctcagctccgaaaaggacacagtaaattctactccaggtgctcaaatcagcaagggcaccgaggctgtaccagagtccagcatgaccgggaaaggttcggccattagaagggtcacactggtgattctcgctgcagtgctttttggaattagcattgctttgaaggatggagctgaaaaggcatcggagtattttgctgggtatttattggaacagagtttgtcggtggacaatctctttgtttttgttctggtttttaagtatttcaaagtgccgaaggaataccagaaccgagtactttcttatggtattgctggagcagtggtgttccggactgtgatgatcatccttggggtcgctaccattcagaaatttgaggcggtgaacctgctgttggctttgatcctactattcacttcttacaagctattttctggagaagaagaagaatctgatctatccgataacttcgttgtgaaaacatgccaaaagttcattccagtcactgattattatgatgatgaccggtttttcactagtcaagatggcttatggaaagccacaccattactcttgactttggcagtgattgagctgagtgatattgctttcgctattgactctataccagcagtcttcggcgtcacaagggatccacttataatactatcatcaaatatttttgctatttctggtttgcggtcactgtacgtgctcatttctgaaagcatggccgaattggagtatctacagcctgctattggtatcgttttgggcttcatagggacaaagatgatctttgacttttttggttatcatattccaacagaagcttcacttgctattgttaccacctgtcttagcggaggtgtcatattaagtcttaggaaagcatcaaaagaggagggggacaagtagagaaatgcaacgacctatgcagtgatcaagaatcatgtcaagtatcaaccatgtttgcaactgacgaggacttagtgtacttcattcactgttcatgtttggaagtaggaggccttgaagacatttgcaattcacgtaacacccttgttgcactagtggtagtctccactacttagctgacttaagcagttcagcggacggctttgagtatgtgacctcagtataaaatggtagatgcgatcaggacatgacattgatgcctgatcctgatctggaagttccaattgaagactgcaggctgaaaacataggaatcctgcccttgtaatgtctgttgcttgttaagctagcacatagagtacattctgaacatgatgggcaatgaactacaatttacagtgtaactcaaacaatagtatgctccagcttaatacattacaacaacaacaacatagcttaatacattacaaaaatatggttttttatcattatatttcatccatgtagctaatgcttctgacctgaggtgtcaaatgaatttattccctatcatgcagt

SEQ ID NO: 21418 - protein, 381 aa, Panicum virgatum
  misc_feature: Ceres CLONE 1816088
  misc_feature (139)..(256): Pfam Name: TerC Pfam Description: Integral membrane protein TerC family
MASAVAASTAARFLPQLGASWLRRARVALLPSPLPWRPLAVTVAAASRRPRDGEGGGRRRTRRRRARGAEQEEGVSLSSEKDTVNSTPGAQISKGTEAVPESSMTGKGSAIRRVTLVILAAVLFGISIALKDGAEKASEYFAGYLLEQSLSVDNLFVFVLVFKYFKVPKEYQNRVLSYGIAGAVVFRTVMIILGVATIQKFEAVNLLLALILLFTSYKLFSGEEEESDLSDNFVVKTCQKFIPVTDYYDDDRFFTSQDGLWKATPLLLTLAVIELSDIAFAIDSIPAVFGVTRDPLIILSSNIFAISGLRSLYVLISESMAELEYLQPAIGIVLGFIGTKMIFDFFGYHIPTEASLAIVTTCLSGGVILSLRKASKEEGDK

SEQ ID NO: 21419 - DNA, 612 bp, Panicum virgatum
  misc_feature: Ceres CLONE 1816091
  misc_feature: Encodes the peptide sequence at SEQ ID NO. 21420
attctgactctgggtaagcaaggtctgctagctataggacgaagctgccgctcgcgcggcagatcagatcgatccagagggcggctgccttctccgccaccgtgggagctccggcctcccccccggccagctgcctcgggagggagcccccccggcagcaccaggcgaccgccgccgtgaactaccatggggagagctccggcgccaaccggctcagggtcgtgggcaaggggatcgactagccaaagcagaccgacgccgccaggaggaagggcctggccgacaacatctacgaccaccagcaagacatctccggggggaagggtctggtcgactccctcttccaggcgcccacgggggacggcagccacgaggccgtgctcacctcctacaagtacctgagccagggcctcacggactacagtgcctgggacaacatgaaggacggcttctacatcgcgccggccttcatggacaagctcgtcgtccacctctcaaagaacttcatgacaatgccaaacatcaaggttcccctcattctgtgtatctggggaggtgaggctcgaggacaatccttacaatgtgagcttgtcttcgcccagatgggcatca

SEQ ID NO: 21420 - protein, 58 aa, Panicum virgatum
  misc_feature: Ceres CLONE 1816091
  misc_feature: Useful for making plants with modulated biomass
MKDGFYIAPAFMDKLVVHLSKNFMTMPNIKVPLILCIWGGEARGQSLQCELVFAQMGI

SEQ ID NO: 21421 - DNA, 1904 bp, Panicum virgatum
  misc_feature: Ceres CLONE 1816098
  misc_feature: Encodes the peptide sequence at SEQ ID NO. 21422
atccggcggagagaccagaccaaacacgaaatccatccccaccgtcccctcgctccagcttccccttccgggcagcaatggagacgggacccaggtgagccgaccaaccggccagccagccagcccgcactggctctccgatggcgtgcctagtgccacagtttatgtgggtcccttccgccgccgcccacgggccctcctcctcctccaggtgctgcgccctccgcgtccactgcgccgtcacctccgccgccgccgttgtcgacgccgactgcgccaacggtggcggtgccgcgcatctcaggctcacttacgccgcgccggcgcttcagagaaactttgagtccactctagcatcagaggcacttctgaatgaagaagctgtagtagaagcggcggcagcagaggcagttgctcttgccagagcagctagcgaagctgttcgcgaagttgttcagatggtgcaaaataacaatcaccagccagtgattagacaaaataagggtgtggacagctacttggcaaatcaaattcttcgcacagagatacaagtgaacagtcccgatggatatgcaaatgatgctttgctggaggacttggagtcctatggtatcatggatgtggatggaaaattagatgatgatgcacagtacactgagaacatagctgtgaagtctgctcgccaatctgagagaagagctaggagaaccagagcagcaataaaggctgcaacaactgtccgtgcttcacaaaaaactgcaacatcttcaaagaagaaacggctcaagggttcctcacctagcatgaatcctttaggttccttgtggaagatgactggcaggagacttcttacagctaaggaagaagttgagttctcagaaggcattcaggatcttttgaagctcgaggcaatccaagctgagcttacagagtacaatggtggacagccaacattctcgcagtgggcaacagcagctggaactgatgagaaaactttgcggaagcgtctggatcatggtatttattgcaagaacagaatggtaacatctaatgtgagacttgtaatatctattgccagggagtttgaaggccctggaatggatctttatgatcttattcaggaaggaatgcagggccttataaggggagctgaaaaatttgatgcgtcaaaaagttttaggttctctacatattctcactggtggataaaacaagcaattcgcaaatctgtctcggagcaatcccaaatatttcgcttgccagctcacatggttgaagcaagttaccgtgtaaaggagtgcacaaaacgactgcgccgtaagcttagaagacggcccactaatgaagaaatagcagtggacactggtatgccaatcaaacgagtagaggcagcagtaaacctcccaaagtacagtgtatcccttgatagtaagattggttccacagacatgacttatcaggaagtcacagctgatcccagcgccgagacagctgaagagatgctgaacagattatctatgaagaacgatgtgcaccaggcactggacactttgaccccacgcgagaagcaagttgttgtgctgagatttgggctcgaggatggtcgaataagaaccctgcaggtgattggcaacatcatgggtgtgagcagggagcgaattcggcaaatcgagtctggcgcatttcggaaactaaggagcaagaaaagggtgaaagctctgaaggattatctagtgccggtaggcaattggtgaaccatttgtctccgcagcatttttttttccttttgaattcctcagtttttttttttcttttcgaggattctttacttgtaccacttacacgggtcctcatgtactacacaacatcagaagatttgtttcacaagagtagtttagtttttc

SEQ ID NO: 21422 - protein, 537 aa, Panicum virgatum
  misc_feature: Ceres CLONE 1816098
  misc_feature (374)..(455): Pfam Name: Sigma70_r3 Pfam Description: Sigma-70 region 3
  misc_feature (467)..(520): Pfam Name: Sigma70_r4 Pfam Description: Sigma-70, region 4
  misc_feature (300)..(370): Pfam Name: Sigma70_r2 Pfam Description: Sigma-70 region 2
MACLVPQFMWVPSAAAHGPSSSSRCCALRVHCAVTSAAAVVDADCANGGGAAHLRLTYAAPALQRNFESTLASEALLNEEAVVEAAAAEAVALARAASEAVREVVQMVQNNNHQPVIRQNKGVDSYLANQILRTEIQVNSPDGYANDALLEDLESYGIMDVDGKLDDDAQYTENIAVKSARQSERRARRTRAAIKAATTVRASQKTATSSKKKRLKGSSPSMNPLGSLWKMTGRRLLTAKEEVEFSEGIQDLLKLEAIQAELTEYNGGQPTFSQWATAAGTDEKTLRKRLDHGIYCKNRMVTSNVRLVISIAREFEGPGMDLYDLIQEGMQGLIRGAEKFDASKSFRFSTYSHWWIKQAIRKSVSEQSQIFRLPAHMVEASYRVKECTKRLRRKLRRRPTNEEIAVDTGMPIKRVEAAVNLPKYSVSLDSKIGSTDMTYQEVTADPSAETAEEMLNRLSMKNDVHQALDTLTPREKQVVVLRFGLEDGRIRTLQVIGNIMGVSRERIRQIESGAFRKLRSKKRVKALKDYLVPVGNW

SEQ ID NO: 21423 - DNA, 1940 bp, Panicum virgatum
  misc_feature: Ceres CLONE 1816109
  misc_feature: Encodes the peptide sequence at SEQ ID NO. 21424
acgaagaagcgccgctctcccccagcttcccccaaaccccaaccatggcagccgccgtcgaccccgccgccgaccaaaaccctaagcctagggacgccgatccccacgtgcccgccgccgaagtggagcccgagttcgcggaggagtacgaagaggatggggaggaggagtacgacgatgaggaggagggggaggagctggacgggcccgcggccgcggcggcggagcgggagcgggtgcagtccgtgttcaagcggctctcgtccgaccccgtggccattcgcgtccacgacgtggtcgtcaagggcaacaccaagacgcgggacgagctcatcgaggcggaggtcggcgacctgctccgcgccgtccccaccgtgcaggagctgctccgcgcctccagcgtcgccacctcgcggctgcacaggctcgacgtcttcgatgccgtcaagatcacgctcgacgcggggccgcccgagctgcccggcaccaccaacgtcgtcatcgaggtcgtcgaggccgccaatcccctcaccggtaacgccggcgtctactcgaagcccgaggcaagatcttggtcgttggaagggtcacttaagttgaagaatttgttcggctatggtgacatctgggatgcatcaggttcctatggttgggaccaaactacagaggttggagttggagtctacctaccaaggtttaaatcagtaccaacaccattgatggcccgggcatctttgtcatcacaagattggctgaagttttcatcatacaaggagcgtctacttggcctttcatttggtttgattccaaccatgaaccatgacttgtcttacaaccttacatggtgtgccttaactgatccgtcgcatgcttcatcaaaggcgataaggaggcagttagggcataaccttctttctgcactgaagtacacatacaagatcgatcagagggattcacttctcaggccaacaaaaggatacgcatttcagtcaacttctcaagttggtggtctatgggataacaaggggttgaaattttttcggcaggagtttgatgtccgtggcgctgtgcctttgggattttataatgctgctctaaatgttggcgtaggagcgggtgtcattttaccacttggacaggggttcatgaattcgtcttcacctgtgcctgataggtttttccttggaggtcattcttctccagtttgcagcttgagtgggctgtcatccctgctgggttttagaacaagaggagttggccccacagaagcacggaggcttgtacccagtgaatcagacagtgactctgctgtcgctccaggaagggattacttgggaggtgatctggctgtgtctgcctttgctgacctttcttttgatctgcctctcaagttattcagagacgctggaatccacggtcatgcgtttctcactgctgggaaccttgcgaagttgtcggagggtgagtacaagaatttctcagtttctgaatttcagcgcacattcaggagctctgctggtgttggcattattttgcctactaaactattccgggtggaggtgaactattgttacattctaaagcaagctgagcatgacagtggaaagaccggaatccagttcagcttctcgtcacccatgtagaaacctgccgtgaaatgttttgcagccgaaatagcttctctttcccctgtagacttgtgtttgtccattgttcttgtcttactgaagcgattgcaaaacgattgtagtcgcatatcatcggcttttcttttgacgctcgtagtttggcgtgaggagcttgagcctagatttgctcattcttttttgtatctgtgaagttacttccctattctgacacgaaggatttacccttcacaactcagatactgcagtggtggataaaataaaattttgggccaagaatgtttacaccagttc

SEQ ID NO: 21424 - protein, 532 aa, Panicum virgatum
  misc_feature: Ceres CLONE 1816109
  misc_feature (187)..(532): Pfam Name: Bac_surface_Ag Pfam Description: Surface antigen
MAAAVDPAADQNPKPRDADPHVPAAEVEPEFAEEYEEDGEEEYDDEEEGEELDGPAAAAAERERVQSVFKRLSSDPVAIRVHDVVVKGNTKTRDELIEAEVGDLLRAVPTVQELLRASSVATSRLHRLDVFDAVKITLDAGPPELPGTTNVVIEVVEAANPLTGNAGVYSKPEARSWSLEGSLKLKNLFGYGDIWDASGSYGWDQTTEVGVGVYLPRFKSVPTPLMARASLSSQDWLKFSSYKERLLGLSFGLIPTMNHDLSYNLTWCALTDPSHASSKAIRRQLGHNLLSALKYTYKIDQRDSLLRPTKGYAFQSTSQVGGLWDNKGLKFFRQEFDVRGAVPLGFYNAALNVGVGAGVILPLGQGFMNSSSPVPDRFFLGGHSSPVCSLSGLSSLLGFRTRGVGPTEARRLVPSESDSDSAVAPGRDYLGGDLAVSAFADLSFDLPLKLFRDAGIHGHAFLTAGNLAKLSEGEYKNFSVSEFQRTFRSSAGVGIILPTKLFRVEVNYCYILKQAEHDSGKTGIQFSFSSPM

SEQ ID NO: 21425 - DNA, 2369 bp, Panicum virgatum
  misc_feature: Ceres CLONE 1816116
  misc_feature: Encodes the peptide sequence at SEQ ID NO. 21426
gcgttatgcacttgtttttgacatttgacacaccggagtaccggacctcctccctagttcccttcagcagtctccacagcgaccaccatggccacgcaccgcggcttttcttcccatctcgccggccttcttgccgcaacctgcttcctcctcgccggcgccgccctctatgcgccgctcaccgatgcgaaagaggaaccgccgccgtggctgttgtgcggccccgctcctgccagtggcaactacacggataacagcccctaccaagccaacatcaataagctctctgccactctccccaagaacgcctcctccaacccggttctctacaacatgagcagcgtcggctccatcccggatgtcgtctacgccctcgctttatgccgtggcgacgccaacgcctccgcctgcgagcgctgcgtggcgacggcctttcagggcgcgcagcaagggtgcccgctcttcaaggacgtgctggccttctacgacctctgccagctccgcttctccaaccgaaatttcttcccggacgacgactatttcgtcaccacctactacctcgtgggctcccaggtcatgagtgcgccgccggcgtttgacgccgctgtacgcctgctcgtcaacaccaccgccgagtacgcggcggagaactcgtcgaggagattcggcacgggggagcagggcttcgaggagagcgacaccaggatctacgctctgtcgcagtgcacgccggacagaacggtggacatctgccggacctgccttcgcaccatcactgatcagctgccgaagtctttcagtggggcgagtggcgggggaatttttggtgtctggtgcagcttccgctacgaggtgtatcctttcttctccggccgcccgctgctgcagctcccagcgttcgttgggacgtcacctgcgcctgcaccggcgaccaaaagtcaggacaaatcaagaaataaaataggtagagtccttgcaattgtgttgtcttcgatcgctgccctgctggctataaccgtgatatgcttttggaggaggaggagatccgcagcacaatcttttcgagcttattcaactagttcagataactatgaaggagccgatatgcttcttctcgatctgtcaacattgcgagctgctacaggagactttgctgaaagccaaatgctcggtaaaggagggtttggtatggtttataagggtgtgctacctgatggtcaagaaattgcggttaaaaggctttgtcagagttctagacaaggaattgcagagctgaaaagtgagctagttttggttgctaagcttcaccacaagaaccttgtaaggcttattggtgtttgcttgcaagagcaagagaaaatacttgtgtacgaatacatgcccaatagaagccttgataccattctttttgattctcaaagaaacgaagagctagattgggcaaagagattcaggatcatcaatggaatcgctagaggcttacaatatctccatgaagattctcaactgaagatagttcaccgggatctcaaagcaagtaatgttctattagacgtcgattacttacctaagatctctgactttggtttagcaaagatatttggcggggatgaatccaaatatttcacccatcgtgttgctgggacatatggatacatggcacctgaatacgcgatgcgtggtctgtattcaatcaagtctgatgtgtttagctttggtgttttggttctggagattgttactggaagaagaaacactggcccctataacagcgaccaagatgttgatctcttaaatcttgtgtgggagcactgggcgaggggaaatgtcttgcagttggtcgatccatctttgagcgaccatcctccagtggagcagatgttgaaatgcctccacatcgggttgctgtgtgttcagagaaaacctgcagctaggcccacgatgtcgtgggtaaacgtcatgcttagcagcggaacggtgcgtctcccttctctttccaggccagctttgtgcatcccggaggatagtcgcagtgacagctcaggtgcgtattcggcgggacagccaggagcttcagagtacaccgatgcttcagtggcaatatcatggaacgaagcatcgatcacggagctcatgccgagatgaatcttgaccgttcaagcatgaaatcatgcatatgtattatcttttcagaaaaaaatatcatgcatgtatattcagtcttttcggtgctagtattatttcctactactttctttcttggagataaggttgatgcagggagaggccctgtctcgccgaactgagttatcccggcactactgccatttgtaattgtactacttgtgatgttaacatgcctgattctg

SEQ ID NO: 21426 - protein, 685 aa, Panicum virgatum
  misc_feature: Ceres CLONE 1816116
  misc_feature (355)..(622): Pfam Name: Pkinase Pfam Description: Protein kinase domain
  misc_feature: SWISSPROT Homolog: EC 2.7.11.1 Non-specific serine/threonine protein kinase
  misc_feature: Useful for making plants with altered carbohydrate content
MATHRGFSSHLAGLLAATCFLLAGAALYAPLTDAKEEPPPWLLCGPAPASGNYTDNSPYQANINKLSATLPKNASSNPVLYNMSSVGSIPDVVYALALCRGDANASACERCVATAFQGAQQGCPLFKDVLAFYDLCQLRFSNRNFFPDDDYFVTTYYLVGSQVMSAPPAFDAAVRLLVNTTAEYAAENSSRRFGTGEQGFEESDTRIYALSQCTPDRTVDICRTCLRTITDQLPKSFSGASGGGIFGVWCSFRYEVYPFFSGRPLLQLPAFVGTSPAPAPATKSQDKSRNKIGRVLAIVLSSIAALLAITVICFWRRRRSAAQSFRAYSTSSDNYEGADMLLLDLSTLRAATGDFAESQMLGKGGFGMVYKGVLPDGQEIAVKRLCQSSRQGIAELKSELVLVAKLHHKNLVRLIGVCLQEQEKILVYEYMPNRSLDTILFDSQRNEELDWAKRFRIINGIARGLQYLHEDSQLKIVHRDLKASNVLLDVDYLPKISDFGLAKIFGGDESKYFTHRVAGTYGYMAPEYAMRGLYSIKSDVFSFGVLVLEIVTGRRNTGPYNSDQDVDLLNLVWEHWARGNVLQLVDPSLSDHPPVEQMLKCLHIGLLCVQRKPAARPTMSWVNVMLSSGTVRLPSLSRPALCIPEDSRSDSSGAYSAGQPGASEYTDASVAISWNEASITELMPR

SEQ ID NO: 21427 - DNA, 1585 bp, Panicum virgatum
  misc_feature: Ceres CLONE 1816123
  misc_feature: Encodes the peptide sequence at SEQ ID NO. 21428
aaaacccgcagagcttccctcgcaattagccccggcccggtatggatggaagtctctagaacacccccacgggcccttgatatccccatctcttcccttgcccctgcccacctaagacctcgattattctgttcgctcaccaagtctacttccggccgtctcccctccctctcgcccccagccacgcagccgccgccggccggagggggcgccatggccgcgtcggatctggggggcaaggccaaggaggccttcgtcgacgacgacttcgagctcgccgccgagctatacacccaggccatcgacgccgggcccgccaccgccgacctctacgccgaccgcgcccaggcgcacatcaagctcggcaactacactgaggctgtggcagatgctaacaaagcaattgaacttgatcctacgatgcataaagcctactatcggaaaggtgctgcatgcatcaaacttgaagaataccaaactgcaaagactgctcttgaattgggttcgtcctatgcaaatggcgactcaaggtttactcgtctgttgaaggaatgtgaagagcgcattgctgaggaggctagccaggcaccagtaaagaatgctgagacacctgccactgctactgttgaggacaaagaggatattgcaaatatggagaatgcacagccagtggtcgaacctccaagcaagcctaaatacaggcatgacttctacaacagtgctacagacgtggttctgacaatatttgctaaaggtgttcctgctgatagcgtggttgttgattttggtgaacagatgttaagtgtatccattgaagtccctggtgaagaaccatatcattttcagccccgtctgttcgctaagattatcccagagaagagcaagtatcaagtcttatccaccaaagttgaaatacgcctcgccaaagctgagcagttgacttggacaaccctggactatagtggcagaccaaaggcccttccccagaagataagcacaccagctgaaactgctccaagaccttcctacccatcttcgaagtctaaaaaagactgggataaattggaagctgaagtcaaaaaggaggagaaagatgaaaaacttgatggtgatgctgcgctgaacaagttcttccgtgacatctataaggatgctgatgaagatatgcggagggccatgatgaagtcatttgttgaatcgaatggcaccgttctctcgacaaactggaaagatgttggctcaaagaaggtggaaggcagccctcctgatggaatggagctcaagaagtgggagtactagagttgggtccaccccatcttgtaaatccgggtctcgcgagacatcatgtcctagttgcagacttgctggtcgctgtctgttcactcagttggattttgtgccatgcgcttggtcaagtttctgcatttgtaaggtgtctgtttgactctccagcttgtctgatactacctgtcgtagttctggacacagggtttgctttatctgtggtatccagtgcagaacacgtttgtggtaactgatactgcaaactatcatatgtgaaatgctatcttttttggccttggat

SEQ ID NO: 21428 - protein, 361 aa, Panicum virgatum
  misc_feature: Ceres CLONE 1816123
  misc_feature (278)..(359): Pfam Name: SGS Pfam Description: SGS domain
  misc_feature (162)..(238): Pfam Name: CS Pfam Description: CS domain
  misc_feature (37)..(70): Pfam Name: TPR_2 Pfam Description: Tetratricopeptide repeat
  misc_feature: SWISSPROT Homolog: EC 3.1.3.16 Phosphoprotein phosphatase
MAASDLGGKAKEAFVDDDFELAAELYTQAIDAGPATADLYADRAQAHIKLGNYTEAVADANKAIELDPTMHKAYYRKGAACIKLEEYQTAKTALELGSSYANGDSRFTRLLKECEERIAEEASQAPVKNAETPATATVEDKEDIANMENAQPVVEPPSKPKYRHDFYNSATDVVLTIFAKGVPADSVVVDFGEQMLSVSIEVPGEEPYHFQPRLFAKIIPEKSKYQVLSTKVEIRLAKAEQLTWTTLDYSGRPKALPQKISTPAETAPRPSYPSSKSKKDWDKLEAEVKKEEKDEKLDGDAALNKFFRDIYKDADEDMRRAMMKSFVESNGTVLSTNWKDVGSKKVEGSPPDGMELKKWEY

SEQ ID NO: 21429 - DNA, 1789 bp, Panicum virgatum
  misc_feature: Ceres CLONE 1816126
  misc_feature: Encodes the peptide sequence at SEQ ID NO. 21430
agctgaagcacggtcgagtagtacacacagcagggcctagtgtgtacacctaactgcagccatgccgcttgttccgtctttatttttattactacttctgcacctgtcctgttctccaactgtccagctagcagctgcagatgaacataagtacacactcgtgacaatgagctcgctgaaacccaaagctacgtgctccggatacagagtgtctccaccccagaacattacgtgggtaccactgaatcacccccatggaccgtgctcgccattgtcggacgctgcaacgccgtccttggccgagctgctccaccatgaccagctccgtgtcgacggcattcacatgaggctctctaacgacactcctggtgatagtaagaagacgcagtcggaccaaaattatcagacagagtcttacggcaatgtagttcatgcccacgttggcggagctggacacccccctcctttgaagcaccaaggttcttcccagcttcgtcgcaatattgatgcgtcagctgccgccgccggaagcaggtcatccagccttcccggagtgctccagacgttcgttttggacacagccagcgacgtgccgtgggtgcagtgcctgccctgccccatcccgccgtgtcacccccaggtggacagcttctacgacccaagcaggtcgccctcctccgcgcctttctcctgcacctccccgacctgcaccgggctcggcacctacgccaatggctgcgtcaacaaccagtgccagtaccgcgtcgtctacccggacggcacgtccacgtccgggagctacatcgctgacctgctcaccttcgacgccagcaacgccgttccaagcttcaagtttgggtgcagccatgccgagcagggcagcttcgacagccgggcggcggggattctggcgctcggcggcggccccgagtcgctgctgtcccagaccgcgtcccgttacggtaaggtcttcgcgtactgcatcccggcgtcgagcagctactccgggttcttcatcctcggcgtgcccagccttgcctcctccaggtacgttgtcacgcccatggtgaggttcagtcaggccacgttttacggcgtgcgcctccgtgccatcactgtcggtgggcagccgctcggcgtgggccccacggtgttcgccgccggctccgtgctggactcccgcaccgacattacgcgcctgccgccgacagcgtaccaggccctgcgcgccgcgttcagaagcagcatgagcatgtaccgctcggctccgcccaaggggatcctcgacacttgctacgacttcaccggcgtcgtcaacatcaagctgcccaagatcaccttggtgttcgaccggaacgccgtggtggtgctggactcctcgggcatcctcttccacgactgtctcgccttcgcctccaatgccaacgatcgcatgccgggcatcctcggcagcgtgcagcagcagaccattgaggtcctctacaacgtcgatggcggcaccgtgggcttccgccaaggcgcgtgctaagatatgatcgtggagatgactgcaggctacaagcaatctactactactatctagtgccaatttgcatggcaccccagcataaaataaactaattactagtgtgtactcgttcttgtgcgccaggtttggatggctgctgtttagtccttgtgtgtgtgtgtgtgtgcacaagctgctggctcattgtgacacaagacctagtttgctgtcatcatccaaattaataattgaacccaatgcaaggtttgcatactgctgttc

SEQ ID NO: 21430 - protein, 488 aa, Panicum virgatum
  misc_feature: Ceres CLONE 1816126
  misc_feature: SWISSPROT Homolog: EC 3.4.23.12 Nepenthesin
MPLVPSLFLLLLLHLSCSPTVQLAAADEHKYTLVTMSSLKPKATCSGYRVSPPQNITWVPLNHPHGPCSPLSDAATPSLAELLHHDQLRVDGIHMRLSNDTPGDSKKTQSDQNYQTESYGNVVHAHVGGAGHPPPLKHQGSSQLRRNIDASAAAAGSRSSSLPGVLQTFVLDTASDVPWVQCLPCPIPPCHPQVDSFYDPSRSPSSAPFSCTSPTCTGLGTYANGCVNNQCQYRVVYPDGTSTSGSYIADLLTFDASNAVPSFKFGCSHAEQGSFDSRAAGILALGGGPESLLSQTASRYGKVFAYCIPASSSYSGFFILGVPSLASSRYVVTPMVRFSQATFYGVRLRAITVGGQPLGVGPTVFAAGSVLDSRTDITRLPPTAYQALRAAFRSSMSMYRSAPPKGILDTCYDFTGVVNIKLPKITLVFDRNAVVVLDSSGILFHDCLAFASNANDRMPGILGSVQQQTIEVLYNVDGGTVGFRQGAC

SEQ ID NO: 21431 - DNA, 1339 bp, Panicum virgatum
  misc_feature: Ceres CLONE 1816160
  misc_feature: Encodes the peptide sequence at SEQ ID NO. 21432
aagttacccaagctaagcttaattgcggttagctgcctcgcactggtaagagggatcgatcgctcgaaatggagctctcgccggcgccggaggggaggtgggccgacctccccgaggacatcgccctcgccctcgcctcccgcctccaggaggccgacgtgtgcgcgctcggcggctgctcccgctcctggcgcgccgcctgcgacgccgactgcgtctgggagcgcctcttccgctgccgctggccggccgccgcggcggaagcggcagcagcatcccgtgtgcaggtaggtaaagagggaagctcttgttttagcgatatatataccgatcctgtagtcgtcctgactgaatttcatccgaatttgcgagtcatcctagctcaattttcaccgggattagaacctcgagctatacatcttcgggacttatagtatcatcatcctgccattaggctcgttctggaatttatctgatatatgcttattgatatcaaggaaattttacatatgcgtgatctgaggttgatattaatacgatttgcttcttgcgccaatcagaaaactattgttcttgcatacaaacttcttgaattttctactgaaaatgtgatgatgctcgccctgtggtcttagattatgctagtgaattgtcggacattcaatgtatctggaattgttagtagaaacgatgaagcctacgtcctgctatccttgtgcattattcttcgcttaatgcaatggcaatggcaatggcatttatcattgttcatgatgtgctgattataaagttattatctcttttatctgtaccccttcttcatttatcatgtgagagtgagaccttattagtttgtatcgggtggaatcaccaaactggatatgacttgcatgtaattttaagtcttcagctgtggttcaaaaattacctatttaactggttccattccatgaatataattattttcgctgtttgagcataaacatacaataattcagatgcttatccattttaaggctcaacttttagtggacaccgttggccctccaagcttcctctccattttctgtgacgtctcttatagagagaaagatatagaaaactgattggctgtatgcaacgcattagcatttagcaggctggcagaaccaatttatggaaccagaatgatacctgcctactacaagtcatattccttttagagattttgatacaaaaattgaaaataagttcaccccaagttgaatatctgatgtaccatttccggtgtattttctttatatacttttatgctcctgtgatactgaaagctggctgatcaaggtttcaagttttgtac

SEQ ID NO: 21432 - protein, 121 aa, Panicum virgatum
  misc_feature: Ceres CLONE 1816160
  misc_feature (9)..(56): Pfam Name: F-box Pfam Description: F-box domain
MELSPAPEGRWADLPEDIALALASRLQEADVCALGGCSRSWRAACDADCVWERLFRCRWPAAAAEAAAASRVQVGKEGSSCFSDIYTDPVVVLTEFHPNLRVILAQFSPGLEPRAIHLRDL

SEQ ID NO: 21433 - DNA, 661 bp, Panicum virgatum
  misc_feature: Ceres CLONE 1816160-R
gcagcttaaataacgggtggcttgaatctgaatgttatttgaaagctattgctgatctggcgttgacggctgatataggatttctcgatgtccagttttttttgttttcaaggaatcatagtgcaataataaacctcattggattgcactactcaattgcatctttgcatgttccgccaactgaagtcagtaaagcactccaagctcgccaagtagcaggaaggaaggtatgtgtgaacttgctcaagcttggtaggtggttctatggtttcaggttgcctgatgagcacgagtctcataaaatctctctgactgagctcaccatggctgagcgagcagaaattctagccattcttaaccgtggagctgttcacgaggtatttcgcctccgaatcagtttggcagacatagataagtgacataaaagtatgcataccacattaccataagtacttgccttatcgtgccctttgtaaatatgtataacttttttcatgtgatgccctcgtgcctctgcttatagttgtaaatgcaagaatagggatagatggaagtatggaaccatgtaaactttttggtacatagtcatgtataaaataaataacaatgccttgccatgtgtacacatttcgataaatgataatctctattgaatgttttc

SEQ ID NO: 21434 - DNA, 658 bp, Panicum virgatum
  misc_feature: Ceres CLONE 1816175
  misc_feature: Encodes the peptide sequence at SEQ ID NO. 21435
attccaagagcttcccccaaagcagagacctctctctccggcctgctggtaaaaccggcgagcttgcttccctgaccggccggcgagtcactcaccgctcgatctccggcgaaccaaccagcagcttcccctgatcggaatggactcgggtggcgcgctgcaaatgccgccggggttccggttccacccgacggacgaggagctggtgatgtactacctgctgcgcaagtgcggcgggctgccgctggcggcgccggtgatcgcggaggtggacctgtacaagttcgacccgtggagcctgccggagcgggcggcgggcggcgagaaggagtggtacttcttctcgccgcgggaccgcaagtaccccaacgggtcgcgccccaaccgcgccgccggcgccgggtactggaaggccaccggcgccgacaagcccgtgggggcgccgcgccccgtcgccatcaagaaggcgctcgtcttctacgccgggaagccgccgcggggcgtcaagaccaactggatcatgcacgagtaccgcctcgccgacgtcgaccgctccgccgccgcgcgcaagaagaccaataacaacgcgctcagggtaattaattttcccctttttaatctataatctttcaaaaaaaacttttttaaaaaaaatggt

SEQ ID NO: 21435 - protein, 161 aa, Panicum virgatum
  misc_feature: Ceres CLONE 1816175
  misc_feature (9)..(134): Pfam Name: NAM Pfam Description: No apical meristem (NAM) protein
  misc_feature: The sequence is a functional homolog of SEQ ID NO 890 in the 10/374,780 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 853 in the 10/374,780 US patent application
  misc_feature: The sequence is a functional homolog of SEQ ID NO 854 in the 10/374,780 US patent application
  misc_feature: Useful for making plants with modulated oxidative stress sensitivity
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: Useful for making plants with altered cell wall content and/or composition
  misc_feature: Useful for making plants with altered lignin content
  misc_feature: The sequence is a functional homolog of SEQ ID NO 891 in the 10/374,780 US patent application
  misc_feature: Useful for making plants with altered terpenoid content
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Useful for making plants with modulated water use efficiency
  misc_feature: Useful for making plants with altered alkaloid content
  misc_feature: The sequence is a functional homolog of SEQ ID NO 851 in the 10/374,780 US patent application
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: Useful for making plants with modulated light quality response
  misc_feature: The sequence is a functional homolog of SEQ ID NO 1012 in the 11/435,388 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: The sequence is a functional homolog of SEQ ID NO 852 in the 10/374,780 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 2592 in the 10/374,780 US patent application
  misc_feature: The sequence is a functional homolog of SEQ ID NO 288 in the 10/225,066 US patent application
  misc_feature: The sequence is a functional homolog of SEQ ID NO 320 in the 10/374,780 US patent application
  misc_feature: The sequence is a functional homolog of SEQ ID NO 850 in the 10/225,066 US patent application
  misc_feature: The sequence is a functional homolog of SEQ ID NO 2472 in the 10/374,780 US patent application
  misc_feature: The sequence is a functional homolog of SEQ ID NO 520 in the 11/435,388 US patent application
  misc_feature: The sequence is a functional homolog of SEQ ID NO 974 in the 10/225,066 US patent application
  misc_feature: The sequence is a functional homolog of SEQ ID NO 492 in the 11/435,388 US patent application
  misc_feature: The sequence is a functional homolog of SEQ ID NO 741 in the 11/479,226 US patent application
  misc_feature: The sequence is a functional homolog of SEQ ID NO 612 in the 11/435,388 US patent application
  misc_feature: The sequence is a functional homolog of SEQ ID NO 2 in US patent 7230164
  misc_feature: The sequence is a functional homolog of SEQ ID NO 6 in US patent 7230160
  misc_feature: The sequence is a functional homolog of SEQ ID NO 116 in the 10/225,066 US patent application
  misc_feature: The sequence is a functional homolog of SEQ ID NO 2476 in the 10/374,780 US patent application
  misc_feature: The sequence is a functional homolog of SEQ ID NO 88 in the 11/375,241 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: Useful for making plants with modulated nitrogen use efficiency
  misc_feature: Useful for making plants with altered carbohydrate content
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: The sequence is a functional homolog of SEQ ID NO 476 in the 10/666,642 US patent application
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: Useful for making plants with modulated light quality sensitivity
  misc_feature: The sequence is a functional homolog of SEQ ID NO 106 in the 10/225,068 US patent application
  misc_feature: The sequence is a functional homolog of SEQ ID NO 2348 in the 10/374,780 US patent application
  misc_feature: The sequence is a functional homolog of SEQ ID NO 340 in the 10/412,699 US patent application
  misc_feature: The sequence is a functional homolog of SEQ ID NO 778 in the 11/479,226 US patent application
  misc_feature: Useful for biocontainment applications
  misc_feature: Useful for making plants with modulated biomass
  misc_feature: The sequence is a functional homolog of SEQ ID NO 2590 in the 10/374,780 US patent application
  misc_feature: The sequence is a functional homolog of SEQ ID NO 286 in the 10/225,066 US patent application
  misc_feature: The sequence is a functional homolog of SEQ ID NO 162 in the 10/225,068 US patent application
  misc_feature: The sequence is a functional homolog of SEQ ID NO 2414 in the 10/374,780 US patent application
  misc_feature: The sequence is a functional homolog of SEQ ID NO 428 in the 11/435,388 US patent application
  misc_feature: The sequence is a functional homolog of SEQ ID NO 508 in the 10/412,699 US patent application
  misc_feature: The sequence is a functional homolog of SEQ ID NO 728 in the 10/225,066 US patent application
  misc_feature: The sequence is a functional homolog of SEQ ID NO 328 in the 10/374,780 US patent application
  misc_feature: The sequence is a functional homolog of SEQ ID NO 852 in the 10/225,066 US patent application
  misc_feature: The sequence is a functional homolog of SEQ ID NO 1816 in the 11/479,226 US patent application
  misc_feature: The sequence is a functional homolog of SEQ ID NO 2112 in the 10/374,780 US patent application
  misc_feature: The sequence is a functional homolog of SEQ ID NO 160 in the 10/666,642 US patent application
  misc_feature: The sequence is a functional homolog of SEQ ID NO 634 in the 10/412,699 US patent application
  misc_feature: The sequence is a functional homolog of SEQ ID NO 638 in the 11/435,388 US patent application
  misc_feature: The sequence is a functional homolog of SEQ ID NO 194 in the 10/374,780 US patent application
  misc_feature: The sequence is a functional homolog of SEQ ID NO 898 in the 10/225,066 US patent application
  misc_feature: The sequence is a functional homolog of SEQ ID NO 344 in the 10/666,642 US patent application
  misc_feature: The sequence is a functional homolog of SEQ ID NO 854 in the 11/435,388 US patent application
  misc_feature: The sequence is a functional homolog of SEQ ID NO 582 in the 10/666,642 US patent application
  misc_feature: The sequence is a functional homolog of SEQ ID NO 1365 in the 11/479,226 US patent application
  misc_feature: The sequence is a functional homolog of SEQ ID NO 2474 in the 10/374,780 US patent application
  misc_feature: The sequence is a functional homolog of SEQ ID NO 744 in the 10/225,066 US patent application
  misc_feature: The sequence is a functional homolog of SEQ ID NO 886 in the 10/412,699 US patent application
  misc_feature: The sequence is a functional homolog of SEQ ID NO 142 in the 10/286,264 US patent application
  misc_feature: The sequence is a functional homolog of SEQ ID NO 324 in the 10/412,699 US patent application
  misc_feature: The sequence is a functional homolog of SEQ ID NO 756 in the 11/479,226 US patent application
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: The sequence is a functional homolog of SEQ ID NO 108 in the 10/666,642 US patent application
  misc_feature: The sequence is a functional homolog of SEQ ID NO 332 in the 10/412,699 US patent application
  misc_feature: The sequence is a functional homolog of SEQ ID NO 1198 in the 10/412,699 US patent application
  misc_feature: The sequence is a functional homolog of SEQ ID NO 867 in the 10/374,780 US patent application
  misc_feature: The sequence is a functional homolog of SEQ ID NO 310 in the 10/666,642 US patent application
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: The sequence is a functional homolog of SEQ ID NO 240 in the 10/225,068 US patent application
  misc_feature: The sequence is a functional homolog of SEQ ID NO 368 in the 10/374,780 US patent application
MDSGGALQMPPGFRFHPTDEELVMYYLLRKCGGLPLAAPVIAEVDLYKFDPWSLPERAAGGEKEWYFFSPRDRKYPNGSRPNRAAGAGYWKATGADKPVGAPRPVAIKKALVFYAGKPPRGVKTNWIMHEYRLADVDRSAAARKKTNNNALRVINFPLFNL

SEQ ID NO: 21436 - DNA, 720 bp, Panicum virgatum
  misc_feature: Ceres CLONE 1816198
  misc_feature: Encodes the peptide sequence at SEQ ID NO. 21437
cgatcggcagggatcttcaagctgcccgtgttacagcagccaataagatacgcctttggaacaagggtgttgattcagaaagcttccatcctcgcttccgaaataaggaaatgcgttcaaggctgactaatggtgaaccagagaagccactaatattgtatgttggacgcttaggagtggagaaaagtttggattttcttaagagagtcatggatcgacttccaggatcaagaattgcgtttattggagatggcccattcagggctgagcttgagcagatgttctcaggtatgcctgcagtgttcacgggtacgttgcaaggggaagagctatcgcaggcatatgccagtggggatgtgtttgtgatgccttcggagtcagagacgctcgggtttgtggtgcttgaggccatgtcatcaggagttccggtagttggcgctcgagctggaggaatacctgatattataccagaagatcaggaggggaagaccagctttctgtacacaccaggggatgttgatgactgtgttagcaagatcgagcgtctcttgtcatgcgaggagttgcgagagatgatggggagggctgccaggaaggagatggagaagtttgactggcgagcagcgacgaggaagatccggaatgagcagtacagcgctgccatctggttctggcgcaagaagagggcacagctgctgaggcctgtccaatgggtgggtc

SEQ ID NO: 21437 - protein, 239 aa, Panicum virgatum
  misc_feature: Ceres CLONE 1816198
  misc_feature (35)..(199): Pfam Name: Glycos_transf_1 Pfam Description: Glycosyl transferases group 1
  misc_feature: SWISSPROT Homolog: EC 2.4.1.21 Starch synthase
  misc_feature: Useful for making plants with altered carbohydrate content
IGRDLQAARVTAANKIRLWNKGVDSESFHPRFRNKEMRSRLTNGEPEKPLILYVGRLGVEKSLDFLKRVMDRLPGSRIAFIGDGPFRAELEQMFSGMPAVFTGTLQGEELSQAYASGDVFVMPSESETLGFVVLEAMSSGVPVVGARAGGIPDIIPEDQEGKTSFLYTPGDVDDCVSKIERLLSCEELREMMGRAARKEMEKFDWRAATRKIRNEQYSAAIWFWRKKRAQLLRPVQWVG

SEQ ID NO: 21438 - DNA, 1159 bp, Panicum virgatum
  misc_feature: Ceres CLONE 1816207
  misc_feature: Encodes the peptide sequence at SEQ ID NO. 21439
ctcgcttccgtccctttccatcctctctgctctcctctctccctctacgccgcctccgctcgccgtcccaaatcagcggctcaccggccgcagcaggctcccgtctccatgggtctcctctccaacaggattgggaaggagaacctcaaggcgggggatcacatctactcgtggagggccgcctgggtctacgcgcatcacggaatatttgtgggtgatgataaggtgattcattttacaagaggaagggaccaggaggttggaacaggaactgtcattgatattcttcttgtgagttctgcacctaaacgaagcgacacgccatgtccggtatgcaccaacgaagacaatgaaaccagcacggagacaaatggtgtggtgtcctcttgcctcaactgcttcctggctgggggtgctctctaccgttttgagtacgcagtcaacccagctctcttccttgccaaagcgcgaggtggaacgtgcacactcgctacctctgatcctgacgaggcagtgatccgccgtgccaaatacttgctgagtaatggtttccggtgctacaacctattcaagagcaactgcgaggacttcgcaatatactgcaagactggcctccttgtggtggagcggggtgttgttgggcagagcgggcaggccatctcaatcattggtggacctctcgctgcggtgatctcaacaccgttccgcctggtgaccacaaacatctatggaatggcggtgatagccgtcggggtgtactgtgccagcaggtacacggctgacatcggcaaccgtcgtgatgtggtgaaagtggaagtcgaggacctgacagcaggactggccagcagcaggatccgtgcggtggagaaccagctggtggtcccaccagaaagcccggctgcctaaaatgcagcactgcttctgtaacatctgcaagatttacatcggccgagaccttcactgctgctaagtgtatgaattgtttgttcattgtggttaaaaatcttccgaaactctgttgaagtgaggtttccgttcggaaatgtctgtatgagtatggtgtatggcttgtccagtgttgtgtatcaagataaaaattactgttgtgtgccttgtcgtaatatcgaacttggtttctaaagaaccgtgtttatatgac

SEQ ID NO: 21439 - protein, 265 aa, Panicum virgatum
  misc_feature: Ceres CLONE 1816207
  misc_feature (107)..(178): Pfam Name: NC Pfam Description: NC domain
MGLLSNRIGKENLKAGDHIYSWRAAWVYAHHGIFVGDDKVIHFTRGRDQEVGTGTVIDILLVSSAPKRSDTPCPVCTNEDNETSTETNGVVSSCLNCFLAGGALYRFEYAVNPALFLAKARGGTCTLATSDPDEAVIRRAKYLLSNGFRCYNLFKSNCEDFAIYCKTGLLVVERGVVGQSGQAISIIGGPLAAVISTPFRLVTTNIYGMAVIAVGVYCASRYTADIGNRRDVVKVEVEDLTAGLASSRIRAVENQLVVPPESPAA

SEQ ID NO: 21440 - DNA, 394 bp, Panicum virgatum
  misc_feature: Ceres CLONE 1816211
  misc_feature: Encodes the peptide sequence at SEQ ID NO. 21441
atctcacgctaaggcattcctactcccagcttctgccctcatctcttcggtctctgacgtctcctcttctccatcgagtgctcaatctggggccctgttgtagacctgggaaacgccgggctgagacgtagaagcaggtgtggtgaccagaaaatggattcatggatcaccagacacccttctgtgagtcttgacctgcacgacggtctgccgccgctcagccgtcgccaggcgcctgacgccttgcccaatcccaatgtgctcgactaggagaacttcctgaatcctcaaaagaaagaaccagaagtatcggccctccacacagaactacatcagatgaactatgataatccgtgcctatgcgaggcgctctcgggggagatcgccaagtaca

SEQ ID NO: 21441 - protein, 38 aa, Panicum virgatum
  misc_feature: Ceres CLONE 1816211
  misc_feature: The sequence is a functional homolog of SEQ ID NO 1200 in the 10/374,780 US patent application
  misc_feature: The sequence is a functional homolog of SEQ ID NO 1395 in the 10/412,699 US patent application
MDSWITRHPSVSLDLHDGLPPLSRRQAPDALPNPNVLD

SEQ ID NO: 21442 - DNA, 1217 bp, Panicum virgatum
  misc_feature: Ceres CLONE 1816214
  misc_feature: Encodes the peptide sequence at SEQ ID NO. 21443
cagcaattgtccgatccgtgccgtgctcccccgccgccgccgcttcctcctcctcaccgcttcgtcgattcggttcgctgcttcccgcgtcaaatcaccgcctcgcggatggcctccaacgccccggcgccccagccccaggccctgcccaagcccactagggtctcgctgtcctacgaggagatctccaagctcttctcgctccccatcgccgaggcagcctccatcctcggagtctgcaccagtgtcttgaagaggatttgccgcagccacgggattgttaggtggccgtatcgaaagcttgtttctgggaaagctggtgacgacgcaaaaggtcctgaaagagagaaagccaaggagcttcttgagttgtcaaaaattgcaaaacaaaaggctttcagcccatctggttcatcagtagcgtcaacgaacacttcccaaggagtggcaaaatctcaacagggcagttctaaggcagggcaagtttcggtttcacccccagcggttaaacaaaatgcatcagttagcttggcgcatggtagccaagccaaagccattccaagctacatggatgatttcaagtacggattcccatcatctggcttgtcctgtgaaactaagaaatggtggggcgggagcagtgactcggactgtgcgcccaccaaagatggaagctgcgaagcccttggcgaggcatcaaagggcatgactgatgatgacgagttggactggggagcagatgaggcggaagctgaggctgatggcgctgttacagcagaagcgtcggcacagctgtgctccctgagaaggaaagcagtagacgatgggcgcaagctattgaatggtgacacccgcaggggacaagacttttctagactgaacaagaggcagaagctggcgctagcccaggtatttggggcttcactgccggatgttgtacttgtgtttagtgagtgagcaactgataaatgcggttgccctccctcttcagatcttcatgtaacatgacccattataagcgagaagtgtgaaatcctctcactgaattgaagaagaatggtaggagcttgttttgcctgccttaccatacaagtcgttggtgttgattttgtatgtattgtctagtctcctgcgtgcacatgagactatgagagcgccttatatatatgtgaatgcactaatatatgtacataacgtgattccattgtgttgtgttc

SEQ ID NO: 21443 - protein, 282 aa, Panicum virgatum
  misc_feature: Ceres CLONE 1816214
  misc_feature (17)..(68): Pfam Name: RWP-RK Pfam Description: RWP-RK domain
MASNAPAPQPQALPKPTRVSLSYEEISKLFSLPIAEAASILGVCTSVLKRICRSHGIVRWPYRKLVSGKAGDDAKGPEREKAKELLELSKIAKQKAFSPSGSSVASTNTSQGVAKSQQGSSKAGQVSVSPPAVKQNASVSLAHGSQAKAIPSYMDDFKYGFPSSGLSCETKKWWGGSSDSDCAPTKDGSCEALGEASKGMTDDDELDWGADEAEAEADGAVTAEASAQLCSLRRKAVDDGRKLLNGDTRRGQDFSRLNKRQKLALAQVFGASLPDVVLVFSE

SEQ ID NO: 21444 - DNA, 1359 bp, Panicum virgatum
  misc_feature: Ceres CLONE 1816217
  misc_feature: Encodes the peptide sequence at SEQ ID NO. 21445
ctctacggcagccactctgcttctcttcttcgcctcccctacaagtagccgcggctcccgcaccgccggcgacagctgagactgacgaggcgcagcggacgacgagggcggcggccatggcgacgacctccaaacccgccgcggctgtggaccccgaggtcgcgatcgcccacaggttccccgaggtctccttcgactacgacgagagggatgtggcgctctacgcgctcggggtcggggcctgcggcgacgacgccgtcgacgacaaggagctacacctcgtgtaccacagggacggacagccacacattaaggttcttccgacttttgtttctttatttcccaacaagaacagcaatgggcttggaattgttgatgtgcctggccttaactttgatgccagtcttctattgcacgggcaacaatacatagagatctacaggccaattccttcttttgccagtgttgtaaacaaggttaaagtagctggtttgcacgataaagggaaagcaactattcttgagctcgaaactaccacaagtctcagagagtctggggaaattatatgcatgaacaggagtactgtctacttgcgtggtgctggagggttttcagactcttcacggccatatacttatgctacttatcctgctaatcaagttcatcgcatttctattccaaatttggcaccttctgcagtatatgatgaccaaacaaagcaatcccaggcattattatacaggttatctggggattacaatcctttgcattcagatcctgatattgcacaggttgcagggttcactcgtccaatcctccacggcctctgcaccctaggattcgctgctcgcgctgtcatcaaatctttctgcaacggtgaaccagcggcggtgaagagcatcttcggcaggttcctcctgcacgtctaccccggggagacgttatccactgaaatgtggctcgacggccagaaggtgcactaccaaacgaaggtcaaggagcggaaccgtgccgtgctgtctggatatgtgttgctccaacacatcccctcatcattgtaagtgatgtatcatattcatattcgttcgtgacaaatattatttgttaagtggtgcccgccggatgcaatagtagtgatgaggtgagaactaatgcacgaggtgggttgccactgtaatgatagcaaagaattctgtacggatctgcacattatcgctctgttcggctggctgtggttggtggcttgtgctgatttgctgtgtgagaaaaatactggtggctgactggtggctactagctgatgctgatttggtgtgagagaaaagtactactgctggttgccagaagaatattcgtacc

SEQ ID NO: 21445 - protein, 314 aa, Panicum virgatum
  misc_feature: Ceres CLONE 1816217
  misc_feature (183)..(305): Pfam Name: MaoC_dehydratas Pfam Description: MaoC like domain
  misc_feature: The sequence is a functional homolog of SEQ ID NO 2 in US patent 7176349
MATTSKPAAAVDPEVAIAHRFPEVSFDYDERDVALYALGVGACGDDAVDDKELHLVYHRDGQPHIKVLPTFVSLFPNKNSNGLGIVDVPGLNFDASLLLHGQQYIEIYRPIPSFASVVNKVKVAGLHDKGKATILELETTTSLRESGEIICMNRSTVYLRGAGGFSDSSRPYTYATYPANQVHRISIPNLAPSAVYDDQTKQSQALLYRLSGDYNPLHSDPDIAQVAGFTRPILHGLCTLGFAARAVIKSFCNGEPAAVKSIFGRFLLHVYPGETLSTEMWLDGQKVHYQTKVKERNRAVLSGYVLLQHIPSSL

SEQ ID NO: 21446 - DNA, 1002 bp, Panicum virgatum
  misc_feature: Ceres CLONE 1816222
  misc_feature: Encodes the peptide sequence at SEQ ID NO. 21447
acagcaccaaccagcaccagcagcacaagatgaagaagcttcacgtcgccgtggtcgcttctctcctggccctggccgcggccgcgccggcggccggcgccgtcacgttcgacgcgacgaacacggcgtccgacacccccggcggcgagcggttcgaccaggccgtcggcctcgactacgccgagcaggtcctctccgacgcgtccaccttcgtctggggcaccttcaaccagcccagccccgccgaccgcaggccggtggacgcggtcaccctcgtcgtcgaggacatcggcggcgtcgccttcaccggcggcagcgagatccacctcagcgcccagtacgtcggcggctactccggagacgtcaagaccgaggtgaccggggtgctgtaccacgaggtggtgcacgtctggcaatgggggctgcaggactacggggcgcacccggggatcttcgagggcatcgccaactacgtccgcctcaaggccgggtacgcgccggggcactgggtgcagccggggcagggcgaccggtgggatcaggggtacgacgtcacggcgaggttcctggactactgcgactcgctgcagccggggttcgtggcgcagctcaacgccaagctcaaggacgggtatagcgaagactacttcctgcagatcctgggcaagaacgtgcagcagctgtggcaggactacaaggctaagtacgggggctgacaatgacatggatgggtagtccgtggtcaacagtcaaccaagtcaatgcctagcttggtgtgatattgttgttgaatagtacttgaataaggtgtttgttgaccacctcgcaaactactattgcttaatgaatgatcaataatatagttatatacatgtcgtcatgtgtggacgtttttctaatttttttttttttaaaaaagacgtgcataaaaggcatattcttggttgagttgtaaacttgtaatggaattattattttgagcttcaagtgtatgattttttt

SEQ ID NO: 21447 - protein, 228 aa, Panicum virgatum
  misc_feature: Ceres CLONE 1816222
  misc_feature (22)..(222): Pfam Name: BSP Pfam Description: Plant Basic Secretory Protein
MKKLHVAVVASLLALAAAAPAAGAVTFDATNTASDTPGGERFDQAVGLDYAEQVLSDASTFVWGTFNQPSPADRRPVDAVTLVVEDIGGVAFTGGSEIHLSAQYVGGYSGDVKTEVTGVLYHEVVHVWQWGLQDYGAHPGIFEGIANYVRLKAGYAPGHWVQPGQGDRWDQGYDVTARFLDYCDSLQPGFVAQLNAKLKDGYSEDYFLQILGKNVQQLWQDYKAKYGG

SEQ ID NO: 21448 - DNA, 702 bp, Panicum virgatum
  misc_feature: Ceres CLONE 1816238
  misc_feature: Encodes the peptide sequence at SEQ ID NO. 21449
ttaaaaaaaggctcaaatcccacaccggacagtttgcagcggcggccggcggccggcggcagagagagcggcggaccgagcagtgtccatccaggtcgcgagcttcctgtggggggcgactgggcgaggctgcgcatgcggcttccaggagcgccggggcggcggccgggcgtctagggagtgaataacttctgtagcgtcaattagccatccagcaaatcttggccttcaggatccaggcaaccagacctctgactcccccgtgaaagcagtcaagcgtctgtggaggaactggagatggtgcaacttgagccaatggcgaagcgcagcatggcatgtagccagggtgtagttggctctgtggaccggcttagcgcgctgccgaatgagctcatccacacggtgttgtcattcctcccagccccggaagtcgtgcggacaagtttgctgtcacggtggtggagaagcctttggcgctctgcgccccgcatcaacctcgatatgcaggactttgggatccccatgatgagcatccatgatgccctggaggagacgtgggccaggtttgaggatttcgccaccaacctgctgctgttccatgataatacttcgcccttgggtgaattccggatttcatctcgcatctataaccagcgtcatgtggaccggtggatttgccgtgacatcgagtactgcccttct

SEQ ID NO: 21449 - protein, 134 aa, Panicum virgatum
  misc_feature: Ceres CLONE 1816238
  misc_feature (23)..(70): Pfam Name: F-box Pfam Description: F-box domain
MVQLEPMAKRSMACSQGVVGSVDRLSALPNELIHTVLSFLPAPEVVRTSLLSRWWRSLWRSAPRINLDMQDFGIPMMSIHDALEETWARFEDFATNLLLFHDNTSPLGEFRISSRIYNQRHVDRWICRDIEYCP

SEQ ID NO: 21450 - DNA, 663 bp, Panicum virgatum
  misc_feature: Ceres CLONE 1816240
  misc_feature: Encodes the peptide sequence at SEQ ID NO. 21451
atccaaagcgcaagcggcagccgcaggcagcgccgcgcaggcgtgagagggaggggggagaaaaggaggaagcggccaaggggaagcgagggggaggccggggcggcggcgtgcgtcagatggggaagtacatgcgcaagtgcaggggggccgcgggcgaggaggtcgccggcgtcgaggtcacgcaggtcgtcggcgtccggacgaggtcgcggaccgcggcggcgccggtgccggccggcggggtcgcgaaggtcgccccgaggaggaagaaagcgctggcgccgccgagcgtggcggcgggggagcctggcgctggcggtgacggcggaagctgctacatcaagctgcggagccggacgctgttcatggcgccgcctcagcagccttcggcggcgccgagggttccggtgccggcggaggctgctggcgccggccagggtgcggcgctcgtggccgggctgtcgcgttgctccagcacggcgtcgtctgtggacgtggggtgtcaggacaggaaccttgcctgccgctccggcgccgcggaggctggcggggatcacaacctggaggtctcggggagcaactcggagagcggcctggagcgcgagataaggagagagacgacgccatcgagccgggcgcacggcgaggtcagcgatctgg

SEQ ID NO: 21451 - protein, 181 aa, Panicum virgatum
  misc_feature: Ceres CLONE 1816240
  misc_feature: The sequence is a functional homolog of SEQ ID NO 2 in US patent 7256280
MGKYMRKCRGAAGEEVAGVEVTQVVGVRTRSRTAAAPVPAGGVAKVAPRRKKALAPPSVAAGEPGAGGDGGSCYIKLRSRTLFMAPPQQPSAAPRVPVPAEAAGAGQGAALVAGLSRCSSTASSVDVGCQDRNLACRSGAAEAGGDHNLEVSGSNSESGLEREIRRETTPSSRAHGEVSDL

SEQ ID NO: 21452 - DNA, 1217 bp, Panicum virgatum
  misc_feature: Ceres CLONE 1816254
  misc_feature: Encodes the peptide sequence at SEQ ID NO. 21453
tcccatttctctactacatacgtgacgtgcttttggctttggcctcgctgcttgcttgctcgatatgatcaccatggacgatctgatgagctgcggcggcggcgacagcggcggcggcggggcttcggtggttcctggcggcgacgggcaggcgacgaggccgcggccgcggcagatgatgatggaggcggtgggggaccaccagctgacggtgtccaggatccggacggcggtgtccgtgctcggccgccgcacgggccacgcgcgcttccgccgcggccccgccgccgtcgtggtggagcacccgtcgtcgtcgccggaccaccagcagccgtcggggagcgtggcggcgcccggcgtggtgctcgacctggtggacttcgtcaaggggcgcgggcggcgcgacaaggcggcgttcagcgcgtcggcctcggggggcagctcatcgctcccctcgacgacgacactgacgagcctcaccgccggcgaagggagcgtgtccaacggccggttccctcctgtggggggcggccacgctgccggcacgccgcggccgccggcggtgtcgatgctgcagcagcctgctgcccccgattaccactacacccccggcgccgcgccgggaagcaagtgcgccggccgcgcgcgctccgagaacgacgccggcaaggcgcacgccggccgctgtcactgctccaagaaacggaagtcgcgcgtgaggcgtgtggtccgcgtgccggcgatcagctcccggaacgccgacatcccgccggacgactactcctggcgcaagtacggccagaagcccatcaagggctcgccgtatccgcgcgggtactacaagtgcagcacggtgcgggggtgcccggcgcggaagcacgtggagcgcgaccccggcgagccggcgatgctcatcgtcacctacgagggcgaccaccgccacgacggccagcagggccggggggacgccgatgccgccgcggcaccgccggagcacatgtcgacgaccaagtgaagaacgaagttcattccaagtctccggcccctttaccttctgcccagtagaaattaaatttcttggagtagtctctgtagtttttcttccttccggccggttcggactctgaaccggttcggtggtgtcacgtcgccgtcgcttgtagaggaagttcaggggaaccaaagacatatatgacacggtgtttgaaattttgacc

SEQ ID NO: 21453 - protein, 313 aa, Panicum virgatum
  misc_feature: Ceres CLONE 1816254
  misc_feature (232)..(292): Pfam Name: WRKY Pfam Description: WRKY DNA -binding domain
MDDLMSCGGGDSGGGGASVVPGGDGQATRPRPRQMMMEAVGDHQLTVSRIRTAVSVLGRRTGHARFRRGPAAVVVEHPSSSPDHQQPSGSVAAPGVVLDLVDFVKGRGRRDKAAFSASASGGSSSLPSTTTLTSLTAGEGSVSNGRFPPVGGGHAAGTPRPPAVSMLQQPAAPDYHYTPGAAPGSKCAGRARSENDAGKAHAGRCHCSKKRKSRVRRVVRVPAISSRNADIPPDDYSWRKYGQKPIKGSPYPRGYYKCSTVRGCPARKHVERDPGEPAMLIVTYEGDHRHDGQQGRGDADAAAAPPEHMSTTK

SEQ ID NO: 21454 - DNA, 1670 bp, Panicum virgatum
  misc_feature: Ceres CLONE 1816256
  misc_feature: Encodes the peptide sequence at SEQ ID NO. 21455
attggtcaattgccaaacgccctgtaactgggaaccaagaaccgagctgagtccagtcgggaatgggagtcttagaagtcaatgcgatgagcgccatgatgaggccggtgctgcacttgatggtcgggctggtgctctacggggtcgccgaggagatgaccgtgccggcgctcgtcgacaaggtcaccgccgcgctctgccacgccgacgaagggtcatgcccggaggccatctacctcaccggcatccaatcttcggcaggagggattttcaggacgataggactcactctgacggggcagctagctgatgaatatggtcggaagcctctcctccttctaactgcctccacttccatcatcccttttgctgtgcttgcatggaataattcaaggactgctgtgtatgtctaccttgttctgcgtaccctctcattcatgattggccaaggaaccatattctgcctctctattgcatacacggcagatgcagtagaaccatcaaggagggcagctgcatttggtttcatgactggaattttcactgcctcacacactttgggcagtgtgttttcaaggtttctgcctgagaggtggatttttcaggtctcmmttgtcttgttgatctgttctgtcctctacatgaaaatatctttggttgagacagttcaaagacttccctctacaccatctcagcattcctcgattacatctttgcttgccgaactaccaaaacaacggtgggaatctatcaaggagaatattagcattgtcaaaaacagtgaaacacttaggcggatctcatatgttgctttcttctataaattgggcatgattgccattagcgacgtcctaatgtattacctaaagtcagtatttggctttgacaagaatcagttctcagaaattctaatggtggtaggcgttggttcgatcttttctcagattttggtcctcccctttcttagccacatagttggtgaaaaaggcgtcttatgtatttcaatactcgcctccattgcttatgcctttctttatggtgttgcatgggcttcatgggttccatattttagctcttcattgggtgtcgtccatgttctagccagacccgcaatatatgcaatcatttctggggaagtactctcgactgatcagggaaaagcgcaaggttttattgaaacagtgcaatctgtagctatattgttggcacctctattcatgagtccactaacctcttacttcatttcagaggaagctcccttcgattgcccaggtttcagttttattgtggctggttttttcttggcaatctccttttgccttgcttggacacttaatcctgaaagcaaggacgacaaatgcagaaaacttgttgtttctgatgaagaagcagcacaagcaccgctactggctcatcatcatcccaaaccatgagcccatgaaactgaaaaaaaaatactaccaactttaacatagtattagtataacactttctgtgtacatacatcggaagtcaaatgagaacttgcagtgagccattggtcaagtaatcttgagttcctgctccgaaatttagctccacactagtacaggcaagcgaactgcatgtaaagtcgtgtttgtagcagttgtaatggtgacatatatagataactgaggtggaagttatat

SEQ ID NO: 21455 - protein, 456 aa, Panicum virgatum
  misc_feature: Ceres CLONE 1816256
  misc_feature (19)..(383): Pfam Name: MFS_1 Pfam Description: Major Facilitator Superfamily
  misc_feature (184)..(184): Xaa is any aa, unknown, or other
MGVLEVNAMSAMMRPVLHLMVGLVLYGVAEEMTVPALVDKVTAALCHADEGSCPEAIYLTGIQSSAGGIFRTIGLTLTGQLADEYGRKPLLLLTASTSIIPFAVLAWNNSRTAVYVYLVLRTLSFMIGQGTIFCLSIAYTADAVEPSRRAAAFGFMTGIFTASHTLGSVFSRFLPERWIFQVSXVLLICSVLYMKISLVETVQRLPSTPSQHSSITSLLAELPKQRWESIKENISIVKNSETLRRISYVAFFYKLGMIAISDVLMYYLKSVFGFDKNQFSEILMVVGVGSIFSQILVLPFLSHIVGEKGVLCISILASIAYAFLYGVAWASWVPYFSSSLGVVHVLARPAIYAIISGEVLSTDQGKAQGFIETVQSVAILLAPLFMSPLTSYFISEEAPFDCPGFSFIVAGFFLAISFCLAWTLNPESKDDKCRKLVVSDEEAAQAPLLAHHHPKP

SEQ ID NO: 21456 - DNA, 1483 bp, Panicum virgatum
  misc_feature: Ceres CLONE 1816263
  misc_feature: Encodes the peptide sequence at SEQ ID NO. 21457
gaccaacgtcggagtcttctcccctctccctccctccccttcccttgtcttgcgttgcccgcaatcgaaagcagatcaaaccctagatctcgtctcgccgccccgatccgaatcccatggattcgtcgtcgtcgtcctcctccagcctgagccagcagcccgagttcgactacctcttcaagctgcttcttatcggcgactccggcgtcggcaagagcagtctcctcctacgcttcaccgccgactccttcgaggacctctcccccaccataggtgttgacttcaaggtgaagatggttaacattggtggcaagaaactcaagcttgccatctgggacacagctggacaggagagatttaggaccttaaccagctcatactacagaggggcacagggaatcattatgggtaattatttgtaacccttgatctgtgaatctgtactttcgtgtgcattgtttatggagtttttactgttttttttccttctgtcccttttgacgtatgcagatacatctgatgaaattaatgtcatatcactgaggaaagtctttttttttttgaaagggcactgaggaaagtcttgaatgccttgaagtgaagttcgattttgaactcaaccttcagttaattttactttcaaattttatgctaggcgcactctaattaatgactatatactgtgcttttgaagtttaaattattaacgggggaattgtctttcagttaagaaagtgcagaaattctatttccagatttgtattactttggagtcgctaacaagtagggaaagcattttctgctcatgtttatgcatgtacattggtatctgtcgtggcgcacatttaccctttcttcgtctgcacggatcttgtcggtttccattgaattcttgcacggagacacatgatgattaatgtctcatcaaatttgcagtgtatgatgtcactcgacgagaaacatttaccaatctttctgatatatgggcaaaggaaattgacctgtattcaaccaaccaggattgtataaagatgcttgttggaaacaaagtagacaaggaaagtgaaagggctgtcacaaaaaaagaaggaatcgaatttgctcgggaatacggatgtttatttctggaatgcagtgcgaaaacaaaagtaaatgtagaacagtgctttgaggaactcgtcctaaagatattagacacgccaagcctcctagctgatgcttcgtcaggggccaagaagaacattttcaaacagaagccaccggaagctgatgcagcggcaagcagctgctgctaacttgcgtgctaatccaggtcggatccctcctgggggtgatgatatctttgttgcataaagtgataagctctgttgcgttgatttattttgcttatggtcctgtatattgccatgctaaaattagaccccacatgcataacattacgttggcagcagatatataatgtattaagttaaatctacctgac

SEQ ID NO: 21457 - protein, 101 aa, Panicum virgatum
  misc_feature: Ceres CLONE 1816263
  misc_feature (22)..(101): Pfam Name: Ras Pfam Description: Ras family
  misc_feature: SWISSPROT Homolog: EC 2.7.11.1 Non-specific serine/threonine protein kinase
  misc_feature: Useful for making plants with altered lignin content
  misc_feature: Useful for making plants with modulated oxidative stress sensitivity
  misc_feature: Useful for making plants with altered alkaloid content
  misc_feature: Useful for making plants with altered terpenoid content
MDSSSSSSSSLSQQPEFDYLFKLLLIGDSGVGKSSLLLRFTADSFEDLSPTIGVDFKVKMVNIGGKKLKLAIWDTAGQERFRTLTSSYYRGAQGIIMGNYL

SEQ ID NO: 21458 - DNA, 1584 bp, Panicum virgatum
  misc_feature: Ceres CLONE 1816287
  misc_feature: Encodes the peptide sequence at SEQ ID NO. 21459
aaaagaggaagaagcccagtttttcattttccggctccctctttctcgtcaatagttttttctcttcgttccttctctcgctcgcttctctacgctgctccccccctattttcccccgcaccctcccgctcgcgccaatctccttccccatctcgtctagaagcttcgagaaccttcggggggcggagatcggctcccccggccgcccggcgatggtctcctggcggcgcagcgcgtcctggctgtcgtccgcctcccgctcctcgctcggcggcgccgtcggcggggaggcgaaggtcacgccggaggtggatccggcggcccaggaggtggtggtggaggaggaggtcgacgaggagcggtggtcgcgcctgctcccggagctgctcacggagatcgtgcggcgcgtcgacgccggcgccgagcggtggccgctgcggcgggacgtggtggtctgcgcctgcgtgtgccggcggtggcgggacgccgcgttctcggtggtgcggccgccgctcgagggcgggaggatcaccttcccgtcgccgctcaagcagcctggacccagggatgcaccgatgcactgctttatcaggagggacaaaaagaactcaaccttttccctccacctcagcttaacacaggccctaatggataaagggaagtttcttttggctgctcgaaggttcaggcaaggagcacatacagaatatatcatctcttatgactatgatgatcttcacccaggaagcacttcatatattggaaagttgagatctgacttcctggggacaaagttcatcatctatgatagccaggcaccatatgatggtgctaaaccctcgaggagccgatctagtcgtcgctttgcaagtaagcagattagcccacaggtttcaggaggcaattacgaagtaggacaggtgacaaataagttcaacttcctgaaatcaagaggaccaagacgaatgcagtgcagtatccagtgccctgtaggtcagggtactgcatcagatccttccaaagagaaaacacctgcccggaattccttagatctaaagaacaaagctccacgatggcatgaacatctgcaatgctggtgcttaaatttccatggccgggtgacggtcgcctctgtgaagaacttccagctcgttgccacggctggttctggtggaccatggggcgttggagacgaggagacggtgatcctgcaatttggtaagatagaggacgatgcattcacgatggactaccggcagcctctttcagccttccaggcattcgccatctgcctcaccagctttggcacgaagctggcttgtgaataagtgactcgggttgtttaccttgttatgtggggtggggggtcaaaatgtagctggtaatctgaactagttgccctgaactgggagaaaaaggcgacaagaaacagtgggcacatgtttgcccctagcttgacggtttcttgtggtcgcttaatgatttgagttatatggatttgcgtctatgtttatgagatgacgatgacttgtataaatgttgacccctttcttttggtgacattactcgtaatgacttgttgcc

SEQ ID NO: 21459 - protein, 371 aa, Panicum virgatum
  misc_feature: Ceres CLONE 1816287
  misc_feature (115)..(365): Pfam Name: Tub Pfam Description: Tub family
MVSWRRSASWLSSASRSSLGGAVGGEAKVTPEVDPAAQEVVVEEEVDEERWSRLLPELLTEIVRRVDAGAERWPLRRDVVVCACVCRRWRDAAFSVVRPPLEGGRITFPSPLKQPGPRDAPMHCFIRRDKKNSTFSLHLSLTQALMDKGKFLLAARRFRQGAHTEYIISYDYDDLHPGSTSYIGKLRSDFLGTKFIIYDSQAPYDGAKPSRSRSSRRFASKQISPQVSGGNYEVGQVTNKFNFLKSRGPRRMQCSIQCPVGQGTASDPSKEKTPARNSLDLKNKAPRWHEHLQCWCLNFHGRVTVASVKNFQLVATAGSGGPWGVGDEETVILQFGKIEDDAFTMDYRQPLSAFQAFAICLTSFGTKLACE

SEQ ID NO: 21460 - DNA, 685 bp, Panicum virgatum
  misc_feature: Ceres CLONE 1816289
  misc_feature: Encodes the peptide sequence at SEQ ID NO. 21461
acgatctaaattcatacagggttctctttgatgagaatggtgatcctcgtctttcatgctttggcctcatgaaaaacagcagggacgggaaaagttatagcacaaatcttgcatacacacctccagaatatttaagaaatggaagagttacatcggaaagtatcatatacagttatggcactatacttctggatctcctcagtgggaaacgtatacctccttcccgtgcttgtgagatgataaaaggcaacaatctccaagtactgatggactcacatttggagggaaactacccaacagaagaagcgaccacaatggttgatctggtctctcagtgcttacagtatgaacctagggatcgccccaacaccaaaaagttggtttctgttctcgagcccatgcaaataaaatcagaggtaccatcctatgagatgcttggcattccaaagcatgaagaagaagaagagcctcccactccccctccgcagccacagcaccctctttctcccatgggtgaggcctgttctaggatggatttgacggctatccatcagattctagtgaatacacattacagggatgatgaagggactaatgagctgtcgttccaggaatggacacagcagatgagggacatgttggaggctaggaaacgtggagactttgcttttcgtgataaagattt

SEQ ID NO: 21461 - protein, 227 aa, Panicum virgatum
  misc_feature: Ceres CLONE 1816289
  misc_feature: SWISSPROT Homolog: EC 2.7.11.1 Non-specific serine/threonine protein kinase
DLNSYRVLFDENGDPRLSCFGLMKNSRDGKSYSTNLAYTPPEYLRNGRVTSESIIYSYGTILLDLLSGKRIPPSRACEMIKGNNLQVLMDSHLEGNYPTEEATTMVDLVSQCLQYEPRDRPNTKKLVSVLEPMQIKSEVPSYEMLGIPKHEEEEEPPTPPPQPQHPLSPMGEACSRMDLTAIHQILVNTHYRDDEGTNELSFQEWTQQMRDMLEARKRGDFAFRDKD

SEQ ID NO: 21462 - DNA, 666 bp, Panicum virgatum
  misc_feature: Ceres CLONE 1816301
  misc_feature: Encodes the peptide sequence at SEQ ID NO. 21463
gccatctcgggctccggcacgcggcactcgcctcccctcgctttccctttccgcgcccaccgccgttgccgcatatagcaacccagcatccggatagccacaccgtcggcggcggcggcgcggcgccgagtatatatatatacatccatgatccatccagacatccagtccaacgactcctcctcgtcctccttccctgtgcggaccatcgtcgatcagcgccatggcgagcgcggaggcggcggccggggtggcaccgttcgtggccaagacgtaccgcatggtggacgacccgtccacggacgccgtcgtcgcgtggggacgcgacagcaacagcttcgtcgtcgccgaccccttcgccttctcgcagacgctcctccccgcgcacttgaagcactccaacttctccagcttcgtgcgccagctcaacacctacggcttccggaaggtggatccggaccggtgggagttcgcgcacgtcgcgttcctgcgcgggcagacgcacctgctgccccagatcgtgcgccggggcggcggcggcggcgggaagcgcaaggacgacggctcttcctgcggcgccaacgccggcgccgcggcggacgaggacgcggtggccatggaggtggtccggttgaggcgggagcagcgggccatcgaggaccaggt

SEQ ID NO: 21463 - protein, 147 aa, Panicum virgatum
  misc_feature: Ceres CLONE 1816301
  misc_feature (11)..(147): Pfam Name: HSF_DNA-bind Pfam Description: HSF-type DNA-binding
  misc_feature: Useful for making plants with modulated heat sensitivity
  misc_feature: The sequence is a functional homolog of SEQ ID NO 1233 in the 11/479,226 US patent application
  misc_feature: The sequence is a functional homolog of SEQ ID NO 144 in the 10/666,642 US patent application
  misc_feature: The sequence is a functional homolog of SEQ ID NO 2203 in the 10/666,642 US patent application
  misc_feature: The sequence is a functional homolog of SEQ ID NO 2205 in the 10/666,642 US patent application
  misc_feature: The sequence is a functional homolog of SEQ ID NO 2207 in the 10/666,642 US patent application
  misc_feature: The sequence is a functional homolog of SEQ ID NO 1685 in the 10/412,699 US patent application
  misc_feature: The sequence is a functional homolog of SEQ ID NO 2201 in the 10/666,642 US patent application
  misc_feature: The sequence is a functional homolog of SEQ ID NO 865 in the 10/666,642 US patent application
  misc_feature: The sequence is a functional homolog of SEQ ID NO 142 in the 10/666,642 US patent application
  misc_feature: The sequence is a functional homolog of SEQ ID NO 194 in the 10/412,699 US patent application
  misc_feature: The sequence is a functional homolog of SEQ ID NO 2278 in the 10/374,780 US patent application
  misc_feature: The sequence is a functional homolog of SEQ ID NO 409 in the 11/479,226 US patent application
  misc_feature: The sequence is a functional homolog of SEQ ID NO 782 in the 10/225,066 US patent application
MASAEAAAGVAPFVAKTYRMVDDPSTDAVVAWGRDSNSFVVADPFAFSQTLLPAHLKHSNFSSFVRQLNTYGFRKVDPDRWEFAHVAFLRGQTHLLPQIVRRGGGGGGKRKDDGSSCGANAGAAADEDAVAMEVVRLRREQRAIEDQ

SEQ ID NO: 21464 - DNA, 1277 bp, Panicum virgatum
  misc_feature: Ceres CLONE 1816317
  misc_feature: Encodes the peptide sequence at SEQ ID NO. 21465
accaagcaagtacataagacaccgactcagcaagacgaagcaggagcaagcaggcacaagtgcacagctagagcccaggaaatcaagaaagctcgtgcaagcagccatggcgggagttgcgtccctcaccctcaccctccgcgcgtcttccccatcacccgcagccccgtacccacgcggcggcagcggcgccgcccgcgcgttcccgaccccggcgcgcttccggtcgctgcgcgccgcgcggcgccgtgtcctgacgcgtgcggtggcggcgggtggtggggatcccgaggacgagtgggtgccggagcctgagggcgggtccacggtcacgggggtggccgaggcgcccgcgccggaggcgagcgaggtggcgcggctcaaggcgcggctcaaggaggcgctggacggcgcggaacggggcctgcgcgcgtccagcgagacgcgggcggaggtggtcgagctcatcgcgcagctcgaggcgcgcaaccccacgcccgcgcccacggaggcgctcgcgctcctcgacggcaagtggatcctcgcatacacatcattttctcaacttttccctctgctggggtccggaaggctgcctgagcttgtaaaggtggaggagatatcacagactattgattcagagaacttcacagtgcaaaactgcatcaagttttcaggaccattggctacaacctcagtttccaccaatgctaaatttgaagttagaagccccaagcgtgtgcagattaaatttgaagaaggtgttatcggaaccccgcaactgaccgactccattgtgctaccagagaagtttgagctctttggacagaacattgacctgagcccattgaaaggcatattttcttccatcgaaaatgcagcatcctcggttgccaagaccatctctggtcagccaccacttaagataccgattcagaccaacaatgctgagtcctggttgctcacaacctaccttgacgaagagctcaggatatccagaggggacggtggaagcatctttgtgctgttgaaggagggaagcacccttctgaactaggttcaatgttgaagggcgaaccttggcagtattatattgactactgactacgttttctttttcttgataccatgtgtttgtagtagtatattagtggggtgtgtgctgtgtggttttttgaaaatatgattgccaccttatgggtaaatgtctgtatcgatgcacttagtttcagtacctgaaatttagatatatatacttgcggttgtgctgtttcttc

SEQ ID NO: 21465 - protein, 316 aa, Panicum virgatum
  misc_feature: Ceres CLONE 1816317
  misc_feature (90)..(308): Pfam Name: PAP_fibrillin Pfam Description: PAP_fibrillin
  misc_feature: Useful for making plants with modulated nitrogen use efficiency
  misc_feature: Useful for making plants with modulated salt sensitivity
MAGVASLTLTLRASSPSPAAPYPRGGSGAARAFPTPARFRSLRAARRRVLTRAVAAGGGDPEDEWVPEPEGGSTVTGVAEAPAPEASEVARLKARLKEALDGAERGLRASSETRAEVVELIAQLEARNPTPAPTEALALLDGKWILAYTSFSQLFPLLGSGRLPELVKVEEISQTIDSENFTVQNCIKFSGPLATTSVSTNAKFEVRSPKRVQIKFEEGVIGTPQLTDSIVLPEKFELFGQNIDLSPLKGIFSSIENAASSVAKTISGQPPLKIPIQTNNAESWLLTTYLDEELRISRGDGGSIFVLLKEGSTLLN

SEQ ID NO: 21466 - DNA, 1293 bp, Panicum virgatum
  misc_feature: Ceres CLONE 1816319
  misc_feature: Encodes the peptide sequence at SEQ ID NO. 21467
tcgccttgcctcctctccaccggctcagtcagcgagacctcagcctgcagcttgctccaccatcaccctccctccatgtccgaccgcgtccaccccgtgccggcgcctccgcctcgcctccccaatcaaccacccgccgacgccgaagcccccgccgccggtgccagcgcgccgcccacggagactgagaccacgccgctgcgcgtgcacccgtccttcaaccgcccgccgtcgccgccgcccggcacctacatcatccaggtgcccaaggaccaggtcctccgcgtcccgcccccggaccgcgcgcgccgctacaagaagctcgccgcgcgcccggcccgccgccgcctcctccgcgccgcctgctgctgctgctgcgccgcgctcctcctcctgctcctcctcgccgcggccttcgccggcgccgtctacctcgtcttccgcccccgcgcgcccaccttctcaatcgcctccctctccatccgcggcctctcgtcgtcctcctcctccgccgcgctctcccccgagctcgacgcctccgtgcgcgcggacaacggcgccaacaggaaggtcggcgtcgactaccgcggcggcgggagcgtcgcggtctcctacgccgggcagcggctcgccgcggggccgtggcccgcgttccggcagccgccgcggaacgtgacggtgttcgcggcggcgatgaggggccagggcgtgcggctgacggatgagcaggcgaggcggctcgccgaggagcgggccgcgggcgccgtgacgctggcggtggaggcgagggtgcccgtgcggctgcgcttcggcaaggtgctgcggacgtggacggtggacgtgaaggcgcggtgcgacgtcgccgtggacaggctggaaggggatgccgcggcggtgaacagggggtgcagggtcagggtcaggccgctctggtggtggtggtgatcgccgccgccgccggcgctcctgtccgcctaataattaatataaacggctagtgattaactactactattctactccgtatagcagtaacggtgtgctactattgaatacagagattactagtacaaggttgccagtggagtaaattcttgcaaaacaaaattctagagaatttttttggggttatgggtgtatgtgtacaatatatatttggggatgatgcgagggaaggctgccgtcagttattcagtacatatatggattgcatcatgacctggtaatggtgaaattgtagataacctttatgttactgtgcagaaaaaagtggattattggatcattcatttt

SEQ ID NO: 21467 - protein, 289 aa, Panicum virgatum
  misc_feature: Ceres CLONE 1816319
  misc_feature (119)..(260): Pfam Name: Hin1 Pfam Description: Harpin-induced protein 1 (Hin1)
MSDRVHPVPAPPPRLPNQPPADAEAPAAGASAPPTETETTPLRVHPSFNRPPSPPPGTYIIQVPKDQVLRVPPPDRARRYKKLAARPARRRLLRAACCCCCAALLLLLLLAAAFAGAVYLVFRPRAPTFSIASLSIRGLSSSSSSAALSPELDASVRADNGANRKVGVDYRGGGSVAVSYAGQRLAAGPWPAFRQPPRNVTVFAAAMRGQGVRLTDEQARRLAEERAAGAVTLAVEARVPVRLRFGKVLRTWTVDVKARCDVAVDRLEGDAAAVNRGCRVRVRPLWWWW

SEQ ID NO: 21468 - DNA, 1088 bp, Panicum virgatum
  misc_feature: Ceres CLONE 1816323
  misc_feature: Encodes the peptide sequence at SEQ ID NO. 21469
actctcacaccattacaatctctctcaagaacagtgcaacgaccgggagggtggtgccggcctgttcccggcggcggcgatgaggtacggcgaggtggcgcacttcagccacccgcagcaccgcctccggctggagcaccacgatacgccgttccggtgcgacgggtgccgcgaggtgggcatcggcgcgcgcttccgctgcccgcacccgggctgcgaccatgacctgcaccggcagtgcgcgctcccgctgtcgccgccgccgccgccgctccggcacccgttctatccgcgctgcgcgttcgccttcctcgcgcgggcgcccgggccgcgctactgcaacgcgtgcggccgcgacgtcgccggcttcgtctaccactgccgcgcgtgcgggttcgacctgcacccgtgctgcgccgcgctcccgcacgcgctcgacgccggcggcggggtccggctgtacctgcacccggactccaaggccggcgtcgcgtgccaccgatgcggccaccgcgggcgcagctggagctaccggagccactgcgggagcttcagcctccacgtggcgtgcgtcgtggacatgctcgtcgagagctggcacggcgtcggccgccgcaagggcgtgtacgacggcgggctggtggtgcccggggccggcgggtacagggtgccggcgatccgcggcgcggcaaagagcgtccacgcgggcaggggaggagggtacgcgtcctggggcaggaagaagggcaaggtgaggcgctgctgcgagatcgccgggttcgcggggcaggtggtcatctcggcggtgctcggcgaccccaccgcgctcatcgccggcgtcatagggtccctcatcgcgctgtgacggacggacgccggccgagggcaccatggcaacatgccgacatgatcaaacgtgcaaaacactgtacatgtatcttgtatgtgcatcgcgcggtcgcatggcatggccgggcagatagggacttcgtggtgaagtaccgagcagtaaacagtaataacatgttcggggcaaactgtaaagttaatctctggtgctccctccattctaaattataagtcattcc

SEQ ID NO: 21469 - protein, 261 aa, Panicum virgatum
  misc_feature: Ceres CLONE 1816323
  misc_feature (85)..(113): Pfam Name: C1_3 Pfam Description: C1-like domain
MRYGEVAHFSHPQHRLRLEHHDTPFRCDGCREVGIGARFRCPHPGCDHDLHRQCALPLSPPPPPLRHPFYPRCAFAFLARAPGPRYCNACGRDVAGFVYHCRACGFDLHPCCAALPHALDAGGGVRLYLHPDSKAGVACHRCGHRGRSWSYRSHCGSFSLHVACVVDMLVESWHGVGRRKGVYDGGLVVPGAGGYRVPAIRGAAKSVHAGRGGGYASWGRKKGKVRRCCEIAGFAGQVVISAVLGDPTALIAGVIGSLIAL

SEQ ID NO: 21470 - DNA, 1111 bp, Panicum virgatum
  misc_feature: Ceres CLONE 1816326
  misc_feature: Encodes the peptide sequence at SEQ ID NO. 21471
aatcactgccgccgccgctcgccagtttcccgcggtttccccgcccacgcgccccaaattcccgccagaaaccgcgcagttctccagcggcgcctccccgccgccgccgagtagtcggctcgctcccctcacgagctggtgcgagaggggaaggaggggaggatatgtcttcctgggacgacgacgagtccgcggcggcgtccgcggccgaggcggcgaccacggacgtggagctgctgaggcgggcctggcgcaacgagaaggccgcgccggagatcctccgcttcgatacgcccctcgtctcccgcgtccgcgagcagatccagctcctcgaggagacgctggacgacttcgccgacaccggcgtcgacgacctggtggtctcgctctaccagatggacctcgaccgcacgctcttcctcctgcgctcctacctccgtctccgcctgcagaagatcgagaagtacacgatgcacatctccaggtctgacgacctcctcagccggctgtcgccgcaggagcgccggtttgccaagagttgcgctgagatcatggagaagcatctcgggcagtcggtcctgtcgaagctaccgtacggctatgactcggttaccaggcagtccttgtcgagcactgaggatgatatggtgccagagcctcagcttgacacctttgtcttctgcaagactaagagcgatgttggagccttccagctagatgacattggagaggaggtcgtggacttggttgcagacgacttgtatgttcttcggtacaagtccatcaagggccttgtcgagggtggccggatcgaccttatctgatgtgaataacaagtcaatgcctgcaagagtgagcattggagatgtaaaagctaaggcttagattataagatgaatgcttcggcctaagattcttctgaatttctggaaagggaggaatcaagggatgaagggaaagagaattgcctagcaccatcgataatcggaattgataaataccattgatgtggcctgggcatgtgccaaaaggtccatctttttctttactacatgtactaatgaaaccaggatcatgtagtccccccatttaacgttgtcttgatgactcc

SEQ ID NO: 21471 - protein, 219 aa, Panicum virgatum
  misc_feature: Ceres CLONE 1816326
  misc_feature (14)..(219): Pfam Name: Sld5 Pfam Description: Synthetic lethal mutants of dpb11-1 five
MSSWDDDESAAASAAEAATTDVELLRRAWRNEKAAPEILRFDTPLVSRVREQIQLLEETLDDFADTGVDDLVVSLYQMDLDRTLFLLRSYLRLRLQKIEKYTMHISRSDDLLSRLSPQERRFAKSCAEIMEKHLGQSVLSKLPYGYDSVTRQSLSSTEDDMVPEPQLDTFVFCKTKSDVGAFQLDDIGEEVVDLVADDLYVLRYKSIKGLVEGGRIDLI

SEQ ID NO: 21472 - DNA, 1195 bp, Panicum virgatum
  misc_feature: Ceres CLONE 1816339
  misc_feature: Encodes the peptide sequence at SEQ ID NO. 21473
acggtgcaggttcaagaagagctctcgtggcgtcatggtctctggaaggtcagagatggatgtcgagctgggcgaggacgtgctcaccgagatcctcgcgaggctgccgtacaggtcgctggcgcggttccagtgcgtctccacctcgtggcgccgcatcatctccagcgactacctccgccgaaggctgacgctcatcacatcgggggtgctctaccacggccgcggcggccgcggcgacggcgcgaggcggccgtacacgtacgcgtgcgctccggacggcggccgcggcggcgtcgcggaggccggcgacatgggcttcttcccgtgccacgacgcgtcgaccatcatcgacgggtgcaacggcctgctgctctactacgcgtcgcgcccggcggcgttccacgtcgtgaacccgaccacgcggcggtgggcggcgctgccggcgccgcgcgcgaggacgctgctctccgtgctggcgttcgaccccagcgcctcgccgcgctacagggtggtgtgcttcacgggctggctgccccggggcgcgaccatcgaggtgttcgactccgagcgcggcgcgtggcggggccacgaggtcgacttcgggctcgacaccgacgccatgacggccaccatgcactactccggcggcgcgctccacgtgctggcctactcgggtcacgtcgtccgcgtcgacctggacaccatggcgtgcgcggtcaccgcgctcccggcgcccgtcagctgccgggcgcgcgccgggcactgccgcggccgcctgcggttcgcgtccagcgacggcgcgcgcctcaggatctgggagctccaggacgcgggcgcgggggagtgggcgctgaagcgtgagatcggggtcggcgacgtcgcccccggcggctcgagccaggccatcaccttcctgttcatggcgttccacccgaagagggaggtggtgtacctgtggtcgccgtggaagctgctggcgttcgacatggtcgagagacgcgtcgaggaggagtgggcgttcgggtcagagaaagaaggcgcgcatctcatacagatttggctgtttccgttctcgcgccatttggccaacgccctggcctgactaggcttgtcgacgcgctgaaaatggcatggggggcaatactggaaagaatgtggccgcgtccaagtatgcaggaaggtaaaaagaacc

SEQ ID NO: 21473 - protein, 349 aa, Panicum virgatum
  misc_feature: Ceres CLONE 1816339
  misc_feature (4)..(47): Pfam Name: F-box Pfam Description: F-box domain
MDVELGEDVLTEILARLPYRSLARFQCVSTSWRRIISSDYLRRRLTLITSGVLYHGRGGRGDGARRPYTYACAPDGGRGGVAEAGDMGFFPCHDASTIIDGCNGLLLYYASRPAAFHVVNPTTRRWAALPAPRARTLLSVLAFDPSASPRYRVVCFTGWLPRGATIEVFDSERGAWRGHEVDFGLDTDAMTATMHYSGGALHVLAYSGHVVRVDLDTMACAVTALPAPVSCRARAGHCRGRLRFASSDGARLRIWELQDAGAGEWALKREIGVGDVAPGGSSQAITFLFMAFHPKREVVYLWSPWKLLAFDMVERRVEEEWAFGSEKEGAHLIQIWLFPFSRHLANALA

SEQ ID NO: 21474 - DNA, 1146 bp, Panicum virgatum
  misc_feature: Ceres CLONE 1816353
  misc_feature: Encodes the peptide sequence at SEQ ID NO. 21475
atcacaattcacagcagcacacttttttttttgaaaagatcacagcagtacacttgcacaaaaacgttcggtcacctagctgtgagctaacatcacacctcacaactttccgggagcaatttagcgcgtcgttttcagcaatggtttctcgtgtgctggtagtggcggtggtactgatgagtctggcgcagctctccgcggggagcaggaggctcatggagctgtacatccctccggcgagcgaccagctcacgtaccaccacggcaccgtgctaagcggcgacatcccggtgtccgtcctctggtacggcaagttcacgccggcgcagaggtccatcgtctccgacttcctcctgtcgctcaccaccgtgccgggcgcggccacgccgtcggccgggcagtggtggggcaccatcgaccagctctacctgtcgagcgccgccacgaacggcgccgcgccggcgcgcgtgctcctcgacgcgcaggtgtccgacgaggcgtgctcgctggggaggtcgctctcgctggcgcagatcgagcagctcgcggcgcgcgccggcgggaagaagggcggcatcgcgctggtcctcaccgacgaggacgtggccgtcgaggggttctgcagcagccggtgcggcaggcacgggtccgccgccccgggcaactccgcctacatctgggtgggcaactccgcgaagcagtgccccgggcagtgcgcgtggccgttcgcgcagccgcagtacgggccgcaggccaagcccctggtggcgcccaacggtgacttcgggatggacggtctggtgatggtcctcgccaccatggtggccggcaccgtgaccaacccctacggcgacgcgttctaccagggccccaaggaggcgccgctggaggcgtgcaccgcgtgcccaggcgtctacggcagcggcgcttacccgggcttccccgggaacctgctcgtcgaccagaccaccggggccagctacaacgccaacggcgccaacgggaggaagtacctgctcccggccttgtacaacccggagacgtccacctgcagcacgctggtgtagtcgtgtcgagtccgtagtgatgtaacctgtactagaaccagacactgcccctgttttctatacatctgacaaaagttgt

SEQ ID NO: 21475 - protein, 308 aa, Panicum virgatum
  misc_feature: Ceres CLONE 1816353
  misc_feature (37)..(308): Pfam Name: Phi_1 Pfam Description: Phosphate-induced protein 1 conserved region
MVSRVLVVAVVLMSLAQLSAGSRRLMELYIPPASDQLTYHHGTVLSGDIPVSVLWYGKFTPAQRSIVSDFLLSLTTVPGAATPSAGQWWGTIDQLYLSSAATNGAAPARVLLDAQVSDEACSLGRSLSLAQIEQLAARAGGKKGGIALVLTDEDVAVEGFCSSRCGRHGSAAPGNSAYIWVGNSAKQCPGQCAWPFAQPQYGPQAKPLVAPNGDFGMDGLVMVLATMVAGTVTNPYGDAFYQGPKEAPLEACTACPGVYGSGAYPGFPGNLLVDQTTGASYNANGANGRKYLLPALYNPETSTCSTLV

SEQ ID NO: 21476 - DNA, 644 bp, Panicum virgatum
  misc_feature: Ceres CLONE 1816354
  misc_feature: Encodes the peptide sequence at SEQ ID NO. 21477
gtgcttttgctctcgcagccgaactcggtcgccgccgccgcgccccacggcttcctcctctccaccgcggccccgcgccacgctcgccaccaccagctacgccgccgcgtcgcccccacggcctacgccgccgccgcggccgccgcagctgaggcgccgctccccatgacgccgcgcttcggccgggccacgcggtttcccgggggcgccgcctccgttgcgcgcgtctacgcggacgccaacgcccagcggcccaaggagtactgggattacgagtcgctcgacatccagtggggggagcaggatggatacgaggtgctgcggaaggtggggaagggaaagtacagcgaggtgtttgaaggtttccagcctgggagcgatgagaggtgcatcattaagatcctcaagcccgtgaagaagaagaagatcaagagggaaataaaaatacttcagaacttatatggagggccaaatattgtaaagctgcttgatgttgtcagagatgaggaatcaaagacgcctagtctgatctttgaatatgtcaataatactgacttcaaagtgctctaccctacactatctgattatgatatcagatattatatttttgaattattaaaggcactagattattgtcattcacg

SEQ ID NO: 21477 - protein, 214 aa, Panicum virgatum
  misc_feature: Ceres CLONE 1816354
  misc_feature: SWISSPROT Homolog: EC 2.7.11.1 Non-specific serine/threonine protein kinase
  misc_feature: Useful for making plants with modulated flowering time
VLLLSQPNSVAAAAPHGFLLSTAAPRHARHHQLRRRVAPTAYAAAAAAAAEAPLPMTPRFGRATRFPGGAASVARVYADANAQRPKEYWDYESLDIQWGEQDGYEVLRKVGKGKYSEVFEGFQPGSDERCIIKILKPVKKKKIKREIKILQNLYGGPNIVKLLDVVRDEESKTPSLIFEYVNNTDFKVLYPTLSDYDIRYYIFELLKALDYCHS

SEQ ID NO: 21478 - DNA, 1153 bp, Panicum virgatum
  misc_feature: Ceres CLONE 1816384
  misc_feature: Encodes the peptide sequence at SEQ ID NO. 21479
aatggacccataacgcccactttactcagcttcccaaacactgcctctgctctccctcttcttcctcattccctctccaccaccaccacattccaattccattccggccaccagagaagagaaacccaacaaagagccaccaccacccttcatcacttctcctccaccaaggcaccaaccagtccgggagccatgagcaaggactgcggcaaccacggcgacgacgacctccgccgctcgtgccggcgcctgctcggcctcctcctgggcctggccctcatcgtcgccatcatcgcgctcatcgtctacctggtcctccgccccacgcacccgcgcttcttcctgcaggacgcctcgctccgccagctcgacctcgccaacggctcctccaacctcctctccaccacgctccaggtcaccgtcgcctcccgcaaccccaacgaccgcgtcggcgtctactacgaccgcctcgacgtctacgcctcctacaagtaccagcagatcaccgtcgccgcctcgctcccgccggtctaccagggccacggcgacgtcgacgtctggtcgcccgtcctcgccggccccaacgtccccttcgccccctacctcgccgacgcgctccagcaggactgccaggccggctacctcatcctccaggtcaagatcgacggccgcgtcaggtggaaggtcggcagctggatctccggccactaccacctcttcgtcacctgcccggccttcctcgtcaccaacggcggcaacggcgcgccgggggccagcggattcaagttccagaccaccacctcctgccgcgtcgaggtctagctagctaccgaggctttggtgctgccgccggcgacggcgaggtaggtgcccgtacgtcgtcttgtgtctgtctgcctgtccagggttatagcagaaggggaaaaaacagaggccacagaagcagagagatcttgatgctcagggtcatggcggaaataatcgatcaattcatcaataccagtgaactgaatcaatcagtgattctgctgctgcgtataaaaatgtaaaggatgatgtttctttttttctttctttcgtagggttgattaataataatataatagtagtacgatcgatcgatggtcatatatatactatttatatatgctgc

SEQ ID NO: 21479 - protein, 209 aa, Panicum virgatum
  misc_feature: Ceres CLONE 1816384
  misc_feature (39)..(179): Pfam Name: Hin1 Pfam Description: Harpin-induced protein 1 (Hin1)
MSKDCGNHGDDDLRRSCRRLLGLLLGLALIVAIIALIVYLVLRPTHPRFFLQDASLRQLDLANGSSNLLSTTLQVTVASRNPNDRVGVYYDRLDVYASYKYQQITVAASLPPVYQGHGDVDVWSPVLAGPNVPFAPYLADALQQDCQAGYLILQVKIDGRVRWKVGSWISGHYHLFVTCPAFLVTNGGNGAPGASGFKFQTTTSCRVEV

SEQ ID NO: 21480 - DNA, 683 bp, Panicum virgatum
  misc_feature: Ceres CLONE 1816385
  misc_feature: Encodes the peptide sequence at SEQ ID NO. 21481
aaagtcctctccgatcggagttagtcaatctctccgtaccccaagatattcaactcttctcccccttctccttttgtccgtacacagcgagcgagcgagcgatcgatcatggagctggaggcggcagcggtctccttggccagcacgtcgtggtcgttctctactagcacggcgccgtccacgcgccgcgacacgccggcggcggcgagcggtggcgcggttggcagagccaggagcgtctcccgcctgccggcgcgcgtcgccggggcggtggcccggggcgccctcaccttcgtcttcgcggcagtgggcatggtcctcggggccgtgacgggcgcgctgatcgggctggccacggagagcggcctggtgcgcggcgccggcgtcggggccatctccggcgccgtcgtgtccatggaggtcgtcgactcctccgtcgccatctggcgctcccaccactcggggatctggagcgtcctctacgtgctcgacgtgatctggagcctcctgaccggccgcctcgtgcgcgagaaggttgaccccgccgtgcagagcgccgtcgacagccagatgaacgcggtggactcaccgttcggggagatggcgccgacactggcagacatgttcgagacgggcgccgcggcggcggcggcgaagggcatgccggccgccggcatcgaggc

SEQ ID NO: 21481 - protein, 191 aa, Panicum virgatum
  misc_feature: Ceres CLONE 1816385
  misc_feature: Useful for making plants with modulated nitrogen use efficiency
MELEAAAVSLASTSWSFSTSTAPSTRRDTPAAASGGAVGRARSVSRLPARVAGAVARGALTFVFAAVGMVLGAVTGALIGLATESGLVRGAGVGAISGAVVSMEVVDSSVAIWRSHHSGIWSVLYVLDVIWSLLTGRLVREKVDPAVQSAVDSQMNAVDSPFGEMAPTLADMFETGAAAAAAKGMPAAGIE

SEQ ID NO: 21482 - DNA, 689 bp, Panicum virgatum
  misc_feature: Ceres CLONE 1816386
  misc_feature: Encodes the peptide sequence at SEQ ID NO. 21483
aattcgaagttcaaacacactctactccaagctcggctatctgagcagaggctcggacatgaccaagaagctcacctccgccatggccgggaagcaggattttcgcaaggcgcaattcgacgatcagggtattcaaggaggcggcaagaagagcgcggcggggctcgggggcagcaggctgatctcccacgagcaggaggacgccatcatcgtcgcggcgctgcggcacgtggtgtccgggtacagcacgccgccgccggaggtcgtcacggtggcgggcggcgaggcgtgcagggtctgcggcatcgacgggtgcctcgggtgcgacttgttcttcggggcgcccgcggaggtggcgagttcttctggcgcggggcgggtggcggcgccggcggcaggaggggagcagcagcagcagaggccgcggcggcggaggaagaggaacatgtaccgcggcgtgcggcagcggccgtggggcaagtgggcggcagagatccgcgacccgcggcgcgcggcgcgcgtgtggctgggcacgttcgacaccgcggaggcggccgccagggcctacgactccgccgcgctcgagttccgcggcccgcgcgccaggctcaacttcccggcccgcggcgccgccgccgccgcctgtgcccccgccgccgcggcgggggctgcggagactgcgacgccgg

SEQ ID NO: 21483 - protein, 210 aa, Panicum virgatum
  misc_feature: Ceres CLONE 1816386
  misc_feature (129)..(180): Pfam Name: AP2 Pfam Description: AP2 domain
  misc_feature: Useful for making plants with modulated biomass
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
  misc_feature: Useful for biocontainment applications
MTKKLTSAMAGKQDFRKAQFDDQGIQGGGKKSAAGLGGSRLISHEQEDAIIVAALRHVVSGYSTPPPEVVTVAGGEACRVCGIDGCLGCDLFFGAPAEVASSSGAGRVAAPAAGGEQQQQRPRRRRKRNMYRGVRQRPWGKWAAEIRDPRRAARVWLGTFDTAEAAARAYDSAALEFRGPRARLNFPARGAAAAACAPAAAAGAAETATP

SEQ ID NO: 21484 - DNA, 1399 bp, Panicum virgatum
  misc_feature: Ceres CLONE 1816388
  misc_feature: Encodes the peptide sequence at SEQ ID NO. 21485
aaggtcgcgcacaaatgctgcgagcggcggcgtcgagatgcacccgcggcgccgcccggcggctgtcgtcggcggcggcggaggcgtctccagccgctgcgggcacacggcatcagccttccctcgacgagggggactggtcgtatcacagggagtggtggggcaaggaggacggtcccggcgagggggcgcagaccgtcttccgccgccactctgagtgcggcaacggcgtcgtctctgtcttcgcctacccagcctcccgcccggctattgagcattggccagcagtggagacatggcttcatgaaagaaatgcaagattatacccagagtcagctggcgtcgaccaatttaagatactaggctaccagtggcgagtaatgcgttttaatgatcatacacggcaaagcactgtaaaagtaatgacatgctataggacatcgggtcagagatcattagtcttgatgcagcaaccacatgttttagctgttccttatgtcaagagtatggtgtcagcgggattaacggcacttccttgtgcttcttatgatctccccgaagcagtatctggacagaacaatatgaaaattctgtgcatcggccatggtggtggcagcttaccattgtttttggcaagcaagttcagaggtgcttccatccacattgtggagattgatccggtggttgtctcagcttccgtcgaagccatgggtttccccatatcacctgtgaaaggcttatcatctgaatccatgctgcccgccgacgccgacgatctgctatggggaggcatacacgaccgcatcttcctccacattgcggatgccgaggacttcatcgccagcgacagcaaccaatacgacctcgtcttcatcgacgcctacgacggggatgacgtgttcccccgcaagctctgggacgccgacggggcgttcatgaaggacctggagaggagggtccacccggtccacggcaccgtggtggtgaacctgcactccgactcggagcttccgggccacgccgagttccagagcgtgcttcccatgggccggcgcgtctccgaggtctgcggggcgtacaagcaccacttcgggatggccttcacggccgccgtcccgtggctctgcaacatcaccctcgtcgcctgccgcggcgaggcggtcgccagcggcgccggcgtcggcgcgcgcctggggctcagccgcagggacttcgtcctcggcaagctcctgtcgaagtgcgacgtggttgagcgcgcgctggggttgccgttcccgtgtttgcagtacgtcaagaacggtttcgcgctggttgagtgagaatgtgggatgctctgtgttgaggaatttgaatggtagtacacttcgatcaatttggatattatttggtggtttacttt

SEQ ID NO: 21485 - protein, 434 aa, Panicum virgatum
  misc_feature: Ceres CLONE 1816388
  misc_feature: SWISSPROT Homolog: EC 2.5.1.16 Spermidine synthase
MLRAAASRCTRGAARRLSSAAAEASPAAAGTRHQPSLDEGDWSYHREWWGKEDGPGEGAQTVFRRHSECGNGVVSVFAYPASRPAIEHWPAVETWLHERNARLYPESAGVDQFKILGYQWRVMRFNDHTRQSTVKVMTCYRTSGQRSLVLMQQPHVLAVPYVKSMVSAGLTALPCASYDLPEAVSGQNNMKILCIGHGGGSLPLFLASKFRGASIHIVEIDPVVVSASVEAMGFPISPVKGLSSESMLPADADDLLWGGIHDRIFLHIADAEDFIASDSNQYDLVFIDAYDGDDVFPRKLWDADGAFMKDLERRVHPVHGTVVVNLHSDSELPGHAEFQSVLPMGRRVSEVCGAYKHHFGMAFTAAVPWLCNITLVACRGEAVASGAGVGARLGLSRRDFVLGKLLSKCDVVERALGLPFPCLQYVKNGFALVE

SEQ ID NO: 21486 - DNA, 710 bp, Panicum virgatum
  misc_feature: Ceres CLONE 1816396
  misc_feature: Encodes the peptide sequence at SEQ ID NO. 21487
atcggaggcaacaaggaacccgtccctctccccacgaaccaagcacgagctcctcctcctcttcagttcttcctagagagaccgagagggagggttccgctctactcttccccgactccactccgccgccgccgcatcccccaactcccgcaagatccgccgggtgcccggctgtcgatttaatttctcgggagcaggaggggttaaccttcgtggggggaaacaatgtactttgaaggctatggctaccatggaaacactttcgagcagacatatcgctgctacccagcatctttcattgacaagccacaacttgaggctggtgacaaaattattatgccaccatcagctcttgatcgtctcgcatctctgcatattgagtatcctatgctttttgaagtccacaatgcggcagcagaacggacttcacattgtggtgttctggagttcattgcagaagaaggcatgatctacatgccatattggatgatgcaaaatcttcttctgcaagagggagatatggtgttcataaaaaatgcgaacctccccaagggcacatatgtcaagttgcagcctcatacaacagactttttggatatctcaaaccccaaagcaatcttggagaaaactttgaggaacttttcttgcctaaccacaggtgacagcattatggtagcatataataaccagaagtactacattgatatagt

SEQ ID NO: 21487 - protein, 161 aa, Panicum virgatum
  misc_feature: Ceres CLONE 1816396
  misc_feature (10)..(161): Pfam Name: UFD1 Pfam Description: Ubiquitin fusion degradation protein UFD1
MYFEGYGYHGNTFEQTYRCYPASFIDKPQLEAGDKIIMPPSALDRLASLHIEYPMLFEVHNAAAERTSHCGVLEFIAEEGMIYMPYWMMQNLLLQEGDMVFIKNANLPKGTYVKLQPHTTDFLDISNPKAILEKTLRNFSCLTTGDSIMVAYNNQKYYIDI

SEQ ID NO: 21488 - DNA, 668 bp, Panicum virgatum
  misc_feature: Ceres CLONE 1816413
  misc_feature: Encodes the peptide sequence at SEQ ID NO. 21489
agacgcgacgccaaagtccaaacagatatccccacattcccatcgcctcgcgattatcccgtgcgtctcctccaaataaaccgcgagagatttggcccgggcgagaggtttcaaaccaaacacctccccctccctcccaggtctcatccggtgcaaacaaatccggtgagctgcctgccagccgcgcgggagcctcggaagggcatagtattgtatactaccactatataaccagccgccgccgcggtcgtcgtcgtcgctcctacctcgctgcaccggccagtccccccccccaccccccccctccgcctcgccgcgccgcgcctccgtcgccgggagtagggagggagaggcgccggcagatcgatcggggaggcgcgcgcgggctcggcggccggttgctgctatggcggaggcggtgcgggagctgcgcgcgagcttcgcggcggggcggacgcggccggcggagtggcgggcggcgcagctccgggcgctggtgcggatgatcgacgagcgggaggccgacatcaccgccgcgctccacgacgacctcgccaagccgcacatggagtcgtacctccacgagatatcgctcgcgaagtcctcgtgcaagttcgcgctcaacgggctcaagaactggatgaagcccgagaaggtacctgcggtca

SEQ ID NO: 21489 - protein, 87 aa, Panicum virgatum
  misc_feature: Ceres CLONE 1816413
  misc_feature: SWISSPROT Homolog: EC 1.2.1.3 Aldehyde dehydrogenase (NAD(+))
MAEAVRELRASFAAGRTRPAEWRAAQLRALVRMIDEREADITAALHDDLAKPHMESYLHEISLAKSSCKFALNGLKNWMKPEKVPAV

SEQ ID NO: 21490 - DNA, 649 bp, Panicum virgatum
  misc_feature: Ceres CLONE 1816427
  misc_feature: Encodes the peptide sequence at SEQ ID NO. 21491
ccgcggacgcgctcgccttctcgggcctccgcgccggcgacctcctcccgcgcgccaacgccgccgccgagagggacagggcgctccgcgtgctcctcaagtcccccgcggtgtcgccctcgtcctcccccaagaagtccgcctcgccgccgccggccccggagccgaggaaggagtacccgcccgacctcacgctcccggacctcaagagcggcctcttcagcaccgacgagttccgcatgtacagcttcaaggtgaagccctgctcccgcgcctactcccacgactggaccgagtgccccttcgtgcaccccggcgagaacgcgcgccgccgcgacccgcgccgctactcctacagctgcgtcccctgccccgagttccgcaagggcggcgcctgccgcaagggggacaactgcgagtacgcgcacggcgtcttcgagtgctggctccacccggcgcagtaccggacgcgcctctgcaaggacgaggtcggctgcgcgcggcgcatctgcttcttcgcgcacaagccggaggagctccgcgccgtcaacccctccgcggtctccgtcggcatgcagcccgccgtgtcctcgccgcccaacgggctcgacatgggcatgctccaccccgcgtggccctcctccccggc

SEQ ID NO: 21491 - protein, 215 aa, Panicum virgatum
  misc_feature: Ceres CLONE 1816427
  misc_feature (118)..(144): Pfam Name: zf-CCCH Pfam Description: Zinc finger C-x8-C-x5-C-x3-H type (and similar)
  misc_feature: The sequence is a functional homolog of SEQ ID NO 230 in the 10/412,699 US patent application
  misc_feature: Useful for making plants with altered cell wall content and/or composition
ADALAFSGLRAGDLLPRANAAAERDRALRVLLKSPAVSPSSSPKKSASPPPAPEPRKEYPPDLTLPDLKSGLFSTDEFRMYSFKVKPCSRAYSHDWTECPFVHPGENARRRDPRRYSYSCVPCPEFRKGGACRKGDNCEYAHGVFECWLHPAQYRTRLCKDEVGCARRICFFAHKPEELRAVNPSAVSVGMQPAVSSPPNGLDMGMLHPAWPSSP

SEQ ID NO: 21492 - DNA, 674 bp, Panicum virgatum
  misc_feature: Ceres CLONE 1816440
  misc_feature: Encodes the peptide sequence at SEQ ID NO. 21493
ataacttgttggatgctgtacatttctcgctactgcgggcactgagacggcatctggaatctaaatccactaagcttgcttcgaattgctttaggtatctggattggacactaatagacacattgacttggccagtgttcttactagaatacctgtacgtgatgggttgcattaagaatctaggggttcagagttttgctagaagcctcctagccactgaatactataagcttcctgttgccgtgaagctgagggtgctgcaaatactctgtgatcatgtcatcgattcagaagaactcaaaacagaactggaggttcaagaaggctacaacgaggggatggaaaatgagactgatcgtagtgttttcttggggcctggttcaagcgcagtctctgctagagccacacaggcctctgcttataaaagaataggtgatctacaaagcctgagaagagctccaaatgtgaacaatctaaaagctgttatagaaaacgcttctcaggatggcaaccataatgcttgccgaatatgtggaatgaatgggactttgttacgttgtgatggctgcccatgggcatatcattcaagatgtattggtcaaaacaaatcttatcttccccagcgagcatggttctgtcacgaatgtgtggttaacaatctcacaccaacttca

SEQ ID NO: 21493 - protein, 223 aa, Panicum virgatum
  misc_feature: Ceres CLONE 1816440
  misc_feature (173)..(218): Pfam Name: PHD Pfam Description: PHD-finger
NLLDAVHFSLLRALRRHLESKSTKLASNCFRYLDWTLIDTLTWPVFLLEYLYVMGCIKNLGVQSFARSLLATEYYKLPVAVKLRVLQILCDHVIDSEELKTELEVQEGYNEGMENETDRSVFLGPGSSAVSARATQASAYKRIGDLQSLRRAPNVNNLKAVIENASQDGNHNACRICGMNGTLLRCDGCPWAYHSRCIGQNKSYLPQRAWFCHECVVNNLTPT

SEQ ID NO: 21494 - DNA, 1694 bp, Panicum virgatum
  misc_feature: Ceres CLONE 1816445
  misc_feature: Encodes the peptide sequence at SEQ ID NO. 21495
attcgaggtcggagggtagagagggtgaggaggaagcaccgagcaccgggtgggtcggcgcgcggcgggccatggcgacctacgacaaggccatcgagtcgtacaagaaggcggtgaccacggcggcgtcgctggcggcgtcggcgatgctggtgcgcggcgtggtaaacgagctggtgccgtacgaggtgcgggacctgctcacctccgggctgggctacctgcggtcgcgcatgtcgtcgcagcacacggtggtgatcgaggagaccgagggctgggccgccaaccagctctacgacgccgcgcgcgcctacctcgccacgcggatcaacaccgacatgcagtgcctccgcgtcagccgcgtcgacgagggcaagagcctcatattcagcatggaggagggcgaggagatggccgacatccacgacggcgccgagttcaggtggcgcctcgtctgccgggacaacccgggcgccggtgccggcaacggcaacggcggccgcggcgggaacggcagctaccgcgtcgaggtgcgctccttcgagatgagcttccacaagaagcacaaggacaaggccatcacctcctacctcccgcacatcctcgccacggccaagaagatcaaggagcaggacagaacgctcaagatctacatgaacgagggcgagtcctggttcgccatcgacctccaccacccatccaccttcagcacgctcgccatggaccacaagatgaagcagtcggtcatggatgacctcgataggtttgtcaagaggaaggagtactacaagaggattggcaaggcgtggaaaagggggtacctcctgtatggcccgcctgggacgggcaagtccagcctcattgcagccatggccaactacctcaagttcgatgtctatgatctcgagctgactgaggtgaactggaactcaacacttcgacgcctgctcattgggatgaccaaccggtcaatccttgtcatcgaggacattgactgctctatcaatctgcaacagcgggacgaaggtcaggacggtaccaaatccaatccttcagaggacaaggtgacactatctgggctcctcaacttcgttgatggcctctggtcaacaagtggggaggagagaatcattatcttcacaacaaactacaaggagcgacttgatccagcgcttcttcgcccaggcaggatggacatgcacatccacatggggtactgctgccccgagtcattcagaatcctggcctccaactaccactccatcagtgaccacgacacgtaccctgagatacaagagttgatcaaggaggtaatggtgactccagcagaggttgcagaagtgcttatgaggaatgacaacactgacattgcactctagggccttatccagttcctcaagggaaagaagagtgatgccaaggatagcaaaggtgagaatgtagaccatgtggccaaagaggatgcgaaagagatgatgactaaataagacatctcaggcgatcaaaagctgaacgatgcaggcaaagaatgatgcccaagtagtgtgcatattatatgttagtacttagtactggaaaaatcagccaaaaatgtattgttttggtattaataagagatcatttttggaactagagaactctggtattatggtactttattttcctctttaaatcagataccacattgtaaagtg

SEQ ID NO: 21495 - protein, 435 aa, Panicum virgatum
  misc_feature: Ceres CLONE 1816445
  misc_feature (249)..(420): Pfam Name: AAA Pfam Description: ATPase family associated with various cellular activities (AAA)
  misc_feature: SWISSPROT Homolog: EC 3.6.4.3 Microtubule-severing ATPase
MATYDKAIESYKKAVTTAASLAASAMLVRGVVNELVPYEVRDLLTSGLGYLRSRMSSQHTVVIEETEGWAANQLYDAARAYLATRINTDMQCLRVSRVDEGKSLIFSMEEGEEMADIHDGAEFRWRLVCRDNPGAGAGNGNGGRGGNGSYRVEVRSFEMSFHKKHKDKAITSYLPHILATAKKIKEQDRTLKIYMNEGESWFAIDLHHPSTFSTLAMDHKMKQSVMDDLDRFVKRKEYYKRIGKAWKRGYLLYGPPGTGKSSLIAAMANYLKFDVYDLELTEVNWNSTLRRLLIGMTNRSILVIEDIDCSINLQQRDEGQDGTKSNPSEDKVTLSGLLNFVDGLWSTSGEERIIIFTTNYKERLDPALLRPGRMDMHIHMGYCCPESFRILASNYHSISDHDTYPEIQELIKEVMVTPAEVAEVLMRNDNTDIAL

SEQ ID NO: 21496 - DNA, 1758 bp, Panicum virgatum
  misc_feature: Ceres CLONE 1816455
  misc_feature: Encodes the peptide sequence at SEQ ID NO. 21497
ggggacgagccgacgacgaagtggcctcccttcccctcccctccctttcctccccgtcccgtcctcccgtcgtcttcactccaactcctctgctgctgctgctgctgctattgcgattgggagggcggtccttgtcgcgagcgacgctgaggctttcgggacggggattgattgattgattgcacgaccccgcccgccagactcggtgccgcctgcgaattactagtgggcagcggcgcgcgctctggttgtggtggactggtggtgtagccgggtgtgtttgcggagcctgcggcggcgatgggccaggacctcgtcgagatccacccgcgcgagctccagttcacctttgaggtgaagaaacaaagttcatgtactgtccatctagtcaacaagtccaatgaatatgttgctttcaaggttaaaacaacatctccaaaaagatactgtgttcgaccaaatactggagttatccttcctaggaaaacatgtgaattcacagttaccatgcaagcactccgaactgctccaccagacatgcaattaaaagacaagtttttggtgcagaccacagttgttccttatgatacatctgatgaggaccttgttcctgcctttttctccaaagaaactggcaggtacatcgaggaaagtaaattgagagttgtccttgttagtgcatcccattctcttgaagaggaacccatcaatggagttcatgacactgagccagctgctgaagttcctgtgctgaaagagatgccaaatatagaggacgaagtgccagttgttgcaaaagaagttcgtccccctctggaacaaactccagcaattgcaactgaaataccttcacctgtcaaagagactccaggcttgagggaaattcctgtgccaataaatgaagtgccagctgcattgacagaatctccttccaatcaaaaagattcatctgctattgcaattgaacatgcctctactgttacaattgaacatgcctctgctattacgattgaatcccctcctttgaaacaaagcactgcagtttttaaggaatctcctccactggagaaaactcctaaagaagctgttatgctaagtgatcgaggacttttcaatgtgcagaaccatcaattatctcatgtaactgaagatgttcagaatctgaagtcaaagctcaacaatcttgaatcaaaattggaagaggctgaaaagatgataataaggctaagagaagagagcagaagtaccacccaggagcgggataagttacagcaagaaatggtatttctaagaaagaagggtgctcctaggagtcaagtgggctttcccttgctgtttgtgatgtacgtggcgcttcttggtacctcactcggttacctgctgcgattatgagttccgtgttcagcagctgggatgctcgatgtggcaagagagttgaagggcagtcgcactccaaaatcttggagaggagcatttgttagcattattagtgcagatggttttggatataacagcggtggaaaactaaactgccagttgcctgtatgtatagaacagttctttttgcgttgtatagaatccacccaaaagatgccttctgcgctgccgctgcctcgtagactaaccagggtttattccatttgccctagttttttttttctttttacagtttgctggattcggttctcccgaacgattacaatctcgtgttatttaccatttggttcgtgacacggtggatcaggttatctttgaccc

SEQ ID NO: 21497 - protein, 363 aa, Panicum virgatum
  misc_feature: Ceres CLONE 1816455
  misc_feature (5)..(112): Pfam Name: Motile_Sperm Pfam Description: MSP (Major sperm protein) domain
MGQDLVEIHPRELQFTFEVKKQSSCTVHLVNKSNEYVAFKVKTTSPKRYCVRPNTGVILPRKTCEFTVTMQALRTAPPDMQLKDKFLVQTTVVPYDTSDEDLVPAFFSKETGRYIEESKLRVVLVSASHSLEEEPINGVHDTEPAAEVPVLKEMPNIEDEVPVVAKEVRPPLEQTPAIATEIPSPVKETPGLREIPVPINEVPAALTESPSNQKDSSAIAIEHASTVTIEHASAITIESPPLKQSTAVFKESPPLEKTPKEAVMLSDRGLFNVQNHQLSHVTEDVQNLKSKLNNLESKLEEAEKMIIRLREESRSTTQERDKLQQEMVFLRKKGAPRSQVGFPLLFVMYVALLGTSLGYLLRL

SEQ ID NO: 21498 - DNA, 2398 bp, Panicum virgatum
  misc_feature: Ceres CLONE 1816470
  misc_feature: Encodes the peptide sequence at SEQ ID NO. 21499
acaccggccaattcatcgagctcgctcgccgtcacactgcgccaccagcgggcaacccgcagctccctcccgccatggcctcttggctcaaggtcgccgaagacttgctcgaagtcgtcgaccggagggccaagattgtggcaactgagttgtcggatgagcagtctacctctcaaccttcaggatcaaatagccgagaagtggatgggaagaagggaaaaccgagggagaagggtccattgaagctcacgtctgctgatggtggtaataagacaggtgctcagagggaaaggaaaagtaggcaaccgccacgagagcggatgaagattgagaagatcaggccttcagcaccagcagattcagcaagtgttgatgccagtgctagtgaacctgaaattgctccagttgatgttaaggcaatgaataatgagagtacactggagaaaggagagaaggctactgatgatcttaagactgatggggctgggactgttgctgataacgtggttgaagtccagccgatggagataaactctgaggatgcagctcccactgtggatgctgttgcacgttccagaaattcagagatcgctgtcgagagctcttcttcagttccagatgaaaaaattgagtcgagcagcagtaaccagactgctgagactggtccagtggttaatttggaggagagagactcagctgtggctgttatccaggacaggaatatgtctgattcgtcaaatacagaaggtactgtcaaattgcatgaatcaaagaaagagtatgtttcagattcaccagaaagcatagaaaatcaacacgcacagaaatcggattcagtttcggccaaagaacaagatcaacttgaggaggctcaaggattgttaaaaagtgctgttaagactgggcaatcaaaagaagctaggttagctcgggtttgtgctggactttcatcccgcctccaggagtataagtctgaaaacgcacagctggaggaacttcttgttcaagagagagagaagtctagctcatatgaggttcacataaagcaactacagcaagaattatcaatgtccagagtagaaggttcaagagctgagtcgaatatggttgatgctttgactgcaaaaaacacagagatcgaatctcttgttaaatcattggactcttggaagaaaagagcagcaacttcagaagaaaagctagcttctttagaggaagatatggatggtctcaagaggaaccgtgaacttactgaaaccagggtcatccaggctttacgggaggaacttgctaccgcagagcgtagggctgaagaagagcgcattgcacataatgccacaaaaatggcagctgtcgagagagaagtagaattagaacatcgagctgttgaggcatcaaatgctcttgctagaatccagagagctgctgaccaaagctcatcaagagcactggaattggagcacaaggtggctgtgcttgaggttgaatgtgcttcgttgcaacaagaacttcaggaaatggaagctcgaaatcgccgtgcgcagaaaaagcctgccgaagaagctaatcaagttcttcagatgcaagcatggcaggaagaagttgagcgtgcacgccaaagccaacgagatgcagagacaaagatatcatccttggaggctgagttacagaagatgagagttgaaatggctggaatgagaagagatgcagagcattattctagacaggagcatattgagctagagaagagatatcgtgagctaactgacttgctgtaccacaaacaaacacaattggaatccatggccagtgaaaagggtgcattggagttccaactggagaaatcattgaagcaattccatgaagtgcagatcgaagcagaaaggagtaaatcaactcgtagatcagcatcgtcgtgggaagaagatactgatatcaaggcattagagcctcttcctcttcatcatcgccacatggcaacagctaatcagcagttacaaaaggctgcgaagcttctagatacaggagctgtccgtgcaacaagatttttgtggcgacatcccgttgctcgagtcagcctgctattctatctggtgtttgtgcatttgttcttgatgcacttgctgcaccgccttcaggacttcgcatccagagaaggagcatcaggcatgggggatctggccaatgttaacctgccatagactctgagctctcctctttcctgccgatccaggcaatcgtccctgattctagctccacacgcttgagcttccctggttggacttgaatgcggtattaaccccccaacatttcattcttttaattttcttccccttttccatcttttgtaaagtagtagtattggccatgggcaatataatccattcttttacacttt

SEQ ID NO: 21499 - protein, 708 aa, Panicum virgatum
  misc_feature: Ceres CLONE 1816470
  misc_feature: SWISSPROT Homolog: EC 2.7.11.1 Non-specific serine/threonine protein kinase
MASWLKVAEDLLEVVDRRAKIVATELSDEQSTSQPSGSNSREVDGKKGKPREKGPLKLTSADGGNKTGAQRERKSRQPPRERMKIEKIRPSAPADSASVDASASEPEIAPVDVKAMNNESTLEKGEKATDDLKTDGAGTVADNVVEVQPMEINSEDAAPTVDAVARSRNSEIAVESSSSVPDEKIESSSSNQTAETGPVVNLEERDSAVAVIQDRNMSDSSNTEGTVKLHESKKEYVSDSPESIENQHAQKSDSVSAKEQDQLEEAQGLLKSAVKTGQSKEARLARVCAGLSSRLQEYKSENAQLEELLVQEREKSSSYEVHIKQLQQELSMSRVEGSRAESNMVDALTAKNTEIESLVKSLDSWKKRAATSEEKLASLEEDMDGLKRNRELTETRVIQALREELATAERRAEEERIAHNATKMAAVEREVELEHRAVEASNALARIQRAADQSSSRALELEHKVAVLEVECASLQQELQEMEARNRRAQKKPAEEANQVLQMQAWQEEVERARQSQRDAETKISSLEAELQKMRVEMAGMRRDAEHYSRQEHIELEKRYRELTDLLYHKQTQLESMASEKGALEFQLEKSLKQFHEVQIEAERSKSTRRSASSWEEDTDIKALEPLPLHHRHMATANQQLQKAAKLLDTGAVRATRFLWRHPVARVSLLFYLVFVHLFLMHLLHRLQDFASREGASGMGDLANVNLP

SEQ ID NO: 21500 - DNA, 676 bp, Panicum virgatum
  misc_feature: Ceres CLONE 1816476
  misc_feature: Encodes the peptide sequence at SEQ ID NO. 21501
agagagaggcagcaggcagggaggggagcatggcgagcgtcaagcagggcggggacgcggcgaaggcggcgggaggcggaggggggcttgggatgccggcggcggaggtggagcaggtgttccggcgctacgacgccaacggcgacggcaagatctcggcggaggagctggcgtccgtgctgcgggcgctgggcgcgccgccggggcccggggaggtgcgccgcatgatggacgagatggacgccgaccgcgacggcttcgtcgacctcgccgagttcgtcgccttccactgcggcgcccagccggcggaggggcaggacgacggcgccgcggaggccgagctgcgggaggccttccgcatgtacgacgccgaccgcaacggcctcatctccgcgcgggagctccaccgcgtcctgcgccagctcggggacaagtgctccgtcgccgactgctcccggatgatccgctccgtcgacgccgacggcgacggcagcgtcaacttcgacgagttcaagaagatgatgggcgccggcgccggagccaggcgctagcagccagccaaggcccaaggaggaggaacctccctgcatgactccgatccacacccccaaagtactacataccaagcaagcacggttttggaggcactctgatctgatttcatggtgaacagcgg

SEQ ID NO: 21501 - protein, 173 aa, Panicum virgatum; identical to SEQ ID NO: 15609
  misc_feature: Ceres CLONE 1816476
  misc_feature (26)..(54): Pfam Name: efhand Pfam Description: EF hand
  misc_feature (104)..(132): Pfam Name: efhand Pfam Description: EF hand
  misc_feature (140)..(168): Pfam Name: efhand Pfam Description: EF hand
  misc_feature (62)..(88): Pfam Name: efhand Pfam Description: EF hand
  misc_feature: SWISSPROT Homolog: EC 2.7.11.1 Non-specific serine/threonine protein kinase

SEQ ID NO: 21502 - DNA, 728 bp, Panicum virgatum
  misc_feature: Ceres CLONE 1816489
  misc_feature: Encodes the peptide sequence at SEQ ID NO. 21503
acatcaccagctcaactcaatcactcgaccagccacttcaatccttccattccatttccatcaccaccacaggcaccagcggctgccggctgcgtcagcaagtcagcaacgtcgcagcccctatagctcgtgcgtacgtcccgatggagcttccaccatgggcggcttttctcggcgtggtgctcgccaccgtgatgcttctcaaggccgtcctcggccgccgcgggcgccgcgcgtaaaacctcccgccggggcccaagccgtggccgatcatcggcaacctcgacctgatgggcgcgctcccgcaccgctccatccacgagctgtcaaggaagtacggcccgctgatgcagctccggttcgggtccttccccgtggtcgtcggctcgtcggtggacatggccaagttcttcctcaagacccacgacgtgatgttcacggaccggcccaagaccgccgccggcaagtacaccacctacaacaaccgggacatcacctggtccccgtacggcgcctactggcggcaggcgcgcaagatgtgcctcaccgagctcttcagcgccaagcgtctcgagtcgtacgagtacatccgcgccgccgaggtccaagcgctgctgcgcgacctgcacgcggcgtctggcaccggccgcgccgtcatgctcaaggactacctgtccacggtgagcctgaacgtgatcacgcgcatggtgctcggcaagaagtacctt

SEQ ID NO: 21503 - protein, 145 aa, Panicum virgatum
  misc_feature: Ceres CLONE 1816489
  misc_feature: SWISSPROT Homolog: EC 1.14.13.21 Flavonoid 3'-monooxygenase
  misc_feature: Useful for making plants with altered carbohydrate content
MGALPHRSIHELSRKYGPLMQLRFGSFPVVVGSSVDMAKFFLKTHDVMFTDRPKTAAGKYTTYNNRDITWSPYGAYWRQARKMCLTELFSAKRLESYEYIRAAEVQALLRDLHAASGTGRAVMLKDYLSTVSLNVITRMVLGKKY

SEQ ID NO: 21504 - DNA, 2632 bp, Panicum virgatum
  misc_feature: Ceres CLONE 1816496
  misc_feature: Encodes the peptide sequence at SEQ ID NO. 21505
acaactgttatgacgaattccaagagttggccagttgtgctctgggggcacgtattgggggagatctgagcaagctgttcttttcctcattcctgtctcccatccaaagaagaagccaagaacgccgatgatcacctcagaaatgtgatgaagtatctatccaaaatatcatcatcccaggaaagatacaaactatttatccagtgacaagtttccagccgaaatcaatggcttcaagaccaagtactggtaaaccttggagatatcagcatctctctgctctattattttcagcaatcctagaatgggttttgatgcttctgctgctgcttgaggggctactctcctatctggtgacgacatttgcacacttttgcaagctgcaaccgccatgcccaatgtgcacaaggttggatcatgtcttgggcaaggcgcagaagggcttttactgcaaccttatgtgcagttctcacaaggcagaagcatcatcatgggcattttgccacatccaccaaaagcttgttgatatccacagtatgtgtgaagcctgccttctttcatttgctactgacaagaagtcaaaccttgagacataccgatccttggtagggaaacttggtgtcggcattgacaatgcaggttgcagatacaacttcgcttcgggaaatgatgcaactgaagcaccagtcctgaaggaaactctatgctcatgctgctcaaggccattggaagtgaagtatcatccttttgtcgttcttcagaacaaagctagtggcattggcattgaggggatctgtagagttgcttcaagagataatcagagtatcgatgagatcaattatgtcgcgtatagtgagctgaagacctctgacactgaatcagagccctggctgcctggttgtaatgttggaaatttgctaaagggtgactatatcaacttgaaggaaggttttgcaatgggccatcatcaactaacagagattgcagatgacatgcctccatatgacaactcgcaggagaaaaatcctgagctgtctgagttgacactagtccagaatggtggttctgacagtaaggctactgaaaattcagaagagttgcgcaacatccaagatgatggaaatggaaaggcaagcctccagtcaactgatcttaccatcaaagatgagcagcaaattactaaacataccggcacaaaagataaattggaagatgatgtttggcacaatgctcttagttctactgaggagttatcagtagacattaaatcagctgaaacagacaccataaccaatgaaaagaaagctgaatttactcatacagcaagaaggaaggagtcttttagagttcatgaagatttgaagtcactgttgtcacagctttctgttgcttcacaggcacctgattttgatagtccgaccgtccagaaccaacatgaacaagccatacttcacaatatcactagagcactctcccttgataggaattattcaggtatctctgagagtatggtgcatgaagctgaaggagagtgcacaattgatcaattgaagcaacaaatcgaattagaccgcaggtcaataaaccgtctttggaaggagctcgaggaagaaagaaatgcttcagctgtcgcggcgaaccaaacaatggccatgatcactagactacaggaagagaaggcagcaatgcagatggaagcattgcagtatcagaggatgatggaagagcaaagtgagtacgaccgcgaggaccttcagaagatggcccaaacagttcaaacactccaagcagagattgaaggctacaagataaaacttaaagatcagttgcccgtcgacgaaatacgcaaccacatgcgcctttcatgtccgaaagaacatggtactagcatctccagagtcaaatcactctcgggttttgaggacgagaagacgtacatctcaaaacgcttgagaaatctgagacagaagcttcatgaattctcaaacaatagcaagcttgttccatctcccaagctcagtgatgacaaagaaggttcagttgatgacagaaacaacgaggatgcgtgtgaagatgtcaacgaagatgacaatacagacgattcggaattcaacaagcatctaggaagaaatggggacacattcagggacttgaaacacggcagaggacttgatccaaaggggcagttccatgccatggtcagtgaaaatgacttggcttctttcgaagaccagatatctgaagtcagtgggaggctgatgatgctggaagcggaccggagcttcctggagcatagcgtgaactcgctgacaaatggcgaggcaggtgagaagctgatccgcgacatcgctagcagcctcagggagctccggaagatggggatctggaaggagtacgattagctgaagatggcggccactgctgtagtagagggtgcagataatgatgagctgattgtagacttgtagtggagcatgtgcctgcggttgctgtcatttggttgtggttgtgggtatgcaagtgtgccgagcatttcgcgtgaagtcatgtgcattgcattggagagttttgatgcttgcgtgtgaccagtgtatatgcacttttgagagctttctttctctctttttccgtg

SEQ ID NO: 21505 - protein, 724 aa, Panicum virgatum
  misc_feature: Ceres CLONE 1816496
  misc_feature: SWISSPROT Homolog: EC 2.7.11.1 Non-specific serine/threonine protein kinase
MASRPSTGKPWRYQHLSALLFSAILEWVLMLLLLLEGLLSYLVTTFAHFCKLQPPCPMCTRLDHVLGKAQKGFYCNLMCSSHKAEASSWAFCHIHQKLVDIHSMCEACLLSFATDKKSNLETYRSLVGKLGVGIDNAGCRYNFASGNDATEAPVLKETLCSCCSRPLEVKYHPFVVLQNKASGIGIEGICRVASRDNQSIDEINYVAYSELKTSDTESEPWLPGCNVGNLLKGDYINLKEGFAMGHHQLTEIADDMPPYDNSQEKNPELSELTLVQNGGSDSKATENSEELRNIQDDGNGKASLQSTDLTIKDEQQITKHTGTKDKLEDDVWHNALSSTEELSVDIKSAETDTITNEKKAEFTHTARRKESFRVHEDLKSLLSQLSVASQAPDFDSPTVQNQHEQAILHNITRALSLDRNYSGISESMVHEAEGECTIDQLKQQIELDRRSINRLWKELEEERNASAVAANQTMAMITRLQEEKAAMQMEALQYQRMMEEQSEYDREDLQKMAQTVQTLQAEIEGYKIKLKDQLPVDEIRNHMRLSCPKEHGTSISRVKSLSGFEDEKTYISKRLRNLRQKLHEFSNNSKLVPSPKLSDDKEGSVDDRNNEDACEDVNEDDNTDDSEFNKHLGRNGDTFRDLKHGRGLDPKGQFHAMVSENDLASFEDQISEVSGRLMMLEADRSFLEHSVNSLTNGEAGEKLIRDIASSLRELRKMGIWKEYD

SEQ ID NO: 21506 - DNA, 2313 bp, Panicum virgatum
  misc_feature: Ceres CLONE 1816548
  misc_feature: Encodes the peptide sequence at SEQ ID NO. 21507
gtcgccccgccaaggccgccacccaactgcaccgccgcccgcctaccaggaggcgcctgcgccaacctgctccgcgctcccggccaatccgcggcctccgcgcccggagccgcctgccaggagcgtctgcgccaccgcgccgcctgcctgcaccgcggcctctgcgctcccggttagtgcgctgctccgcgccccgcaggccgcagctgcccgcttcaccatctctttctccttccgttcctccagttctctctcgtgcatttctttcccggcgacccggcggtgaggactggcgagcgccgccgccgccatacgcccggtcttcgtcaggccctttgccggcgacaagcactcacctgattcgacccggaatgtgaatacgttgtgtaattgcccgcgaaacgatggcatcagacgagttcatcagccttgatgcaacttgcgaggctgatgcggaaggtgaacaagggggagaccttcaggttgaagctcctgatgtgaatggggcggagcctcagacatctgaactccaaccagaaggggaagctggtactgtgggtagtaatcccaagctgtctgatgggaacatagatcttgaagagggggaattggaagatatggacatcgcggacgatgatgttgtggttgtaaaagatgagctattagatgcttccgttcagcctgaagtcagtgttgcagctgtacagactgtaattggttttgaggtcaagctggacaagggtattggggctgaaaatgcaccaaattatgtgtcaaacagcatctctgtcgaagaaagtccagcaagaggagttaaaagagctcgtgtggaatcaaaggagccttcagttcgtgtcatctacagtgacttgacaagggaaagcaaaagaaagcttatggaactgatgcaacattggtctcagtggcaggccagaaggcagcacaaagtgaaggaagctgtggaagagatcttagaaagtggtgaagagacttattatccggcattacatgttggttccgagaaatcttgtgctgtgtcattttgggtggataaccaagcaagggagagtgctaccatggatgatgaatctgttccactgtatgatcgggaatttaccttgggctcaactccactgggtgattcatcaaacactgaaagggcagataaggatgattcgcgctgcttcaattgtggttcttatagccatgctctgaaggattgcccaaagcctcgggacaatgttgcaattagcaatgctcggaagcagcataatttgaaaagaaaccaatctaatgttaaccgcgtacagaaccgatattaccagaaaacacccggcaaatttgatgatcttaaagctggagtactgggacctgaaactagagagtgcctgggaattggggaaaatgacccccctccttggctgcataggatgcgtgaattaggttatcctccaggctacctagatgtggttgatgatgaagacaaaccttctggtatcaccatatttggagatggtgaggtgaaactagagtacgaggagggagagcttccagggcaaggcgaaccatccccacctcggaaaaggatgacagtggaattccctggaataaatgcccccatcccagagaacggtgacccctggctgtggggcagcacccctccccagtcctctgcccgccaatactcatcggattcgagggattaccgtgatagaggacctcctggtgctgatcattattcatcgagataccattccctcgaccatgggcagttgagcccaagcttggggaggtcacactcagagagggggtggagaagcccacctcgttacgataatctgccggcagatgacggtgcttggaccccacattcgtaccctagtaggcagttctcgggacactacagctcgagctcggagatgtcgtcgcgccattacagggacagggacagggacagggacagagacaggcatgacagcaggcactaccaccaccgcagataagtcaagtcaagcatgcagctgatttgtacggtatcattttgctgaagaatcttatactggacgacttggatctgacataacagcagttctattacagtgtctgaagtttcgaattttccttatctccatatattttgcagcgctgctcccaaatgcatagtaggcagtcgccttctctcatctagcctgtgactgatgtttgttcccgtgttgtatgactgccgttatctgtaactctgctcatttttccacagttaaggagaagacatagtatattgtagaatgaaaatctgagggcctgtttggatag

SEQ ID NO: 21507 - protein, 532 aa, Panicum virgatum
  misc_feature: Ceres CLONE 1816548
  misc_feature (317)..(367): Pfam Name: PSP Pfam Description: PSP
MASDEFISLDATCEADAEGEQGGDLQVEAPDVNGAEPQTSELQPEGEAGTVGSNPKLSDGNIDLEEGELEDMDIADDDVVVVKDELLDASVQPEVSVAAVQTVIGFEVKLDKGIGAENAPNYVSNSISVEESPARGVKRARVESKEPSVRVIYSDLTRESKRKLMELMQHWSQWQARRQHKVKEAVEEILESGEETYYPALHVGSEKSCAVSFWVDNQARESATMDDESVPLYDREFTLGSTPLGDSSNTERADKDDSRCFNCGSYSHALKDCPKPRDNVAISNARKQHNLKRNQSNVNRVQNRYYQKTPGKFDDLKAGVLGPETRECLGIGENDPPPWLHRMRELGYPPGYLDVVDDEDKPSGITIFGDGEVKLEYEEGELPGQGEPSPPRKRMTVEFPGINAPIPENGDPWLWGSTPPQSSARQYSSDSRDYRDRGPPGADHYSSRYHSLDHGQLSPSLGRSHSERGWRSPPRYDNLPADDGAWTPHSYPSRQFSGHYSSSSEMSSRHYRDRDRDRDRDRHDSRHYHHRR

SEQ ID NO: 21508 - DNA, 701 bp, Panicum virgatum
  misc_feature: Ceres CLONE 1816554
  misc_feature: Encodes the peptide sequence at SEQ ID NO. 21509
aaatcaaacttctcgaaaattgggttcaatttcttctacggccgcctccacctcgaacagcgcggaccgaggagaccccccgggaaagagaggccatggcttcctctgccccggggagagcaggaagaagggtgacctcacctgcggcggcggctgttttgctaatggtacttgctggggcggagccggcggcggcgtgctacccgcgcttgttcagcttcggggactcgctggccgacacgggcaacttccccttctactacggcaacaactccggcgagcccgcgctccggccgccctacggcgagacattcttccgccgcgccaccgggcgcttctccaacggccgcctcatcctcgacttcatcgcggacacgatggggctcccgttcgtgcggccgtacctgagcgggcggcgcgcggaggacttcgcgtgcggggccaacttcgcggtgggcggcgccacggcgctcggcccggacttcttccgcgacaggggtttcaacatcggcgacgggagggtgcacctcgatttggagatgaagtggttccgcaacctgctcgacctcctctgccccggcggccgctccggttgcttagacatgatgagccaatcccttttcttggttggagaaattgggggcaatgattacaacctacctcttctctccagagtaccaattgagaagatccgctccttc

SEQ ID NO: 21509 - protein, 201 aa, Panicum virgatum
  misc_feature: Ceres CLONE 1816554
  misc_feature: SWISSPROT Homolog: EC 3.2.1.51 Alpha-L-fucosidase
MASSAPGRAGRRVTSPAAAAVLLMVLAGAEPAAACYPRLFSFGDSLADTGNFPFYYGNNSGEPALRPPYGETFFRRATGRFSNGRLILDFIADTMGLPFVRPYLSGRRAEDFACGANFAVGGATALGPDFFRDRGFNIGDGRVHLDLEMKWFRNLLDLLCPGGRSGCLDMMSQSLFLVGEIGGNDYNLPLLSRVPIEKIRS

SEQ ID NO: 21510 - DNA, 445 bp, Panicum virgatum
  misc_feature: Ceres CLONE 1816571
  misc_feature: Encodes the peptide sequence at SEQ ID NO. 21511
aagccaccacctcacaagtcacgcgcgcctatccctccccgcgctcgcgcacgtgaggcgagcaggcggccggccagcgcccgccccccatcctctccacctccgccatggcgttcgcgctcaaggccgcctccaccgcgaccgccgggtcggcgtcgctcgccgccgtggggcccaggaggggcgccgcgccggccgccgggagggtctcgttccggggcgcggcgcccgccgggcccgcggtcgccgtcagggcggcagcggcggcgagctgccgccgtggcgcaggacaggcgcagcatctcggggaaattcaccgagctcagggagcaggggaagactgccctcatccccttcatcgttgctggtgaccctgacttgcccaccaaaacaaacgcactcaacatccttgacgcctatggctcgcacgtgattgaattgggcg

SEQ ID NO: 21511 - protein, 148 aa, Panicum virgatum
  misc_feature: Ceres CLONE 1816571
  misc_feature: SWISSPROT Homolog: EC 4.2.1.20 Tryptophan synthase
KPPPHKSRAPIPPRARAREASRRPASARPPSSPPPPWRSRSRPPPPRPPGRRRSPPWGPGGAPRRPPGGSRSGARRPPGPRSPSGRQRRRAAAVAQDRRSISGKFTELREQGKTALIPFIVAGDPDLPTKTNALNILDAYGSHVIELG

SEQ ID NO: 21512 - DNA, 703 bp, Panicum virgatum
  misc_feature: Ceres CLONE 1816577
  misc_feature: Encodes the peptide sequence at SEQ ID NO. 21513
ctgaaaacaataaaacaggctgtggaaatgaggaacagtgtttgccacagtgcaactatatgtgccaatgcaatcatgcatgcaggaactactgtagataccttcctaagagaaaacctggagtggttaagcagagcaaccaattgggcgaaattcagtgcaactgctggactaggtgtcattcatagaggccaccttcaacagggccgggctttgatggccccctacctacctcaaagtggtgcagttggtggtggcagtccatattcagaaggtggtgccctgtatgcgttaggtctgattcatgccaatcatggtgaaggaatcaaacagtttctccgtgaaagtcttcgcaacaccagtgctgaggtcatccaacatggtgcatgtttgggacttgggcttgcagctttgggaactgcagatgaggagatatacgaggacataaagaatgtcctttacacagacagtgctgtggctggtgaggcagctggtattggcatgggcttgctcatggttgggaccgccagtgagaaggctagtgaaatgcttgcttatgcacatgatacccaacatgaaaatattataaggggtttgtctctgggcattgcattgacagtatatggcagggaagaagaagcagacaccttgattgaacaaatgactagagatcaagatcccatactacgttatggtggtatgt

SEQ ID NO: 21513 - protein, 234 aa, Panicum virgatum
  misc_feature: Ceres CLONE 1816577
  misc_feature (128)..(162): Pfam Name: PC_rep Pfam Description: Proteasome/cyclosome repeat
  misc_feature (93)..(126): Pfam Name: PC_rep Pfam Description: Proteasome/cyclosome repeat
  misc_feature (163)..(196): Pfam Name: PC_rep Pfam Description: Proteasome/cyclosome repeat
  misc_feature (53)..(86): Pfam Name: PC_rep Pfam Description: Proteasome/cyclosome repeat
LKTIKQAVEMRNSVCHSATICANAIMHAGTTVDTFLRENLEWLSRATNWAKFSATAGLGVIHRGHLQQGRALMAPYLPQSGAVGGGSPYSEGGALYALGLIHANHGEGIKQFLRESLRNTSAEVIQHGACLGLGLAALGTADEEIYEDIKNVLYTDSAVAGEAAGIGMGLLMVGTASEKASEMLAYAHDTQHENIIRGLSLGIALTVYGREEEADTLIEQMTRDQDPILRYGGM

SEQ ID NO: 21514 - DNA, 641 bp, Panicum virgatum
  misc_feature: Ceres CLONE 1816578
  misc_feature: Encodes the peptide sequence at SEQ ID NO. 21515
actagcagagtagcagagcatgcctgctgctggccagcccagcccccactcacgctcagaattgaattgcttgatgctgcaggtgcacccggacacgtacgcgctggtggtgagcacggagaacatcaccctgaacgcctacatgggcaaccaccggccgatgctggtgaccaacacgctcttccgcgtcggcggcgccgccatcctcctctccaaccgccgcggcgaccgcggccgggccaagtaccagctcatccacaccgtccgcacccaccgcggcgcgcacgaccagagcttcacctgcgtcacgcaggaggaggacgccgccggctgcgtcggcgtctccctctccaaggacctcatgctcgtcgccggcgaggccctgcgcaccaacatcaccacgctggggcccctcgtcctccccatgtccgagcagctccgcttcctcgccaccgtcgtcctcacccgcgtcttccgcgccaacgtccgcgcctacctccccgacttccgcctcgccttcgaccacttctgcatccacgccggcggccgcggcgtgctggacgagctcgagcgcagcctccagctcagcgcctggcacatggagccctccaggattacgctctgccgcttccgccacacct

SEQ ID NO: 21515 - protein, 207 aa, Panicum virgatum
  misc_feature: Ceres CLONE 1816578
  misc_feature (1)..(151): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
  misc_feature: The sequence is a functional homolog of SEQ ID NO 2 in US patent 7038112
MPAAGQPSPHSRSELNCLMLQVHPDTYALVVSTENITLNAYMGNHRPMLVTNTLFRVGGAAILLSNRRGDRGRAKYQLIHTVRTHRGAHDQSFTCVTQEEDAAGCVGVSLSKDLMLVAGEALRTNITTLGPLVLPMSEQLRFLATVVLTRVFRANVRAYLPDFRLAFDHFCIHAGGRGVLDELERSLQLSAWHMEPSRITLCRFRHT

SEQ ID NO: 21516 - DNA, 635 bp, Panicum virgatum
  misc_feature: Ceres CLONE 1816582
  misc_feature: Encodes the peptide sequence at SEQ ID NO. 21517
acgtcgcgggcgccagcgcagcccccgttcgctcgctcgcggccgagcggaagagacaggcgcggagaatggcgccgctacccgccgccccgccgccgccctcggcctgctcatcctcccccgcggcgggcccggccttcctcgccaggcctcaccaccaccaccgcagggcggtggcggcctcctgctgctcccccgcagtgaccgccgcagctgctccgtcgaggaaagcgttcctgtcatgcccggatcacagccccggacgggcactggcgccgccacgcgtcaccccatcgtcgtccccggcgcttgtcgcgtccgtaaaggacctgtacgacttcatctgcagcgggccgctggtggacaggatcggctacaccaaggagaaggtcgccgagtccatcgaccggtggctgccctgcggaagtcagatcgctcgcctgttccgcctcaacgagctccagctgtcggaggccgagaaagtcaggatataccacttctacatccccgtcttcctctggtgcgaggaccaggtcaccgagcacagggccaaatacaaggagggcgacgacatcccaccattggtgattggggtcagcgctcctcaaggaagtggaaagacgacccttgtcttc

SEQ ID NO: 21517 - protein, 188 aa, Panicum virgatum
  misc_feature: Ceres CLONE 1816582
  misc_feature: SWISSPROT Homolog: EC 2.7.1.31 Glycerate kinase
MAPLPAAPPPPSACSSSPAAGPAFLARPHHHHRRAVAASCCSPAVTAAAAPSRKAFLSCPDHSPGRALAPPRVTPSSSPALVASVKDLYDFICSGPLVDRIGYTKEKVAESIDRWLPCGSQIARLFRLNELQLSEAEKVRIYHFYIPVFLWCEDQVTEHRAKYKEGDDIPPLVIGVSAPQGSGKTTLV

SEQ ID NO: 21518 - DNA, 612 bp, Panicum virgatum
  misc_feature: Ceres CLONE 1816591
  misc_feature: Encodes the peptide sequence at SEQ ID NO. 21519
cgatattcggcggcggcggcggccggtggcgggtgtcggggatggcggtatggcgagcggtgggcgctcgcgccgttcttcggcggctcggcgccgcagcggagacggcggggagatgtgatggcggtgtgctcccgaccatctgtagcagcagcggaaatgcgacatccggcttaggtcaatatgcaaatctattcagggcacaagcctttgcctcaaggagtatcccagcaaattttcatcagtttatccgcaatgctggaatatcaactacaaggaacttgcttgcagatgatgctatggttcctatttcttctcctttgacgccaccactgggtgacagtgaagagactgacaaaaagggggctgtggttaagcgattgagggtccaagccataaaaaaggatatcaaacagagcccaaagaaggtgaatctagtagcgaagctggtccgaggtatgcgtgtggaagatgccttgttgcagctgcaagtgacagttaaaagggctgccaaaactgtttaccaggtgatccattctgctcgtgccaatgcatctcacaaccacggattggatcctgataagctcattgttgaggaggcctttgtgggaa

SEQ ID NO: 21519 - protein, 190 aa, Panicum virgatum
  misc_feature: Ceres CLONE 1816591
  misc_feature (118)..(190): Pfam Name: Ribosomal_L22 Pfam Description: Ribosomal protein L22p/L17e
MAVWRAVGARAVLRRLGAAAETAGRCDGGVLPTICSSSGNATSGLGQYANLFRAQAFASRSIPANFHQFIRNAGISTTRNLLADDAMVPISSPLTPPLGDSEETDKKGAVVKRLRVQAIKKDIKQSPKKVNLVAKLVRGMRVEDALLQLQVTVKRAAKTVYQVIHSARANASHNHGLDPDKLIVEEAFVG

SEQ ID NO: 21520 - DNA, 1399 bp, Panicum virgatum
  misc_feature: Ceres CLONE 1816593
  misc_feature: Encodes the peptide sequence at SEQ ID NO. 21521
ggccccttcccttcttcttcctcctgccgcgtccttgtcgccaccttctttctccgattcctcgctcctgctgctgctgctgccaaaagatcgcttttttcgtggggttattccgttactgtcggccagttggtgcggtgggtgatccatggaggtggttgctgggggagtcgaggtggcgaagcccgccgccgcggccacggccggggagcgcgcggccaagcgccggcgggtggcgccggagacgggagcgaggcgggccggaggaggggtggcgcggcgcgggagcgggaggcggcggcgcgtgcaggcggacgcggacgcggccgccgtgcagcggctcttccaggcctgccgcgacgtcttcagggggcccggcaccgtgcccaggcccggcgaggtccgccagctccgcgccatgctcgataggatgaagccggaagatgtcggcctaagcccggatctcaagttcttcagggctagagatgctgctcaaggaacccccacaattacacacacgacaatatacaaatgcccaaatttttcgatggttatcttatttttgccgcggaatgcggtcatccctctccacaatcaccctggaatgacggtgttcagcaagctgctcctcgggtctatgcatataaagtcgtatgactgggttgatcctgattctatcccgtcagtgagcagctgttcatcgtcagctgatgatcaattgagattggcaaaactggtggtcgatgatgcttttacggcgccgtgtgatacctcagttctatatccgacgactggaggaaacatgcatcgatttactgccaatgcgccttgcgcgatcctcgacattcttgggcccccgtactccatagaagaggacagggattgcacatactacagcgatattccatacacacaacattcgacggcagacggcacccgtgaccgtgacctcaacaacgttgagcaagatcaaggccgtctggcatggctgaaggagatcgacatgccgagggagctgaagatgtgcagcgtccactacggcggcccgccgatctctgacaagtgacaccgggcgtcggcatgaacgaaggcctactcgatctctcctgctgtagttgtcctgtacttaactgaatgatgtgcaactgatcatggctggatcggatcgtcgtctaaccttgtgaatagcactagcagcaagccataagccttgacagactgacttccaccagttggccagagatagaatgcttgcttgcttgggtgcacgcggcgttgttgttgttaggtgtttttatttcggtctttatttctttcttttcttttttttaaagaaaatggatgcttcctgtttttggttcataattctaatgcattgatcatccatagttttcatttc

SEQ ID NO: 21521 - protein, 305 aa, Panicum virgatum
  misc_feature: Ceres CLONE 1816593
  misc_feature: SWISSPROT Homolog: EC 1.13.11.19 Cysteamine dioxygenase
MEVVAGGVEVAKPAAAATAGERAAKRRRVAPETGARRAGGGVARRGSGRRRRVQADADAAAVQRLFQACRDVFRGPGTVPRPGEVRQLRAMLDRMKPEDVGLSPDLKFFRARDAAQGTPTITHTTIYKCPNFSMVILFLPRNAVIPLHNHPGMTVFSKLLLGSMHIKSYDWVDPDSIPSVSSCSSSADDQLRLAKLVVDDAFTAPCDTSVLYPTTGGNMHRFTANAPCAILDILGPPYSIEEDRDCTYYSDIPYTQHSTADGTRDRDLNNVEQDQGRLAWLKEIDMPRELKMCSVHYGGPPISDK

SEQ ID NO: 21522 - DNA, 713 bp, Panicum virgatum
  misc_feature: Ceres CLONE 1816597
  misc_feature: Encodes the peptide sequence at SEQ ID NO. 21523
ccgcgctgtcccggcggctgttcccccccacaccgtcgcctccgccgctgcccgccgccgcggacgccgacctctaccaccacttctacgaggcggggccctacctcaagttcgcgcacttcacggccaaccaggccatcctggaggccgtccagggctgccggcacgtccacatcatcgacttcaacctcatgcagggcctccagtggcccgcgctgatccaggccctcgcgctccgccccggcgggccgccgttcctccgcctcaccggcattggcccgccctccccgccgggccgcgacgacctccgcgacgtcggcgtccgcctcgccgacctggcgcgctccgtgcgcgtccacttctccttccgcggcgtggccgccaaccgcctcgacgaggtccgcccctggatgctgcaggtgtcgcagggcgaggccgtcgccgtcaactcggtgctccagctccaccgcctggtcgccgccgacccgcccgcggccgacgcccgggcgcccatcgacgccgtcctcgagtgcgtggcctccctacggccccgggtgttcacggtggtggagcaggaggccgaccacaacaagccggggttcctggaccggttcacggaggcgctcttctactactcggcggtgttcgactccctggacgcggcgagcggcggcgcgggcgacgcggcggccgaggcgtacctggagcgggag

SEQ ID NO: 21523 - protein, 236 aa, Panicum virgatum
  misc_feature: Ceres CLONE 1816597
  misc_feature (1)..(230): Pfam Name: GRAS Pfam Description: GRAS family transcription factor
  misc_feature: Useful for making plants with modulated biomass
  misc_feature: The sequence is a functional homolog of SEQ ID NO 218 in the 10/412,699 US patent application
  misc_feature: The sequence is a functional homolog of SEQ ID NO 2290 in the 10/374,780 US patent application
  misc_feature: The sequence is a functional homolog of SEQ ID NO 439 in the 11/479,226 US patent application
  misc_feature: The sequence is a functional homolog of SEQ ID NO 784 in the 10/225,066 US patent application
  misc_feature: The sequence is a functional homolog of SEQ ID NO 216 in the 10/412,699 US patent application
  misc_feature: The sequence is a functional homolog of SEQ ID NO 435 in the 11/479,226 US patent application
  misc_feature: The sequence is a functional homolog of SEQ ID NO 1 in US patent 7268272
  misc_feature: The sequence is a functional homolog of SEQ ID NO 68 in the 10/666,642 US patent application
ALSRRLFPPTPSPPPLPAAADADLYHHFYEAGPYLKFAHFTANQAILEAVQGCRHVHIIDFNLMQGLQWPALIQALALRPGGPPFLRLTGIGPPSPPGRDDLRDVGVRLADLARSVRVHFSFRGVAANRLDEVRPWMLQVSQGEAVAVNSVLQLHRLVAADPPAADARAPIDAVLECVASLRPRVFTVVEQEADHNKPGFLDRFTEALFYYSAVFDSLDAASGGAGDAAAEAYLER

SEQ ID NO: 21524 - DNA, 1220 bp, Panicum virgatum
  misc_feature: Ceres CLONE 1816603
  misc_feature: Encodes the peptide sequence at SEQ ID NO. 21525
atccattcgccttcctcttcctctgcccccgccgctcgctgtgccttcccccacagtcccactccgtcttcgtcctccctcccagaccgaccggccgccgccgctgcggaaccaggaccttcgccaggcgcccgcgcccaagaggaggagccgccgccgccgccatccaccaagagctagccggtcgcactcattgcaaagcacaaatatatggccctcaatacactgcaacttccatctaacttggcaaggccaagcagcttcagtccatcctcagcttcttaccagtaccagccaaagccgccagtgagacttgacacaaggaccacggcaaagaagcaccagaagagaaccacatcagtccttaaatgcagagccaatctgcatggctgcatggacgaggttgttcagacccccaaagaccagaccactgaaatcccaatcgtcatgtacccgtcggtggtcttccctggcgccacactccagctgcaggcgtttgagttcaggtaccgcataatgatgcacacccttcttcagcaaggcctcaagtttggggtcatctactgcggcaagaatggcaggatggctgatgtcgggtgcatcgtccatgccatcgagtgcgagaggctcatcgatgaccggtacttcctcacctgcgtaggcgaagatcgcttcagggtcatcgagattgtcaggacaaagccctatgttgttgcaaggatccaggtgctgaacgaccgtcccagctcagagccccaggacgaccttgggagcctgatgcagcaggtggagcagcacctgaagaatgtggccatgctttcagacaaactgaacctgaaccagaaactgaggggagaccatcaggctgagcaattccgcaggatgcactctgcggcctctttctcattcctcatcgcgcgactgttcatcgatgatcgcttggagcagcaggcgctgctgcagatgaatgacagcgcccagcggttggcgcgagaggggatgtacctggagcgcaggagcaagtacctggctgccattgcagcaatcaaggacgcctttgagcacatgtcctgcaacgagaagtagaacctaccttcgcattttggatatgtgatattgctactaagtagatactagtatgtagagcaatgccccctcaaaaaaaaaagtatgtagagcaataagcaaccagacaatgtcatggtcataggtttccttag

SEQ ID NO: 21525 - protein, 230 aa, Panicum virgatum
  misc_feature: Ceres CLONE 1816603
  misc_feature (14)..(207): Pfam Name: LON Pfam Description: ATP-dependent protease La (LON) domain
MDEVVQTPKDQTTEIPIVMYPSVVFPGATLQLQAFEFRYRIMMHTLLQQGLKFGVIYCGKNGRMADVGCIVHAIECERLIDDRYFLTCVGEDRFRVIEIVRTKPYVVARIQVLNDRPSSEPQDDLGSLMQQVEQHLKNVAMLSDKLNLNQKLRGDHQAEQFRRMHSAASFSFLIARLFIDDRLEQQALLQMNDSAQRLAREGMYLERRSKYLAAIAAIKDAFEHMSCNEK

SEQ ID NO: 21526 - DNA, 122 bp, Panicum virgatum
  misc_feature: Ceres CLONE 1816609
  misc_feature: Encodes the peptide sequence at SEQ ID NO. 21527
ggttcttgaggttctcggggctgagagcaacacatggctgcttttgatgttgagtacccctgcctggctgggcgccttccctgcgccaccgaccactcctccctctccaacgccttcccccc

SEQ ID NO: 21527 - protein, 29 aa, Panicum virgatum
  misc_feature: Ceres CLONE 1816609
  misc_feature: Useful for making plants with altered lignin content
  misc_feature: Useful for making plants with modulated nitrogen use efficiency
  misc_feature: Useful for making plants with modulated flowering time
MAAFDVEYPCLAGRLPCATDHSSLSNAFP

SEQ ID NO: 21528 - DNA, 718 bp, Panicum virgatum
  misc_feature: Ceres CLONE 1816661
  misc_feature: Encodes the peptide sequence at SEQ ID NO. 21529
  misc_feature (605)..(605): n is a, c, t, g, unknown, or other
agccagagggggagaggcggaggaagggggaagaagagctgtagaggaagggggaagcaaatcttggaggggcgtcgtgagattcctgcggtggaggaggaaacgcgagcggagggtagtgaggtagctcaatagatctaccacagcttatgtgagttgatgcaaagctgagttggcattggtgtagccctgtcttattcattgatggcatcagcaggtgtagccccgtctgggtacaagaacagcagcagcacaagcattggtgctgataagttgcaggatcacatgaacgagctaaagattagagatgataaggaagttgaagcaaccataattaatgggaaagggacagaaactgggcacataattgtgactactactggtggcaagaatggtcaaccaaagcagacggtgagctacatggctgagcgcattgtaggtcaaggttcttttgggattgtcttccaggctaaatgcttggagacgggtgagactgttgccataaagaaggttcttcaggataagcgttacaagaaccgtgagctgcaaaccatgcgccttcttgaccaccctaatgttgttgctttgaagcattgcttcttttncacaactgagaaggatgaactgtatctaaacttggttcttgagtatgtgcctgagactgttcatcgagtcgtgaagcatcacaacaagatgaaacaacgaatgccacttatct

SEQ ID NO: 21529 - protein, 171 aa, Panicum virgatum
  misc_feature: Ceres CLONE 1816661
  misc_feature: SWISSPROT Homolog: EC 2.7.11.1 Non-specific serine/threonine protein kinase
  misc_feature: Useful for making plants with modulated water use efficiency
  misc_feature: Useful for making plants with modulated biomass
  misc_feature (134)..(134): Xaa is any aa, unknown, or other
MASAGVAPSGYKNSSSTSIGADKLQDHMNELKIRDDKEVEATIINGKGTETGHIIVTTTGGKNGQPKQTVSYMAERIVGQGSFGIVFQAKCLETGETVAIKKVLQDKRYKNRELQTMRLLDHPNVVALKHCFFXTTEKDELYLNLVLEYVPETVHRVVKHHNKMKQRMPLI

SEQ ID NO: 21530 - DNA, 704 bp, Panicum virgatum
  misc_feature: Ceres CLONE 1816663
  misc_feature: Encodes the peptide sequence at SEQ ID NO. 21531
actccgcagctccgctctcaaacccccccgctctccctcgtccctcccaccacgctctccctcctcctaccttgctcgctcctctcctcttcgtcgtcctccagacgaatccgcgtgtcgtccacttccacccgtgcttcgtgcgcttctgatccgctgatttgttgtgcggggagttttgctcgggctggaactggatcgtctgttggttagtagccttggagttgtttgagttgaccgggagcgagggagaagggaggagcttgctgtgttcgttggccgggcggatcggtggcgatgccggactccgacaaagagtccggctggccgagcaacgaggagttctcgtcgccgcgggagcaggaccggttcctgccgatcgcgaacgtcagccggatcatgaagaaggcgctcccggcgaacgccaagatctccaaggacgccaaggagacggtgcaggagtgcgtctccgagttcatctccttcatcaccggcgaggcctccgacaagtgccagcgcgagaagcgcaagaccatcaacggcgacgacctcctctgggccatgaccacgctcggcttcgaggactacatcgagccgctcaagctctacctccacaagttccgcgagctcgagggcgagaaggtggcctccggcgccgcgggctcctccggctccggctcgcagccgcagagggagacgacgcc

SEQ ID NO: 21531 - protein, 135 aa, Panicum virgatum
  misc_feature: Ceres CLONE 1816663
  misc_feature (24)..(89): Pfam Name: CBFD_NFYB_HMF Pfam Description: Histone-like transcription factor (CBF/NF-Y) and archaeal histone
  misc_feature: SWISSPROT Homolog: EC 2.7.7.7 DNA-directed DNA polymerase
  misc_feature: The sequence is a functional homolog of SEQ ID NO 2153 in the 10/666,642 US patent application
  misc_feature: The sequence is a functional homolog of SEQ ID NO 366 in the 11/435,388 US patent application
  misc_feature: The sequence is a functional homolog of SEQ ID NO 368 in the 10/714,887 US patent application
  misc_feature: The sequence is a functional homolog of SEQ ID NO 50 in the 10/675,852 US patent application
  misc_feature: The sequence is a functional homolog of SEQ ID NO 805 in the 10/374,780 US patent application
  misc_feature: The sequence is a functional homolog of SEQ ID NO 2143 in the 10/666,642 US patent application
  misc_feature: The sequence is a functional homolog of SEQ ID NO 338 in the 11/435,388 US patent application
  misc_feature: The sequence is a functional homolog of SEQ ID NO 340 in the 10/714,887 US patent application
  misc_feature: The sequence is a functional homolog of SEQ ID NO 76 in the 10/675,852 US patent application
  misc_feature: The sequence is a functional homolog of SEQ ID NO 796 in the 10/374,780 US patent application
  misc_feature: The sequence is a functional homolog of SEQ ID NO 1164 in the 10/412,699 US patent application
  misc_feature: The sequence is a functional homolog of SEQ ID NO 29 in the 10/675,852 US patent application
  misc_feature: The sequence is a functional homolog of SEQ ID NO 780 in the 10/374,780 US patent application
  misc_feature: The sequence is a functional homolog of SEQ ID NO 807 in the 10/666,642 US patent application
  misc_feature: The sequence is a functional homolog of SEQ ID NO 2151 in the 10/666,642 US patent application
  misc_feature: The sequence is a functional homolog of SEQ ID NO 364 in the 11/435,388 US patent application
  misc_feature: The sequence is a functional homolog of SEQ ID NO 366 in the 10/714,887 US patent application
  misc_feature: The sequence is a functional homolog of SEQ ID NO 48 in the 10/675,852 US patent application
  misc_feature: The sequence is a functional homolog of SEQ ID NO 804 in the 10/374,780 US patent application
  misc_feature: The sequence is a functional homolog of SEQ ID NO 2141 in the 10/666,642 US patent application
  misc_feature: The sequence is a functional homolog of SEQ ID NO 336 in the 11/435,388 US patent application
  misc_feature: The sequence is a functional homolog of SEQ ID NO 338 in the 10/714,887 US patent application
  misc_feature: The sequence is a functional homolog of SEQ ID NO 794 in the 10/374,780 US patent application
  misc_feature: The sequence is a functional homolog of SEQ ID NO 92 in the 10/675,852 US patent application
  misc_feature: The sequence is a functional homolog of SEQ ID NO 62 in the 10/675,852 US patent application
  misc_feature: The sequence is a functional homolog of SEQ ID NO 106 in the 10/666,642 US patent application
  misc_feature: The sequence is a functional homolog of SEQ ID NO 1784 in the 10/412,699 US patent application
  misc_feature: The sequence is a functional homolog of SEQ ID NO 2010 in the 10/374,780 US patent application
  misc_feature: The sequence is a functional homolog of SEQ ID NO 292 in the 11/435,388 US patent application
  misc_feature: The sequence is a functional homolog of SEQ ID NO 294 in the 10/714,887 US patent application
  misc_feature: The sequence is a functional homolog of SEQ ID NO 6 in the 10/675,852 US patent application
  misc_feature: The sequence is a functional homolog of SEQ ID NO 719 in the 11/479,226 US patent application
  misc_feature: The sequence is a functional homolog of SEQ ID NO 134 in the 10/225,068 US patent application
  misc_feature: The sequence is a functional homolog of SEQ ID NO 1398 in the 10/666,642 US patent application
  misc_feature: The sequence is a functional homolog of SEQ ID NO 14 in the 10/286,264 US patent application
  misc_feature: The sequence is a functional homolog of SEQ ID NO 290 in the 11/435,388 US patent application
  misc_feature: The sequence is a functional homolog of SEQ ID NO 292 in the 10/714,887 US patent application
  misc_feature: The sequence is a functional homolog of SEQ ID NO 306 in the 10/412,699 US patent application
  misc_feature: The sequence is a functional homolog of SEQ ID NO 4 in the 10/675,852 US patent application
  misc_feature: The sequence is a functional homolog of SEQ ID NO 708 in the 11/479,226 US patent application
  misc_feature: The sequence is a functional homolog of SEQ ID NO 90 in the 10/374,780 US patent application
  misc_feature: The sequence is a functional homolog of SEQ ID NO 18 in the 10/675,852 US patent application
  misc_feature: The sequence is a functional homolog of SEQ ID NO 2183 in the 10/666,642 US patent application
  misc_feature: The sequence is a functional homolog of SEQ ID NO 406 in the 11/435,388 US patent application
  misc_feature: The sequence is a functional homolog of SEQ ID NO 408 in the 10/714,887 US patent application
  misc_feature: The sequence is a functional homolog of SEQ ID NO 798 in the 10/374,780 US patent application
  misc_feature: The sequence is a functional homolog of SEQ ID NO 22 in the 10/675,852 US patent application
  misc_feature: The sequence is a functional homolog of SEQ ID NO 2175 in the 10/666,642 US patent application
  misc_feature: The sequence is a functional homolog of SEQ ID NO 398 in the 11/435,388 US patent application
  misc_feature: The sequence is a functional homolog of SEQ ID NO 400 in the 10/714,887 US patent application
  misc_feature: The sequence is a functional homolog of SEQ ID NO 80 in the 10/675,852 US patent application
  misc_feature: The sequence is a functional homolog of SEQ ID NO 801 in the 10/374,780 US patent application
  misc_feature: The sequence is a functional homolog of SEQ ID NO 66 in the 10/675,852 US patent application
  misc_feature: The sequence is a functional homolog of SEQ ID NO 20 in the 10/675,852 US patent application
  misc_feature: The sequence is a functional homolog of SEQ ID NO 2181 in the 10/666,642 US patent application
  misc_feature: The sequence is a functional homolog of SEQ ID NO 404 in the 11/435,388 US patent application
  misc_feature: The sequence is a functional homolog of SEQ ID NO 406 in the 10/714,887 US patent application
  misc_feature: The sequence is a functional homolog of SEQ ID NO 800 in the 10/374,780 US patent application
  misc_feature: The sequence is a functional homolog of SEQ ID NO 2187 in the 10/666,642 US patent application
  misc_feature: The sequence is a functional homolog of SEQ ID NO 410 in the 11/435,388 US patent application
  misc_feature: The sequence is a functional homolog of SEQ ID NO 412 in the 10/714,887 US patent application
  misc_feature: The sequence is a functional homolog of SEQ ID NO 86 in the 10/675,852 US patent application
  misc_feature: The sequence is a functional homolog of SEQ ID NO 16 in the 10/675,852 US patent application
  misc_feature: The sequence is a functional homolog of SEQ ID NO 2179 in the 10/666,642 US patent application
  misc_feature: The sequence is a functional homolog of SEQ ID NO 402 in the 11/435,388 US patent application
  misc_feature: The sequence is a functional homolog of SEQ ID NO 404 in the 10/714,887 US patent application
  misc_feature: The sequence is a functional homolog of SEQ ID NO 797 in the 10/374,780 US patent application
  misc_feature: The sequence is a functional homolog of SEQ ID NO 82 in the 10/675,852 US patent application
  misc_feature: The sequence is a functional homolog of SEQ ID NO 2177 in the 10/666,642 US patent application
  misc_feature: The sequence is a functional homolog of SEQ ID NO 400 in the 11/435,388 US patent application
  misc_feature: The sequence is a functional homolog of SEQ ID NO 402 in the 10/714,887 US patent application
  misc_feature: The sequence is a functional homolog of SEQ ID NO 52 in the 10/675,852 US patent application
  misc_feature: The sequence is a functional homolog of SEQ ID NO 799 in the 10/374,780 US patent application
  misc_feature: The sequence is a functional homolog of SEQ ID NO 38 in the 10/675,852 US patent application
  misc_feature: The sequence is a functional homolog of SEQ ID NO 64 in the 10/675,852 US patent application
  misc_feature: Useful for making plants with modulated biomass
  misc_feature: The sequence is a functional homolog of SEQ ID NO 46 in the 10/675,852 US patent application
  misc_feature: The sequence is a functional homolog of SEQ ID NO 56 in the 10/675,852 US patent application
  misc_feature: The sequence is a functional homolog of SEQ ID NO 785 in the 10/374,780 US patent application
  misc_feature: The sequence is a functional homolog of SEQ ID NO 786 in the 10/374,780 US patent application
  misc_feature: Useful for making plants with modulated drought sensitivity
  misc_feature: Useful for making plants with altered alkaloid content
  misc_feature: Useful for making plants with altered terpenoid content
  misc_feature: The sequence is a functional homolog of SEQ ID NO 2155 in the 10/666,642 US patent application
  misc_feature: The sequence is a functional homolog of SEQ ID NO 368 in the 11/435,388 US patent application
  misc_feature: The sequence is a functional homolog of SEQ ID NO 370 in the 10/714,887 US patent application
  misc_feature: The sequence is a functional homolog of SEQ ID NO 94 in the 10/675,852 US patent application
  misc_feature: The sequence is a functional homolog of SEQ ID NO 60 in the 10/675,852 US patent application
  misc_feature: The sequence is a functional homolog of SEQ ID NO 34 in the 10/675,852 US patent application
  misc_feature: The sequence is a functional homolog of SEQ ID NO 807 in the 10/374,780 US patent application
  misc_feature: The sequence is a functional homolog of SEQ ID NO 12 in the 10/675,852 US patent application
  misc_feature: The sequence is a functional homolog of SEQ ID NO 10 in the 10/675,852 US patent application
  misc_feature: The sequence is a functional homolog of SEQ ID NO 1502 in the 10/666,642 US patent application
  misc_feature: The sequence is a functional homolog of SEQ ID NO 1910 in the 10/412,699 US patent application
  misc_feature: The sequence is a functional homolog of SEQ ID NO 2172 in the 10/374,780 US patent application
  misc_feature: The sequence is a functional homolog of SEQ ID NO 320 in the 11/435,388 US patent application
  misc_feature: The sequence is a functional homolog of SEQ ID NO 322 in the 10/714,887 US patent application
  misc_feature: The sequence is a functional homolog of SEQ ID NO 791 in the 10/374,780 US patent application
  misc_feature: The sequence is a functional homolog of SEQ ID NO 1166 in the 10/412,699 US patent application
  misc_feature: The sequence is a functional homolog of SEQ ID NO 31 in the 10/675,852 US patent application
  misc_feature: The sequence is a functional homolog of SEQ ID NO 782 in the 10/374,780 US patent application
  misc_feature: The sequence is a functional homolog of SEQ ID NO 809 in the 10/666,642 US patent application
  misc_feature: The sequence is a functional homolog of SEQ ID NO 2135 in the 10/666,642 US patent application
  misc_feature: The sequence is a functional homolog of SEQ ID NO 28 in the 10/675,852 US patent application
  misc_feature: The sequence is a functional homolog of SEQ ID NO 330 in the 11/435,388 US patent application
  misc_feature: The sequence is a functional homolog of SEQ ID NO 332 in the 10/714,887 US patent application
  misc_feature: The sequence is a functional homolog of SEQ ID NO 792 in the 10/374,780 US patent application
  misc_feature: The sequence is a functional homolog of SEQ ID NO 88 in the 10/675,852 US patent application
  misc_feature: The sequence is a functional homolog of SEQ ID NO 14 in the 10/675,852 US patent application
  misc_feature: The sequence is a functional homolog of SEQ ID NO 310 in the 11/435,388 US patent application
  misc_feature: The sequence is a functional homolog of SEQ ID NO 312 in the 10/714,887 US patent application
  misc_feature: The sequence is a functional homolog of SEQ ID NO 72 in the 10/675,852 US patent application
  misc_feature: The sequence is a functional homolog of SEQ ID NO 36 in the 10/675,852 US patent application
  misc_feature: The sequence is a functional homolog of SEQ ID NO 2149 in the 10/666,642 US patent application
  misc_feature: The sequence is a functional homolog of SEQ ID NO 362 in the 11/435,388 US patent application
  misc_feature: The sequence is a functional homolog of SEQ ID NO 364 in the 10/714,887 US patent application
  misc_feature: The sequence is a functional homolog of SEQ ID NO 40 in the 10/675,852 US patent application
  misc_feature: The sequence is a functional homolog of SEQ ID NO 58 in the 10/675,852 US patent application
  misc_feature: The sequence is a functional homolog of SEQ ID NO 78 in the 10/675,852 US patent application
  misc_feature: The sequence is a functional homolog of SEQ ID NO 806 in the 10/374,780 US patent application
  misc_feature: The sequence is a functional homolog of SEQ ID NO 2171 in the 10/666,642 US patent application
  misc_feature: The sequence is a functional homolog of SEQ ID NO 2173 in the 10/666,642 US patent application
  misc_feature: The sequence is a functional homolog of SEQ ID NO 2185 in the 10/666,642 US patent application
  misc_feature: The sequence is a functional homolog of SEQ ID NO 24 in the 10/675,852 US patent application
  misc_feature: The sequence is a functional homolog of SEQ ID NO 394 in the 11/435,388 US patent application
  misc_feature: The sequence is a functional homolog of SEQ ID NO 396 in the 10/714,887 US patent application
  misc_feature: The sequence is a functional homolog of SEQ ID NO 396 in the 11/435,388 US patent application
  misc_feature: The sequence is a functional homolog of SEQ ID NO 398 in the 10/714,887 US patent application
  misc_feature: The sequence is a functional homolog of SEQ ID NO 408 in the 11/435,388 US patent application
  misc_feature: The sequence is a functional homolog of SEQ ID NO 410 in the 10/714,887 US patent application
  misc_feature: The sequence is a functional homolog of SEQ ID NO 84 in the 10/675,852 US patent application
  misc_feature: The sequence is a functional homolog of SEQ ID NO 2137 in the 10/666,642 US patent application
  misc_feature: The sequence is a functional homolog of SEQ ID NO 332 in the 11/435,388 US patent application
  misc_feature: The sequence is a functional homolog of SEQ ID NO 334 in the 10/714,887 US patent application
  misc_feature: The sequence is a functional homolog of SEQ ID NO 54 in the 10/675,852 US patent application
  misc_feature: The sequence is a functional homolog of SEQ ID NO 74 in the 10/675,852 US patent application
  misc_feature: The sequence is a functional homolog of SEQ ID NO 790 in the 10/374,780 US patent application
  misc_feature: The sequence is a functional homolog of SEQ ID NO 787 in the 10/374,780 US patent application
  misc_feature: The sequence is a functional homolog of SEQ ID NO 1168 in the 10/412,699 US patent application
  misc_feature: The sequence is a functional homolog of SEQ ID NO 32 in the 10/675,852 US patent application
  misc_feature: The sequence is a functional homolog of SEQ ID NO 784 in the 10/374,780 US patent application
  misc_feature: The sequence is a functional homolog of SEQ ID NO 811 in the 10/666,642 US patent application
  misc_feature: The sequence is a functional homolog of SEQ ID NO 308 in the 11/435,388 US patent application
  misc_feature: The sequence is a functional homolog of SEQ ID NO 310 in the 10/714,887 US patent application
  misc_feature: The sequence is a functional homolog of SEQ ID NO 44 in the 10/675,852 US patent application
  misc_feature: The sequence is a functional homolog of SEQ ID NO 42 in the 10/675,852 US patent application
  misc_feature: The sequence is a functional homolog of SEQ ID NO 26 in the 10/675,852 US patent application
  misc_feature: The sequence is a functional homolog of SEQ ID NO 802 in the 10/374,780 US patent application
  misc_feature: The sequence is a functional homolog of SEQ ID NO 1440 in the 10/666,642 US patent application
  misc_feature: The sequence is a functional homolog of SEQ ID NO 1856 in the 10/412,699 US patent application
  misc_feature: The sequence is a functional homolog of SEQ ID NO 2102 in the 10/374,780 US patent application
  misc_feature: The sequence is a functional homolog of SEQ ID NO 290 in the 10/225,066 US patent application
  misc_feature: The sequence is a functional homolog of SEQ ID NO 8 in the 10/675,852 US patent application
  misc_feature: The sequence is a functional homolog of SEQ ID NO 416 in the 11/435,388 US patent application
  misc_feature: The sequence is a functional homolog of SEQ ID NO 418 in the 10/714,887 US patent application
  misc_feature: The sequence is a functional homolog of SEQ ID NO 789 in the 10/374,780 US patent application
  misc_feature: The sequence is a functional homolog of SEQ ID NO 418 in the 11/435,388 US patent application
  misc_feature: The sequence is a functional homolog of SEQ ID NO 420 in the 10/714,887 US patent application
  misc_feature: The sequence is a functional homolog of SEQ ID NO 795 in the 10/374,780 US patent application
  misc_feature: The sequence is a functional homolog of SEQ ID NO 803 in the 10/374,780 US patent application
  misc_feature: The sequence is a functional homolog of SEQ ID NO 306 in the 11/435,388 US patent application
  misc_feature: The sequence is a functional homolog of SEQ ID NO 308 in the 10/714,887 US patent application
  misc_feature: The sequence is a functional homolog of SEQ ID NO 70 in the 10/675,852 US patent application
  misc_feature: The sequence is a functional homolog of SEQ ID NO 2139 in the 10/666,642 US patent application
  misc_feature: The sequence is a functional homolog of SEQ ID NO 334 in the 11/435,388 US patent application
  misc_feature: The sequence is a functional homolog of SEQ ID NO 336 in the 10/714,887 US patent application
  misc_feature: The sequence is a functional homolog of SEQ ID NO 90 in the 10/675,852 US patent application
  misc_feature: The sequence is a functional homolog of SEQ ID NO 134 in US patent 7294759
  misc_feature: The sequence is a functional homolog of SEQ ID NO 2 in US patent 7220894
  misc_feature: The sequence is a functional homolog of SEQ ID NO 1165 in the 10/412,699 US patent application
  misc_feature: The sequence is a functional homolog of SEQ ID NO 30 in the 10/675,852 US patent application
  misc_feature: The sequence is a functional homolog of SEQ ID NO 781 in the 10/374,780 US patent application
  misc_feature: The sequence is a functional homolog of SEQ ID NO 808 in the 10/666,642 US patent application
  misc_feature: The sequence is a functional homolog of SEQ ID NO 793 in the 10/374,780 US patent application
  misc_feature: The sequence is a functional homolog of SEQ ID NO 2382 in the 10/374,780 US patent application
  misc_feature: The sequence is a functional homolog of SEQ ID NO 540 in the 10/225,066 US patent application
  misc_feature: The sequence is a functional homolog of SEQ ID NO 72 in the 10/286,264 US patent application
  misc_feature: The sequence is a functional homolog of SEQ ID NO 294 in the 11/435,388 US patent application
  misc_feature: The sequence is a functional homolog of SEQ ID NO 296 in the 10/714,887 US patent application
  misc_feature: The sequence is a functional homolog of SEQ ID NO 308 in the 10/412,699 US patent application
  misc_feature: The sequence is a functional homolog of SEQ ID NO 723 in the 11/479,226 US patent application
  misc_feature: The sequence is a functional homolog of SEQ ID NO 22 in US patent 7166765
  misc_feature: The sequence is a functional homolog of SEQ ID NO 788 in the 10/374,780 US patent application
  misc_feature: The sequence is a functional homolog of SEQ ID NO 414 in the 11/435,388 US patent application
  misc_feature: The sequence is a functional homolog of SEQ ID NO 416 in the 10/714,887 US patent application
MPDSDKESGWPSNEEFSSPREQDRFLPIANVSRIMKKALPANAKISKDAKETVQECVSEFISFITGEASDKCQREKRKTINGDDLLWAMTTLGFEDYIEPLKLYLHKFRELEGEKVASGAAGSSGSGSQPQRETT

SEQ ID NO: 21532 - DNA, 1363 bp, Panicum virgatum
  misc_feature: Ceres CLONE 1816665
  misc_feature: Encodes the peptide sequence at SEQ ID NO. 21533
agcgtggagagaggggaaaccggaggtcctggccgttcctctctcctcacaggcgggctccgtctgttccgtccagccaccgccccggtcgcctcccgtccagatccctctcctgaaaggtttctttgcggaaggccggagaagatgatgggcgggttcctctccagggtcctccttttggtctttggctatgcctatcctgcctatgagtgctacaagactgttgaactgaacaaaccggagattgagcagctcatattttggtgtcagtattggattttagttgccctgttgactgttctagaaagatttggagatcttacagtatcatggctaccattttactcagaagcaaagctgttgttctttgtatacttgtggtacccaaagacaaagggaactacatacatttatgggactttctttaggccatatatttctcagcatgagaatgaaattgatcgcaatctgcttgagttgagagctcgagccaccgatacggttgtcctttatttccagaaggctgcttctgcaggacagaatactttctttgatgttttgaaatatgtcgcgtcccagtcaccttctcagaaatcaaggcagcgcccacatcaggaaccacagcagccacaacagcagcaaccacaagtacagcaccagcagcagcagcaaccacaaaaacaagcagcacctgttatgcgcagagcagcatcaatcgctgctcggcaagcagcaatggcacagcaatctcaggagaccaagcccgtcccatcttccccaaagatcaagcgtcaagcatcagcgaaatctagttcagtggcatccacaaagcccgtcgcagctgcatccactcaaaaacctggagggagcccaaagaaaagcgaggtgaaacatgccgttgagccggtgccaactccagccacaagtgccgattcaccgaaatctgagcctagtgccaaatcactccctgaagctgaagaggtggacaagatggccatcgatgaggccggtggtgatgctgaagaaggcacagaagagctggaccctgcacttgaggagacgccgatggaggagacgatccgtgtgacgcgcgccaagctaaggaggcgcatcgatcctgctgggaattagctgcgagccattgttctccttgcacattgtgtttgttctttgaggtttaggttgtcctgttgcctggtggagtggccatgtgttgttcacctggttattctgtgctgtcttcgtggtttttcatgtgcttttgtctctgggcatgtgtatataaattggtggcgtgggcaaggaatgcctgtatttgaaacattatgcatttacaatctggccattccctgactgacttttc

SEQ ID NO: 21533 - protein, 328 aa, Panicum virgatum
  misc_feature: Ceres CLONE 1816665
  misc_feature (3)..(98): Pfam Name: TB2_DP1_HVA22 Pfam Description: TB2/DP1, HVA22 family
MMGGFLSRVLLLVFGYAYPAYECYKTVELNKPEIEQLIFWCQYWILVALLTVLERFGDLTVSWLPFYSEAKLLFFVYLWYPKTKGTTYIYGTFFRPYISQHENEIDRNLLELRARATDTVVLYFQKAASAGQNTFFDVLKYVASQSPSQKSRQRPHQEPQQPQQQQPQVQHQQQQQPQKQAAPVMRRAASIAARQAAMAQQSQETKPVPSSPKIKRQASAKSSSVASTKPVAAASTQKPGGSPKKSEVKHAVEPVPTPATSADSPKSEPSAKSLPEAEEVDKMAIDEAGGDAEEGTEELDPALEETPMEETIRVTRAKLRRRIDPAGN

SEQ ID NO: 21534 - DNA, 612 bp, Panicum virgatum
  misc_feature: Ceres CLONE 1816670
  misc_feature: Encodes the peptide sequence at SEQ ID NO. 21535
tgccgccggcgacgaacccgggagcctgagtttcggtcgcaagccccgctatgtccatgttcaacaggatcttcgggaagcccaaggaggaggctaactccaatgcgttggccactctggacaagtcaaatgacactcttgatatgctggagaagaaagaaaaggtgctggagaaaaaagcacgctgctgagcttgacagggccaaggacttctcaaaaccacaaaatcaaacagccgctattcagtccttgaagaggaaaaaactttatgaacaacaaatcgagcagcttgaaaatttccttttgagaatccatgatcagatgatcatgctacaagcacctaaagcgacaacccatactgttgatgcattgacgactggagctgcacctatgaaagcaatgcaaaaagcaacaaatattgatgatgtcgacaagactatggatgaaattaacgaacagactgaaaacatgaaacaaattcaagatgctttatcagctcctcttgcagcttctgctgatttcgatgaggatgaactggaagcggaacttgaagaactggagggagcagagttggaatctcaccttctggagcctgttgcagctcctccagtg

SEQ ID NO: 21535 - protein, 169 aa, Panicum virgatum
  misc_feature: Ceres CLONE 1816670
  misc_feature (2)..(169): Pfam Name: Snf7 Pfam Description: Snf7
MRWPLWTSQMTLLICWRRKKRCWRKKHAAELDRAKDFSKPQNQTAAIQSLKRKKLYEQQIEQLENFLLRIHDQMIMLQAPKATTHTVDALTTGAAPMKAMQKATNIDDVDKTMDEINEQTENMKQIQDALSAPLAASADFDEDELEAELEELEGAELESHLLEPVAAPP

SEQ ID NO: 21536 - DNA, 693 bp, Panicum virgatum
  misc_feature: Ceres CLONE 1816671
  misc_feature: Encodes the peptide sequence at SEQ ID NO. 21537
agctgcgaagctggtctccgctgttacgtctcggctcggctctctccctcaccatcttcctctagtccaaagactccaaagccccccaccccaccggccaccaccatcccgtccccccactccttccgttcgcatacgcgggaacgcgcgccgccggcggggcggggaggggaggccgatgcacccgaagctgtcgcgggccgcccgcaggctcctctgctgcggcgggcccgcctccggggaggacctgtctgacgaagggacaggatcgttaaggtgggtgttctcattgagggagcttcgatcggcaacaaacagcttcaattacgataacaagattggagaagggccatttgggagtgtgttttggggacaagtttgggatggctctcagattgctgtcaagaggttaaagaattcaaagaatggcacagaagtggaattcgcttcagaagtcgagatcttgggaagaataagacaaaaaaacctcctgagtttccgtggatattgtgcggatggacctgaacgcattctggtgtatgactatatggcaaactcaagtctctatgcacatcttcatggaccactttctgcggagtgtctccttgactggcgcaggagaacatctattgccattggtgctgctcgggctctcttgtatcttcatcaccatgcaacacctcagataatcca

SEQ ID NO: 21537 - protein, 171 aa, Panicum virgatum
  misc_feature: Ceres CLONE 1816671
  misc_feature: SWISSPROT Homolog: EC 2.7.11.1 Non-specific serine/threonine protein kinase
MHPKLSRAARRLLCCGGPASGEDLSDEGTGSLRWVFSLRELRSATNSFNYDNKIGEGPFGSVFWGQVWDGSQIAVKRLKNSKNGTEVEFASEVEILGRIRQKNLLSFRGYCADGPERILVYDYMANSSLYAHLHGPLSAECLLDWRRRTSIAIGAARALLYLHHHATPQII

SEQ ID NO: 21538 - DNA, 1464 bp, Panicum virgatum
  misc_feature: Ceres CLONE 1816677
  misc_feature: Encodes the peptide sequence at SEQ ID NO. 21539
ggaaatatcagcaatccattctctcctcccgatttaggatttatacccacccccgccgatcccctcgcccagttcgccaccgcgccgccgggacctgtctcgcctcttccggccggtcctgccgccgcgccttcaggcaagatcccgctgcggcgtcggtagcggctcctgaccgcggtctcgccctgtcatgccggttcaggtcggagggagcaaggtggcggagcccagggccaggctggagctctcccccaccgccgtctccgacaagggccgcgcctcgtccaagaagatccgccgccgtcgccagaaggccccggcggcgccttcccagtcgccgatgcagaggctgttcgacaccagcagggaggtcttcttggcctcctcgccgggctttgtgccgccgccggacgccgtggcgcgcctctcgggcatcctcaatgatttgaaaccacatgatgttggggtagattctagtatgccgtacttcaagcattccgattctaaaggcccccctcgagttacttatttgcatttctatgattgccccaagttttcgtttggtatcttctgtttaccgaaatcagcaattattccccttcacaaccatcctgggatgacagtatttagcaagatactatttggttccatgcacctgaagtcatatgactgggctaagagtctgccagagagtcatgatactgcaattgagcactcagatggagctcgtttggccaaggtaaatactgattctgttttcgatgcttcatccgagacagtagttctgtaccctgaaaatggagggaatttgcactgttttactgcgttgaccccctgtgccgtgctggatgtgatgggccccccttacaaccgtgctgatggaagggattgcgcgtactatgacgaatcaccgtacttgactggtggagatgaacagtattcttggcttaaagaggtttctaccacatttgagatgaaaggtatacagatgccgcggaagtttagcgtctcggcatgactagcatgacattgccgtgacacctgaagaggatgaagcaaatgccgctagcttgatgtacatatcttagctgcgaagacagacaacaatgggtacaagggaaaggccgggccaggccagtttcacaggctaggaaacttgacatttgtttcccttatttcgtctgggtcgaaacaaacaatctcttgtggtttgggatgactctgctcctcttgtgttactggagtatccaatagtgcaatttgaatttgggctttttggggcatgatcattttttgtttccctgtagacagatgtacgcaggtgttctttttgaagtgatcatggaccaaattcagtgggtcgtttgcttggtttgttgagcagggaaaggtctttgcctgctttaatgtttcaggggcacatcttctgtttccttgttgaacaaagaaatgtctctcaagtat

SEQ ID NO: 21539 - protein, 275 aa, Panicum virgatum
  misc_feature: Ceres CLONE 1816677
  misc_feature: SWISSPROT Homolog: EC 1.13.11.19 Cysteamine dioxygenase
MPVQVGGSKVAEPRARLELSPTAVSDKGRASSKKIRRRRQKAPAAPSQSPMQRLFDTSREVFLASSPGFVPPPDAVARLSGILNDLKPHDVGVDSSMPYFKHSDSKGPPRVTYLHFYDCPKFSFGIFCLPKSAIIPLHNHPGMTVFSKILFGSMHLKSYDWAKSLPESHDTAIEHSDGARLAKVNTDSVFDASSETVVLYPENGGNLHCFTALTPCAVLDVMGPPYNRADGRDCAYYDESPYLTGGDEQYSWLKEVSTTFEMKGIQMPRKFSVSA

SEQ ID NO: 21540 - DNA, 473 bp, Panicum virgatum
  misc_feature: Ceres CLONE 1816678
  misc_feature: Encodes the peptide sequence at SEQ ID NO. 21541
agggacgtcccccaaccagaccgcgcgcgccgccaatctagggtttcccccgtcgtcctccctcccctcgccgacgaggtgcggggcaagtttgggcgatgaagctggcggggctcaagtcggcggacagcgcccatgaggaatccttctgggcggtggcgtggacgcccgtgtgctaccaccgccccaagggggtgctacggacgagcgcgcttgacgagaccgttcgctgatggcgtccccacgagtgcggatctcttgagcacctctcaaggcggcaagacctggggtgcgccatacgacgctccagctgcgctggaccgcacgctgccagccctgcagacggactacgtggatctttatcccacctattgtccggtgactatgacgcaacgcgctgggtatggcccgcagaggactgtcccgtccgatatcacggcgacgtgagcggcgatggagaagctgtacgaggt

SEQ ID NO: 21541 - protein, 44 aa, Panicum virgatum
  misc_feature: Ceres CLONE 1816678
  misc_feature: Useful for making plants with modulated flowering time
MKLAGLKSADSAHEESFWAVAWTPVCYHRPKGVLRTSALDETVR

SEQ ID NO: 21542 - DNA, 673 bp, Panicum virgatum
  misc_feature: Ceres CLONE 1816685
  misc_feature: Encodes the peptide sequence at SEQ ID NO. 21543
gacagttcagaagacatcaggaacctctgcggcaaggctcttcagatgctgaaagcgcagtacggttgggagaccgtggaggtgactgtccctgagatcgaggagatgcggctggcgcactacgtgaccatgggatccgagtgcacggcgtccctcgccaagtacctcgacaacatgagcaggtctgagatcgggtgggacgtgcggatcgggctgagcgcctaccgctccttcagcagcagggactacctcaacgcgcagcgcctccggtgccgtcagatgtacttccacgagaggatcttcgaggcggccgacgcgatcgtcacgccgatgacaggggtgaccgcgtacccgctgcaggacgacgcgctgcgcacgggggagctcgactacatcaacggagctgcgctggtgcggtactcgatcgcgggcaacttcctgggtctgccggcgatcaccgtgccggtggggcacgacggaggggggctccccgtggggctgcagctcgtcggccggccatggtcggaggccacgcttctgcacctcgcccacgccgtgcaggaggcctgctgggagcaccgccgcgagccgcccaaggtgcacttcgacctgctcgctcctcgccaaagactgacgacaggccttgccccttgacgacagtccattgctcctc

SEQ ID NO: 21543 - protein, 217 aa, Panicum virgatum
  misc_feature: Ceres CLONE 1816685
  misc_feature: SWISSPROT Homolog: EC 3.5.1.4 Amidase
DSSEDIRNLCGKALQMLKAQYGWETVEVTVPEIEEMRLAHYVTMGSECTASLAKYLDNMSRSEIGWDVRIGLSAYRSFSSRDYLNAQRLRCRQMYFHERIFEAADAIVTPMTGVTAYPLQDDALRTGELDYINGAALVRYSIAGNFLGLPAITVPVGHDGGGLPVGLQLVGRPWSEATLLHLAHAVQEACWEHRREPPKVHFDLLAPRQRLTTGLAP

SEQ ID NO: 21544 - DNA, 680 bp, Panicum virgatum
  misc_feature: Ceres CLONE 1816728
  misc_feature: Encodes the peptide sequence at SEQ ID NO. 21545
actactgctcctcctccacctcgcggcgctgggaccggccgcctcggcgggcagccgcctccggcgctacgactccatcttcagcttcggcgactccttcgccgataccggcaacaagcccatcgccttcgcgcggtactccgtccccgtcaccgtcatgcggccgccctacggcgaggccttcttcggtcgccccaccggccgcaccaccgacggccgggtcatcctcgacctcgctgcccaagccctgggcctgccgctcgtcccgccgtccctggctcgcgacggccgctccttccgtcaaggcgccaacttcgccgtcgccggcgccaccactctgaactccgagttctaccacgcgaggggcatccccggcggcgccagcaagctgcctatcaacaccagcctgagcgtgcagctggagtggtttgaggcgctggagccttcgctgtgcgccacatcccaagagtgcgaggagttcttcggcagatccctctttttcgtgggcgagttcggggtcaacgactaccacctgtctctgaaaaagcttagcgtgcagcaggtccgaccgcttgttcctgacgtgatccagacaatctcaatggccatcgagaggctgatcgtcaagcacggcgcgacgagcttggtggttcccggggtgatcccgtcaggatgctcgc

SEQ ID NO: 21545 - protein, 226 aa, Panicum virgatum
  misc_feature: Ceres CLONE 1816728
  misc_feature: SWISSPROT Homolog: EC 3.2.1.51 Alpha-L-fucosidase
LLLLLHLAALGPAASAGSRLRRYDSIFSFGDSFADTGNKPIAFARYSVPVTVMRPPYGEAFFGRPTGRTTDGRVILDLAAQALGLPLVPPSLARDGRSFRQGANFAVAGATTLNSEFYHARGIPGGASKLPINTSLSVQLEWFEALEPSLCATSQECEEFFGRSLFFVGEFGVNDYHLSLKKLSVQQVRPLVPDVIQTISMAIERLIVKHGATSLVVPGVIPSGCS

SEQ ID NO: 21546 - DNA, 641 bp, Panicum virgatum
  misc_feature: Ceres CLONE 1816729
  misc_feature: Encodes the peptide sequence at SEQ ID NO. 21547
acttctgctcttgctccccctcacggctttggaaaccgccgccacggcagccagattcctccggcttgaccactccctattcaagttccgagaatgcgttaccgcgatacccgaaacaaaaccaacggcatcgcgcggtactccgtacccgggaccgtcgatgcggccgccctactgtcaggccttctacggtgggcccaccggccgcaccaccgacggccgggtcatcctccacctcgctgcccaagccctgggcctgccgctcgtcccgccgtccctggctcgcgacggccgctccttccgtcaaggcgccaacttcgccgtcgccggcgccaccactctgaactccgagttctaccacgcgaggggcatccccggcggcgccagcaagctgcctatcaacaccagcctgagcgtgcagctggagtggtttgaggcgctggagccttcgctgtgcgccacatcccaagagtgcgaggagttcttcggcagatccctctttttcgtgggcgagttcggggtcaacgactaccacctgtctctgaaaaagcttagcgtgcagcaggtccgaccgcttgttcctgacgtgatccatacaatctcaatggccatcgagaggctgatcgtcaagcacggcgcga

SEQ ID NO: 21547 - protein, 160 aa, Panicum virgatum
  misc_feature: Ceres CLONE 1816729
  misc_feature: SWISSPROT Homolog: EC 3.2.1.51 Alpha-L-fucosidase
MRPPYCQAFYGGPTGRTTDGRVILHLAAQALGLPLVPPSLARDGRSFRQGANFAVAGATTLNSEFYHARGIPGGASKLPINTSLSVQLEWFEALEPSLCATSQECEEFFGRSLFFVGEFGVNDYHLSLKKLSVQQVRPLVPDVIHTISMAIERLIVKHGA

SEQ ID NO: 21548 - DNA, 650 bp, Panicum virgatum
  misc_feature: Ceres CLONE 1816731
  misc_feature: Encodes the peptide sequence at SEQ ID NO. 21549
gatcagaccccacccaaatggcagggccccgggtcaacagcgtcttgtggcgttctcctccgtctccgtggcccgcatgctcgtgcacaccctcgagccgtgtagccccccccagcccgcgcccgctcccccgcggtcgccggcctgctgcccctccctgtccttctgacgcccgcacggggcccaggcggccccgccgccaacggcgttctcccgcgagtcggtgcgagggagcgcagcgcggccgctcgcggggaggcccaccaaagctgcgaggcgcgcggcgctctgtgcgcgatgcgagatcggtgacggcctgtaggagttcctgaccctggcgactccggactagaacctcctcacgctgctctcctgcctgggggaggccatgacgactatcgcgttcaaggtgcggacggtgtcctgcggcggcacggcctgcgtcaactccttcggcgacaagcagctcgccatctacatgctctccaacaatctcctcttcgatgctctggaatactcccatgtgtgctagtatgcgtgctctgaggaactccccgaactgcggaacatgggtggcccaactgactgtggcttcaccgtcgcgttcgatccccttgacggttccagcattgactacaccaacttcaccg

SEQ ID NO: 21549 - protein, 47 aa, Panicum virgatum
  misc_feature: Ceres CLONE 1816731
  misc_feature: SWISSPROT Homolog: EC 3.1.3.37 Sedoheptulose-bisphosphatase
  misc_feature: Useful for making plants with modulated biomass
MTTIAFKVRTVSCGGTACVNSFGDKQLAIYMLSNNLLFDALEYSHVC

SEQ ID NO: 21550 - DNA, 1019 bp, Panicum virgatum
  misc_feature: Ceres CLONE 1816738
  misc_feature: Encodes the peptide sequence at SEQ ID NO. 21551
gaaaccccaccaggcacagccgcaccaaccatggacgccggcggcgcacgtccatcggcaccgtcggccgccgccggggccggggccgggggcgcctccgtcgcggacgagccccgggacgcgcgggtggtgcgggagctcctgcgctcgatggggctcggcgagggcgagggcgagtacgagccccgcgtcgtgcaccagttcctggacctggcctaccgctacgtcggcgacgtgctcggggacgcccaggtctacgccgaccacgccgggaaggcccagatcgacgccgacgacgtccgcctcgccatccaggccaaagtcaatttctccttctcgcagccgccgccgcgcgaggttctccttgagctggcacgcaaccggaacagaatcccgctgcctaagtcgatcgctcctcctggttcaattcccctgccaccagagcaggacacactgttggctcagaattaccaactcctgccaccattgaagccgccacctcaagttgaggagacagacgatgacaacgaagaaaccaaccctagtccaaccccaaaccctggaaattccaatccgaaccactcccaggatcagaggggtaatgagcaacaacacacttctcagcatggtcagagggtttctttccaactcaacgccgtggcagctgccgctgctgcgaagcgttctcggatgaccattgaccagatgaacatgggctaaccgtttgttgtcaattggatcgtagcatctcttttctctttctactagtctgctttttttgaaattagtgttacattggtatgttcttattgagtagccacgagatgtgcagtacagcagctgcacaagttttcggcctgtaagcacgtcgcctttggaagggaactgtgctagtattgtatgctgtacctggttcactactcactagtcactagaggttaaatttctactggaatgttatctgggcctgcatgctctttgcatcgccgttcttctatgtaaaattatctcaagagggc

SEQ ID NO: 21551 - protein, 229 aa, Panicum virgatum
  misc_feature: Ceres CLONE 1816738
  misc_feature (19)..(150): Pfam Name: TFIID-31kDa Pfam Description: Transcription initiation factor IID, 31kD subunit
MDAGGARPSAPSAAAGAGAGGASVADEPRDARVVRELLRSMGLGEGEGEYEPRVVHQFLDLAYRYVGDVLGDAQVYADHAGKAQIDADDVRLAIQAKVNFSFSQPPPREVLLELARNRNRIPLPKSIAPPGSIPLPPEQDTLLAQNYQLLPPLKPPPQVEETDDDNEETNPSPTPNPGNSNPNHSQDQRGNEQQHTSQHGQRVSFQLNAVAAAAAAKRSRMTIDQMNMG

SEQ ID NO: 21552 - DNA, 1321 bp, Panicum virgatum
  misc_feature: Ceres CLONE 1816755
  misc_feature: Encodes the peptide sequence at SEQ ID NO. 21553
atcggcctccctcctcttatccgcgccctcccctcgctaaaccctcaccagccacccatggcgatggccggcgccgccgccgccggtcgctgcctgctgctttcccgcccgtcacccctccgcctccgcctcctccgcgccgccctctccaacaccgcccccaccctcacccccaccacctccactcccgctccccctctgcggcacgagctcctcctcgagcgcctccgcctgcggcacctcaaggacgcctcgccccccggatccccgaaccttcccccgcgggggaaggcgaggggcggggagcgggcctcgcagcacccgcagcaggggaagaaggtcgaggccgcggagagcttcgaggagctcgggctcggggaggaggtgatggccgcgctcggggagacgggcatctccaagcccacggagatccagtgcgtcggcgtgccggcggttctggacggcaccagcgtcgtgctcggctcccacacaggctccgggaagacgctcgcctacctgctcccacttgttcagctacttcggcgggatgaagcaatgttggggatgtcaatgaagccaaggcggccaagagcagtagtactctgccccacaagggagctaaccgaacaggtctatcgtgttgcaaagtccatcagccatcatgcacgtttccggtcaacgatggttagcggaggcacccgcataaggccccaggaagattctttgaacatgcctgttgacatggttgttgatactcctggaaggatcctggatcatatcaaggatggtaacatggtttacggtgatatcaagtatctggttctggatgaggcagatacaatgtttgatcaaggctttggaccagacatacggaagttccttgctccattgaagaatcgtgcttcaaagcctggtgatcagggtttccaaactgtattagttactgctaccatgacgaaggctgtacaaaaattaattgatgaggaatttgaaggtattgtccatttgcggacgtcaacatttcaaaagagagttgcaacggctcgacatgactttatcaaacttactggcgcagaaaacaaacttgaggctcttctgcaggttcttgagccaagcttggcaaagggaaacaaagttatggtgttttgtaatactttaaattcaagtcgcgcagtggaccattttctgactgagaatcagatatctactgttaactatcatggggaggttcctgccgaagagagggttgagaacctgaacaaatcccgtaaagaagaaggggattgtccaacattggtatgcactgatctggcagctagag

SEQ ID NO: 21553 - protein, 421 aa, Panicum virgatum
  misc_feature: Ceres CLONE 1816755
  misc_feature (123)..(306): Pfam Name: DEAD Pfam Description: DEAD/DEAH box helicase
MAMAGAAAAGRCLLLSRPSPLRLRLLRAALSNTAPTLTPTTSTPAPPLRHELLLERLRLRHLKDASPPGSPNLPPRGKARGGERASQHPQQGKKVEAAESFEELGLGEEVMAALGETGISKPTEIQCVGVPAVLDGTSVVLGSHTGSGKTLAYLLPLVQLLRRDEAMLGMSMKPRRPRAVVLCPTRELTEQVYRVAKSISHHARFRSTMVSGGTRIRPQEDSLNMPVDMVVDTPGRILDHIKDGNMVYGDIKYLVLDEADTMFDQGFGPDIRKFLAPLKNRASKPGDQGFQTVLVTATMTKAVQKLIDEEFEGIVHLRTSTFQKRVATARHDFIKLTGAENKLEALLQVLEPSLAKGNKVMVFCNTLNSSRAVDHFLTENQISTVNYHGEVPAEERVENLNKSRKEEGDCPTLVCTDLAAR

SEQ ID NO: 21554 - DNA, 743 bp, Panicum virgatum
  misc_feature: Ceres CLONE 1816755-R
acgaactgcacggcatgggagccaaagggaaagttacaagccttgtggctaagaaagatgtggctttagctacacggatagaagaggccatcaagaaaaatgagagcttggaagctctaacgactaacaatgtcagaagagctaccaacccacagagtgcgagcaccaaaggaaggacctcaaggtcggttaacacttcaagtgctcttaaagttgtgaatcagaagggtagaaggggagttgtgctatctagcaagtcatcaaggactcccaaggacacaacatcaacccgaaggcgctcaccaccaaaaatccagccaaaagcgacgaaatcggcagcccctcgcaaagccaaggtggtgaaacctgccaacagtgtgaaggtttcaaaggtcaaagcaaaacctgagggccgaaaggcgaagggtgatgttctgaacaagctgggaactaagctcagtgtggtcggattcagaagtcgcagctcgggcaaatctgtgcaatcttcataagaggcctggagaattttttattcccctgcttcaagaaaggctggagattttggataatgcaccctgtaaatatatgagacttcatttcttcattttttcccttgcggtgcgggcttgcaagttaattaaagagtagaatcgagatgttaacacagcacatctatgtaatacttatgcataatgttggaataatatgttgtattacttgtacccacgaattttcttgagtat

SEQ ID NO: 21555 - DNA, 516 bp, Panicum virgatum
  misc_feature: Ceres CLONE 1816769
  misc_feature: Encodes the peptide sequence at SEQ ID NO. 21556
attcacctgagtgtgctcgatcatcaagcaatccacaaacccccccaattatcctttcctcccatcatcttccttcttcccagatgtcttgccgctgcgagatcaagctgcaactgcggctccaactgcaagtgcggcaacatgtaccctgaccttgaggagaagagcagcggcggcgctcacgccaccctcgccctcggcgtggcccccgagaacaaggccggccacctccaggccgccgcggagtccggccagaccgcccacccctgcaagtgccctaacccctgcagctgcgacccctgcaactgctgatttcgatggggaacgtcacaacacacctgcatgcatgctagctaccacctactactctgcctgtgtgtgacttgatcgatccaccacgactaaggatgagcctgagccatcatgtctcatgtatcggtctggccccggcccaatcacgcatgcatgcgtcgtctgcccctctgcgtgctttgcgtccgtcctgtgtctgtatgt

SEQ ID NO: 21556 - protein, 103 aa, Panicum virgatum
  misc_feature: Ceres CLONE 1816769
  misc_feature (35)..(103): Pfam Name: Metallothio_2 Pfam Description: Metallothionein
IHLSVLDHQAIHKPPQLSFPPIIFLLPRCLAAARSSCNCGSNCKCGNMYPDLEEKSSGGAHATLALGVAPENKAGHLQAAAESGQTAHPCKCPNPCSCDPCNC

SEQ ID NO: 21557 - DNA, 722 bp, Panicum virgatum
  misc_feature: Ceres CLONE 1816780
  misc_feature: Encodes the peptide sequence at SEQ ID NO. 21558
tttcgcgctgttgggctccccacctcccccgtcccgtccgccactccgccgcgcccgcctcccaccccgtgagtcgccgcacggggggaggacggaggaggctaccgccgcgacgcagccttgccgctccagcctccaggtccggccccgcctcgtttccatgtctagctagtgtccgggactccgggcgataggttacttgggttctcctgggttgcgttgcgtgctccaccgacctgttctcggcgccttctcgtcctccggatggccaacgggagcctccacgtctcgtggtgccgcgccttggtctgcgcgctggcgctcgtcgcagcggacggcttgctcgtggacatcacctacgtggaaaccgcgcccgccgtggccaaaggagcagtgtgcttggatgggagcgcgccggcgtatcacctcgcccgcggcttcggctccggcgtgaacagctggcttgtgcattttgaggggggaggatggtgcaacaatgtcacgagctgcctgcaacggaagcgcacgcggctggggtcctccaaggagatggcgacgcagattgccttctccggaatcctgagcgacacgccggattacaacccagacttttacaattggaacaaggtcaaggttcggtactgcgatggatcatcttttaccagcgatgtcgaacaagtcgatcctacaacaaagctacactacagaggtgcaaggatatg

SEQ ID NO: 21558 - protein, 152 aa, Panicum virgatum
  misc_feature: Ceres CLONE 1816780
  misc_feature (12)..(152): Pfam Name: PAE Pfam Description: Pectinacetylesterase
  misc_feature: Useful for making plants with altered cell wall content and/or composition
  misc_feature: Useful for making plants with altered carbohydrate content
MANGSLHVSWCRALVCALALVAADGLLVDITYVETAPAVAKGAVCLDGSAPAYHLARGFGSGVNSWLVHFEGGGWCNNVTSCLQRKRTRLGSSKEMATQIAFSGILSDTPDYNPDFYNWNKVKVRYCDGSSFTSDVEQVDPTTKLHYRGARI

SEQ ID NO: 21559 - DNA, 649 bp, Panicum virgatum
  misc_feature: Ceres CLONE 1816790
  misc_feature: Encodes the peptide sequence at SEQ ID NO. 21560
aattcttttctctgctctccggccgccttgctctctgtctgtcttgtcctcgtcgcctctccgcttgccctccgccctccggcgcctcggtgccctgcctactgcaagttcagcacatggttgttcgcccgcgcctgcgcggcctttgatcgcgatagcctcctcgtcgcagttgtcgggggaagcagcgccggcggcgtccatggcggcggggtcgtcgaggcaagcgacggagaaggtggacaagtggatggcgttcccgtcgggcgccggcagcggcagcttcaccttcccgccgctgagttccgagtcgggcggcggcaaggagatcgtggaggagctggcgtcttcctccctgcgcgccgccgccggaggcggcagcagcagtaaccggcagccgtcgttccagcgcgggcgcgacagcggcgtggcgggcagcaccaagtcgtcgctggacggcgcgcgcggctcgtgggagtcgtcgtcgctgccgcgggtgtcgcaggagctcaaggacgcgctgtccaacctgcagcagaccttcgtcgtctccgacgcgacgcgcccggactgccccatcatctacgccagcgccggcttctacaccatgaccggctactcccccaaggaggtcatcggccgcaactgc

SEQ ID NO: 21560 - protein, 148 aa, Panicum virgatum
  misc_feature: Ceres CLONE 1816790
  misc_feature: SWISSPROT Homolog: EC 2.7.11.1 Non-specific serine/threonine protein kinase
MAAGSSRQATEKVDKWMAFPSGAGSGSFTFPPLSSESGGGKEIVEELASSSLRAAAGGGSSSNRQPSFQRGRDSGVAGSTKSSLDGARGSWESSSLPRVSQELKDALSNLQQTFVVSDATRPDCPIIYASAGFYTMTGYSPKEVIGRN

SEQ ID NO: 21561 - DNA, 1724 bp, Panicum virgatum
  misc_feature: Ceres CLONE 1816791
  misc_feature: Encodes the peptide sequence at SEQ ID NO. 21562
acctaccgcgccacacacccacctcaaatccccgactcatcgagctcaaccatcgatcacagcaccccacgccgtcgccatcgccgcccccgcccccgctgcttcccaagccatctcatggcggcgtcggcctcttccctcctcgccgccgcagcatcctcgtcctgcgcggccatctctccccggattccccgcggagctccggctgccgcctccgttccttcgccgtcgcatcactcctgcccttccctccgcgcttcccccgcgaggcgccatcagagccgcttcgtagccagcgtcgctcccacgatgcagcctccggcggagtccagggtctctacggtggtcgacgtcgacctcggcgaccgtagctacccgatctacatcggcgcaggcctcctcgacgagccagacttgctgcagaggcatgttcacgggaagagggttctggtggtgaccaacacgaccgtcgcgccgctttacctggagaaggtgacctgggcactcacccacaacaaccggaacgtgtcagtggagagcgtgatcctgcctgacggcgagaagtacaaagatatggacacgctgatgaaggtgtttgacaaggcagtcgagtcccggcttgaccggcgttgcacatttgtagcactgggtggtggtgtcattggggacatgtgcgggtttgcagctgctgcgttccttcgtggtgtcaacttcatacagataccaactactctgatggctcaggtggattcatctgttggtggaaagaccgggattaaccacccacttgggaagaacttaattggggcattctaccagcctcaatgtgtactgatagacacggacacactgaataccttgcctgacagggagctagcttcaggcattgctgaggtagtcaagtatgggctcataagggatgcaccattctttgagtggcaagagaagaacatgtcagcattgttagcaagagaaccaagtgctttggcatatgctattaagagatcatgtgaaaacaaagctgaagtggttgcacaggatgagaaggaaagtggtcttcgagcaacactaaacctgggtcacacatttggccatgctattgaaactgggcttggatacggagcatggttccatggggaggcaattgcagctggaacagttatggcagctgatatgtctcaccgcctggggtggatagacgagtcaatcaaaaaacgtgtagtggatatattagaggaagccaagcttcccattacacctccagagactatgacagtggagaagttcaaaagtattatagctgttgacaagaaggttgctgatggtttgttgaggctcatccttctgaaagggcctctggggagctgcgtttttactggggaatacgacaggaaagcacttgatgaaacccttcatgcattctgcaacaactgatccttcttgattttggattttgcctcttgtatactaataggctcccttcatgcactctgcaacagctgatccttcttggttttggatttcgcctcttgtaaggctatattgatcatcagggaggagagtgcattgtgtattgagagtgcattgtgtatttatacccattgattttttgttgttgggaataatgggattgctagggattggtttgagtttgtagggaaccatatctgatcaactgtgatcagtcatcttctagagttctagtaataaagaagttttactgc

SEQ ID NO: 21562 - protein, 438 aa, Panicum virgatum
  misc_feature: Ceres CLONE 1816791
  misc_feature (90)..(401): Pfam Name: DHQ_synthase Pfam Description: 3-dehydroquinate synthase
  misc_feature: SWISSPROT Homolog: EC 4.2.3.4 3-dehydroquinate synthase
MAASASSLLAAAASSSCAAISPRIPRGAPAAASVPSPSHHSCPSLRASPARRHQSRFVASVAPTMQPPAESRVSTVVDVDLGDRSYPIYIGAGLLDEPDLLQRHVHGKRVLVVTNTTVAPLYLEKVTWALTHNNRNVSVESVILPDGEKYKDMDTLMKVFDKAVESRLDRRCTFVALGGGVIGDMCGFAAAAFLRGVNFIQIPTTLMAQVDSSVGGKTGINHPLGKNLIGAFYQPQCVLIDTDTLNTLPDRELASGIAEVVKYGLIRDAPFFEWQEKNMSALLAREPSALAYAIKRSCENKAEVVAQDEKESGLRATLNLGHTFGHAIETGLGYGAWFHGEAIAAGTVMAADMSHRLGWIDESIKKRVVDILEEAKLPITPPETMTVEKFKSIIAVDKKVADGLLRLILLKGPLGSCVFTGEYDRKALDETLHAFCNN

SEQ ID NO: 21563 - DNA, 1983 bp, Panicum virgatum
  misc_feature: Ceres CLONE 1816803
  misc_feature: Encodes the peptide sequence at SEQ ID NO. 21564
aaaagccgaacgggagatagatacaaagttacgaacacaaagatgaggcgtgggctaaaaggtctcaccttcctgcttctccttgtcttgcttgttctgtgctccagcattcgtctatgctatgcaagaagtgggaagcattggaggcgaagcagagcgacctccacctctatgctgagaaaagggaaaccaaagagcagcagttcccacaagcaaaacggcaaaggaaataggagtccataccagccaagtccgagcacaagccctgtccagagcaaaggaggccagggtccaacaatgccaacaccaggcggtggcagtggatgtacagtgccacctccaccaccgttgcagctgcctccactgccgtctccaccggcagcgcacgacacagtcttcaacgtggttgattttggagccaagggtgatggggttacggatgatactcaggcttttgaagcagcatgggcagcagcatgcaaggtggaggcatctacggttcttataccatctgaactcgagtttgtcgttggcccaatctcattttctggaccttactgtaaaccaaacattctattccagctggatgggactattttagctcaaactagtacgagagtgtggggttctggtttgcttcaatggcttgagttcacaaagctaactggaataacaatccaaggcagtggtgtaataaatggtagggggcaagaatggtggacctactcagatccaaacggtgacgatgacgatgatgccttcagagtggagctagacaagatgccacagattaaacctacggcactgagattttatggcagctccaatgtcacagtaacgggtatcacgattgttaacagctcacagtgccatctgaagtttgatagctgtcaaggagtcatggttcacgatttaaccatctcttcccctgagaatagtcccaacaccgatggaatacacctgcaaaactccagagaagtcaacattcaccacactaacatggcttgcggtgatgactgtgtttccatccagacaggatgcagtgacataaacatacataatgtgaactgtggaccaggccatgggatcagcattggtggtctagggaggtacaacacaaaagcatgtgtatccaacgtcaccgtgagagatgtcaacatgttcaaaacaatgaatggtgtcagaatcaagacttggcaggatggttccgggctggttcagggtataaggttctcaaacatacaggtctcagaagttcaaacgcctatcatcatagaccaattctactgtgacaaaacaacatgcagaaatcaaacttcagcagtggctgtttcaggtgttcagtatgagaacatcagggggactttcacaattaaaccggcccacttcgcgtgcagcgacaattcaccttgttcagatatcactcttacaggaatacaactcaaacctgtgatagtaccgcagtaccacctatacaaccccttctgctggcaagcctttggagcgctgtacacccctactgtacctcccataccttgcttgcagatcggcaaaccagcagggaacagcgtgctgtcagatggtgacctttgctgaaaggccgaggctctctgagaaggagcagaagtgctcaagtgccttaatcggattcggaacaatactgtttgtgtctgtcagttaaggcggtcgtcgtgattcttccgacccctttgcacaatgccaagtgctgtgcatatatgcagctgttgtcaggaatcaggaatatggcttccatggcacgtgccaactcgcctcttgataggaaatataggaagtggatgatatagtataggtagtgtttgtccagcgtttccagtgatgtatcatgcatacgtatgagatgcttcaagggaaaacatagaatcagcagtctgtactctgtagtccgcttcaacgcgatgcacatacagataattaatggtagcaaagccttattctctcttc

SEQ ID NO: 21564 - protein, 517 aa, Panicum virgatum
  misc_feature: Ceres CLONE 1816803
  misc_feature (146)..(482): Pfam Name: Glyco_hydro_28 Pfam Description: Glycosyl hydrolases family 28
  misc_feature: SWISSPROT Homolog: EC 3.2.1.15 Polygalacturonase
  misc_feature: Useful for making plants with altered carbohydrate content
  misc_feature: Useful for making plants with altered cell wall content and/or composition
MRRGLKGLTFLLLLVLLVLCSSIRLCYARSGKHWRRSRATSTSMLRKGKPKSSSSHKQNGKGNRSPYQPSPSTSPVQSKGGQGPTMPTPGGGSGCTVPPPPPLQLPPLPSPPAAHDTVFNVVDFGAKGDGVTDDTQAFEAAWAAACKVEASTVLIPSELEFVVGPISFSGPYCKPNILFQLDGTILAQTSTRVWGSGLLQWLEFTKLTGITIQGSGVINGRGQEWWTYSDPNGDDDDDAFRVELDKMPQIKPTALRFYGSSNVTVTGITIVNSSQCHLKFDSCQGVMVHDLTISSPENSPNTDGIHLQNSREVNIHHTNMACGDDCVSIQTGCSDINIHNVNCGPGHGISIGGLGRYNTKACVSNVTVRDVNMFKTMNGVRIKTWQDGSGLVQGIRFSNIQVSEVQTPIIIDQFYCDKTTCRNQTSAVAVSGVQYENIRGTFTIKPAHFACSDNSPCSDITLTGIQLKPVIVPQYHLYNPFCWQAFGALYTPTVPPIPCLQIGKPAGNSVLSDGDLC

SEQ ID NO: 21565 - DNA, 696 bp, Panicum virgatum
  misc_feature: Ceres CLONE 1816806
  misc_feature: Encodes the peptide sequence at SEQ ID NO. 21566
gcggattcccccctcagacctgaccctttttttttcttcctttctcaccatggatcgtgtgaaaaaacaaacaaacaaatagagcttcttccccgcgatgacgaagatcgtggggacgctcgggcccaagtcgcgcaccgtcgacaccatctccgcctgcctcaaggccggcatgtccgttgcgcggttcgatttctcgtggggagacgccgcctaccaccaggagacgctcgagaacctcaagctcgccatcaaggccaccaagaagctatgcgccgtcatgcttgatactgtcggccccgagttgcaggtggttaacaagaatgaaaccccgatttccctcgaggagaatggcactgtggttctcacacctcatcaggggcaagaagcctcctccagcttgctgcccatcaacttctccggactcgccaaggctgtgacaccaggcgcaacaatatttgtgggacaatacttgttcactggcagtgagactacttcagtttagttggaggtttctgaagttcaaggagatgatgtggtctgtataatcaagaacacagctacattggctgggtcactgttcacactgcattgctcccagattcatattgacttgccaacgctatctgatgaggataaggacgttatcagaaaatggggtgctccaaacaagattgactttctctctttgtctta

SEQ ID NO: 21566 - protein, 135 aa, Panicum virgatum
  misc_feature: Ceres CLONE 1816806
  misc_feature (2)..(134): Pfam Name: PK Pfam Description: Pyruvate kinase, barrel domain
  misc_feature: SWISSPROT Homolog: EC 2.7.1.40 Pyruvate kinase
MTKIVGTLGPKSRTVDTISACLKAGMSVARFDFSWGDAAYHQETLENLKLAIKATKKLCAVMLDTVGPELQVVNKNETPISLEENGTVVLTPHQGQEASSSLLPINFSGLAKAVTPGATIFVGQYLFTGSETTSV

SEQ ID NO: 21567 - DNA, 697 bp, Panicum virgatum
  misc_feature: Ceres CLONE 1816846
  misc_feature: Encodes the peptide sequence at SEQ ID NO. 21568
gattgattgatttgcatttcatggctgtagggagcaccaagggtctggtgagcatcaagccggtgaagtacttcaaggacgatgcggcgctgacggcggacacggtgacggcggaggtggagatcaacgcgacatcctccaccaccgtgagggaggggctggacctggtggccgtgctcgacgtcagcggcagcatgcgcggggacaagatcgcgagcctgaagaaagccatgacgttcgtgatcatgaagctcaccccggtggaccgcctctccatcgtcaccttctccaacgacgccgccaggctgaccccgctgcgctccatgaccccggtcgcccagaccgagctcaaggctgtcgtcgacggcctaacggccggcggctggaccaacatccaggccggccttgagaccgggctggccgtgatcgccggccgcgtcaacaccaaggcccgcaccgccaacatcttcctcatgtccgacggggagcagaagcccggcgacgccaggcaggtcgaccccggccaggtggccatctacacgtttggcttcggcaaggacaccaaccaccagctgatgagcgacattgccaagagatcgccgggcgggaccttcagctccgtgccggacgggtccacggtgactctgcccttctcgcagctgctggctggtctcctcaccgtggtggcgcaggacgt

SEQ ID NO: 21568 - protein, 231 aa, Panicum virgatum
  misc_feature: Ceres CLONE 1816846
  misc_feature (54)..(220): Pfam Name: VWA Pfam Description: von Willebrand factor type A domain
  misc_feature: SWISSPROT Homolog: EC 6.6.1.1 Magnesium chelatase
LIDLHFMAVGSTKGLVSIKPVKYFKDDAALTADTVTAEVEINATSSTTVREGLDLVAVLDVSGSMRGDKIASLKKAMTFVIMKLTPVDRLSIVTFSNDAARLTPLRSMTPVAQTELKAVVDGLTAGGWTNIQAGLETGLAVIAGRVNTKARTANIFLMSDGEQKPGDARQVDPGQVAIYTFGFGKDTNHQLMSDIAKRSPGGTFSSVPDGSTVTLPFSQLLAGLLTVVAQD

SEQ ID NO: 21569 - DNA, 650 bp, Panicum virgatum
  misc_feature: Ceres CLONE 1816848
  misc_feature: Encodes the peptide sequence at SEQ ID NO. 21570
accacccctgcaggctgcagctcggccggagtagtgcgctgtgagagggagccaggagtgggggtccgtacacccgcggtcaccataccggccaccgctctgctctcctcttccctccctcctcttctgcaaacggcgggcggagttaaaaaaggaaaccaaaaatctagggtttgttccgttccatttccggggagcccaaagcccccgtgtacgctcaccaccgtgccggccgcctccctcgtccctccctcttcccgctcctcctccccaacgttatccgccgtccggggcggcagcttgggggagtcaagtagcggcggcggcggcggcgtcgacggccttcgtgctgcggaagggctgccggcggctgccggctgcccccggcagctccgaggcaaggtcacattttgagaactgagggtagtatacgatggcagatgccagtcctatagtagaaacatcaacagatgatactgacgacaaccatgggctggaaccaagcacaggcgctcttgttgttgcttccgactccagtgacagatccaaggacaaacatgaagatcaaaaggtactgcgccgtcttgctcaaaatcgcgaggctgcaaggaagagtcgattgaggaagaaagcatatgtccaacagttgg

SEQ ID NO: 21570 - protein, 72 aa, Panicum virgatum
  misc_feature: Ceres CLONE 1816848
  misc_feature: The sequence is a functional homolog of SEQ ID NO 1792 in the 10/412,699 US patent application
  misc_feature: The sequence is a functional homolog of SEQ ID NO 2030 in the 10/374,780 US patent application
  misc_feature: The sequence is a functional homolog of SEQ ID NO 206 in the 10/225,068 US patent application
  misc_feature: The sequence is a functional homolog of SEQ ID NO 356 in the 10/412,699 US patent application
  misc_feature: The sequence is a functional homolog of SEQ ID NO 831 in the 11/479,226 US patent application
  misc_feature: The sequence is a functional homolog of SEQ ID NO 934 in the 11/435,388 US patent application
  misc_feature: The sequence is a functional homolog of SEQ ID NO 1494 in the 10/374,780 US patent application
  misc_feature: The sequence is a functional homolog of SEQ ID NO 1564 in the 10/412,699 US patent application
  misc_feature: The sequence is a functional homolog of SEQ ID NO 1788 in the 10/412,699 US patent application
  misc_feature: The sequence is a functional homolog of SEQ ID NO 2026 in the 10/374,780 US patent application
  misc_feature: The sequence is a functional homolog of SEQ ID NO 354 in the 10/412,699 US patent application
  misc_feature: The sequence is a functional homolog of SEQ ID NO 823 in the 11/479,226 US patent application
  misc_feature: The sequence is a functional homolog of SEQ ID NO 930 in the 11/435,388 US patent application
  misc_feature: The sequence is a functional homolog of SEQ ID NO 1496 in the 10/374,780 US patent application
  misc_feature: The sequence is a functional homolog of SEQ ID NO 1566 in the 10/412,699 US patent application
  misc_feature: The sequence is a functional homolog of SEQ ID NO 1878 in the 10/412,699 US patent application
  misc_feature: The sequence is a functional homolog of SEQ ID NO 2138 in the 10/374,780 US patent application
  misc_feature: The sequence is a functional homolog of SEQ ID NO 372 in the 10/225,066 US patent application
  misc_feature: The sequence is a functional homolog of SEQ ID NO 878 in the 11/435,388 US patent application
  misc_feature: The sequence is a functional homolog of SEQ ID NO 1794 in the 10/412,699 US patent application
  misc_feature: The sequence is a functional homolog of SEQ ID NO 2032 in the 10/374,780 US patent application
  misc_feature: The sequence is a functional homolog of SEQ ID NO 380 in the 10/412,699 US patent application
  misc_feature: The sequence is a functional homolog of SEQ ID NO 534 in the 10/225,066 US patent application
  misc_feature: The sequence is a functional homolog of SEQ ID NO 936 in the 11/435,388 US patent application
  misc_feature: The sequence is a functional homolog of SEQ ID NO 1495 in the 10/374,780 US patent application
  misc_feature: The sequence is a functional homolog of SEQ ID NO 1565 in the 10/412,699 US patent application
  misc_feature: The sequence is a functional homolog of SEQ ID NO 114 in the 10/666,642 US patent application
  misc_feature: The sequence is a functional homolog of SEQ ID NO 2362 in the 10/374,780 US patent application
  misc_feature: The sequence is a functional homolog of SEQ ID NO 376 in the 10/412,699 US patent application
  misc_feature: The sequence is a functional homolog of SEQ ID NO 608 in the 10/225,066 US patent application
  misc_feature: The sequence is a functional homolog of SEQ ID NO 848 in the 11/435,388 US patent application
  misc_feature: The sequence is a functional homolog of SEQ ID NO 871 in the 11/479,226 US patent application
  misc_feature: The sequence is a functional homolog of SEQ ID NO 242 in the 10/374,780 US patent application
  misc_feature: The sequence is a functional homolog of SEQ ID NO 764 in the 10/412,699 US patent application
  misc_feature: The sequence is a functional homolog of SEQ ID NO 826 in the 10/225,066 US patent application
  misc_feature: The sequence is a functional homolog of SEQ ID NO 950 in the 11/435,388 US patent application
  misc_feature: The sequence is a functional homolog of SEQ ID NO 96 in the 11/375,241 US patent application
  misc_feature: The sequence is a functional homolog of SEQ ID NO 1497 in the 10/374,780 US patent application
  misc_feature: The sequence is a functional homolog of SEQ ID NO 1567 in the 10/412,699 US patent application
  misc_feature: Useful for making plants with modulated biomass
  misc_feature: Useful for making plants with modulated flowering time
  misc_feature: The sequence is a functional homolog of SEQ ID NO 1786 in the 10/412,699 US patent application
  misc_feature: The sequence is a functional homolog of SEQ ID NO 2024 in the 10/374,780 US patent application
  misc_feature: The sequence is a functional homolog of SEQ ID NO 352 in the 10/412,699 US patent application
  misc_feature: The sequence is a functional homolog of SEQ ID NO 819 in the 11/479,226 US patent application
  misc_feature: The sequence is a functional homolog of SEQ ID NO 928 in the 11/435,388 US patent application
MADASPIVETSTDDTDDNHGLEPSTGALVVASDSSDRSKDKHEDQKVLRRLAQNREAARKSRLRKKAYVQQL

SEQ ID NO: 21571 - DNA, 2165 bp, Panicum virgatum
  misc_feature: Ceres CLONE 1816852
  misc_feature: Encodes the peptide sequence at SEQ ID NO. 21572
aaaaatccaaggcacctctcgttccctccacctccacctcctcctctcccacggtcccacctcatcgccttcctccaccgtttccgccagcccggacgtacacgacgcgacacctccgtgcacacgaccggtcgtcgcagccgccgcgggtttgatcgatcgcgagctgtgacttgcttcccttcgttttcggtcttccccgatgaccacgtcgtcgtccgggagcatcgaggcgccggcgaactcgaggcccggatcgttctcgttcgcgagcacgaacttcacggtcatgctggggggctccgcggccgcggccggcggggcgtcgaggtacaaggccatgaccccgccgtccctgccggtgtcgccgccgccggtgtcgccctcgtccttcttcaacatccccggcggcctgaaccctgccgacttcctcgactcgccggccctcctcacctccagtttcttcccgtcgccgacgacgaacgcattcgcctcgcagcagttcagctggctgacgccgccgggcgcggagcaaggcggcaaggacgagcagaggcagtcgtacccggatttctcgttccagacggcgccgacgaccgaagaggccgtgcggacgacgacgaccttccagcagccacccgttccaccggccccactgggtgaagaggcatacagaagtcagcagcagcagcagcagcaaccatggagctaccaccagcagcagccagccatggacgcgggctccagccaggcggcctacggcgggcagttccaggcaggctcgtcggacgccgccgcgatggcgccgcacgcgccggcgagcggcgggtacagccaggcgcagtcgcagaggcggtcgtcggacgacgggtacaactggcgcaagtacgggcagaagcaggtgaaggggagcgagaacccgcgcagctactacaagtgcactttcccgggctgccccaccaagaagaaggtggagcggtcgctggacggccagatcaccgagatcgtgtacaagggcacgcacaaccacgccaagccgcagaacacgcgcaggaactccagcgcggcggcgcagctgttgcagggcgccggcgaggcgtccgagcactcgttcggcggcacgcccgtcgcgacgcccgagaactcctcggcgtccttcagggacgacgaggccgccggcgtgggctcgccgcgggctgggaacgccggcggcgacgagttcgacgaggacgagccggattccaagagatggaggaaagacggcgacggcgaggggatctccatggccggcaaccgcacggtgcgcgagccgagggtcgttgtccagaccatgagcgacatcgacatcctcgatgacggctaccgctggaggaagtacgggcagaaggtggtgaagggaaaccccaaccccaggagctactacaagtgcacgacggccgggtgcccggtgcggaagcacgtggagcgcgcgtcgcacgacctgcgcgccgtgatcaccacgtacgagggcaagcacaaccacgacgtgcccgccgcgcggggcagcgccgcgctgtaccggcccgcgccgccgccaacggacacctacctcgccgcggcccccggcgtgaggccgccggcgcccagcatggcctaccagacggggccgcggtacgggttcggcggccagagctcgttcggcctcggcgccggcgcgccggcgcagcagagcggcggcggcggcttcgggttcccctccggcttcgacaacccgatggggtcgtacatgagccagcaccagcagcagcagcggcagaacgacgccatgcacgcgtcgagggccaaggaggagcccagggaggacatggcgttcttcccgcagtcgatgatggacaactgaactgacgacaggaggaggacacgacgtcgcgggaaatggcaaagacatgacgcgatgtccgtagtagggttgctgtatctaggatagggttgaacagattatttctttatttgtttggaggcctccatgtcgcttgccgaaaatgggggccctcccttaacacgtggatactactagaatcataggacacaggacaaggtagaaaagggtatcaacagttttgttcttcgattattttttttcgcatgaaaatgttgtattcaaaattgaattgaatttttgcatc

SEQ ID NO: 21572 - protein, 558 aa, Panicum virgatum
  misc_feature: Ceres CLONE 1816852
  misc_feature (383)..(442): Pfam Name: WRKY Pfam Description: WRKY DNA -binding domain
  misc_feature (220)..(278): Pfam Name: WRKY Pfam Description: WRKY DNA -binding domain
  misc_feature: The sequence is a functional homolog of SEQ ID NO 1112 in the 10/225,066 US patent application
  misc_feature: The sequence is a functional homolog of SEQ ID NO 2440 in the 10/374,780 US patent application
  misc_feature: The sequence is a functional homolog of SEQ ID NO 586 in the 10/412,699 US patent application
  misc_feature: The sequence is a functional homolog of SEQ ID NO 612 in the 10/225,066 US patent application
  misc_feature: The sequence is a functional homolog of SEQ ID NO 22 in the 10/374,780 US patent application
  misc_feature: The sequence is a functional homolog of SEQ ID NO 231 in the 11/479,226 US patent application
  misc_feature: The sequence is a functional homolog of SEQ ID NO 858 in the 10/225,066 US patent application
  misc_feature: The sequence is a functional homolog of SEQ ID NO 88 in the 10/412,699 US patent application
  misc_feature: The sequence is a functional homolog of SEQ ID NO 202 in the 10/714,887 US patent application
  misc_feature: The sequence is a functional homolog of SEQ ID NO 202 in the 11/435,388 US patent application
  misc_feature: The sequence is a functional homolog of SEQ ID NO 204 in the 10/714,887 US patent application
  misc_feature: The sequence is a functional homolog of SEQ ID NO 204 in the 11/435,388 US patent application
  misc_feature: The sequence is a functional homolog of SEQ ID NO 86 in the 10/412,699 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
MTTSSSGSIEAPANSRPGSFSFASTNFTVMLGGSAAAAGGASRYKAMTPPSLPVSPPPVSPSSFFNIPGGLNPADFLDSPALLTSSFFPSPTTNAFASQQFSWLTPPGAEQGGKDEQRQSYPDFSFQTAPTTEEAVRTTTTFQQPPVPPAPLGEEAYRSQQQQQQQPWSYHQQQPAMDAGSSQAAYGGQFQAGSSDAAAMAPHAPASGGYSQAQSQRRSSDDGYNWRKYGQKQVKGSENPRSYYKCTFPGCPTKKKVERSLDGQITEIVYKGTHNHAKPQNTRRNSSAAAQLLQGAGEASEHSFGGTPVATPENSSASFRDDEAAGVGSPRAGNAGGDEFDEDEPDSKRWRKDGDGEGISMAGNRTVREPRVVVQTMSDIDILDDGYRWRKYGQKVVKGNPNPRSYYKCTTAGCPVRKHVERASHDLRAVITTYEGKHNHDVPAARGSAALYRPAPPPTDTYLAAAPGVRPPAPSMAYQTGPRYGFGGQSSFGLGAGAPAQQSGGGGFGFPSGFDNPMGSYMSQHQQQQRQNDAMHASRAKEEPREDMAFFPQSMMDN

SEQ ID NO: 21573 - DNA, 1743 bp, Panicum virgatum
  misc_feature: Ceres CLONE 1816862
  misc_feature: Encodes the peptide sequence at SEQ ID NO. 21574
atctctattattgaggatcacaacgccatccgcgcaaaaacaaatggagctcacgtggcttctgctcgctgctctcctccttcctctctccttccttctgctgttctcgcactccaagaacatgggcaaagccagccaccgcctgccgccggggcctgccgtcgtgccggtgctcggcaacctgctgtggctgaggcaccatggggtcgacatcctgcgcgccatgcgccgcctccacgcgcgccacggcccgctgctcacgctccgcatgggctcccgcctcgaggtcaccgtctccgaccgcggcctcgcgcacgccgcgctcgtcgagcgcggcgccgcgctggccgaccgccccgggttcgcgtcgagggacctcctggggctcaacgccgccaccatctccacctccagctacggcccgctgtggcgcctgttccggcgcaacttcgtggccgaggtcgcgcacccggcgcggctccggctgttcgcgccggcgcgggtggcggtgctcgccgagctcacggacaagctgcgcctcagggaggagggcggcggcggcgaccaaggcaccatcgtggcaacgttccagtacgccatgttccgcctcctcgtggccatgtgcttcggggagcagctcggcgagcgcgccgtgcgcgacatcgccgccgcgcagcgcgacctgctgctctactcctccaccaaggcccgaatcttcgccttcctgccggccgtcacggcgcgcctcttccgcggccgcctgcgggccatgttcgccatgcgccagcggctcaaggacatgtacatgccactgatcgaggcgcgcagggagcgcaagaagctcggactcggagccgtgccgccgcctgagccgcaggacaagacaacgacgacgctgccgcactcttacgtcgacacgcttctggacatccagctggccgacgacggtgggcgcgcgctgaccgacgacgagatgatcgcgctgtgctcggagttcctcaacggcggcacggacaccacgtccacggcgctgcagtggatcatggctgagctcgtcaagaacccggccatccaggaaaagctccacgacgagatcaaatcaacgatggccaccaccggctcggatcacatctccgaggaggacgtgcacaagatgccgtacctgaaggcggtggtgctggaaggcctccggcgccacccgccggggcacatgctgctgccgcacgcgccggcggaggacatggagctgggcgggtacgtcatccccaaggacacgatggtgaacttcttggtggcggacatgggcatggacgagcgggcgtgggagcggccgacggagttcgcgccggagaggttcatgccgggcggcgacggcgaaggcgtcgacatcacgggcacgcgggagatcaggatgatgccgttcggggccgggcggaggatctgccccggcctcaacgtcgcaacgcttcacctcgagtacttcgtggcgaacctggtgcgtgcgttcgagtggcgaagcgcggaggggcaggaggtggacgtcgacggcgagaaggccgagttcaccatcgtcatggccaagccgctccaggcgcgcatcgtgcccagagtagctgctcgagacttagcgaggctgttgcgtgcttgctcttgattgtaccgtgtcaatgcaatgtactagtagtactataggtaattgatgctatgtaatggtgaattagtggataatgccattttgttgct

SEQ ID NO: 21574 - protein, 536 aa, Panicum virgatum
  misc_feature: Ceres CLONE 1816862
  misc_feature (35)..(520): Pfam Name: p450 Pfam Description: Cytochrome P450
  misc_feature: SWISSPROT Homolog: EC 1.14.13.21 Flavonoid 3'-monooxygenase
MELTWLLLAALLLPLSFLLLFSHSKNMGKASHRLPPGPAVVPVLGNLLWLRHHGVDILRAMRRLHARHGPLLTLRMGSRLEVTVSDRGLAHAALVERGAALADRPGFASRDLLGLNAATISTSSYGPLWRLFRRNFVAEVAHPARLRLFAPARVAVLAELTDKLRLREEGGGGDQGTIVATFQYAMFRLLVAMCFGEQLGERAVRDIAAAQRDLLLYSSTKARIFAFLPAVTARLFRGRLRAMFAMRQRLKDMYMPLIEARRERKKLGLGAVPPPEPQDKTTTTLPHSYVDTLLDIQLADDGGRALTDDEMIALCSEFLNGGTDTTSTALQWIMAELVKNPAIQEKLHDEIKSTMATTGSDHISEEDVHKMPYLKAVVLEGLRRHPPGHMLLPHAPAEDMELGGYVIPKDTMVNFLVADMGMDERAWERPTEFAPERFMPGGDGEGVDITGTREIRMMPFGAGRRICPGLNVATLHLEYFVANLVRAFEWRSAEGQEVDVDGEKAEFTIVMAKPLQARIVPRVAARDLARLLRACS

SEQ ID NO: 21575 - DNA, 1773 bp, Panicum virgatum
  misc_feature: Ceres CLONE 1816878
  misc_feature: Encodes the peptide sequence at SEQ ID NO. 21576
acacaagacacaaccacgcgctcgcgccatggacgccgttgtcgtgccgctcctcctcctcctcctcctcctcgccgtcgccgttcttctccgtctgcgcctccggcggcgccgtgcgtcagcggcaagcgcggggcgccgcaaccactgcccctacccgaaccccgtcctcggcaaccttgtgcccctcatccgcaacttccaccgcttcctcgactgggccaccgacctcctcgccgccgccccagcatccaccatcgaggtgcgcggcgcgctcggcctcgccaacggcgtcgccaccgcggacccgggagtcgtcgaccacttcctgcgcgccaatttccccaactacgtcaagggcgcgcgctacgcggtccccttcgccgacctcctcggccgagggctcttcctcgccgacggccgcctctggagcctccagcgcaagctcgcctcctactccttcacatcccgctcgctgcgccacttctcggggcgcgtgctccgggcccatctgcaccgccggcttctgcctttcctcgcggccgccgcggactccggcgagcccgttgacctgcaggacgcgctcaagcgcttcaccttcgacagcatctgcagagtcgcgttcggggtcgagagctcgacgctgctcgaggccgcgggggatggacgccggcacgaggcgttcttcagggcgttcgacgacgccgtcgagatctccttcacgcgcatgttccacccgacgaccgtcgtgtggaaggcgatgaggctcgctggcgtcgggagcgagcggcagctccgcaaggccatcggcatcatcgacgagtacgtcatggcgatagtggaatcggaggagcggcggctgcacggggaggaccaggacgagcagcacctgctgtcacggttcacggcggctatggaggaagaggacgacaacgagctcggtgccatgttcgagtcgccggaggcgaaacgccggttccttcgcgatatcgtggtcagcttcgtgctcgccgggaaggacagcacgtcctccgctctgacatggttcttctggctcctcgccgccaatccgcgctgcgagcggcgcgtgtacgaggaggcgtcgcgccacggagacgatcgcggcgccgacgacgacggcggcgacggctacgacgaattgaaggggatgcactacctgcacgccgcgatcaccgaggcgatgcggctgtacccgccggtgcccatcaactcgcgggtggcggccgcgggcgacgtgctgccggacggcacgacggtgcgcgccggctggttcgcggactacagcgcgtacgctatggggaggatgccgcggctgtggggcgacgactgccgcgagttccgccccgagcggtggctggacgggcgcggcgagttcgtggcggtggacgcggcgaggtacccagtcttccacgcgggcccgcgggcgtgcctcgggaaggagatggcgtacgtgcagatgaaggccgtggcggccgccgtggtcaggaggttcgcggtggagccggtgcgggcggcgtggatggaggcgcctccgccgtacgagatgacggtgacgctgagggtgaagggcggactccctgtgcggatcaggaggcgggacggcgacgcgggccggcagaagctagctgcccagctcaccgtgacacaagagtagactggcggcaactttgattggtccatcgatcagggagggaacacagaaaatatgatgaacctcaaccagaaattcctgtgaaatacacacaccttttc

SEQ ID NO: 21576 - protein, 548 aa, Panicum virgatum
  misc_feature: Ceres CLONE 1816878
  misc_feature (40)..(526): Pfam Name: p450 Pfam Description: Cytochrome P450
  misc_feature: SWISSPROT Homolog: EC 1.14.14.1 Unspecific monooxygenase
MDAVVVPLLLLLLLLAVAVLLRLRLRRRRASAASAGRRNHCPYPNPVLGNLVPLIRNFHRFLDWATDLLAAAPASTIEVRGALGLANGVATADPGVVDHFLRANFPNYVKGARYAVPFADLLGRGLFLADGRLWSLQRKLASYSFTSRSLRHFSGRVLRAHLHRRLLPFLAAAADSGEPVDLQDALKRFTFDSICRVAFGVESSTLLEAAGDGRRHEAFFRAFDDAVEISFTRMFHPTTVVWKAMRLAGVGSERQLRKAIGIIDEYVMAIVESEERRLHGEDQDEQHLLSRFTAAMEEEDDNELGAMFESPEAKRRFLRDIVVSFVLAGKDSTSSALTWFFWLLAANPRCERRVYEEASRHGDDRGADDDGGDGYDELKGMHYLHAAITEAMRLYPPVPINSRVAAAGDVLPDGTTVRAGWFADYSAYAMGRMPRLWGDDCREFRPERWLDGRGEFVAVDAARYPVFHAGPRACLGKEMAYVQMKAVAAAVVRRFAVEPVRAAWMEAPPPYEMTVTLRVKGGLPVRIRRRDGDAGRQKLAAQLTVTQE

SEQ ID NO: 21577 - DNA, 2022 bp, Panicum virgatum
  misc_feature: Ceres CLONE 1816891
  misc_feature: Encodes the peptide sequence at SEQ ID NO. 21578
agccaccaccacttgttccttccttcgcctcctcttcctcctcccgtcgtctcctcttcctccccctttcctcccccccgcgttcccctccgtccctccggatccgcatggcgcctccacaatccgtgccgcgcggtctcccatagccgcggctccgccccggcccagctcccgccgcgccgctcgctcccgtcccaggctcatcatttggttcgtctagactgtcattacttggcatcttgcttgtactattgttggaggaagttttgatgtttcagcgcaattgcatttactgtgattgacctttagtagatgtcgttccgcagcattgtgcgtgatgttagggatggttttgggagcttgtctcgaagagggttcgaggtgaagcttctgggccaccgcagagggaaatctcatggtgctgtccacgagttgcatgatccagccccggtgatccagagcagttgctgggctaatttgccccctgaattgcttcgagatgtgatcgagaggttggaaaccagtgaagcaacatggcctaataggaagaatgtggtttcttgcgcggctgtttgtcgaacctggagagagatgtgcaaagagattgttaagaatccagaattttctggaaaaatcactttccctgtgtccctgaagcagcctgggcctcgagatgcaactatccagtgcttcatcaaaagggataaatctacccaaacatactacctgtatctgtgtcttagcacagctgtgcttgttgaaagtggcaagttcctcctatgcgcaaaacgaacctcccgtccaacctgtacagaatatacaatatttatgaattctgaaaatatatctaggtcaagcaaaatgtacattggaaaactgaggtcaaatctcctcggcacaaagtttgcaatatatgatatccagcctccatgcaatgtagcacagacagggaaaacaagccgtaggttctactccaggaaggtatcaccaaaagtctcttgcagcacctacaacatagcacaggtttcatatgagctgaatgtcttgggaactcggggtcctaggcggatgaactgtgttatgcactccattcccgcctcatcccttgaggctggaggcactgttccatgccagccagacagtatcctcacccgctcccttgacgagtcatttggtagcatttccttctcgaagtcatctgttgtggatcattccatgcgtttcgggagcacaagattctctgaagtctcgatgagcagccaaaggattggagacatggcattgggtgacaatgatgaatgcaaggagaggccattggttctccgtaacaaggccccaagatggcacgagcaattgcagtgctggtgcctcaattttaggggcagagtgactgtcgcatccgtcaagaacttccagcttgtagctgcaacacagcctgctgctggagccccaaccccgtcgcaggctgtcccagcaccgccaccagagcatgaaaaggtgatcctgcaattcgggaaggtggccaaggatatgttcacaatggactaccgttatccgctctcagccttccaggccttcgcaatctgcctgagcagtttcgacacgaaactggcctgcgaataaagctatcgtggccgaaggatctgtttcgtgatgacggcggccccgaattttgctgggccaccatattctcttgtatgttgttgatgccttcttaacttccctagaaagctgtgtttagccatttccacctgatctacagctgctgctgtgctatgtcctgattgctttgttccgtggagtagcatcatggcctgcctgcccttaactagttgacatatttaaattgttttttgttcatactatggttgtattaactatgaagggagtatgacattttcgttgtgcctaagctctgaatttcttattgcctgcctgtggtggtgtctgcaactgtgcattttgtaaaattctggattatcttatcataagtcatagcaataaaaagaattagcttttgtt

SEQ ID NO: 21578 - protein, 436 aa, Panicum virgatum
  misc_feature: Ceres CLONE 1816891
  misc_feature (117)..(430): Pfam Name: Tub Pfam Description: Tub family
  misc_feature (51)..(106): Pfam Name: F-box Pfam Description: F-box domain
  misc_feature: The sequence is a functional homolog of SEQ ID NO 130 in the 10/225,068 US patent application
  misc_feature: The sequence is a functional homolog of SEQ ID NO 2896 in the 10/374,780 US patent application
  misc_feature: The sequence is a functional homolog of SEQ ID NO 458 in the 10/666,642 US patent application
MSFRSIVRDVRDGFGSLSRRGFEVKLLGHRRGKSHGAVHELHDPAPVIQSSCWANLPPELLRDVIERLETSEATWPNRKNVVSCAAVCRTWREMCKEIVKNPEFSGKITFPVSLKQPGPRDATIQCFIKRDKSTQTYYLYLCLSTAVLVESGKFLLCAKRTSRPTCTEYTIFMNSENISRSSKMYIGKLRSNLLGTKFAIYDIQPPCNVAQTGKTSRRFYSRKVSPKVSCSTYNIAQVSYELNVLGTRGPRRMNCVMHSIPASSLEAGGTVPCQPDSILTRSLDESFGSISFSKSSVVDHSMRFGSTRFSEVSMSSQRIGDMALGDNDECKERPLVLRNKAPRWHEQLQCWCLNFRGRVTVASVKNFQLVAATQPAAGAPTPSQAVPAPPPEHEKVILQFGKVAKDMFTMDYRYPLSAFQAFAICLSSFDTKLACE

SEQ ID NO: 21579 - DNA, 682 bp, Panicum virgatum
  misc_feature: Ceres CLONE 1816914
  misc_feature: Encodes the peptide sequence at SEQ ID NO. 21580
aaaacgcagcaacgcctcgtgcagtttcttcgtgacacggcaagtaaaagccacaccaaaactaccacacgagaaggggttttttttttttttggtagcagcgagctgttgcaaatggcgtcgacggtggcgagcctgtccaccccggcgaccttcgcggccgcggacgtggtcccgaggaggaaggtcgtcgccgccggccgcgtctggttccccgtggcgcgccgcggcggcggcttcgcggtgaggtcgagcgggccggcgacgccgccggggatctccgacaaggtgtcggaaagcatcaagaaggcggaggagacgtgcttggaggagacggcctccggggagtgcgcggcggcttgggacgaggtggaggagctcagcgccgcggcgagccacgcccgggacaagctcaaggagaacagcgacccgctcgagaactactgcaaggagaaccccgaggccgacgagtgccgcacctacgacaactagaccatgcctgtatgctaaatttgccgcacacgaccggaggatttgcacgaagctttatgtttctctgcctgtaatatatatccactatactcgtgtgtgtgatatagattgaatataagaacgagttatctttcgaaaataaatatataataacgaggtggaaaaaaaaagctcgtgcaaaagcatcatc

SEQ ID NO: 21580 - protein, 125 aa, Panicum virgatum
  misc_feature: Ceres CLONE 1816914
  misc_feature (55)..(125): Pfam Name: CP12 Pfam Description: CP12 domain
MASTVASLSTPATFAAADVVPRRKVVAAGRVWFPVARRGGGFAVRSSGPATPPGISDKVSESIKKAEETCLEETASGECAAAWDEVEELSAAASHARDKLKENSDPLENYCKENPEADECRTYDN

SEQ ID NO: 21581 - DNA, 1840 bp, Panicum virgatum
  misc_feature: Ceres CLONE 1816930
  misc_feature: Encodes the peptide sequence at SEQ ID NO. 21582
agttcggaagccccacgaccttgatcaccccactcgccttctttttgcacaaaccccctcccctccagcaccgcttccccgacccgccctcgtttctctcgatctctccagctctctccctctctctcaacttgactcacaaaccgccagccgccggccgccacagccgccccgcgagacggcctgactgcctcggccgctcccggtgccccgccgcttcgaggagccgggggccagaatttggcacgccgtatctctctgactctccccgatttcgagccgttccgcgctacgggaaggcgccgatcccgcgccgcggaggcgaggcgcgatgtgcggatcagagcatggaagtgaccgcgctcgcgcccagtaggagctgctgctgcgaggcaggccggcgtgggagcgggggctgctgcggagttgacgatgtacatagcgcgggaggcgtccaaggtatggaggaaggtgactgcggagataacggtggagctgcagctcctgcgcgacaagtgggggctcctactcgccgggctgatttttcagtacattcatggattggctgctcgaggagtacattatttgcatcgacctggaccactgctccaggacttgggatttatggcccttccagagcttgggcaagacaaaggttatcttagtgagagcatattttcttccatcttcctctccttcgtgttgtggacattccatccttttatttatcacagcaaacgtttctataccgtgttaatctggcgcagggtgctcgcttttttagttgcttcacagtttttaaggattattacattctattcgacccagctcccaggtccaaattatcactgtcgtgagggctcagcattggcaactcttccaccaccaaacagtgtacttgaagttctcctgattaactttcctcgtggagtgctttttggttgcggtgatttgatattttcatctcacatgattttcactcttgttttcgtccgaacataccataaatatggctcgaaaagattcattaagttccttgcttggttcatggctatagttcagagtcttcttataattgcatctcgcaagcactactccgttgatgttgttgttgcatggtatactgtaaatttagtggtgttctttgtcgacaagaagctgccagaaatgccggatcggactactggtgtaccattgcttccgttgagcaacaaggaaaaagagatcaggttgaaggaagagagagacagtaaactgaaggacgagttccacaagttactgaacgggaaccatggggaccctactgatcggcgacagcgggcgcagatgaacgggaggcagcacgacgaagacaccaatcacgcgctcaccgaggcagccactgccaacggcacataaggggccggcggcatctgcttttcaccgggagctttgtccttggcgcccggaggagaatcctccgggggccgagagaaaactgcccgggaggggccccgcccgttccgcctgtagctctgaagccgtccaagattccagccgcagcgttccatatgcatctccccgaactgccccgtcgcgttgtgcaagaatccgagacccctggcgtttcacggctcagttttgcaacacccttcattgcagtgacatttctcaggacggcacagggaaaaatagaaagaaattgatctggatgtacatattgatccgattacacatgcgggctatagcgtcggtcttgccactcttgcgctagctgatgcgcgcaattggggagaaaaggctgatgtgcgcgatgatgccttagccgatggctggagtactcgagatgtggcttcgcgcc

SEQ ID NO: 21582 - protein, 321 aa, Panicum virgatum
  misc_feature: Ceres CLONE 1816930
  misc_feature: SWISSPROT Homolog: EC 2.7.8.27 Sphingomyelin synthase
MYIAREASKVWRKVTAEITVELQLLRDKWGLLLAGLIFQYIHGLAARGVHYLHRPGPLLQDLGFMALPELGQDKGYLSESIFSSIFLSFVLWTFHPFIYHSKRFYTVLIWRRVLAFLVASQFLRIITFYSTQLPGPNYHCREGSALATLPPPNSVLEVLLINFPRGVLFGCGDLIFSSHMIFTLVFVRTYHKYGSKRFIKFLAWFMAIVQSLLIIASRKHYSVDVVVAWYTVNLVVFFVDKKLPEMPDRTTGVPLLPLSNKEKEIRLKEERDSKLKDEFHKLLNGNHGDPTDRRQRAQMNGRQHDEDTNHALTEAATANGT

SEQ ID NO: 21583 - DNA, 1740 bp, Panicum virgatum
  misc_feature: Ceres CLONE 1816967
  misc_feature: Encodes the peptide sequence at SEQ ID NO. 21584
aaaaaaaaaaaccccttcttcctccgattcgatctcccctcgtgcctgaagggaatcgcagatacagggcggatttggtatccgcgaaacgcaagggcaaaggccgttcggttcagcaaggagtctgcctagtgggagcgtggtgcccggcgagatgaggcacctgaccggtggccggagcggcggggcgggccaatccgtaccgcggttcaggtgccaggagtgccacggcgcgcttgccgtcgtcggggacgccgacaggctcccggcctccggtttgcatgcatctgctgttcagggttgtaatatggctgcaagcaggatggacaattcttatgtagtattatcgaagaagaacagatctaaaggtcttggaattcccccatgcccacgaagtgctgcatccccactaacaagaccaatagaggactcatatattatgcttccacctcctactgcttccatatacaagacttcttcctctgaaggagatggtgcgcagctgctgccaccaagttgctcctcgccaggaaataattctggttttttctctagtgttactgtattaaaaagagcattcgagattgcgacctcacaaactcaggttgagcagccactttgtgttgaatgtatgagaattctttctgataagatggattttgagattgaagatattaattctgatatcaaagcttatgaggcttgtcttcaacaactggagcaagaatcctacagcatcctcagtgaaacagattttcaggaggagaaccgaaagattgaggaagaagaacagaaacttaaagctgatattgaagaagctgaaaagcaatattcagaagttagttctgagatgaaagatcttgaaacaaaatataaacaatttgaggaattggaagagcggtattggcaagaattcaacagctttcagcttcagctgacatctaatcagggagaaagagatgccatttcagcaaaaatagaagattctcaagcccatctggaaatgttagagcatacagatattctgaatgatgtattctatatttcacactatggaatattcggaacaataaatagccttcgacttggacacactcatgtggttgagtgggatgagataaatgctgcttggggtcaggctgcacttctgttgcataccatggctcagtattacaccccgaaatttcaatacaggatcaagattcatgctgtgggaagctatccaagaatcacagacatcaataacaaaacacataaactgtttggtccggcaaatgtgttattcagcacccaatatgataatgccatgacattgtttctgacgtgcctgcaagagtttgctgagtttgctgtaagtttggataaggagaagaatgttccacctgacaagtcattcaagctcccctataagattgatggtgataaagtagggggctacagagttgtcctaagtgatttcaatacgagggagaactcgacgaaggcgctgaagaacatgctgtgcaatttgaaatgggttctcttctggtttatacgcaccacgagttagtgccctcctgatcattgcgcacgtagagctgaagctttgtttagcttgaacagttagattagatggtttcagtacaggctgaattactgagccctaggagctgattgtagccccacatagcgacaaaaagacgcatttgtacataactatagcatttttttaataaaaaaaatctgtcacttgttgcttgc

SEQ ID NO: 21584 - protein, 464 aa, Panicum virgatum
  misc_feature: Ceres CLONE 1816967
  misc_feature (134)..(462): Pfam Name: APG6 Pfam Description: Autophagy protein Apg6
MRHLTGGRSGGAGQSVPRFRCQECHGALAVVGDADRLPASGLHASAVQGCNMAASRMDNSYVVLSKKNRSKGLGIPPCPRSAASPLTRPIEDSYIMLPPPTASIYKTSSSEGDGAQLLPPSCSSPGNNSGFFSSVTVLKRAFEIATSQTQVEQPLCVECMRILSDKMDFEIEDINSDIKAYEACLQQLEQESYSILSETDFQEENRKIEEEEQKLKADIEEAEKQYSEVSSEMKDLETKYKQFEELEERYWQEFNSFQLQLTSNQGERDAISAKIEDSQAHLEMLEHTDILNDVFYISHYGIFGTINSLRLGHTHVVEWDEINAAWGQAALLLHTMAQYYTPKFQYRIKIHAVGSYPRITDINNKTHKLFGPANVLFSTQYDNAMTLFLTCLQEFAEFAVSLDKEKNVPPDKSFKLPYKIDGDKVGGYRVVLSDFNTRENSTKALKNMLCNLKWVLFWFIRTTS

SEQ ID NO: 21585 - DNA, 1662 bp, Panicum virgatum
  misc_feature: Ceres CLONE 1816968
  misc_feature: Encodes the peptide sequence at SEQ ID NO. 21586
atagtcggatccccaaaggccgctcgccgtcgctccatttcccccaaacctgtgcccccgcgtccgcgccgagcacgcgcctccgtccagaactccagatccagccatcctcgcttgctcccgctgcagccgcaccactctccattccttcccgcatcggcggcgggcgggcaggcgggcgtccttcgccttcctcttcccccgagcggggattggcgtggaggcggtttcttcgtcttccgtgttatgcccttctccagtggcacagctgttcaactgaagagcagattcttgtagtgcaatggctgtggaaagagatgcctttggcatctctgggccgacatacctgaaatctgttgattgggacgcacagcatgtcaattgaaatatactaggaaccaatttatttggacaaccttaagggttatgtttgcaaagcgcaaagattctaatctgtgtcatggactgtgctcggctgtatttctgcatcctcagaactgcaagcataatcggagatctgtggctgcaagcttagttcaggctgtatatgtgttggagagagaccgacaattaaatcgccaatctgttgaagccctggctcctccttggtgggaattcttccattttgagctgattcgcaagctcgttgatgatgccgatatgtccatatttggtgcaatatttgaattcaatcctccttcaagtgaagaagcttctgctgtgaatgctccaagatttgtcattgctttcagaggcaccataacagaaagggataccatctctagggatctttcccttgacatccaccttgtacaaaatggtctccacaggacctcaagatttaccattgcaatgcaagctgttcaaaatgttgcctcagtttttcctggatccaaaatttggttagcagggcactcattgggtgctggtatggctatccttactggaagaaacatggttaagaagggtgtgcttttggaaagctttctcttcaatccgccctttgtcgctgctccaattgaaaggatcagagatgaaaaggtaaagcacggtttccgcattgctagaaatgtaattaccgctggattaactattgcaatgaatggtaaaactgaggggaacagtcagagatctgttgctgatgaatctttcagcattctgtcatcgtggacgccgtatctatacgttaacccaggagaccacatctgttcagagtacatcgggtacttccaacaccggaagaacatggaggatctcggtgctggttttattgagaagcttgcgacccagaattccatcggagatctgttcttcaaggcattagggtgggaatcagaaccactgcaccttctcccatctgctgacttgatcgtcaatgtgagcccttcacctgatttcaaatatgctcacagcatcagccaatggtggcagccagagctgaacttgcagtgcagtaaatatcggtacgaatagctatacactgctcgaaaaggaagatgttcttagaaactatagtcttctattctttcagtttattcatgtggtccattccatttatatgacacactatttcagacacaatactgcaaccttgacctgcaaaatctattgattatgtacagtaatcagattaactgcatttctgtacaatgatgtgcttag

SEQ ID NO: 21586 - protein, 348 aa, Panicum virgatum
  misc_feature: Ceres CLONE 1816968
  misc_feature (105)..(225): Pfam Name: Lipase_3 Pfam Description: Lipase (class 3)
MFAKRKDSNLCHGLCSAVFLHPQNCKHNRRSVAASLVQAVYVLERDRQLNRQSVEALAPPWWEFFHFELIRKLVDDADMSIFGAIFEFNPPSSEEASAVNAPRFVIAFRGTITERDTISRDLSLDIHLVQNGLHRTSRFTIAMQAVQNVASVFPGSKIWLAGHSLGAGMAILTGRNMVKKGVLLESFLFNPPFVAAPIERIRDEKVKHGFRIARNVITAGLTIAMNGKTEGNSQRSVADESFSILSSWTPYLYVNPGDHICSEYIGYFQHRKNMEDLGAGFIEKLATQNSIGDLFFKALGWESEPLHLLPSADLIVNVSPSPDFKYAHSISQWWQPELNLQCSKYRYE

SEQ ID NO: 21587 - DNA, 1350 bp, Panicum virgatum
  misc_feature: Ceres CLONE 1816981
  misc_feature: Encodes the peptide sequence at SEQ ID NO. 21588
agcgcacgcaccaccgcaactcccaacgaccccgccaccgccgccgctctcttcgccggagaagagagacacgaggaggggaaggaacagcagcctcctccaggagcctagcctccgcgacccgatccccgacgagcccccccccctcccctccgggcgtggccgagtggtaggcatcacggctagcgttgcagcccccccggcgcggccccgcagctgcgcaggtggagcccacgggcaccatcgcctccgccgtcgccaccagccccgccccgcacggcggccgcggggcgctgccctcggccggagggagcccgtccgacctcctcttcctcgccggcggcggttgcctctgagccgctcccccacccctctcccctccctccctctctctgacccctccccctcctcctcctgacaaccgtcgtctgctgagccccccgaccccgacaaacacacacccgagagattgattgacaccgcccgagagcgagccgccggccgccatggagatgaagctcaccatcaggagggtgcccaccgtcgtctccaactaccaggaggacgccgacaagccccgagccggatgcgggaggaactgcctcggccactgctgcctgcctgtttccaagcttcccctctatgctttcaaggcaaatccggcaaaacctgcacaggaggatgctgcttcaactaagtcccttgtcaatatccttctagctgagtgggaggacaggatggcccggggcttattccgctatgatgtcactgcctgcaagaccaaagtcatccctggcaaccttgggtttgttgcacaactgaatgaagggcgccaccttaagaagcgccctactgagttccgtgtcgaccgtgtgcttcagccatttgaccctgccaagttcaacttcaccaaagttggccaggaagaggtgctcttccaatttgagaatggtgctggggatgacagctacttcctgaataatgctccaatcactgctgctgatcgtgcaccaaatgttgttgctatcaatgtgagcccaattgaatatggacacgtgcttctcattccccatgttctggaccgcctgcctcagaagattgatccagagagcttcttgcttgcgctgcagatggcagcagaggcagccagtccatacttcaggcttggttacaatagtttaggtgccttcgctaccatcaatcacctccactttcaggcatactacttgtcagtgcctttccctgtcgagaaggcagctacccacaagatccctctttctgaagacacaaggaagagtggggtgactgtgtccaagctgataaattatcctgtgagaggcctggtatttg

SEQ ID NO: 21588 - protein, 281 aa, Panicum virgatum
  misc_feature: Ceres CLONE 1816981
  misc_feature: Useful for making plants with modulated nitrogen use efficiency
MEMKLTIRRVPTVVSNYQEDADKPRAGCGRNCLGHCCLPVSKLPLYAFKANPAKPAQEDAASTKSLVNILLAEWEDRMARGLFRYDVTACKTKVIPGNLGFVAQLNEGRHLKKRPTEFRVDRVLQPFDPAKFNFTKVGQEEVLFQFENGAGDDSYFLNNAPITAADRAPNVVAINVSPIEYGHVLLIPHVLDRLPQKIDPESFLLALQMAAEAASPYFRLGYNSLGAFATINHLHFQAYYLSVPFPVEKAATHKIPLSEDTRKSGVTVSKLINYPVRGLVF

SEQ ID NO: 21589 - DNA, 727 bp, Panicum virgatum
  misc_feature: Ceres CLONE 1816981-R
  misc_feature: Encodes the peptide sequence at SEQ ID NO. 21590
aggcaggaaaaacagaaaattccctgacaaattttgtgtgcagtacttgcatttgattgcaggacaacaatgttcctaccaaagttcttatttctgtctgaggcaagaggatgttttacttcccacaggactacgggcagaagcaggctgtaggcgaagtgagccaagagctattggtcacccagggagatctaaatgtgtgggagatcagaggtcacaatgtgctgaaggggaggaatgattatgaggaggcatatgaaacctcggagtggaagctccttggcgaggtctccttgtgagaagtatggtttgaggaagtgaaggcttacatcttcatacgcagggagtatggttcagcccgaggaggaggaagtcagcaagggtgaggaagcaacttacaggcctgtccgtgtcccccctttacctatttcagaaggttgcctggtcctccagtttgccgggtcagctgggggttgaagtattaaccgttgtcattgtcgtttatggtcaccgaaaattctgccataataaggtccttgtgtttggaaatgttgcctggtgtggtgtgtgggattgacccttgtgctaagtcacaccaagctttttttttcgaattctatttttggcgtctgagtgattatgtgctgtgcaatattaagaggaggttatgtgtattgtttgggtggtttagatcttaagtgaaatgtaatggccatgggtagtatgt

SEQ ID NO: 21590 - protein, 62 aa, Panicum virgatum
  misc_feature: Ceres CLONE 1816981-R
  misc_feature: Useful for making plants with modulated nitrogen use efficiency
MFYFPQDYGQKQAVGEVSQELLVTQGDLNVWEIRGHNVLKGRNDYEEAYETSEWKLLGEVSL

SEQ ID NO: 21591 - DNA, 2069 bp, Panicum virgatum
  misc_feature: Ceres CLONE 1816983
  misc_feature: Encodes the peptide sequence at SEQ ID NO. 21592
aagtttggcactaaagcaaacgacagccaattgtgcaggccatggacaaattttggcttggccagccacagggtcaccaacgaaacggacccattcctgtgcctagcagggccaaccaaaatacgagacctggatagggtgctcaactgctcagtaccggtagcaggcagctcggccccagttctcttctatccctgttcctcgctgctgctatccctcgtcctccccatccggccttcgtgtgccattactgcaagacaggagctgcgtctgtatgggtcttcagatgatgcaaggcaggcctggcgcctcgtgctgtccatcgtcctcgtcgtcttcctcctcgtggatgatggcggcccatcccccgaaacagtctccccatccattagggggaaggtccatttcttctgaatcccttgcagcactggccttgcatctcgtgctaaagcgccgcaaataccatggccgggacattgcgaccggttttgcatcttcatccagtgtgcttcagatcacagagaacaagtcaagcagtttgacgaaacccaaggcagaaaggaaggtccttgatgacgctcttgacagaaatttacagtatgactggatggatgaagagacattattctggctggatagcaattacacagatagcaatctacagtttggcttgttaatgaaaaaccttcaggcattggagactagtttggccggcaaagacttgaaaatgctggaaaaggatatccttgtacatattgaacagcttggagctctgggatcgtttaacgcgtctatgtccatggccaccctagacaccctaacacagacctcacatgaaccagatttgtctctgcttgacaaagtcatcaggtttgacccagagactcctctgaaggagcaagatgctgaagtaatcgttcggagtggcaagagtcaagagaggaaacagaaaagaatgagagcatcagaaaaggcctccaagatctctgtgaagataaatccaagaagatcgaagaaatcgcgcaagtctagtagtagtcagtttatatccgagtggaaaaattatccgggcaggagaaggaccattgtacgtgaacaatcatcattgttagttaccatcaaggaatgtgcgaaccttgaaaagatcagagatgatatggtaaaggagggggaggaggtgagctatcagaggtgggcagaggcagctggagttgatgaggcagagctgaagagcaggctgcatgcggggtactgctgccgagagaggctgatagtgaccaccgagtggctcgtccggtacattgcaagaacatacaccggaatggggacggctttcgacgatctacttcaggctgggaagatgggcgtccttgatggcgccgagaagttcgacagccggaaggggtgcaaattctccacatacgtcaagtactggatcaggaaagggatgctagctctgcttgccgaaaattcaggagtcaccctgctgccggcaagaatggagtgcatcatccgcaaggtgaaggaggcgcggcgcgcgatccggtacagccaagggaggaacccgtcggattcagagatcgccgccgtggtcggcgtgtccgtggccaacgtcaggctggcgcgcaagtgctctcgcaaggtcctgtcgctctactccgagatcgggatcggtcagaatgcaaagttcacggaagtgatcccggacccgtctctggaggccgccgacgaggccatcttccgggcgcagctgagggagaggctgctggtggtgctggagaggctgccggcgcgggaagggcgcgtgctgaagctgcggcacgggctggaggacggcaggtgcatgtcgctggagcagatcggccgcatctaccgcgtgtccaaggagtggatcaggaagatcgagaagtcggcgatggccaagctcaggaaccaggacgtgcgcagcgagctagacgacttctgcatcttctagcagatgcttccgtgagctatatatatgctagctgtgcacggtagcatggtacagtctaattttcaggcaattcacgctaccagattgaagctgt

SEQ ID NO: 21592 - protein, 540 aa, Panicum virgatum
  misc_feature: Ceres CLONE 1816983
  misc_feature (474)..(527): Pfam Name: Sigma70_r4 Pfam Description: Sigma-70, region 4
  misc_feature (380)..(462): Pfam Name: Sigma70_r3 Pfam Description: Sigma-70 region 3
  misc_feature (306)..(376): Pfam Name: Sigma70_r2 Pfam Description: Sigma-70 region 2
MAAHPPKQSPHPLGGRSISSESLAALALHLVLKRRKYHGRDIATGFASSSSVLQITENKSSSLTKPKAERKVLDDALDRNLQYDWMDEETLFWLDSNYTDSNLQFGLLMKNLQALETSLAGKDLKMLEKDILVHIEQLGALGSFNASMSMATLDTLTQTSHEPDLSLLDKVIRFDPETPLKEQDAEVIVRSGKSQERKQKRMRASEKASKISVKINPRRSKKSRKSSSSQFISEWKNYPGRRRTIVREQSSLLVTIKECANLEKIRDDMVKEGEEVSYQRWAEAAGVDEAELKSRLHAGYCCRERLIVTTEWLVRYIARTYTGMGTAFDDLLQAGKMGVLDGAEKFDSRKGCKFSTYVKYWIRKGMLALLAENSGVTLLPARMECIIRKVKEARRAIRYSQGRNPSDSEIAAVVGVSVANVRLARKCSRKVLSLYSEIGIGQNAKFTEVIPDPSLEAADEAIFRAQLRERLLVVLERLPAREGRVLKLRHGLEDGRCMSLEQIGRIYRVSKEWIRKIEKSAMAKLRNQDVRSELDDFCIF

SEQ ID NO: 21593 - DNA, 740 bp, Panicum virgatum
  misc_feature: Ceres CLONE 1817006
  misc_feature: Encodes the peptide sequence at SEQ ID NO. 21594
ctctctctctcctcttttaaaccctccgctcgaagacaccacccggaaatacgtcggaacaaaacggctgcaaatcttctccggcagcggtacgaatccgggaatccgccgctcgaatggacccaggatacaaccccaggacggtggaggaggtgttccgggacttcaagggccgccgcgccgggataatccgcgcgctcaccaccgatgtggaggatttcttccagcaatgcgacccggaaaaggaaaacctgtgcctgtatgggtttcccaatgagaattgggaagtaaatttgcctgcagaagaggtgccacctgagctcccagagccagcattgggcatcaactttgcacgagatggaatgcaagaaaaagattggttatccatggttgctgtgcacagtgatgcttggttgctttctgttgcattttactttggtgctcgattcggtttcgatagaaatgacaggaagcgcctgtttggtatgattaatgaacttcccacaacttttgaagttgttagtgggaagagtaatatcaaggcaccaccgagcaataataaccatagcaatagcaaatccaagtccaacaacaaaacgaaatcatcggagcctaaggtgaagcagccaaagccggcggcggcaccccaggtgaaggcagaagaccctgcccctgcagaggaaggcccagctgctgaggatgaaggtggcggcggtggtgtcagtgagggtgagcatggg

SEQ ID NO: 21594 - protein, 207 aa, Panicum virgatum
  misc_feature: Ceres CLONE 1817006
  misc_feature: The sequence is a functional homolog of SEQ ID NO 1052 in the 10/225,066 US patent application
  misc_feature: The sequence is a functional homolog of SEQ ID NO 2552 in the 10/374,780 US patent application
  misc_feature: The sequence is a functional homolog of SEQ ID NO 1645 in the 11/479,226 US patent application
  misc_feature: The sequence is a functional homolog of SEQ ID NO 782 in the 10/412,699 US patent application
  misc_feature: The sequence is a functional homolog of SEQ ID NO 816 in the 10/412,699 US patent application
  misc_feature: The sequence is a functional homolog of SEQ ID NO 1981 in the 11/479,226 US patent application
  misc_feature: Useful for making plants with altered alkaloid content
  misc_feature: Useful for making plants with altered lignin content
  misc_feature: Useful for making plants with modulated flowering time
MDPGYNPRTVEEVFRDFKGRRAGIIRALTTDVEDFFQQCDPEKENLCLYGFPNENWEVNLPAEEVPPELPEPALGINFARDGMQEKDWLSMVAVHSDAWLLSVAFYFGARFGFDRNDRKRLFGMINELPTTFEVVSGKSNIKAPPSNNNHSNSKSKSNNKTKSSEPKVKQPKPAAAPQVKAEDPAPAEEGPAAEDEGGGGGVSEGEH

SEQ ID NO: 21595 - DNA, 1538 bp, Panicum virgatum
  misc_feature: Ceres CLONE 1817007
  misc_feature: Encodes the peptide sequence at SEQ ID NO. 21596
atccctgtgtggtgggcggcggccgctctgggctccccggcgcaccgcgccacgccggcgacccgcagaacgcggtgtcagtgcatagcactagccagttcgcccgcacatctcagacgctacgctggcttagctgcggttctccctccgcacgatggcgccggcggtagatcggcggcgcgcgttcttgaggatggttgagcactacggcgcgcgccgctgcaacagtgttcacctttcgacgcgccggaggatttccaagttggggtggggagtgattagtcatcgcttctctaatttgcatcaacgcccaactccgctccctcctgaaccagctggtttctacaatgacattggtgcatccgtagatatcccacttgataaaaaggacctaaagaaaaaggagagagaacttatggctaaagaggccgagctaaacaggagagaacaggaaataaaaagaagggaagaagctcttgcaagagctggggtcttaatagagccaaaaaactggccaccattcttccccatcattcatgttgacatttcaaatgatatacctgtgcatttgcagcgagtacagtatgtttcttttgcatcacttctagggttggtcatatgcctcttctggaacattttatgtgtatctggtgcttggattacagggcatgatcctaggatctggtttctggcagtcatatacttcattactggatgccctggtgcctactttttatggtaccgccctctttatcgtgcaatgaggaaggatagtgcattcagctatggatggttcttcctattctacttttttcacattgccttctgcatatacgctgctgtttctccgccattcttttatatgggaagatcattggccggaattttccaagcgatcagtgaaatgggcgagaatgctggtgttgggataatgtactttatgggcttcgcgatgtttgtgctggaggtgctgctgagcatatgggttttccagagggtgtactggtttttccgcggaaaaggcacggaggcgcagatgcggcctgatgccgcgtctcgtgggccgcagttctgacgccctcgctccaagctctgaacccggagggggggggatatgaaacctgtgtgaattcagtttgcattggtgtggtggagtggacactgatttacagttggtgatggcagcagaagttccagggtggtgacttgtcgattgttgcagcagcgccaggcgcacagccatagtgacatttcgcttttgtgtgaggttcctttcttatctgatgatgaaactgaaatccctgaaaggcgacagagaaaaaaaagaagaagaagagacatcccagcctttgcccagatgcttgccgctagccctttcggcaaagtatgctgcagtactagtctgctccttttctatttctttttttctattctttgtgattacaaacgcacaccccttgacgtttgccgtaatcttgcgagttttgaacatttgtttgtaaatgtgtgatccgaaatgattccttcagttttcatcg

SEQ ID NO: 21596 - protein, 306 aa, Panicum virgatum
  misc_feature: Ceres CLONE 1817007
  misc_feature (116)..(290): Pfam Name: SCAMP Pfam Description: SCAMP family
  misc_feature: Useful for biocontainment applications
MAPAVDRRRAFLRMVEHYGARRCNSVHLSTRRRISKLGWGVISHRFSNLHQRPTPLPPEPAGFYNDIGASVDIPLDKKDLKKKERELMAKEAELNRREQEIKRREEALARAGVLIEPKNWPPFFPIIHVDISNDIPVHLQRVQYVSFASLLGLVICLFWNILCVSGAWITGHDPRIWFLAVIYFITGCPGAYFLWYRPLYRAMRKDSAFSYGWFFLFYFFHIAFCIYAAVSPPFFYMGRSLAGIFQAISEMGENAGVGIMYFMGFAMFVLEVLLSIWVFQRVYWFFRGKGTEAQMRPDAASRGPQF

SEQ ID NO: 21597 - DNA, 632 bp, Panicum virgatum
  misc_feature: Ceres CLONE 1817011
  misc_feature: Encodes the peptide sequence at SEQ ID NO. 21598
acccaaatccaaagcgaagccaagacacgtttcatttaatcatttggctcactcgctcactcacctgtctgtccatcgctctagctcagctcccagtgatagctgcaccaagagctgggagaggaaggttgtagacgatggggaagctctggacgatccttactcacctccactccctcgcagggtatcttcacagcttcagaccatcactctctgattgtaccttttttcagttcttgcatcgttcttttcctctcttttttttttagctttcagttcagctcggatcaagtgtctgaacttatctgatgatctttttgggttcttgcaggccaacggtcatgctcctgtaccccctgtacgcgtcggtgcaggcgatggagagcccgtcgaagcttgacgacgagcagtggctcgcctactggatcctctactccttcatcacgctcatggagatggtgctcgagtccctcatctactggatcccgatttggtacgagctgaagctgctgttcatcgcgtggctggtgctccccaacttcaggggcgcggccttcatctacgacaagttcgtcagggagcagctccggaagcacggcctcaccgtcggcggcggcaaggtcaagaaggac

SEQ ID NO: 21598 - protein, 107 aa, Panicum virgatum
  misc_feature: Ceres CLONE 1817011
  misc_feature (1)..(93): Pfam Name: TB2_DP1_HVA22 Pfam Description: TB2/DP1, HVA22 family
MIFLGSCRPTVMLLYPLYASVQAMESPSKLDDEQWLAYWILYSFITLMEMVLESLIYWIPIWYELKLLFIAWLVLPNFRGAAFIYDKFVREQLRKHGLTVGGGKVKK

SEQ ID NO: 21599 - DNA, 979 bp, Panicum virgatum
  misc_feature: Ceres CLONE 1817012
  misc_feature: Encodes the peptide sequence at SEQ ID NO. 21600
cctagtgcgcgcgggcgcggcgattactgaccggcttcccgcccttgtccgtcctctgctccggcctaaggccgcgccgccggcccttctccgttctctgctccggcctccgggcgcgccaccgcacctagctcatcgatcggtctctgcaccttgtaagttccgccatgatttcctttatttgcctttcttcccatggctagctgctaccttggtagattgattccttccgctagtaggtttcgtggtcgagggaggagagcgctggggggaagaaacacagaggtgactcgattgagagaagcaatcgtgcagtagtcctctccaccggatctccgctaggcaaacaaacagaaaaaaacgacatggcatcggaggagaacacccaaggccaggggccgccaaggcaaaggaaaggcaagaagctggccccgcggtccacggtgtatcagcacttcacacaaaacaacaaccagaagacttggtggtcgtgcaagtactgcggcgaggtggtcggcgcagacaccaataagcatggcaccaccaacctgtggaagcaccacaggaaatgcaagggacggggcggggagtcacagtcacatccaacgagctcgtggccgctgaagccgcagctgcagtcacagccgcagcctccctcaggccccggtggtgagtcatcttgtcatgagcctgcgggcctggacgaccaagaagccagcagagacctggctcggatgatcgtgcttcatggctacgatccgtcggtcgtggaggacgactacttccggagcttcgtgcgcggcctcaatcctcaattcaagctgccctcgcgcattgacattgagcacatgtgccgctgggattttcatttatgaatttcatagtaatagaaatccatgtcctaccgagacagaatttcacggtattcgagggtatgtaactagaactaatagaagagatgggataacagatattcacc

SEQ ID NO: 21600 - protein, 169 aa, Panicum virgatum
  misc_feature: Ceres CLONE 1817012
  misc_feature (25)..(70): Pfam Name: zf-BED Pfam Description: BED zinc finger
MASEENTQGQGPPRQRKGKKLAPRSTVYQHFTQNNNQKTWWSCKYCGEVVGADTNKHGTTNLWKHHRKCKGRGGESQSHPTSSWPLKPQLQSQPQPPSGPGGESSCHEPAGLDDQEASRDLARMIVLHGYDPSVVEDDYFRSFVRGLNPQFKLPSRIDIEHMCRWDFHL

SEQ ID NO: 21601 - DNA, 685 bp, Panicum virgatum
  misc_feature: Ceres CLONE 1817015
  misc_feature: Encodes the peptide sequence at SEQ ID NO. 21602
tatactgataattgaagtggcatcactctgtagaccgaccatgggcgccacgctaccaggcttgctctctgcgcttctgctcctcctcctcccggcttccctccgagtccgggaccaactccccgcgtcccaccggcatgtcctgacccttgacgccgggctgcagccgggtggaacgggtcgggtggttcgggctgttaacgaaccgcacctggaagctggacgccgagcgcgcggagtgcttcgtcgaccagatgcgcctcgtctacgatcccgtcctcggggacttccgtaacctgcccggcgtcgagacgcgcgtcccctacttcggctccgccgccgggtccggctccaagattccaacacacccggagttttgtatgggagcactgaggtctgcactaggaacgcttggctaccgtgagggagaaaccctcttcggagctccctacgacccgcggtacgctcccccgatacccggccagacgtccccattctactcccgctacttccgccagatggcaaggctcatcgaggacgcgagtgagaggaacaacggcaggcccgccatcgtcctcggccacagcttcggcggcgcggtggcgctcgagttcgtcaggaacgccccgctgcagtggcgggacagattcgtcaggcacctcatcacggtggcgccgacgtggtc

SEQ ID NO: 21602 - protein, 143 aa, Panicum virgatum
  misc_feature: Ceres CLONE 1817015
  misc_feature: SWISSPROT Homolog: EC 2.3.1.43 Phosphatidylcholine--sterol O-acyltransferase
MRLVYDPVLGDFRNLPGVETRVPYFGSAAGSGSKIPTHPEFCMGALRSALGTLGYREGETLFGAPYDPRYAPPIPGQTSPFYSRYFRQMARLIEDASERNNGRPAIVLGHSFGGAVALEFVRNAPLQWRDRFVRHLITVAPTW

SEQ ID NO: 21603 - DNA, 1309 bp, Panicum virgatum
  misc_feature: Ceres CLONE 1817016
  misc_feature: Encodes the peptide sequence at SEQ ID NO. 21604
ataggtggccgttcctttccgcggtctcttccgccgccgcctcgccctccctccgcgcacctccggccgccgccgcctccctctccttctctcccgatgcgggccctcgctcgcgccgcgtcgctgctccgccgcgccgccgtgaggacggggccggctcccgtggcgccgcgccacccgctgcccggcgcggggccgagcctcgccaagaattttccagcttcctgtttcaatgggtattctactcttttggctccagcaaacgaagtcctgattccaccagaacttctatccagcaagactgtttggacaccagaccgcgaacttgggcagtatgaagacctgatagctagggtgacaaacttccataatgaggacaagggcttcatggttttggatggtgacgtttttgatgttccaattaggaaagatatagttcatcgagtcgtaaggtggcagcttgctaaaagacagcaggggacacactcaactaaaactatcagtgaagtcagtggcacaggaagaaagccttacaaacaaaaaggaactggaagagcacggcatggaacactacgtggtcctcagtttcgtggtggtgcgaccatgcatgggcctaaaccacgaagccatgcaatcaagctgcaaaagaaagtacggcggctggggctcaagattgccctgtctgctcgcactgcagaggggaagctcttgatttttgaggacttggaagttcctagccacaagacaaaaaacattgtgcaatacatacgccagatggatgattcaaagaaggttttattggtggatggagatgatattgataagaagctaaagctggctactcaaaaccttcactacgtgaatgttcttccttcgattggcctcaacgtttacagtatcctccagcatgacacccttgtaatgactcgagcagcaatcaatagaattgtcgagcggatgcacaccccgatcaaccgctagcaagaagagattccagtcagaccattatttcttaccgacagcaactgcaatttaatccctggagctaggtgctttccagttacctcggagctgacttgaagcaccaaacacaactgttttttgtgttaaaacggtccgtttaattttgatgtgcaaggatattaggatttgcaataaagttagcgttgacagattggggatgttgttgctagattgtggatggaccgtaagcttctttcacggtctattatgctgtcctagttttgtaattccgaaaacaagtagattgcgattacatttggtttgtgaagcgcacgaggcttgcttg

SEQ ID NO: 21604 - protein, 294 aa, Panicum virgatum
  misc_feature: Ceres CLONE 1817016
  misc_feature (97)..(287): Pfam Name: Ribosomal_L4 Pfam Description: Ribosomal protein L4/L1 family
MRALARAASLLRRAAVRTGPAPVAPRHPLPGAGPSLAKNFPASCFNGYSTLLAPANEVLIPPELLSSKTVWTPDRELGQYEDLIARVTNFHNEDKGFMVLDGDVFDVPIRKDIVHRVVRWQLAKRQQGTHSTKTISEVSGTGRKPYKQKGTGRARHGTLRGPQFRGGATMHGPKPRSHAIKLQKKVRRLGLKIALSARTAEGKLLIFEDLEVPSHKTKNIVQYIRQMDDSKKVLLVDGDDIDKKLKLATQNLHYVNVLPSIGLNVYSILQHDTLVMTRAAINRIVERMHTPINR

SEQ ID NO: 21605 - DNA, 512 bp, Panicum virgatum
  misc_feature: Ceres CLONE 1817038
  misc_feature: Encodes the peptide sequence at SEQ ID NO. 21606
  misc_feature (44)..(44): n is a, c, t, g, unknown, or other
  misc_feature (47)..(47): n is a, c, t, g, unknown, or other
cccagcaatcgattcgcccaccagcacccttaaagcccccgacngcnagcgcgcgcgcgccccgagaagccgaagaaacaaaccggccaccgccccggcgcgcccgacggacggaccgcgggccgcagccccaagcgaacccagggcgccccacggagacggagccgagcccgcggcgccgcccaaccaggagggggcgagcggcgagaagcgcaacgaccacggccccgacgcggcgggccccgcgcccgccgaggcggggggccgcgacaaggcccccggcggcgcgcccgccaacggcgcccgcgccagccccaagcacggcggactttttttcttcctcggcaagttcggcgacgacgagttcgggcacatgctggtgaacatcctgaagcagaacggcgtcaacgcggagggctgcctctttgaccagcacgcgcgcaccgcgctcgccttcgtcaccctcaagaagaacggcgagcgcgagttcatgttctaccgcaaccccagcg

SEQ ID NO: 21606 - protein, 170 aa, Panicum virgatum
  misc_feature: Ceres CLONE 1817038
  misc_feature: SWISSPROT Homolog: EC 2.7.1.4 Fructokinase
  misc_feature (15)..(15): Xaa is any aa, unknown, or other
  misc_feature (16)..(16): Xaa is any aa, unknown, or other
PAIDSPTSTLKAPDXXRARAPRSRRNKPATAPARPTDGPRAAAPSEPRAPHGDGAEPAAPPNQEGASGEKRNDHGPDAAGPAPAEAGGRDKAPGGAPANGARASPKHGGLFFFLGKFGDDEFGHMLVNILKQNGVNAEGCLFDQHARTALAFVTLKKNGEREFMFYRNPS

SEQ ID NO: 21607 - DNA, 692 bp, Panicum virgatum
  misc_feature: Ceres CLONE 1817045
  misc_feature: Encodes the peptide sequence at SEQ ID NO. 21608
aagctcacggagtcgcagtgacaccgcgccttccaagaaccgcagctcgcccatcccccgcggcttgctgagcggagcggcggcggcaatgtcttccaacggcaagcccaccccgcagcccccggccgccgccggcaacggcgccggaggcccgcccaagatgtaccagcggccaatctaccgcccgcagcaggggcccgccaagcgccgccgcggcgagcgctcctgcccgttcagctgctgctgctgcttcttctggacggtcctcgtcatcctcctcctcgccttcatcgccgccgtggtcgggggcgccttctacctcctgtaccgcccgcaccgcccggccttcacgctcaccgtggcgcgcgtcaccaagctgagcgtctcctcctccgccacggcgcccgcggtcaccgacgccatcgacgtgacgctcaccgccaagaaccccaacaagaagctcgtctacttctacgacgacttcaccgtcacggccgccaccgccgccaacgccgtcccgctcggggaggcctccgtgcccgggttcgcgcacgaggccggcaacatcaccgtcatcaaggccaccgtctccgcctccgccctcgcgatcgaccccaccgccagctccgacatcaagaagtccggcgagttccccatcaccgtcgacctggagaccaaggccggcgtcaagt

SEQ ID NO: 21608 - protein, 201 aa, Panicum virgatum
  misc_feature: Ceres CLONE 1817045
  misc_feature (77)..(200): Pfam Name: Hin1 Pfam Description: Harpin-induced protein 1 (Hin1)
MSSNGKPTPQPPAAAGNGAGGPPKMYQRPIYRPQQGPAKRRRGERSCPFSCCCCFFWTVLVILLLAFIAAVVGGAFYLLYRPHRPAFTLTVARVTKLSVSSSATAPAVTDAIDVTLTAKNPNKKLVYFYDDFTVTAATAANAVPLGEASVPGFAHEAGNITVIKATVSASALAIDPTASSDIKKSGEFPITVDLETKAGVK

SEQ ID NO: 21609 - DNA, 694 bp, Panicum virgatum
  misc_feature: Ceres CLONE 1817057
  misc_feature: Encodes the peptide sequence at SEQ ID NO. 21610
atttggagcattgcaacctttcacatactgctttccttaagtaccttggaaatttataccagttgaggtacttaagactatattctacgcatatttctcagctcccggaagaaataggaaacctgcagtttctacaaacattggatgtgaggagcaatcctatttccatcttgccttcaagtgttgtcgagctaagaaatttgatgtgcctagacattgacgagactacaagagtgccaaatggaattggaaacctaacatgccttgaacagctatcatggttacgtattgatgactccaccataaacattatagaggagttgggccagctttttgaactgaggtttctgcgtattagattggacaagtggaacgacaagctgttggggtgcctacacaagttacaaaagatccaggaactagatataaaagtccatcgtgggccacacaacatcggtggattggatgcctgggtcgctcctcgacatctccgtttgttgaaagcagaaggcatctgttggatctcacctgcctagagattgcagtgagggagctacatcaggtcgatctcgacatcctcgggaggttgccagctctttgctctctatggctgaaggtggacaataagaacctgggaatccttcaggggttaattgttagtcctggttcgttcccgtgccttgaattctgtcac

SEQ ID NO: 21610 - protein, 177 aa, Panicum virgatum
  misc_feature: Ceres CLONE 1817057
  misc_feature: SWISSPROT Homolog: EC 2.7.11.1 Non-specific serine/threonine protein kinase
LEHCNLSHTAFLKYLGNLYQLRYLRLYSTHISQLPEEIGNLQFLQTLDVRSNPISILPSSVVELRNLMCLDIDETTRVPNGIGNLTCLEQLSWLRIDDSTINIIEELGQLFELRFLRIRLDKWNDKLLGCLHKLQKIQELDIKVHRGPHNIGGLDAWVAPRHLRLLKAEGICWISPA

SEQ ID NO: 21611 - DNA, 653 bp, Panicum virgatum
  misc_feature: Ceres CLONE 1817065
  misc_feature: Encodes the peptide sequence at SEQ ID NO. 21612
acgccgctcgcgtcgtctctcgccctcgcgccgccgccgccgccgcagctgctgcagcagcaagaccgtcatctcctatccccctctcgtcgtcgtcccagcaaacagtcgccatgggcaaggttaagatcggaatcaacggattcggaaggatcggcaggctcgtggcccgggtcgccctccagagagagcatgccgactatgttgtggagtccacaagtgtcttcatagacaagaaggctgcggctctcttgaagggtggtgccaaaaacgtaatctctgctccaagcaaagatgccccggttcatgccatcgcagccacccagaagactgtttatgggccatctgccaaggactggagaggtggcagggctgccagcttcactggtgctgccaagacctacatgttcaagtacgacaccatgcacggccactgcaagcatagtgacatcagcatcaaggactccaagacccttctcttcggtgagaagctggtcactgtcttcggcatcaggaacccggaggagatcccgtgcggtgaggctggtgctgactatgtcgtggagtccactggtgtcttcactgacaaggagaaggctgctgctcacttgaagggtggtgcccaaagataatctctgctccaagcaaagatg

SEQ ID NO: 21612 - protein, 172 aa, Panicum virgatum
  misc_feature: Ceres CLONE 1817065
  misc_feature (4)..(172): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MGKVKIGINGFGRIGRLVARVALQREHADYVVESTSVFIDKKAAALLKGGAKNVISAPSKDAPVHAIAATQKTVYGPSAKDWRGGRAASFTGAAKTYMFKYDTMHGHCKHSDISIKDSKTLLFGEKLVTVFGIRNPEEIPCGEAGADYVVESTGVFTDKEKAAAHLKGGAQR

SEQ ID NO: 21613 - DNA, 714 bp, Panicum virgatum
  misc_feature: Ceres CLONE 1817066
  misc_feature: Encodes the peptide sequence at SEQ ID NO. 21614
atctcacggccatatccgcctgtatgctccttctccaagatccatccctgcagctaggatccttcaagagttcttctccagaagcctcgatttgtagcaggtcagatccatagctactccaatcatcagaaatggcgagcctgcagagccaggagagtcttgcgagtacattaccgacaaacctaccagcgacctttatgaaggaaattaccgccgattttgcttctgagcgagaacttggccgctctgtatttggaatagcttacaagggtgttcttccagagacagaagggaaccgcatgattgctgtgaagaggcttgctgaaaactcacctgtgccggctggcaaaacatttgaaactgaggttacaaatcttatggcacttaaacacagaaatgtagtagagctggttagcttctgccacgaagcgcagaagaaagtagttcagcataatgggagatatgtgattgtagacgtgatcgaaagctgtctttgctacaaatatctaccaaagggaagtcttgacaagcatctttatggtatgcaatgccctatcccacacatttgtcttctgtttgtactattgatacttgagatgtaaacaaatgtgtgatattgatacttgagatgtaaacaaatgtgtgatacatcatgattcttattttttatgttcgttttattgccactaatgtaagcagtacacacttttgtac

SEQ ID NO: 21614 - protein, 156 aa, Panicum virgatum
  misc_feature: Ceres CLONE 1817066
  misc_feature: SWISSPROT Homolog: EC 2.7.11.1 Non-specific serine/threonine protein kinase
MASLQSQESLASTLPTNLPATFMKEITADFASERELGRSVFGIAYKGVLPETEGNRMIAVKRLAENSPVPAGKTFETEVTNLMALKHRNVVELVSFCHEAQKKVVQHNGRYVIVDVIESCLCYKYLPKGSLDKHLYGMQCPIPHICLLFVLLILEM

SEQ ID NO: 21615 - DNA, 714 bp, Panicum virgatum
  misc_feature: Ceres CLONE 1817080
  misc_feature: Encodes the peptide sequence at SEQ ID NO. 21616
aaccaaccgcgcttgtgtacactccactcactagtcccagctagcatccgggcctcatccagctccacccaagccaggcatcaaccagccaggaagcagagctagctagaggcgtccatggcggcgctccgggccctgtccgcggcggtggcggtggcgctggcgctggtggcggcgtcggcgtcggcggactcgtggctgtacgagaagttcaccacggatggccgcgtgcgcgccgactacaacgcgcaggggcagcaggtgacgtcgctcatcctcgaccgccagtccggcggcgccttctactcccgccagaagtacctctacggcgtcttcagcatccagatgaagctcatccgcggcaactctgccggcaccgtcacctccttctacctgacctccggcgacggccccgggcacgacgagatcgacatggagttcatgggcaactccagcggcgacccggtggtgctcaacaccaacgtgtgggccgccggcgacggcaagaaggagcagcagttctacctgtggttcgacccggccgccgacttccacacctacaccatcatctggaacgaccggaacgtcatcttcaaagtggacgacctcttcgtccgcagcttccggcggcacgccgacctgccgtaccccggcgggaagcccatgtcggtgcacgccacgctgtgggacggcagcttctgggtcacgcagcag

SEQ ID NO: 21616 - protein, 198 aa, Panicum virgatum
  misc_feature: Ceres CLONE 1817080
  misc_feature (28)..(197): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
  misc_feature: Useful for making plants with altered carbohydrate content
  misc_feature: Useful for making plants with altered cell wall content and/or composition
MAALRALSAAVAVALALVAASASADSWLYEKFTTDGRVRADYNAQGQQVTSLILDRQSGGAFYSRQKYLYGVFSIQMKLIRGNSAGTVTSFYLTSGDGPGHDEIDMEFMGNSSGDPVVLNTNVWAAGDGKKEQQFYLWFDPAADFHTYTIIWNDRNVIFKVDDLFVRSFRRHADLPYPGGKPMSVHATLWDGSFWVTQ

SEQ ID NO: 21617 - DNA, 671 bp, Panicum virgatum
  misc_feature: Ceres CLONE 1817093
  misc_feature: Encodes the peptide sequence at SEQ ID NO. 21618
ctgctgcctgctagtaggtaggtaggtagtgtacgtgcagcgtccggccacttctcttcccaaaagaaaattaagaagaagaagcagcagcagctgatcatcatcttcatcatcaacaacaagcaaataagcagtcatgtcgatcaagtactgcgaccagcacaaggactgcgagcggcagcggctgtaccggcgcttctgcgccggcctcgccgccctcatcctgctggccctcctgatcgtgctcatcgtctggctggtgctccgccccagcaagccccgcttctacctcaacaacgtcgacatcgtctgcatcaacgtcagcgcctcctccgccctcaccgtcaccatgcaggccacgctggcggcgcgcaaccccaacggccgcgtcggcatcttctacgaccgcgccgacgtctacgccgagtaccggggcctccaggtcaccgtcgccaccgcgctgccgcccatgtaccagggccacaacgacgtcaccgtctgggcgcccttcctctccggcgccggcgtcccgctctcgccgtacctggccaccgcgctggcgcaggacgagacggcgggctacctgctcctcaccatccgcgtcgacggctggatccgctggaaggccggggccttcatcaccagccactaccacctcagggtccgctgcc

SEQ ID NO: 21618 - protein, 178 aa, Panicum virgatum
  misc_feature: Ceres CLONE 1817093
  misc_feature (40)..(178): Pfam Name: Hin1 Pfam Description: Harpin-induced protein 1 (Hin1)
MSIKYCDQHKDCERQRLYRRFCAGLAALILLALLIVLIVWLVLRPSKPRFYLNNVDIVCINVSASSALTVTMQATLAARNPNGRVGIFYDRADVYAEYRGLQVTVATALPPMYQGHNDVTVWAPFLSGAGVPLSPYLATALAQDETAGYLLLTIRVDGWIRWKAGAFITSHYHLRVRC

SEQ ID NO: 21619 - DNA, 716 bp, Panicum virgatum
  misc_feature: Ceres CLONE 1817103
  misc_feature: Encodes the peptide sequence at SEQ ID NO. 21620
ggatcagtagactctaccgaccactaccagagcaagacagctcccatcctgctgctcgagctcgcagcgcacgctcatggaggacgccatctcccatcctcgcaacacaagagttgccgtggtcaccggcgggaacagaggcatcgggctagaagtgtgccggcagctggccagcaaaggcgtcgccgtcgtcctgacggcggtggacgagaagatgggcgcggaagccgtcgagaagctcaaagggttggcgctgtccgaagtcctttcccaccagctggatatcacggatgcttccagcatcgctcgactggccgatttcttgaagacccggttcgggaagctggatatcctggtgaataatgccgccgtcagtggggttgtgtatcttcaacatcatgctgatggttcagtaactagcggtgaaatgttcaaaggcatggatcgggacgagaggattgaatggatgtggggaaattgccgggagacgtacgacgctgccaaggaaggcctgcagacaaactactacggcacgaagcacgtgaccgaggcgctgctgcctctgctgcaagcctcttccgacggaagaatcgtgaatgtctcctccgactttgggctactaaggcatttcagagacgaggagctgaagcaagagctgaatgacaccgacaccctcacggaggagaggctggacgagctgctggtcatgttcctaa

SEQ ID NO: 21620 - protein, 213 aa, Panicum virgatum
  misc_feature: Ceres CLONE 1817103
  misc_feature (12)..(190): Pfam Name: adh_short Pfam Description: short chain dehydrogenase
  misc_feature: SWISSPROT Homolog: EC 1.1.1.184 Carbonyl reductase (NADPH)
MEDAISHPRNTRVAVVTGGNRGIGLEVCRQLASKGVAVVLTAVDEKMGAEAVEKLKGLALSEVLSHQLDITDASSIARLADFLKTRFGKLDILVNNAAVSGVVYLQHHADGSVTSGEMFKGMDRDERIEWMWGNCRETYDAAKEGLQTNYYGTKHVTEALLPLLQASSDGRIVNVSSDFGLLRHFRDEELKQELNDTDTLTEERLDELLVMFL

SEQ ID NO: 21621 - DNA, 1070 bp, Panicum virgatum
  misc_feature: Ceres CLONE 1817104
  misc_feature: Encodes the peptide sequence at SEQ ID NO. 21622
tctctctgcccgccgcattccgagctcgctggtcgctgctgctcgcctccgctcctccgatcctcgcgccggcgtccactcacgcaccgccggacgaaatggaagcagcaccagccctacgcacattctccccctcctcgtcctcaccagcgggagtcggaccccgccgtgttctcgcggccccggccccgcggcgcgcccgggcgctcgcggcgccgcctccgccccgcgccgtcgcctcctcccgcgcgccgctggtggtctccagccctccgccgcctcccgcggcgtcggttacgcccgcgccgacccccgcgcacgccaaggtcgaccgctccggccgcttctgcagcccccgcgccgcccgggagctcgcgctgatgatttcctacgccgcgtgcctggagggcgccgacgtcgtccggctcttcgaccgacggatcagtgcgaggcgagagcccgggtatgttttcgacaaggcgtgcctggcgagttacaaccatatgagcttcggcgggggacctcttgaggttgggacggaggaggaggccgagaagctgaccagccagaacgagatggattcggtcaacgaagcagaagttctttcagctcctccaaagctggtttacaacaactttgtcttaaggttatccagggagcttttagttgctgttgccagtggatgggataaacatgttgatatcattgacaaaataattccccagacttggaaggatgagcctgtggcaaggatacttgagctctgcattctccatattgctatggcagagatgacatcaaaaggaacacctcacaaagttgtcattaatgaggcagtagatttggcaaaacgattttgtgacggtggtgcccctcgggtaatcaatggatgccttcgaactttcgtaaaagatcacgtcgacaatacaggtactagtcaggcagctgaatcaaaagcgtgaagtttagtaaataccatgtatcgtacatcagaatcgtggctgaagtgcagaagtattgagaaaacatagctcgtctccaaattcaggcaaagtcttttcatctgaagg

SEQ ID NO: 21622 - protein, 287 aa, Panicum virgatum
  misc_feature: Ceres CLONE 1817104
  misc_feature (87)..(273): Pfam Name: NusB Pfam Description: NusB family
MEAAPALRTFSPSSSSPAGVGPRRVLAAPAPRRARALAAPPPPRAVASSRAPLVVSSPPPPPAASVTPAPTPAHAKVDRSGRFCSPRAARELALMISYAACLEGADVVRLFDRRISARREPGYVFDKACLASYNHMSFGGGPLEVGTEEEAEKLTSQNEMDSVNEAEVLSAPPKLVYNNFVLRLSRELLVAVASGWDKHVDIIDKIIPQTWKDEPVARILELCILHIAMAEMTSKGTPHKVVINEAVDLAKRFCDGGAPRVINGCLRTFVKDHVDNTGTSQAAESKA

SEQ ID NO: 21623 - DNA, 621 bp, Panicum virgatum
  misc_feature: Ceres CLONE 1817106
  misc_feature: Encodes the peptide sequence at SEQ ID NO. 21624
ggacgtggagcatctgccggcagtccgcgggcccgccgctggcaaccgcggggagcatgagcatacgcgcggtgctcgaccgcgtcttctccgccgtcgacgcctccggcccgcgccccgtcctggcgatcggcaacggcgaccccaccgcctccgcctgcttcaggcctccgcccgaggccgaggaggccgtggtggcggcgctccgctccaggaagcacaacggttactccccgtccgtcggcgtcctgccggcacgccgtgctattgcagagtacctatcacgggatcttccttattttttttcaccggatgatatttacctcactgctggatgctgccaagctattgacgtcatgatctccgtcctcgcccagcctggatccaacatcttgcttcccaaacctgggtttccgttatatgagtcacggaccatgttcagtaatctagaggcccggcatttcaaccttattcctgaccgaggctgggaggctgatcttgagtccgtggaggctcttgctgatgagaacacggttgcgatggtcattgtaaatcccagtaacccttgtgggagtgtgtactcacacgatcatttggccaaaattgcagagactgcaagga

SEQ ID NO: 21624 - protein, 206 aa, Panicum virgatum
  misc_feature: Ceres CLONE 1817106
  misc_feature: SWISSPROT Homolog: EC 2.6.1.5 Tyrosine transaminase
TWSICRQSAGPPLATAGSMSIRAVLDRVFSAVDASGPRPVLAIGNGDPTASACFRPPPEAEEAVVAALRSRKHNGYSPSVGVLPARRAIAEYLSRDLPYFFSPDDIYLTAGCCQAIDVMISVLAQPGSNILLPKPGFPLYESRTMFSNLEARHFNLIPDRGWEADLESVEALADENTVAMVIVNPSNPCGSVYSHDHLAKIAETAR

SEQ ID NO: 21625 - DNA, 1019 bp, Panicum virgatum
  misc_feature: Ceres CLONE 1817113
  misc_feature: Encodes the peptide sequence at SEQ ID NO. 21626
atcgaccccgcatttacattacaccacgggcacagtgagccagacagccaacgacgagccaccagcaccaggtctcccagcgacacggcggcgcgcgccacgaccagcagccgccacacacctcgagcgaagaagcagccatggcgacgcgtcgcctcccgtcgtcgtccctcccactgctgctgctccttgcggcgggatcccttgcggtggcagcagcggcggcaggcgcgcttggcggcaactcccccgaggccgacacggacccgaacatggtgccgcgctccggccggagcctgcagcagctgccgcagccggacccgaacccacagccgcagcccggggggaacccgccggtgccacagcccctgccgcaaccaaatccgaacccgccgcagccgcttccacagccacagccgcagcccatgccgcagccgcagcctcagccgcagccgcagccgctgcctcagccacagccgcagccagacccaacagccccacagccgcagcccttgccgcagccggacccaggccagcagcagccacagcccgggacgcagccggctcagaatccgcaggcgcagccggaccagctgcttccgagcggcgtcgggtcgaggatgatgctggtgaacctgcaagactccatgtgcatacttctcccaagtcttgcctatctgttagtgtaaccctgtgcaaatactttttttctttttcttccttccttcatttgttagttgttacccgccgcgtctgtatgtaattattaattaaatatatatagtcgcgagatatgtacagttgtatttttttttgcgtacgttgtgcgagtgtgtgtagtaattagattgcatagatttttgctagtgtgtggtaacagggcttgcgctgtggcctgtgggtatttggatgtagcttgcgtgtaccatgattgtgtgcctctctgtacatactatacaatacacttgatttacatggacgttcttgagtcccctgcacctttttcgagtgcaaatacg

SEQ ID NO: 21626 - protein, 182 aa, Panicum virgatum
  misc_feature: Ceres CLONE 1817113
  misc_feature: Useful for making plants with altered lignin content
MATRRLPSSSLPLLLLLAAGSLAVAAAAAGALGGNSPEADTDPNMVPRSGRSLQQLPQPDPNPQPQPGGNPPVPQPLPQPNPNPPQPLPQPQPQPMPQPQPQPQPQPLPQPQPQPDPTAPQPQPLPQPDPGQQQPQPGTQPAQNPQAQPDQLLPSGVGSRMMLVNLQDSMCILLPSLAYLLV

SEQ ID NO: 21627 - DNA, 691 bp, Panicum virgatum
  misc_feature: Ceres CLONE 1817122
  misc_feature: Encodes the peptide sequence at SEQ ID NO. 21628
tcgcacctcgcagccatatctcccctcgcttaaaagctcgcgcgagccgtgtctggggaggaggatccactgatccagtcccatccggccgaatcccctcgccgccgccgccctctccttcctctaactaaaaccctagcgtgcgtgcgcggggatgaagatccagtgcaacgcgtgcggggccgcggaggcgcgggtgctgtgctgcgcggacgaggcggcgctctgcggggcctgcgacgaggaggtgcacgccgccaacaagctcgcggggaagcaccagcgggtgccgctgctctcggacgccgacgccgccgccgcggcggcggcgcccgccgtgcccaagtgcgacatctgccaggaggcttctggatacttcttctgcctagaggaccgtgcactactttgtagagattgtgatgttgctatacacacggtaaattcatttgtttcggtgcatcagagattcctgctaactggagttcaggtgggccttgatcctgccgatccagttccgcccattgctgaaaaccgtgttaatgacgctggtggctcggtatatcaaccagcaaaacatctgccaaggagaaacccaacagttcaattttcagtcaggacgggagtggttgattggacaatgcacaatgctgcaattcaatccgtagaatctccgactaagtacatgtcagag

SEQ ID NO: 21628 - protein, 178 aa, Panicum virgatum
  misc_feature: Ceres CLONE 1817122
  misc_feature (60)..(107): Pfam Name: zf-B_box Pfam Description: B-box zinc finger
  misc_feature (1)..(47): Pfam Name: zf-B_box Pfam Description: B-box zinc finger
  misc_feature: Useful for making plants with altered lignin content
  misc_feature: The sequence is a functional homolog of SEQ ID NO 1023 in the 10/666,642 US patent application
  misc_feature: The sequence is a functional homolog of SEQ ID NO 1645 in the 10/374,780 US patent application
  misc_feature: The sequence is a functional homolog of SEQ ID NO 1671 in the 10/412,699 US patent application
MKIQCNACGAAEARVLCCADEAALCGACDEEVHAANKLAGKHQRVPLLSDADAAAAAAAPAVPKCDICQEASGYFFCLEDRALLCRDCDVAIHTVNSFVSVHQRFLLTGVQVGLDPADPVPPIAENRVNDAGGSVYQPAKHLPRRNPTVQFSVRTGVVDWTMHNAAIQSVESPTKYMS

SEQ ID NO: 21629 - DNA, 1076 bp, Panicum virgatum
  misc_feature: Ceres CLONE 1817135
  misc_feature: Encodes the peptide sequence at SEQ ID NO. 21630
aatggttctcccgctccgcctgatcccgcgcttggctgccgcagccaggtcgccgcgcgctccccggtccatctcgccgcgcgcgcggtcagtgccggctctcacaatggcggcggcgtacagcaccgggtccggcgcgggcaggaggctgctcttcaggcagctgttcgagaaggagagctccacgtacacctacctcctcgccgacgtcgccgaccccgacaagcccgccgtgttgattgaccctgtcgacagaacagttgacagagatcttaatcttatcaaggaattgggcttgaagctcgtgtatgctatgaatactcatgtgcatgctgatcacgtcactggaacaggattaataaaaactaaggtaccaggagttaagtctgttatttctagagctagtggagcaaaatcagatcattttgttgatcatggggacaaattacagtttggtaaccttttccttgaggttcgagctactcctggccacactgctggctgtgtgacttacataacaggtgatgctgatggtcaaccttcaccaaggatggcttttaccggggacgccttgattattcgagcatgtggaaggacagactttcagggaggaagctctgatctgctatatcagtcggtgcattcacagattttcacattgccaaaggataccctgctttatcctgcccatgattacaaaggtttcacagttagtactgttgaagaggaggttgcctataacggccgactaacgaaagataaggaaactttcaagaccatcatggataacttaaacctgccttatccaaagatgattgatgtagctgtacccgccaatttggtgtgtggcatccaggatccaccaccgaagatctgagctgttccaaccgaagccagcagctgagttgtacaaaaaataatctgtttgctgccgcctgtgattttgtgagaaaataatttagtcaatggatggtgtgggcctctggttgtaacttgcaagacactactatttgatgatatcagtgagaatgacactaatgataaatgaagccagtttgtctcccctcttttacttc

SEQ ID NO: 21630 - protein, 256 aa, Panicum virgatum
  misc_feature: Ceres CLONE 1817135
  misc_feature (26)..(195): Pfam Name: Lactamase_B Pfam Description: Metallo-beta-lactamase superfamily
  misc_feature: SWISSPROT Homolog: EC 3.1.2.6 Hydroxyacylglutathione hydrolase
MAAAYSTGSGAGRRLLFRQLFEKESSTYTYLLADVADPDKPAVLIDPVDRTVDRDLNLIKELGLKLVYAMNTHVHADHVTGTGLIKTKVPGVKSVISRASGAKSDHFVDHGDKLQFGNLFLEVRATPGHTAGCVTYITGDADGQPSPRMAFTGDALIIRACGRTDFQGGSSDLLYQSVHSQIFTLPKDTLLYPAHDYKGFTVSTVEEEVAYNGRLTKDKETFKTIMDNLNLPYPKMIDVAVPANLVCGIQDPPPKI

SEQ ID NO: 21631 - DNA, 598 bp, Panicum virgatum
  misc_feature: Ceres CLONE 1817136
  misc_feature: Encodes the peptide sequence at SEQ ID NO. 21632
agagcgcacaaaccctcctcgcctccgccctcgatgccccgccgtcgccgaggaggaagaagaagaagaagaagcgccggccaagatgaagaccattctggcgtcggagaccatggacatcccggaggaggtcacggtgaaggtggccgccaaggtggtgacggtggagggcccccgcgggaagctcacccgcaacttcaagcacctcaacctcgacttccagctgcaggacggcggccgcaagctcaaggtcgacgcctggttcggcacccgccgcaccatggccgccatccgcaccgccatctcccacgtccagaacctcatcaccggcgtttttttgggataccgctacaagatgaggttcgtctacgcccacttccccatcaacgcctccatcaccaacgccaacaccgccatcgagatcaggaacttcctgggcgagaagaaggtcaggaaggtggacatgcttgagggtgtgaccatcttgcggtccgagaaggtcaaggatgagctcatcctcgacggcaacgacatcgagctcgtctctcgctctgccgccctcatcaaccagaaatgccatgtgaagaacaaggatatc

SEQ ID NO: 21632 - protein, 170 aa, Panicum virgatum
  misc_feature: Ceres CLONE 1817136
  misc_feature (12)..(86): Pfam Name: Ribosomal_L6 Pfam Description: Ribosomal protein L6
  misc_feature (98)..(170): Pfam Name: Ribosomal_L6 Pfam Description: Ribosomal protein L6
MKTILASETMDIPEEVTVKVAAKVVTVEGPRGKLTRNFKHLNLDFQLQDGGRKLKVDAWFGTRRTMAAIRTAISHVQNLITGVFLGYRYKMRFVYAHFPINASITNANTAIEIRNFLGEKKVRKVDMLEGVTILRSEKVKDELILDGNDIELVSRSAALINQKCHVKNKD

SEQ ID NO: 21633 - DNA, 578 bp, Panicum virgatum
  misc_feature: Ceres CLONE 1817177
  misc_feature: Encodes the peptide sequence at SEQ ID NO. 21634
accatccggggttggacccttgtctcgcgcacttcaccgcgggggaaagggagagggagggggtcactttcttcacccagcagggggccaggagggagggagtgaggaggcatggggaggccgccgtgctgcgagaaggccggggtgaagaaggggccgtggacgccggaggaggacctcgtgctcgtctcctacgtgcaggagcacggccccggcaactggcgcgccgtgcccaccaacaccgggctgatgcgctgcagcaagagctgccggctccgctggaccaactacctccgcccgggcatcaagcgcggcaacttcagcgtcaaggaggagaagctcatcatccacctccaggcgctgctcggcaacaggtgggcggcgattgcgtcgtacctcccggaccggacggacaacgacatcaagaactactggaacacccacctcaagaagaagctcgccacgatgggcgccgacggcgccggcgccggcggcgccgaggcgaggagcggcagggcggccgcgcccaaggggcagtgggagcgccgcctgcagacggacatccacaccgcgcgcca

SEQ ID NO: 21634 - protein, 155 aa, Panicum virgatum
  misc_feature: Ceres CLONE 1817177
  misc_feature (67)..(112): Pfam Name: Myb_DNA-binding Pfam Description: Myb-like DNA-binding domain
  misc_feature (14)..(61): Pfam Name: Myb_DNA-binding Pfam Description: Myb-like DNA-binding domain
  misc_feature: The sequence is a functional homolog of SEQ ID NO 592 in the 10/374,780 US patent application
  misc_feature: The sequence is a functional homolog of SEQ ID NO 786 in the 11/435,388 US patent application
  misc_feature: The sequence is a functional homolog of SEQ ID NO 794 in the 11/435,388 US patent application
  misc_feature: The sequence is a functional homolog of SEQ ID NO 726 in the 11/435,388 US patent application
  misc_feature: The sequence is a functional homolog of SEQ ID NO 1074 in the 10/412,699 US patent application
  misc_feature: The sequence is a functional homolog of SEQ ID NO 590 in the 10/374,780 US patent application
  misc_feature: The sequence is a functional homolog of SEQ ID NO 594 in the 10/374,780 US patent application
  misc_feature: The sequence is a functional homolog of SEQ ID NO 784 in the 11/435,388 US patent application
  misc_feature: The sequence is a functional homolog of SEQ ID NO 792 in the 11/435,388 US patent application
  misc_feature: The sequence is a functional homolog of SEQ ID NO 1072 in the 10/412,699 US patent application
  misc_feature: The sequence is a functional homolog of SEQ ID NO 1073 in the 10/412,699 US patent application
  misc_feature: The sequence is a functional homolog of SEQ ID NO 588 in the 10/374,780 US patent application
  misc_feature: The sequence is a functional homolog of SEQ ID NO 589 in the 10/374,780 US patent application
  misc_feature: The sequence is a functional homolog of SEQ ID NO 730 in the 11/435,388 US patent application
  misc_feature: The sequence is a functional homolog of SEQ ID NO 788 in the 11/435,388 US patent application
  misc_feature: The sequence is a functional homolog of SEQ ID NO 1031 in the 11/479,226 US patent application
  misc_feature: The sequence is a functional homolog of SEQ ID NO 1804 in the 10/412,699 US patent application
  misc_feature: The sequence is a functional homolog of SEQ ID NO 2050 in the 10/374,780 US patent application
  misc_feature: The sequence is a functional homolog of SEQ ID NO 444 in the 10/412,699 US patent application
  misc_feature: The sequence is a functional homolog of SEQ ID NO 598 in the 10/225,066 US patent application
  misc_feature: The sequence is a functional homolog of SEQ ID NO 620 in the 11/435,388 US patent application
  misc_feature: The sequence is a functional homolog of SEQ ID NO 790 in the 11/435,388 US patent application
  misc_feature: Useful for making plants with modulated low light sensitivity
  misc_feature: The sequence is a functional homolog of SEQ ID NO 1071 in the 10/412,699 US patent application
  misc_feature: The sequence is a functional homolog of SEQ ID NO 587 in the 10/374,780 US patent application
  misc_feature: The sequence is a functional homolog of SEQ ID NO 728 in the 11/435,388 US patent application
  misc_feature: The sequence is a functional homolog of SEQ ID NO 184 in the 10/412,699 US patent application
  misc_feature: The sequence is a functional homolog of SEQ ID NO 397 in the 11/479,226 US patent application
  misc_feature: The sequence is a functional homolog of SEQ ID NO 46 in the 10/374,780 US patent application
  misc_feature: The sequence is a functional homolog of SEQ ID NO 590 in the 11/435,388 US patent application
  misc_feature: The sequence is a functional homolog of SEQ ID NO 6 in the 10/225,068 US patent application
  misc_feature: The sequence is a functional homolog of SEQ ID NO 593 in the 10/374,780 US patent application
  misc_feature: The sequence is a functional homolog of SEQ ID NO 782 in the 11/435,388 US patent application
  misc_feature: The sequence is a functional homolog of SEQ ID NO 796 in the 11/435,388 US patent application
  misc_feature: The sequence is a functional homolog of SEQ ID NO 1075 in the 10/412,699 US patent application
  misc_feature: The sequence is a functional homolog of SEQ ID NO 591 in the 10/374,780 US patent application
  misc_feature: The sequence is a functional homolog of SEQ ID NO 743 in the 10/666,642 US patent application
  misc_feature: The sequence is a functional homolog of SEQ ID NO 263 in the 11/479,226 US patent application
  misc_feature: The sequence is a functional homolog of SEQ ID NO 478 in the 11/435,388 US patent application
  misc_feature: The sequence is a functional homolog of SEQ ID NO 54 in the 10/666,642 US patent application
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
  misc_feature: The sequence is a functional homolog of SEQ ID NO 296 in the 11/479,226 US patent application
  misc_feature: The sequence is a functional homolog of SEQ ID NO 824 in the 10/412,699 US patent application
  misc_feature: Useful for making plants with altered alkaloid content
  misc_feature: Useful for making plants with altered lignin content
  misc_feature: Useful for making plants with modulated nitrogen use efficiency
  misc_feature: The sequence is a functional homolog of SEQ ID NO 569 in the 10/374,780 US patent application
  misc_feature: The sequence is a functional homolog of SEQ ID NO 1684 in the 11/479,226 US patent application
  misc_feature: The sequence is a functional homolog of SEQ ID NO 2582 in the 10/374,780 US patent application
  misc_feature: The sequence is a functional homolog of SEQ ID NO 30 in the 11/375,241 US patent application
  misc_feature: The sequence is a functional homolog of SEQ ID NO 854 in the 10/412,699 US patent application
  misc_feature: The sequence is a functional homolog of SEQ ID NO 2572 in the 10/374,780 US patent application
  misc_feature: The sequence is a functional homolog of SEQ ID NO 636 in the 10/225,066 US patent application
  misc_feature: The sequence is a functional homolog of SEQ ID NO 838 in the 10/412,699 US patent application
  misc_feature: The sequence is a functional homolog of SEQ ID NO 1052 in the 11/479,226 US patent application
  misc_feature: The sequence is a functional homolog of SEQ ID NO 456 in the 10/412,699 US patent application
  misc_feature: The sequence is a functional homolog of SEQ ID NO 2564 in the 10/374,780 US patent application
  misc_feature: The sequence is a functional homolog of SEQ ID NO 276 in the 10/225,066 US patent application
  misc_feature: The sequence is a functional homolog of SEQ ID NO 818 in the 10/412,699 US patent application
  misc_feature: The sequence is a functional homolog of SEQ ID NO 110 in the 10/412,699 US patent application
  misc_feature: The sequence is a functional homolog of SEQ ID NO 259 in the 11/479,226 US patent application
  misc_feature: The sequence is a functional homolog of SEQ ID NO 168 in the 10/412,699 US patent application
  misc_feature: The sequence is a functional homolog of SEQ ID NO 377 in the 11/479,226 US patent application
  misc_feature: The sequence is a functional homolog of SEQ ID NO 58 in the 10/666,642 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 156 in the 10/412,699 US patent application
  misc_feature: The sequence is a functional homolog of SEQ ID NO 164 in the 10/412,699 US patent application
  misc_feature: The sequence is a functional homolog of SEQ ID NO 1754 in the 10/412,699 US patent application
  misc_feature: The sequence is a functional homolog of SEQ ID NO 1978 in the 10/374,780 US patent application
  misc_feature: The sequence is a functional homolog of SEQ ID NO 353 in the 11/479,226 US patent application
  misc_feature: The sequence is a functional homolog of SEQ ID NO 369 in the 11/479,226 US patent application
  misc_feature: The sequence is a functional homolog of SEQ ID NO 40 in the 10/374,780 US patent application
  misc_feature: The sequence is a functional homolog of SEQ ID NO 776 in the 10/225,066 US patent application
  misc_feature: The sequence is a functional homolog of SEQ ID NO 1010 in the 11/435,388 US patent application
  misc_feature: The sequence is a functional homolog of SEQ ID NO 1680 in the 11/479,226 US patent application
  misc_feature: The sequence is a functional homolog of SEQ ID NO 202 in the 10/666,642 US patent application
  misc_feature: The sequence is a functional homolog of SEQ ID NO 852 in the 10/412,699 US patent application
  misc_feature: The sequence is a functional homolog of SEQ ID NO 1002 in the 11/435,388 US patent application
  misc_feature: The sequence is a functional homolog of SEQ ID NO 822 in the 10/412,699 US patent application
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 1011 in the 11/479,226 US patent application
  misc_feature: The sequence is a functional homolog of SEQ ID NO 434 in the 10/412,699 US patent application
  misc_feature: The sequence is a functional homolog of SEQ ID NO 134 in the 10/412,699 US patent application
  misc_feature: The sequence is a functional homolog of SEQ ID NO 321 in the 11/479,226 US patent application
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: Useful for making plants with altered cell wall content and/or composition
  misc_feature: The sequence is a functional homolog of SEQ ID NO 116 in the 10/412,699 US patent application
  misc_feature: The sequence is a functional homolog of SEQ ID NO 280 in the 11/479,226 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: The sequence is a functional homolog of SEQ ID NO 1073 in the 10/374,780 US patent application
  misc_feature: The sequence is a functional homolog of SEQ ID NO 1004 in the 11/435,388 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 271 in the 11/479,226 US patent application
  misc_feature: Useful for making plants with altered carbohydrate content
  misc_feature: The sequence is a functional homolog of SEQ ID NO 148 in the 10/412,699 US patent application
  misc_feature: The sequence is a functional homolog of SEQ ID NO 2266 in the 10/374,780 US patent application
  misc_feature: The sequence is a functional homolog of SEQ ID NO 341 in the 11/479,226 US patent application
  misc_feature: The sequence is a functional homolog of SEQ ID NO 58 in the 11/375,241 US patent application
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 1411 in the 11/479,226 US patent application
  misc_feature: The sequence is a functional homolog of SEQ ID NO 2492 in the 10/374,780 US patent application
  misc_feature: The sequence is a functional homolog of SEQ ID NO 52 in the 10/225,066 US patent application
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: The sequence is a functional homolog of SEQ ID NO 442 in the 10/412,699 US patent application
  misc_feature: The sequence is a functional homolog of SEQ ID NO 1681 in the 10/374,780 US patent application
  misc_feature: The sequence is a functional homolog of SEQ ID NO 122 in the 10/412,699 US patent application
  misc_feature: The sequence is a functional homolog of SEQ ID NO 126 in the 11/375,241 US patent application
  misc_feature: The sequence is a functional homolog of SEQ ID NO 148 in the 10/286,264 US patent application
  misc_feature: The sequence is a functional homolog of SEQ ID NO 34 in the 10/374,780 US patent application
  misc_feature: The sequence is a functional homolog of SEQ ID NO 438 in the 10/225,066 US patent application
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 1901 in the 11/479,226 US patent application
  misc_feature: The sequence is a functional homolog of SEQ ID NO 310 in the 10/374,780 US patent application
  misc_feature: The sequence is a functional homolog of SEQ ID NO 842 in the 10/225,066 US patent application
  misc_feature: The sequence is a functional homolog of SEQ ID NO 1041 in the 11/479,226 US patent application
  misc_feature: The sequence is a functional homolog of SEQ ID NO 112 in the 10/225,066 US patent application
  misc_feature: The sequence is a functional homolog of SEQ ID NO 20 in the 11/375,241 US patent application
  misc_feature: The sequence is a functional homolog of SEQ ID NO 2052 in the 10/374,780 US patent application
  misc_feature: The sequence is a functional homolog of SEQ ID NO 450 in the 10/412,699 US patent application
  misc_feature: The sequence is a functional homolog of SEQ ID NO 1094 in the 10/225,066 US patent application
  misc_feature: The sequence is a functional homolog of SEQ ID NO 386 in the 10/374,780 US patent application
  misc_feature: Useful for making plants with altered terpenoid content
  misc_feature: Useful for making plants with modulated biomass
  misc_feature: The sequence is a functional homolog of SEQ ID NO 178 in the 10/412,699 US patent application
  misc_feature: The sequence is a functional homolog of SEQ ID NO 389 in the 11/479,226 US patent application
  misc_feature: The sequence is a functional homolog of SEQ ID NO 1100 in the 10/225,066 US patent application
  misc_feature: The sequence is a functional homolog of SEQ ID NO 158 in the 10/412,699 US patent application
  misc_feature: The sequence is a functional homolog of SEQ ID NO 2268 in the 10/374,780 US patent application
  misc_feature: The sequence is a functional homolog of SEQ ID NO 357 in the 11/479,226 US patent application
  misc_feature: The sequence is a functional homolog of SEQ ID NO 480 in the 11/435,388 US patent application
  misc_feature: The sequence is a functional homolog of SEQ ID NO 18 in the 11/375,241 US patent application
  misc_feature: The sequence is a functional homolog of SEQ ID NO 426 in the 10/374,780 US patent application
  misc_feature: The sequence is a functional homolog of SEQ ID NO 458 in the 10/225,066 US patent application
  misc_feature: The sequence is a functional homolog of SEQ ID NO 2570 in the 10/374,780 US patent application
  misc_feature: The sequence is a functional homolog of SEQ ID NO 634 in the 10/225,066 US patent application
  misc_feature: The sequence is a functional homolog of SEQ ID NO 832 in the 10/412,699 US patent application
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: The sequence is a functional homolog of SEQ ID NO 1656 in the 11/479,226 US patent application
  misc_feature: The sequence is a functional homolog of SEQ ID NO 834 in the 10/412,699 US patent application
  misc_feature: The sequence is a functional homolog of SEQ ID NO 428 in the 10/374,780 US patent application
  misc_feature: The sequence is a functional homolog of SEQ ID NO 54 in the 11/375,241 US patent application
  misc_feature: The sequence is a functional homolog of SEQ ID NO 870 in the 10/225,066 US patent application
  misc_feature: The sequence is a functional homolog of SEQ ID NO 136 in the 10/412,699 US patent application
  misc_feature: The sequence is a functional homolog of SEQ ID NO 325 in the 11/479,226 US patent application
  misc_feature: The sequence is a functional homolog of SEQ ID NO 1118 in the 10/225,066 US patent application
  misc_feature: The sequence is a functional homolog of SEQ ID NO 1396 in the 11/479,226 US patent application
  misc_feature: The sequence is a functional homolog of SEQ ID NO 2488 in the 10/374,780 US patent application
  misc_feature: The sequence is a functional homolog of SEQ ID NO 658 in the 10/412,699 US patent application
  misc_feature: The sequence is a functional homolog of SEQ ID NO 1917 in the 10/374,780 US patent application
  misc_feature: The sequence is a functional homolog of SEQ ID NO 2394 in the 10/374,780 US patent application
  misc_feature: The sequence is a functional homolog of SEQ ID NO 544 in the 10/225,066 US patent application
  misc_feature: The sequence is a functional homolog of SEQ ID NO 999 in the 11/479,226 US patent application
  misc_feature: Useful for biocontainment applications
  misc_feature: The sequence is a functional homolog of SEQ ID NO 836 in the 10/412,699 US patent application
  misc_feature: The sequence is a functional homolog of SEQ ID NO 112 in the 11/375,241 US patent application
  misc_feature: The sequence is a functional homolog of SEQ ID NO 2398 in the 10/374,780 US patent application
  misc_feature: The sequence is a functional homolog of SEQ ID NO 466 in the 10/412,699 US patent application
  misc_feature: The sequence is a functional homolog of SEQ ID NO 580 in the 10/225,066 US patent application
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: The sequence is a functional homolog of SEQ ID NO 1033 in the 10/412,699 US patent application
  misc_feature: The sequence is a functional homolog of SEQ ID NO 540 in the 10/374,780 US patent application
  misc_feature: The sequence is a functional homolog of SEQ ID NO 1916 in the 10/412,699 US patent application
  misc_feature: The sequence is a functional homolog of SEQ ID NO 2176 in the 10/374,780 US patent application
  misc_feature: Useful for making plants with modulated flowering time
  misc_feature: The sequence is a functional homolog of SEQ ID NO 126 in the 10/412,699 US patent application
  misc_feature: The sequence is a functional homolog of SEQ ID NO 1563 in the 10/374,780 US patent application
  misc_feature: The sequence is a functional homolog of SEQ ID NO 156 in the 10/225,068 US patent application
  misc_feature: The sequence is a functional homolog of SEQ ID NO 262 in the 10/374,780 US patent application
  misc_feature: The sequence is a functional homolog of SEQ ID NO 282 in the 10/225,066 US patent application
  misc_feature: The sequence is a functional homolog of SEQ ID NO 1566 in the 10/374,780 US patent application
  misc_feature: The sequence is a functional homolog of SEQ ID NO 196 in the 10/225,066 US patent application
  misc_feature: The sequence is a functional homolog of SEQ ID NO 2900 in the 10/374,780 US patent application
  misc_feature: The sequence is a functional homolog of SEQ ID NO 1565 in the 10/374,780 US patent application
MGRPPCCEKAGVKKGPWTPEEDLVLVSYVQEHGPGNWRAVPTNTGLMRCSKSCRLRWTNYLRPGIKRGNFSVKEEKLIIHLQALLGNRWAAIASYLPDRTDNDIKNYWNTHLKKKLATMGADGAGAGGAEARSGRAAAPKGQWERRLQTDIHTAR

SEQ ID NO: 21635 - DNA, 948 bp, Panicum virgatum
  misc_feature: Ceres CLONE 1817184
  misc_feature: Encodes the peptide sequence at SEQ ID NO. 21636
acacgcacggatccactcccctgggcccactcggcctcatggcggcggcgccggaggcggcgtcctgcgacggcagcggcgcgcgcatgacgctgaactgcagccacggcggccgcttcctgcccctcggccccggcggcgcgctgcggtacgtgggcggcgagacgcgcgtcctcgccgtgccgcacgccgcgaccttccgcgacctggcggcgcggctgtcgccggaggtggccggcggcgcggaggtgcgcgcgatcaggcaccgcctcgccgacgagggcctcgaggacgtgatcgtctcggtcacctgcgacgacgagctcgcgcacatgcgcgacgagtacgaccgcctgcgcgccacgcggccagccgccaggttccgggtttacgtcaccaccagcgctcccgccggttccgccgccgccggcgacttccaagggcggagagcggcgtcagggctcccacccctcctcgaccccaagatgcgacgcgtcaagagcgtggaggcgcagctgcaccggcgccccgccttgccagcgccgatgcggcggatccagagcgcaatggagttcgcacgggccacccaagtccaaccgtgtccttacgccaccggcgccagcaggagagctgccgcaacagtcagcgccgtgacctgtgcgcggccgcgccgccgctggcgcgtccagtggacgcactgcccggcatgtccaagaaagtagctgctccttcggtgcccgcggcgatggcaacagggcggctggtcttcacagatgccgcaagggagaaggcgaggagcagaagcctcctggcggccatggagaacagaagagcgatctgggagttggctagttagggcttagattgtgttgacggttattgccaagctgtaaatacagattgctgtgtaaatacagtttttgaaatacaatattattttataattcg

SEQ ID NO: 21636 - protein, 227 aa, Panicum virgatum
  misc_feature: Ceres CLONE 1817184
  misc_feature (31)..(122): Pfam Name: PB1 Pfam Description: PB1 domain
MAAAPEAASCDGSGARMTLNCSHGGRFLPLGPGGALRYVGGETRVLAVPHAATFRDLAARLSPEVAGGAEVRAIRHRLADEGLEDVIVSVTCDDELAHMRDEYDRLRATRPAARFRVYVTTSAPAGSAAAGDFQGRRAASGLPPLLDPKMRRVKSVEAQLHRRPALPAPMRRIQSAMEFARATQVQPCPYATGASRRAAATVSAVTCARPRRRWRVQWTHCPACPRK

SEQ ID NO: 21637 - DNA, 1391 bp, Panicum virgatum
  misc_feature: Ceres CLONE 1817222
  misc_feature: Encodes the peptide sequence at SEQ ID NO. 21638
agacaagacgcccactagctaggccacgaataacagctcgggccagccatggccatggcgctcatctccgcctccggcacggcggccccgctgcaggtcctgctcttggcgctgctgctcgcggcgtcggccgcggccttgccggccatggaccgcgcgcgctggcaggtggacacggtcaaccggcgaggaacatccctcggcctcgtcatgtcctacgtcgacgaggccaccgcgctgcaggcctccggctacttcacgccctggcgcgtcctcccgtttgttgacctctatggacgacggtttcacattggcagcattcgtggcgtgaatgttatatacgcactgacaggacaacgcaggttgaatgcagctgtcactgtacagactctcatcgatgtctttggtgtgtctggcattgttcattatggcacagcagggagttctaatgattccctgtcgtttggcgatgtcagtgtccccaagcttgttgcttacacaggtgcctggacatggaagaagttcagatcaccaaaagagtcatcagcagaactcagatttggagaatataatagcccaaatggaggagagaatctgctagggtccctgaaattcagaaacgaggagttatattctgtgggtaagcctatggaagaagttttctggctacctgtagattcagcatggttcaaagttgcagaacaactaaaggtcaaacttgaaagatgcaatgacactttctgcttacctacaactccacaagttgtctatgggcttaaaggatcatcagctgacatgtttcttgacaatgcagagtacaggaaattccttttcagagaatttggggtgtcaacagtagatgaggagagcgcagcagtggtgatgacaacaaaatctcctggtgtacctgtgattgtattccgtggtgtatctgatttggctggcggggaaccaacatggtcatcaacaagcctgatgaacctagcatctattaatgcattaaaagtggcagtggagttcatcggaacggttggcaagcagaagtcaatagaatcagtacaaaggagtaataactgagaaaaggatgattgccatgctcatccatcaccactccaaaataattctacacaataattggaagctaccctcagaatgatacagaatcttgaggcttcaaggcctgtgtcccctcaaatcaacatataaatgtttgggatgtatagccacattgtaaccttgcctctggccatgattttttagtgcaattttgatgatgatgatgatggaacaaaatggtgagccagatgtttcattttttattagaagcataccattgatgtaatcatgtaatattgattatttttataaagaatcatcgacttggccactgg

SEQ ID NO: 21638 - protein, 342 aa, Panicum virgatum
  misc_feature: Ceres CLONE 1817222
  misc_feature (50)..(325): Pfam Name: PNP_UDP_1 Pfam Description: Phosphorylase family
  misc_feature: SWISSPROT Homolog: EC 3.2.2.9 Adenosylhomocysteine nucleosidase
MAMALISASGTAAPLQVLLLALLLAASAAALPAMDRARWQVDTVNRRGTSLGLVMSYVDEATALQASGYFTPWRVLPFVDLYGRRFHIGSIRGVNVIYALTGQRRLNAAVTVQTLIDVFGVSGIVHYGTAGSSNDSLSFGDVSVPKLVAYTGAWTWKKFRSPKESSAELRFGEYNSPNGGENLLGSLKFRNEELYSVGKPMEEVFWLPVDSAWFKVAEQLKVKLERCNDTFCLPTTPQVVYGLKGSSADMFLDNAEYRKFLFREFGVSTVDEESAAVVMTTKSPGVPVIVFRGVSDLAGGEPTWSSTSLMNLASINALKVAVEFIGTVGKQKSIESVQRSNN

SEQ ID NO: 21639 - DNA, 985 bp, Panicum virgatum
  misc_feature: Ceres CLONE 1817235
  misc_feature: Encodes the peptide sequence at SEQ ID NO. 21640
acgctccatctctcgagcacagagcactgcaccctctcatccgccggtgcttgctcctcctccccacttcagctagtagcctcttcttgagagaatcatcaggaagaggccgggatatcgagggatcgagcaagatgatgagcggcaaggctctccttgtcgccgtgctcttggtgggcgtcgcctcccggtgctccggcagcaggggcctgcagtggggtcacatcgctgagcagaagtacggtggcggtgggtacggtggcggcggcggcggatacggtggtggcggtgggtacggcggcggaggtggtggtggtgggtatggaggcggcggcggctacacgcccggctactccggcaccggaacctgcgactactggaagagccacccggacgcgatcatctcgtgcatcgggtcgctgggcagcatcctggggtcctttggcgacgtgtgcagcgccttcttcgggagcaagctgcagacgctgcaggacgcgctgtgcaacacccgcaccgactgctacggcgacctcctccgcgagggcgccgccgcctacctcaactccgtcgcctcccagaagtacgcctacaccacgcagcaggtcaaggactgcatcgccgtcgcgctcacctccgaggccgccgccgccgcgcaggccgccatgttcaagaaggccaactacgcctgccactactaatcgatcgatgacgaaggagcgagctgcttcctccatctatcatttcgtcagtgtagcgtgcttgttaaataagatgtgtgtgcgtgactgtgtttgtgtgtgtgtccgatccccagctagcgtcgccttcgcttctgcgtcgtcgtcttcccgtgactagctcccatgaatccatgaggacgcatgacgccatgccgtctcgttgtctgcttcttcagtagtgatgatgcctgcttccttgtcgttgttgctgatgtaatgagaaataagatgagttggttggtggt

SEQ ID NO: 21640 - protein, 186 aa, Panicum virgatum
  misc_feature: Ceres CLONE 1817235
  misc_feature (1)..(76): Pfam Name: GRP Pfam Description: Glycine rich protein family
  misc_feature: Useful for making plants with altered lignin content
  misc_feature: Useful for making plants with altered terpenoid content
MSGKALLVAVLLVGVASRCSGSRGLQWGHIAEQKYGGGGYGGGGGGYGGGGGYGGGGGGGGYGGGGGYTPGYSGTGTCDYWKSHPDAIISCIGSLGSILGSFGDVCSAFFGSKLQTLQDALCNTRTDCYGDLLREGAAAYLNSVASQKYAYTTQQVKDCIAVALTSEAAAAAQAAMFKKANYACHY

SEQ ID NO: 21641 - DNA, 700 bp, Panicum virgatum
  misc_feature: Ceres CLONE 1817240
  misc_feature: Encodes the peptide sequence at SEQ ID NO. 21642
gcgactcctttcggttcccctccttccacagcccttgagaagcttccacccctcccgcgccgccgccgccacagcagcgcaaaccctaaccgccgtcctccgcgtctctccgcccaccggcgcccccgtcgtcgtctccaccgccgccgccgccgccgccgccgagcgatcggatctcgggacccgtcgagccacgatggaggactgggatgctgaagattttcaaccagccgcacctgttgttaaagcagagccacttaaaaatcagtgggttgatgaagatgttgaagaagaggacgtaaaagattcatgggaagaagaggaggaggagaaacctaagccaccacctgtagaaaagcccacggcgaaacctagcagtaaggctcctgcgaaaaagggaaaacagcaggcatctactagtgctgaagaaccagatgaacctcctcttagtcccacttcagagaaaattcgccagcaaaggcttgtggaagaagctgatttcaagtcaaccacggaactttttgcaaagaagggtggcgaccaaaagtcactagatacatttatcccaaagtctgagagtgactttgcggaatatgcagagcttattgcaaataaactacgcccctacgagaaaagctttcactacatgggtctacttaagaatgtcatgagactttccatgacaccgttgaaaggtgtg

SEQ ID NO: 21642 - protein, 167 aa, Panicum virgatum
  misc_feature: Ceres CLONE 1817240
  misc_feature (1)..(167): Pfam Name: eIF3_subunit Pfam Description: Translation initiation factor eIF3 subunit
MEDWDAEDFQPAAPVVKAEPLKNQWVDEDVEEEDVKDSWEEEEEEKPKPPPVEKPTAKPSSKAPAKKGKQQASTSAEEPDEPPLSPTSEKIRQQRLVEEADFKSTTELFAKKGGDQKSLDTFIPKSESDFAEYAELIANKLRPYEKSFHYMGLLKNVMRLSMTPLKG

SEQ ID NO: 21643 - DNA, 716 bp, Panicum virgatum
  misc_feature: Ceres CLONE 1817250
  misc_feature: Encodes the peptide sequence at SEQ ID NO. 21644
gtgagccgcacgcacgcgcgcgcgcacagcctccgcgttccaccggcaagtcaactccgccggccagcgccgccgcggcgcagagttgcgggcggtttcggggccccgggccgggccgggccggacgggatgcagtcgctgcaggacaaggcgtcggagtggagcggcgtggcggccgccgacgccttcgccatcgacgacggcaacatcttcgaggccctcggcggcaccccgcagcccttcgtcgacctctccaccaacttctacaccagggtgtacgaggatgaggaggagtggttccgcgagatattcgcggggtcgaagaaggaggacgccatccagaaccagtacgagttcctgatccagcgcatgggcggcccgccgctcttctcccagaggagaggacatcctgcccttataggacgacatcgaccattcctggtaacccaccgagctgcagagcggtggctgcaccacatgcggcaagctttggatacaactgaaagcatagatgctgactcaaaaaccaaaatgatgaactttttcaggcacactgcttacttcctcgttgctggcaatgagatgacaaggcaacagagccaaggagtagcctgcaaacatgcaacaagcaaaccagctgagtaacccattctagccttggagctggtaagtggtaaccatgtgaataacgaatgatggaagcctttgcccactgc

SEQ ID NO: 21644 - protein, 171 aa, Panicum virgatum
  misc_feature: Ceres CLONE 1817250
  misc_feature (26)..(146): Pfam Name: Bac_globin Pfam Description: Bacterial-like globin
MQSLQDKASEWSGVAAADAFAIDDGNIFEALGGTPQPFVDLSTNFYTRVYEDEEEWFREIFAGSKKEDAIQNQYEFLIQRMGGPPLFSQRRGHPALIGRHRPFLVTHRAAERWLHHMRQALDTTESIDADSKTKMMNFFRHTAYFLVAGNEMTRQQSQGVACKHATSKPAE

SEQ ID NO: 21645 - DNA, 1050 bp, Panicum virgatum
  misc_feature: Ceres CLONE 1817254
  misc_feature: Encodes the peptide sequence at SEQ ID NO. 21646
gaaacaaacgcatcgcttgcttccgccttccaacctcctcttcccccaccccaccgcccgattcccgaggcggtcgccgcccccgccgttgtccccccgccctcgggggagacgacgtagcccgccgcggcaggctccaccggcgatcggcaggatggtggtggccacggaggaaatggcggtctactgcttcgacaccctcgtcgcccacttcaccggcgaccagccgccgccccccgccttcgaggacggcaaccacccattgtttgtgacctggaagaaggctaccaatggttcagaaccacgcctccggggatgcataggaaccttggagccccggcaaattgtcagtggctttaaggactatgcattaactagtgccctgagggaccggcgcttccccccgatacaatcaaaggaactgccaaccttggagtgcgcagtatctatactgactgattatgaaactgcagagggctacctcgattgggaggttggaaagcatggtttaatcattgaatttacagacccagactataacataagatgcagtgcaacctatttacctgaggttgccagccatgaaggatggggacacatagagactattgacacgctgatgaagaaggcaggttaccatggtgccatcactgaatccttgaggaagaaactccgtgtcacccgctaccagagcaccctatacaccatgcactacagtgaatatgttgcatatgtcaagaagaatagaggtgcagccccgacaattaatggggtgcctgtagttaatggcttcaagccaggccattgatttatccatattgcaaaagctgaaagaacagtttataatttatctaggagcaattggggtgataacttgtttaaagagttcccacccctcatagctcattgatctagcaccatctcatcccaaggaaaggggggcgccataccaacatgtccccaagaataatgtcttcctgtgatggatggtgcttatgtatctttgaatacttgcttcaacaagtgcaaattgtctggtgaaattaattc

SEQ ID NO: 21646 - protein, 217 aa, Panicum virgatum
  misc_feature: Ceres CLONE 1817254
  misc_feature (4)..(187): Pfam Name: AMMECR1 Pfam Description: AMMECR1
MVVATEEMAVYCFDTLVAHFTGDQPPPPAFEDGNHPLFVTWKKATNGSEPRLRGCIGTLEPRQIVSGFKDYALTSALRDRRFPPIQSKELPTLECAVSILTDYETAEGYLDWEVGKHGLIIEFTDPDYNIRCSATYLPEVASHEGWGHIETIDTLMKKAGYHGAITESLRKKLRVTRYQSTLYTMHYSEYVAYVKKNRGAAPTINGVPVVNGFKPGH

SEQ ID NO: 21647 - DNA, 2015 bp, Panicum virgatum
  misc_feature: Ceres CLONE 1817258
  misc_feature: Encodes the peptide sequence at SEQ ID NO. 21648
gtccgcctctctctcgctccccttcctgcccgtcctctcccctccctccgtgggcggagtccccttccccgcccccaaatcaccccttcccgaagcacagcacagcaccggcagcgcgcgggaggagaggaggggggaggcggcgggtcgggcgagatgagcgactccttctgcccggactgcaagaagcagacggaggtggcgttcgaccactcggcgggggacacggtgtgcaccgagtgcggcctcgtcctcgaggcgcactccgtcgacgagacctccgagtggcgcaccttcgccaacgagtccaacgacaacgaccccgtccgtgtcggcgggcccaccaacccgctcctcaccgacggcggcctctccaccgtcatcgccaagcccaacggcgcgcagggcgagttcctctcctcgtcgctcggcaggtggcagaaccgcggctccaaccccgaccgatccctcatcctcgccttccgcaccatcgccaacatggccgacaggtttctcctcacctcccgccccctcgcgctccaatcctccccttccttactctccccggttcgattcgatcaaattatgctgtggcgctggtgggtgcgccgatttctaggatataccatgggattgatcgtctgtgcttgtgtgacgctgcctgatttgggttttaggcgatggatttagatgtcgcgagcactgtgatgacgggtttcagggttggttacgcctgctgggtctagatttggaacgtctgattgatgagtagacgcctagtgcttgctatattgtgcctgggtcaggtgctgaatgattttcacttggatctacggaaatttcgtaattccttaacctgggaatcaatctaataccattagtttcaacagggaatgccaaaacttcagtttttatctggcacacaataggctctagtaaaatagatggcctgcttgcacctctgcatcatcatgctatgcagggtaaagcatcgacaagttgatcatgatagcatgtaggagtagtacctatacctgaggcatgtgatgtggcctagtgaaggatcattctagagtggggcatttatatagtaaaaaaaattgcaacatgtttctgatttgggtgaataaatgtgcattgctcaaagttgtgtgcatcagtaatttgatttactgaagttgtgtggacctttacctttgtaacatctggatttctacaatatgctaacatcaatgatctgtcttcttcaggttgggtcttgtggctactattaaggaccgagccaatgaaatctacaagaaggttgaagatctcaagtctatcaggggaagaaatcaagatgccatattagctgcttgtctgtatattgcttgtagacaagaagataggcctagaactgtgaaagaaatatgttctgttgctaatggagccacgaagaaagaaattggccgagcaaaagaatttatagtgaaacagctggaagttgagatggggcaatctatggagatgggaaccattcatgctggagattttctgaggcgtttctgttcaactcttgggatgaacaatcaagctgttaaagcagcccaggaggcagttcagcgctcagaggagcttgatataaggaggagccctatctcaattgcagcagcggtaatttatatgataacccaactctcagaggacaaaaagccacttaaagatatttccttggctactggtgtggcagaaggcaccatcagaaattcatacaaggatctgtatccctatgcttcaaggcttatccctaacacctacgccaaggaggaagacctaaagaatctctgcacaccttaggaaacctttttctttttcattgttacataagtcggaattagatttgtcaaagaagagtgagtgatgttgtccctggtgactgtactggtccctggttaactttatgtgggcatgagaacaaatgttgtcctcatcagatggaatttctttccagtaatgccaagtttcgtacattatct

SEQ ID NO: 21648 - protein, 177 aa, Panicum virgatum
  misc_feature: Ceres CLONE 1817258
  misc_feature (4)..(47): Pfam Name: TFIIB_Zn_Ribbon Pfam Description: TFIIB zinc-binding
  misc_feature: Useful for making plants with altered terpenoid content
MSDSFCPDCKKQTEVAFDHSAGDTVCTECGLVLEAHSVDETSEWRTFANESNDNDPVRVGGPTNPLLTDGGLSTVIAKPNGAQGEFLSSSLGRWQNRGSNPDRSLILAFRTIANMADRFLLTSRPLALQSSPSLLSPVRFDQIMLWRWWVRRFLGYTMGLIVCACVTLPDLGFRRWI

SEQ ID NO: 21649 - DNA, 1878 bp, Panicum virgatum
  misc_feature: Ceres CLONE 1817264
  misc_feature: Encodes the peptide sequence at SEQ ID NO. 21650
gaaaaattgaacacaccgaaagctcccggacgggaagacgacttggcgctggtgctgccgcgagatctaaccaaaccccgcgccctcctcaccgtccggcgagccccgggggacccctgcagatcaccggcgctcgagtgacacccagaggcgcgcggtggaaccggcgccgagataagggcggtgccagacgctcgggccgcgggcgcgcgggcgggcgacgatgtcggtggcggcgtcggccatctacttcctcaacctccgcggggacgtcctcatcaaccgcctctaccgcgacgatgtcgggggaaatatggttgatgcgttcaggatgcatattatgcaaacaaaagaacttggcacatgccctgttcggcaaataggaggctgttccttcctttacatgaggatcagtaatgtttatattgtgattgtggttagcagcaatgctaatgttgcttgtgctttcaagtttgtagtcgaggcagtggctctcttcaagtcctactttggtggagcttttgatgaagatgccatcaggaataactttgttttaatatacgaacttcttgatgagattatggattttggttatcctcaaaatctgtcacctgaaatcttgaagttgtatataactcaagaaggcgtcaggtcaccattttcctccaaggcctcagacaagcctgttccaaatgcgacccttcaagtcactggtgctgttggttggagaagagagggtcttatgtacaagaagaatgagattttcttggacatagttgagagtgtaaaccttctaatgtcttcgaaagggagtgttctgcgatgtgatgtgacaggaaagattcttatgaagtgcttcctttctggaatgcctgatctgaagctgggattaaatgacaagattgggcttgaaaaggaagcccaactgaagtccaggccttcaaagagtggaaagaccatagaacttgatgatgtcacattccaccagtgtgtcaacttaacaagatttaactcagaaaagacagtcagctttgtgccaccagatggtgaatttgaattgatgaagtaccgaatcacagagggtgtcaaccttccattccgtgttcttccgacaattaaggaattgggtcgaacgcggatggagattaatgtgaaagtcaagagtgtttttggtgctaagatgttcgcactaggtgtcgttgtcaaagtaccagttccaaagcagacagcaaagactagcttccaaacaacatcaggcaaagcaaaatacaatgcttcgattgattcactggtgtggaagatcaggaaattccctggacagactgaggcaactatgagtgcagaggttgagttgatctctaccatgggtgaaaagaagtcatggaacagaccacctattcagatggaattccaggttccaatgttcactgcttctggtctacgtgttcggttccttaaggtctgggagaagagcggttacaacactgttgagtgggttcgctacatcacgagagcaggatcttacgagataaggtgttagtgacagataaaatctttcaagctcaattgaacagttatttcaaggatccacagaggtcgtcatgcatgattataaagcacgtatactgtgacacaactatcttcaaaccttgtacttaagcagagggggcaggccagggcagaccagacagttttcctttatgttcttctattcactgtagtctgggatatctattctcccccctcgtgccctgtttgtttggtagggagtgtattttttgtttgtatatttggcggtagcgttccttgttgatacacacccccttatcagtttgtactgtttttcgtgttaaatggatgagtggtttcacttggcac

SEQ ID NO: 21650 - protein, 438 aa, Panicum virgatum
  misc_feature: Ceres CLONE 1817264
  misc_feature (166)..(438): Pfam Name: Adap_comp_sub Pfam Description: Adaptor complexes medium subunit family
MSVAASAIYFLNLRGDVLINRLYRDDVGGNMVDAFRMHIMQTKELGTCPVRQIGGCSFLYMRISNVYIVIVVSSNANVACAFKFVVEAVALFKSYFGGAFDEDAIRNNFVLIYELLDEIMDFGYPQNLSPEILKLYITQEGVRSPFSSKASDKPVPNATLQVTGAVGWRREGLMYKKNEIFLDIVESVNLLMSSKGSVLRCDVTGKILMKCFLSGMPDLKLGLNDKIGLEKEAQLKSRPSKSGKTIELDDVTFHQCVNLTRFNSEKTVSFVPPDGEFELMKYRITEGVNLPFRVLPTIKELGRTRMEINVKVKSVFGAKMFALGVVVKVPVPKQTAKTSFQTTSGKAKYNASIDSLVWKIRKFPGQTEATMSAEVELISTMGEKKSWNRPPIQMEFQVPMFTASGLRVRFLKVWEKSGYNTVEWVRYITRAGSYEIRC

SEQ ID NO: 21651 - DNA, 987 bp, Panicum virgatum
  misc_feature: Ceres CLONE 1817268
  misc_feature: Encodes the peptide sequence at SEQ ID NO. 21652
ctccagcctcagcctcgccgtttatacacgcctctcccctccccaacaccttcctctccgcgcccgcttcctccatcctccgttcgctgccctccctctctccgccgattcggagctcggcgaatttggacactgcgcggcgcggcgacgtcggcccctcccctccacgaagaatcctgcgcgggctcctgccgcacctcgggccccggctgggcgaaatggaaggtgtggtcgtgaggagggtgatcccttcggacaacagctgcctcttcaatgccgtgggttacgtgatggaacataaccggaataaggcttctgagctcagacaggttatagcagcagcagttgctagtgatcctgtaaagttcaatgaagtgtttcttggcaaaccgaatgaagcatattgtgcttggattctggatcccgaaaagtggggaggagccattgagctctctattctatcggaatattacgggcgtgaaattgctgcatatgacattcagaccacccgctgtgatctatatggtcaggagaagaattataatgaaagggtcatgctcatttatgatgggttgcattatgatgctctggctatgtctccagctgaaggagcaccagaagaatttgaccagacaatattcccaatcaaccataatcgttcaattggtccagcagaaggccttgctctcaacttagtgagggaggcacagagaaagaggagctatactgacactgcaaacttcactttgcgctgtggggtgtgccagattggcgtcattggtcaaaaggaggccgtcgaacatgcgcaagccactggccatgtcaacttccaagaatacaaatgacagtagaagataagactggttctgttgtaaacttatcatttgttcatcaatttgatattcttcttctgttggatatggttggcactttgtatcacaatgtatttgtcacagggaaaacataataatactgtgtttgttccgg

SEQ ID NO: 21652 - protein, 208 aa, Panicum virgatum
  misc_feature: Ceres CLONE 1817268
  misc_feature (11)..(121): Pfam Name: OTU Pfam Description: OTU-like cysteine protease
MEGVVVRRVIPSDNSCLFNAVGYVMEHNRNKASELRQVIAAAVASDPVKFNEVFLGKPNEAYCAWILDPEKWGGAIELSILSEYYGREIAAYDIQTTRCDLYGQEKNYNERVMLIYDGLHYDALAMSPAEGAPEEFDQTIFPINHNRSIGPAEGLALNLVREAQRKRSYTDTANFTLRCGVCQIGVIGQKEAVEHAQATGHVNFQEYK

SEQ ID NO: 21653 - DNA, 1078 bp, Panicum virgatum
  misc_feature: Ceres CLONE 1817335
  misc_feature: Encodes the peptide sequence at SEQ ID NO. 21654
atcatatccgagtcacaaacgcacacacccacccctagcagcgacagaaatggctcaatcctatctcctgctcctcctctttctgctcgtgttcctcacctccacctccggctcgcgatccatggcgcaggccaccgatcaagaaacactcctaacaatcaagaaagactggggcagcccatcggcactcagctcatggaatcccatcaacgctccttccaactgcagctgggcaggcgtcagctgcaacaacaatggccaagtgaccaagctatccttccagaatctcaacataaccaatccgatcccgttctcggtggtcgccggcgtcatcctcatgggcgccgtcgggtgcctcgtcatccggcgaaggacgcgccggcgcgacctgacgacgtggaaggtaacgccgttccgcaaggtggacttcaccgagatcgacatactcggcaagctccgcgaggagaacgtgatcggcagcggcggctccggcaaggtgtaccgcgtccacctcggtggccgcggcggcgcgtcggcggccgtgaagaagctgtggggcaggggcaaggccgaggagaagctggacagggagttcgactcggaggtgaggatcctgggcgagatccggcacgccaacatcgtgagcctcctctgctacatctccagcgaggacaccaagctgctggtgtacgaatacatggagaacggcagcctcgaccggtggctgcacccgcgggacccggccggcgcggcggcggcgctggactggccgacgcggctgggcatcgccatcgacgcggcgaggggtctgagctacatgcaccacgagtccgcgcagcccatcatgcaccgggacatcaagtccagcaacatcctgctcgacccgggcttccgcgccaagattgccgacttcgggctcgcccggatcctggtcaagtccggcgagctggagtccgtgtccgccgtcggcggcgacatcacttattaattgcgagtgtgttagaaatgaagcttatacacttaacgctattaaattaaagtacttaggctacccagttttaagctagggtgggcaggc

SEQ ID NO: 21654 - protein, 288 aa, Panicum virgatum
  misc_feature: Ceres CLONE 1817335
  misc_feature (112)..(286): Pfam Name: Pkinase_Tyr Pfam Description: Protein tyrosine kinase
  misc_feature (3)..(43): Pfam Name: LRRNT_2 Pfam Description: Leucine rich repeat N-terminal domain
  misc_feature: SWISSPROT Homolog: EC 2.7.11.1 Non-specific serine/threonine protein kinase
MAQATDQETLLTIKKDWGSPSALSSWNPINAPSNCSWAGVSCNNNGQVTKLSFQNLNITNPIPFSVVAGVILMGAVGCLVIRRRTRRRDLTTWKVTPFRKVDFTEIDILGKLREENVIGSGGSGKVYRVHLGGRGGASAAVKKLWGRGKAEEKLDREFDSEVRILGEIRHANIVSLLCYISSEDTKLLVYEYMENGSLDRWLHPRDPAGAAAALDWPTRLGIAIDAARGLSYMHHESAQPIMHRDIKSSNILLDPGFRAKIADFGLARILVKSGELESVSAVGGDITY

SEQ ID NO: 21655 - DNA, 843 bp, Panicum virgatum
  misc_feature: Ceres CLONE 1817346
  misc_feature: Encodes the peptide sequence at SEQ ID NO. 21656
accgaccaaggaagaggggaacgaacagtgcccagctgccgacgagccccgagcgcggcgcgcgagggagagacagagagggccttcccgttcgcgacagaggagtggaggcggaggcagcgaggggtcggagatgaacgtgttccggctcgcgggggacatgacccacctcctcagcgtggtggtgctgctcctcaagatccacaccatcaagtcctgcgcaggtgtatctctgaagacgcaggagctgtacgcacttgtttttgcagctcggtacctggacttgtttgttcattttgtgtctctgtataacacagtcatgaagctggtcttcttggcaagctctttctcaatagtttggtacatgaggaagcataagattgtgcagagaacctacaacaaggatcatgacacctttcgccattactttttagtgttgccttgtcttcttctggctctaatcatcaatgagaagtttacttttagagaggtgatgtgggcattctccatttatttggaagctgtcgccatatttccacaacttgtactgctacagcggacaaggaatattgataacttgactggccaatatgtcttcttcttgggtgcataccgcattctttacatccttaactggatataccgctacttcactgagccccattttgttcactggataagctgggttgcaggaattgtgcaaactctattgtatgctgacttcttctactattatataatgagttggaagaacgatgtgaagctagagcttcctgcttaagctctgttgttcgcttccaaaatacacaatggaaatagctggtaatataacggataggaaga

SEQ ID NO: 21656 - protein, 215 aa, Panicum virgatum
  misc_feature: Ceres CLONE 1817346
  misc_feature (1)..(205): Pfam Name: ER_lumen_recept Pfam Description: ER lumen protein retaining receptor
MNVFRLAGDMTHLLSVVVLLLKIHTIKSCAGVSLKTQELYALVFAARYLDLFVHFVSLYNTVMKLVFLASSFSIVWYMRKHKIVQRTYNKDHDTFRHYFLVLPCLLLALIINEKFTFREVMWAFSIYLEAVAIFPQLVLLQRTRNIDNLTGQYVFFLGAYRILYILNWIYRYFTEPHFVHWISWVAGIVQTLLYADFFYYYIMSWKNDVKLELPA

SEQ ID NO: 21657 - DNA, 697 bp, Panicum virgatum
  misc_feature: Ceres CLONE 1817359
  misc_feature: Encodes the peptide sequence at SEQ ID NO. 21658
aaccactctagctccgagacaaagaagtagcccagttagctctagccagagaggcgtacgttacgttatcgccatgtctccggttgcaagtgaaggaatggctaatggcgcggcggcagtggcggcggcggccatggcggccgccgtcgctctgctgtgcctccagctgccggcggtggcccagggccagctgcaggtggggttctacaacacgagctgccccaacgccgagtccctggtccggcaggcggtggccaacgccttcgccaacgactccggcatcgccgccggactcatccggctgcatttccacgactgcttcgtcaggggctgcgacgcgtcggtgctgctgacctccccgaacaacacggcggagcgcgacgcggcgcccaacaacccgagcctccgcgggttccaggtgatcgacgccgccaaggctgcggtggagcagagctgcccgcgcaccgtctcctgcgccgacatcgtcgccttcgcggcccgtgatagcatcaacctcacgggcaacctcccgtaccaggtgccctcgggccgccgcgacggcaacgtctctctcgacaccgacgccctcaacaacctgcccccgcccaccttcaacgcgtcgcagctcgtcgcccactttgccgccaagaacctcaccgccgaggagatggtcatcctctccggagcccacaccgtc

SEQ ID NO: 21658 - protein, 207 aa, Panicum virgatum
  misc_feature: Ceres CLONE 1817359
  misc_feature (56)..(207): Pfam Name: peroxidase Pfam Description: Peroxidase
  misc_feature: SWISSPROT Homolog: EC 1.11.1.7 Peroxidase
  misc_feature: Useful for making plants with altered carbohydrate content
  misc_feature: Useful for making plants with altered cell wall content and/or composition
MSPVASEGMANGAAAVAAAAMAAAVALLCLQLPAVAQGQLQVGFYNTSCPNAESLVRQAVANAFANDSGIAAGLIRLHFHDCFVRGCDASVLLTSPNNTAERDAAPNNPSLRGFQVIDAAKAAVEQSCPRTVSCADIVAFAARDSINLTGNLPYQVPSGRRDGNVSLDTDALNNLPPPTFNASQLVAHFAAKNLTAEEMVILSGAHT

SEQ ID NO: 21659 - DNA, 1894 bp, Panicum virgatum
  misc_feature: Ceres CLONE 1817363
  misc_feature: Encodes the peptide sequence at SEQ ID NO. 21660
gttgctttgctctctcgcctacccacccaccctctcatggttctcatcgcttgctctctccgccgctcgcgccccgcgggtcaaatccccccaaattggaattgagaatcccctagggccgaggagtacgcgccagctccgctgcccgctgctgacccccggcgccaggcggcgggacgcgtctgcctccgaggatcgaggttgatggcgagggacccggacgcggcggcgcggcggcgctggactctggtgctggtgaacttggcgtccgtgctggagaaggcggacgaggtgctgctccccgccgtgtaccgggaggtgggcgccgcgctgggcgcctccccgacggcgctcggatccctcacgctctgccgcgcgctcgtccaggccgcctgctacccgctcgccgcgtacgcctccgcgcgccacgaccgcgcccgcgtcgtcgccgccggggccttcctctgggccgccgccaccttcctcgtcgccgtctccggcaccttcctccagatggccatctcgcgggggctcaacggcatcggcctggcgctggtcctcccggcgatcagctccctcgtcgccgactacaccgacgaccacacgcgcggcgccgccttcggctggctccagatgacctgcaacctgggctccatcctgggcggagccttcggcgtgctgctcgcgcccgtcaccttcctcggcgtcgccgggtggcggctcgccttccacgccgtcgcgggcgtcagcgtcgcgctgggcgcgctcatgtggctcttcgccgccgacccgcgcgccaagtcaaagaccgccgcttcggcgggggaagaagccagggagctgctccgggacgccaggcgcgtcctcggcgtgcccacgttccagatcatcgtggcgcaggggatcgcggggtccatcccctggtccgcgctcaacttctccgccatgtggctggagctcgtggggttcacgcactgggagaccagcgtcatcacggggctctacctcttcgccacggccctcggcgcgctcttcggcggcatcgtcggggaccccgtcgccaggcgctttcccaacgccggcaggatcgcgctagcgcagatcagctccgcgtcggcgctcccgctcggcgccatcctgctgctcgcgctgcccaacgacccgtccaccggcgtcgcgcacgccgtcgtcttcttcgtcatgggcttcgccatctcctggaacgccccctccaccaacaaccccattttcgcggagattgtgccggagaaggccaggacgacggtctacgcactggacaagtgcttcgaagccgtgttcgcgtcgtttgcgcctcccatcgttggagtccttgcagagcgcgtgttcggctacaagcctgtctcttccgacacgtgcgtggacacggacagagagaatgcggccgcactggccaaggcggtttacacggagatcgccgtgcccatggccatctgctgcctgacctacaccttcctctactgcacgtacccgcgagacagggagcgtgctcggaaggagcttctggtggcgtcagctgaccagctcggtgaggaaggcagtgacagtgcgccgagtgcggttcgcccactgggagatgaagaatcttctgccagatccttaaatcagaggctaatttccagaggagagtagcaggcgaaaggcaggtcgggaagcgcaagacagccaattttacggctttgtatcgtttcccagatgatgtaaatcctggtgctgctcgcctgctcttcagtttcagattcatcctgtggatagactcgatctgactcgtcggaactatttaccaggccagctaccaatggagtgaaatgtactcagtggatgcaattctaaatctattcaaatgttgttgtgc

SEQ ID NO: 21660 - protein, 488 aa, Panicum virgatum
  misc_feature: Ceres CLONE 1817363
  misc_feature (15)..(377): Pfam Name: MFS_1 Pfam Description: Major Facilitator Superfamily
MARDPDAAARRRWTLVLVNLASVLEKADEVLLPAVYREVGAALGASPTALGSLTLCRALVQAACYPLAAYASARHDRARVVAAGAFLWAAATFLVAVSGTFLQMAISRGLNGIGLALVLPAISSLVADYTDDHTRGAAFGWLQMTCNLGSILGGAFGVLLAPVTFLGVAGWRLAFHAVAGVSVALGALMWLFAADPRAKSKTAASAGEEARELLRDARRVLGVPTFQIIVAQGIAGSIPWSALNFSAMWLELVGFTHWETSVITGLYLFATALGALFGGIVGDPVARRFPNAGRIALAQISSASALPLGAILLLALPNDPSTGVAHAVVFFVMGFAISWNAPSTNNPIFAEIVPEKARTTVYALDKCFEAVFASFAPPIVGVLAERVFGYKPVSSDTCVDTDRENAAALAKAVYTEIAVPMAICCLTYTFLYCTYPRDRERARKELLVASADQLGEEGSDSAPSAVRPLGDEESSARSLNQRLISRGE

SEQ ID NO: 21661 - DNA, 624 bp, Panicum virgatum
  misc_feature: Ceres CLONE 1817365
  misc_feature: Encodes the peptide sequence at SEQ ID NO. 21662
acggacggaggcgacggcgatggcgcggcattgccagggtcacatcgcgcactgcctcggcggcctcctcacccgccgcggcggtgccaccgtcgctgcggactcaggcggtcgcagcatcaccggcgcggagttcgtcgacggcgtgcacaggctggccgtggggctcatcggcagcggggtgcgccccggcaacgtcgtcgccaccgtcgccttcaacagcatcgagtacgtcgagctgttcctcgccgtggcacacgtcggagcaatcatcgcccctctcaactaccgctggagctttgaggaggcggcgcaggcgctggagctcgtggagccgatggcgttcatctttgacggcgtcttcagctcttgggccctccggctgacggacagcaacaagtattcgtccattggcctctacatcattctgggggacgcttgcagcacaggccatgctgcaaactttggatcagttgatcacatcaagagaagcgtgagaggacctatagcgacagagcccatatccgctccaagggatgttgctttgatatgcttcacatctggtactactgggcgaccaaagggtgtagcgataagccatacatctttgatcattcaatccct

SEQ ID NO: 21662 - protein, 201 aa, Panicum virgatum
  misc_feature: Ceres CLONE 1817365
  misc_feature: SWISSPROT Homolog: EC 6.2.1.12 4-coumarate--CoA ligase
MARHCQGHIAHCLGGLLTRRGGATVAADSGGRSITGAEFVDGVHRLAVGLIGSGVRPGNVVATVAFNSIEYVELFLAVAHVGAIIAPLNYRWSFEEAAQALELVEPMAFIFDGVFSSWALRLTDSNKYSSIGLYIILGDACSTGHAANFGSVDHIKRSVRGPIATEPISAPRDVALICFTSGTTGRPKGVAISHTSLIIQS

SEQ ID NO: 21663 - DNA, 675 bp, Panicum virgatum
  misc_feature: Ceres CLONE 1817404
  misc_feature: Encodes the peptide sequence at SEQ ID NO. 21664
ctcaggtcgctgtcctcagcccaaacgtgccggcgatgtacgagctgcacttcgccgtgcccatggcgggcgcggtcctctgcacgttcaacacgcggcacgacgcggccatggtgtccgccctgctcaagcactccggcgccaaggtgttcctcgtcgagtcgcacctcctcgacgtcgggagagccgcgctgaagcgcctcgccgattccagcgccgccgccctcccggttctcctcaccatctcggacgacgccgagtccgacgattatgaggatctcgtcaggaacgcccccgcgcggttcgacatccggtggccggcgagcgagctggacccgatctcgctcaactacacgtctggcacgacgtcgcggcccaagggcgtggtctacaaccaccgcggcgcgtacctcaacaccatcgccaccgtcctcgcgtacgacatcaccgccatgcccacctacctgtggaccgtgcccatgttccactgcaacggctggaacctcccgtggggcgtcgcgatgcagggcggcaccaacatctgcctccgccacttcacggccaaggtcatcttcgacagcatcgcgcgccacggggtcacgcacatgggcggcgctccgaccgtgctcaacatgatcgccaacgcgcccgccgcggaccgcaagccgctgccgg

SEQ ID NO: 21664 - protein, 224 aa, Panicum virgatum
  misc_feature: Ceres CLONE 1817404
  misc_feature: SWISSPROT Homolog: EC 6.2.1.12 4-coumarate--CoA ligase
QVAVLSPNVPAMYELHFAVPMAGAVLCTFNTRHDAAMVSALLKHSGAKVFLVESHLLDVGRAALKRLADSSAAALPVLLTISDDAESDDYEDLVRNAPARFDIRWPASELDPISLNYTSGTTSRPKGVVYNHRGAYLNTIATVLAYDITAMPTYLWTVPMFHCNGWNLPWGVAMQGGTNICLRHFTAKVIFDSIARHGVTHMGGAPTVLNMIANAPAADRKPLP

SEQ ID NO: 21665 - DNA, 1041 bp, Panicum virgatum
  misc_feature: Ceres CLONE 1817412
  misc_feature: Encodes the peptide sequence at SEQ ID NO. 21666
gacgcgcctctcgctcctcgctttctcccctctctctgccccgccctcttctccggcgaggcaatcagccctgcccgcgtgaagcacacgcgccgatccggggaggggcatccgatccgatccgttccccgtgcccgcggcgccgatggagaaggtgaagaacctgctgaagccgcggccgactccgcagcagcagctgcgcgagtggcagcgccgcctccgcaacgagtgccgcgtcctcgaccgccagatccgagatgtgcagagggaggagaagaatgtggagaaagccatcagggaggctgccaagcgcaacgacatgggatctgcaaaggcacttgctaaggaacttgtgcgatcaagacgtgctgttaatcgtctttatgaaaacaaggcccagctgaactcagtatcgatgcacctcggagaaattgttgcaactgcaagaacagtgggccatctgtccaagagtgctgaagtgatgaaaattgttaataatctaatgaaagctccagagttggctgccactatgcaagaatttagcaaagaaatgacgaaggctggtgtgatggaagagatggtgaatgaagctgttgattcagctttggactctgaggacatggaagaggaaattgaggaggaggtcgacaaggttcttgcttcggtagcaggggagactgcatcccagctaccagatgctgccaggacacagaagatacagcaagcttcaacaagcaaggttccagaagagcgacaagctgttgctgagggtgttgatgacgacgaggaagacctagaagagatcagggcccggcttgccaaagtgaggtcgtaaaccatgcatccccgaggcatctaacttccagagtccatgatctaggcagccaaaccgttgtatgtcaaattgggttgatgaatgatgatggttgtttccctcttgaccccgcaaggtattgttgtacagtaagcaatgtgatgtgaacagcgacttcttgttgctgatttggtctgagattgaagatttagcacagaaaaaaactg

SEQ ID NO: 21666 - protein, 229 aa, Panicum virgatum
  misc_feature: Ceres CLONE 1817412
  misc_feature (20)..(190): Pfam Name: Snf7 Pfam Description: Snf7
MEKVKNLLKPRPTPQQQLREWQRRLRNECRVLDRQIRDVQREEKNVEKAIREAAKRNDMGSAKALAKELVRSRRAVNRLYENKAQLNSVSMHLGEIVATARTVGHLSKSAEVMKIVNNLMKAPELAATMQEFSKEMTKAGVMEEMVNEAVDSALDSEDMEEEIEEEVDKVLASVAGETASQLPDAARTQKIQQASTSKVPEERQAVAEGVDDDEEDLEEIRARLAKVRS

SEQ ID NO: 21667 - DNA, 1164 bp, Panicum virgatum
  misc_feature: Ceres CLONE 1817425
  misc_feature: Encodes the peptide sequence at SEQ ID NO. 21668
accgcagccgggtcctctcttccccccccgccacccctctcttccgcgccgtaggcgctcccccgccgatcgcccttctgccctgcggaggcgtgattgctggagatccatcgatctggagttggattggcctcatctttcttggcacgaagattttgccaagatcgtcaacattgtggaaatgggaggtgtaatcggtggtgagtcgccaaggaacagttccccggcatcaaagttagagaggaagatggttgaggcaatgcagcagagggcattgaaaggaacttctgtgaaatcgttcaacagtgtcatcatgaaattccctaaaattgacgagagcttgagaaactgcaggaccatctttcagcaatttgatgaagattccaatggtgaaatagatcaacaggaactcaagcactgtttccagaaattgggtatcgaatctactgatgatgaaataaaagatctgtttcaggcatgcgacatttatgaacacatgggcatgaagttcaatgaatttattgtcttcctgtgccttgtttatcttctcaatgatcctgcggtgtctgaagcaagaaaaagaatgggattaggctgtcttgagccaacattcgagacattggttgagtcatttgtcttcttggacaagaacaaagatggttacgtcagtaagaacgagatgatacaagcaataaacgagaccagtgcaggagaacgctcctctgggcgcataggcgtgaaaagatttgaggaaatggattgggacaagaatggcacagtgaccttcaaggagttcctcttcgcttttactcgctgggtggggatcgacaatgaggacgaagatgacgacgacgaagatgaatgagcgtgtcaacaactgaagattaggcgatctgaattggccatatcagccctcaggaggcctccagaagcttcctcctcgacgagtactatatgacagtcaaaagtagctgttcatatttccttggtgtctagctgatggtagatgcttaagttcgtattaatagagtgaacccgagttgtttctagtcgtggcaagaatttgctgataaaagagttacattgttgagatgatgttcagttaggttaccctgttattcagatgtttggaacctgttaagaaaatggagaattgctaaggtt

SEQ ID NO: 21668 - protein, 227 aa, Panicum virgatum
  misc_feature: Ceres CLONE 1817425
  misc_feature (56)..(84): Pfam Name: efhand Pfam Description: EF hand
  misc_feature (146)..(174): Pfam Name: efhand Pfam Description: EF hand
  misc_feature: SWISSPROT Homolog: EC 2.7.11.1 Non-specific serine/threonine protein kinase
MGGVIGGESPRNSSPASKLERKMVEAMQQRALKGTSVKSFNSVIMKFPKIDESLRNCRTIFQQFDEDSNGEIDQQELKHCFQKLGIESTDDEIKDLFQACDIYEHMGMKFNEFIVFLCLVYLLNDPAVSEARKRMGLGCLEPTFETLVESFVFLDKNKDGYVSKNEMIQAINETSAGERSSGRIGVKRFEEMDWDKNGTVTFKEFLFAFTRWVGIDNEDEDDDDEDE

SEQ ID NO: 21669 - DNA, 539 bp, Panicum virgatum
  misc_feature: Ceres CLONE 1817446
  misc_feature: Encodes the peptide sequence at SEQ ID NO. 21670
aaaccgcgcagcacaaaccccacgagccacgagagcactcccccccgggccgcgccagcacggcacgacacgccgccgccgccatggcgatccggatgagcaacaatgtgatcggcgcgctgaacgtggtggcgctgctgctctcggtccccgtcctcgccgcgggcgtctggctgcggtcccgcgccgacagcaccgggtgcgaccacttcctctccaccccgaccgtcgcgctgggcgcggcgctcgcggccgtctccctcgcggggctcgccggcgcctgctgccgcgccacctggctggtctggctctacctcctagccatgctcgcgctcgccgccgcgctgctctgcttcaccgccttcgccctcgccgatcaccagcaggggggccggggacgggggctggcacgactcagcctggctgcggcgccacgtcgagaggagcaggagctggagcagggtccggagctgcctcgccgacaccggcgtgtgcaagcgcctcgagaaggaaggcggcaagggcaaggaggaggagga

SEQ ID NO: 21670 - protein, 151 aa, Panicum virgatum
  misc_feature: Ceres CLONE 1817446
  misc_feature (5)..(129): Pfam Name: Tetraspannin Pfam Description: Tetraspanin family
MAIRMSNNVIGALNVVALLLSVPVLAAGVWLRSRADSTGCDHFLSTPTVALGAALAAVSLAGLAGACCRATWLVWLYLLAMLALAAALLCFTAFALADHQQGGRGRGLARLSLAAAPRREEQELEQGPELPRRHRRVQAPREGRRQGQGGG

SEQ ID NO: 21671 - DNA, 446 bp, Panicum virgatum
  misc_feature: Ceres CLONE 1817460
  misc_feature: Encodes the peptide sequence at SEQ ID NO. 21672
aagcctccgtccccctccccatttccctctttcctcttcctcgccggcgcccgcccccgcctcccccaaccccccgcacgccggccggagaattcctcccgacctggccttgagccaatccttttcctgcctcgtccgctaattgcgagttcctcccccgccgtcctgcggaaggcctggcgaggttcggatggagagtcggttcccaggtgcagagatggggtcggagcttcttccggggcttctcttctgcttcgattccgtctcagctggagcacacactattatcgacttggtttgaacgtctacgagaacttaactaaaatagggaagaatgtaggattcattggactcgggaatatgggatcccatatggcaaggaacctgattacggctggatataaagtgactgttcatgatataaatgaaaattcgatgaagaaatt

SEQ ID NO: 21672 - protein, 148 aa, Panicum virgatum
  misc_feature: Ceres CLONE 1817460
  misc_feature: SWISSPROT Homolog: EC 1.1.1.31 3-hydroxyisobutyrate dehydrogenase
KPPSPSPFPSFLFLAGARPRLPQPPARRPENSSRPGLEPILFLPRPLIASSSPAVLRKAWRGSDGESVPRCRDGVGASSGASLLLRFRLSWSTHYYRLGLNVYENLTKIGKNVGFIGLGNMGSHMARNLITAGYKVTVHDINENSMKK

SEQ ID NO: 21673 - DNA, 528 bp, Panicum virgatum
  misc_feature: Ceres CLONE 1817462
  misc_feature: Encodes the peptide sequence at SEQ ID NO. 21674
cgaggccaccaccatagtaaccgtcccccgggccaacactagcggctagcctagctaccttggtcgtgtacgtgcccccggccgcccggacgatctccatccatcccccatgtgcgagtgccaccaccgcgagtgctgcggctgcttcggctcctacagccgcttcgcgtgcggcttctgcatcggcctcgccctcgtcgccccggtcgccgtcctcatcgtcctcgtcgtcggctacggccacgccgcccagccccggttcgaggtcgaggacgcctcgctcgctcgcttcgcgcttaccgcgacgtctcccaccaccaccatctcctacaacctcacgctcacgctcgccgtgcgcaaccccaactgggccatgggcgccaccttccggtccctcgaggccgactacctcttcgacggccagcgcttcgaccgcgtcgacgtcgccgcgccgggctacgttctgcccgccaggaagaccgccgtgttccgcatcgccagcggcgccgacgaggcgagcgtcatgct

SEQ ID NO: 21674 - protein, 139 aa, Panicum virgatum
  misc_feature: Ceres CLONE 1817462
  misc_feature (45)..(138): Pfam Name: Hin1 Pfam Description: Harpin-induced protein 1 (Hin1)
MCECHHRECCGCFGSYSRFACGFCIGLALVAPVAVLIVLVVGYGHAAQPRFEVEDASLARFALTATSPTTTISYNLTLTLAVRNPNWAMGATFRSLEADYLFDGQRFDRVDVAAPGYVLPARKTAVFRIASGADEASVM

SEQ ID NO: 21675 - DNA, 1289 bp, Panicum virgatum
  misc_feature: Ceres CLONE 1817472
  misc_feature: Encodes the peptide sequence at SEQ ID NO. 21676
attcattcgaaatccctccctctctcctctctcatctcggccgcctcctcactttgccaaccatcgccgccgcaacagcaagagggcgggatcaggtcggccgagccggtcccattccgtcccctcttcagctgaggacaacataattccaagaccctgatgatggcgacagctggttatattgatgattcctgttctgagattattgatcccccaaagactgaggtactggatgttactgaactcactgacgaccatattcagcagccaccaaaaccaaatgtggtggtgtctagcagtgtgcgcgatcttctggaatgtccagtctgcttgagtgccatgtatcctcctattcatcagtgctctaatggtcatacattgtgctcgggatgcaaaccaagggttcataatcgctgtccaacttgtaggcatgaactgggtaacataagatgccttgctctcgagaaggtggctgcatctcttgaacttccatgcaagtaccagagctttgggtgctcaggcatatatccttactacagcaagctgaagcatgagtctcagtgccaatataggccttatagctgtccatatgctggatctgaatgcacagttgctggtgacattccgtacttggtaaatcacttgaaagatgaccacaaagttgacatgcacaatggctgcaccttcaaccatcgctatgtcaagccaaatcctcatgaagtcgagaatgccacctggatgcttacggtgtttagctgctttggccaatacttctgcctacactttgaagcctttcagcttggcatggcacctgtctacattgccttcctgagattcctgggagatgatgcagaagcaaagaactacagctacagcctggaggtgggaggcaccgggcgcaagatgatctggcaaggggtgccacggagcatcagagacagccaccgtaaggtccgtgacagctatgacgggctgatcatccagcggaacatggctctgtttttctcgggaggggacaggaaggagctcaagctgcgggtcactgggagaatctggaaggagcagtaggataatcaggtagccctcttcgtgctgtcctgaccacctgaggtcacaaatcacattagcaagagctgtagccgcatgcaggaaccgacgtttggtatttttatagcatgctctagtttgcttttgtcttttggcttctgtagcctggtgccggtggatgtagcatctcatgtaaaccaggacggtactgatgtagaattggtagagatctcttcgactcg

SEQ ID NO: 21676 - protein, 301 aa, Panicum virgatum
  misc_feature: Ceres CLONE 1817472
  misc_feature (95)..(294): Pfam Name: Sina Pfam Description: Seven in absentia protein family
MATAGYIDDSCSEIIDPPKTEVLDVTELTDDHIQQPPKPNVVVSSSVRDLLECPVCLSAMYPPIHQCSNGHTLCSGCKPRVHNRCPTCRHELGNIRCLALEKVAASLELPCKYQSFGCSGIYPYYSKLKHESQCQYRPYSCPYAGSECTVAGDIPYLVNHLKDDHKVDMHNGCTFNHRYVKPNPHEVENATWMLTVFSCFGQYFCLHFEAFQLGMAPVYIAFLRFLGDDAEAKNYSYSLEVGGTGRKMIWQGVPRSIRDSHRKVRDSYDGLIIQRNMALFFSGGDRKELKLRVTGRIWKEQ

SEQ ID NO: 21677 - DNA, 1410 bp, Panicum virgatum
  misc_feature: Ceres CLONE 1817475
  misc_feature: Encodes the peptide sequence at SEQ ID NO. 21678
cactcgtctgcctggacgaccccagccggaatcgatcgaccggtgcttttatccggcccttagcaagcgagctcaccaaccaccgccgctagctgccagccggagaggggaggaggaggaaaaggaaaggaggcggtggcatggggaggccgccgtgctgcgacaaggtgggagtaaagaaggggccgtggacgcccgaggaagacctcatgctcgtctcctacgtccaggagcacggccccgggaactggcgggccgtgccgaccaacaccgggctgatgcggtgcagcaagagctgcaggctgcggtggaccaactacctccggccgggcatcaagcgcggcaacttcaccgaccaggaggagaagctcatcatccacctccaggccctcctcggcaacaggtgggcggcgatagcgtcttacttgccggagaggacggacaacgacatcaagaactactggaacacgcacctcaagaagaagctcaagaagatgcaggccggcgaagggggcgggggagacgacgtcgcagctggtgcctcaggtccggacggcggcgacgccggcggtaagatcggggccggggccaggaagcgtccagacgtccccaaggggcagtgggagcggcggctgcagaccgacatccacacagcgcggcaggcgctgcgcgacgcgctctcgctggagccctcggcaacgccggctaaggtagcgcctccaccgactcctccggggtccacgacgtacgcgtccagcgctgagaacatcgcgcggctgctggaggggtggctgcgcccgccgggcggaggcagcgggggcaagggtccggaggcgtcggggtcgacgtccacgacggcgacgacacagcagcggccgcagtgctccggcgagggcgcggcgtccgcgtcggcaagccacagcggaggcgccgccgggaacacgtacacggccgcgcagacacccgagtactcgacggagacaagcaagatggcaggcagcgcggccggcgccggctccgcgccggtgttctcgatgctggagagctggctgctcgacgatggcacggggcacggcgaggtggggctcatggccgacgtggtgccactaggggaccccagtgagttcttttaatcaaggcccctgtacaagtacaaccaaaagcaagttaatcgagtagctagtaacatgcaagaacagaaggaagtaattgccgggttaggttactggttaagcagacattaaacaaaccaaatgtctctgaattctcggcgatttagatcgagttgggtgtcgatctagtctgtttaatcctttttttctgtttttttcgctgttgtttctcagatgttagggtttggaactgatatagtaagcttacactaatgacaggttcctaaatggaccatgc

SEQ ID NO: 21678 - protein, 330 aa, Panicum virgatum
  misc_feature: Ceres CLONE 1817475
  misc_feature (67)..(112): Pfam Name: Myb_DNA-binding Pfam Description: Myb-like DNA-binding domain
  misc_feature (14)..(61): Pfam Name: Myb_DNA-binding Pfam Description: Myb-like DNA-binding domain
  misc_feature: The sequence is a functional homolog of SEQ ID NO 794 in the 11/435,388 US patent application
  misc_feature: The sequence is a functional homolog of SEQ ID NO 726 in the 11/435,388 US patent application
  misc_feature: The sequence is a functional homolog of SEQ ID NO 1074 in the 10/412,699 US patent application
  misc_feature: The sequence is a functional homolog of SEQ ID NO 590 in the 10/374,780 US patent application
  misc_feature: The sequence is a functional homolog of SEQ ID NO 592 in the 10/374,780 US patent application
  misc_feature: The sequence is a functional homolog of SEQ ID NO 786 in the 11/435,388 US patent application
  misc_feature: The sequence is a functional homolog of SEQ ID NO 594 in the 10/374,780 US patent application
  misc_feature: The sequence is a functional homolog of SEQ ID NO 784 in the 11/435,388 US patent application
  misc_feature: The sequence is a functional homolog of SEQ ID NO 1075 in the 10/412,699 US patent application
  misc_feature: The sequence is a functional homolog of SEQ ID NO 591 in the 10/374,780 US patent application
  misc_feature: The sequence is a functional homolog of SEQ ID NO 1031 in the 11/479,226 US patent application
  misc_feature: The sequence is a functional homolog of SEQ ID NO 1804 in the 10/412,699 US patent application
  misc_feature: The sequence is a functional homolog of SEQ ID NO 2050 in the 10/374,780 US patent application
  misc_feature: The sequence is a functional homolog of SEQ ID NO 444 in the 10/412,699 US patent application
  misc_feature: The sequence is a functional homolog of SEQ ID NO 598 in the 10/225,066 US patent application
  misc_feature: The sequence is a functional homolog of SEQ ID NO 620 in the 11/435,388 US patent application
  misc_feature: The sequence is a functional homolog of SEQ ID NO 1072 in the 10/412,699 US patent application
  misc_feature: The sequence is a functional homolog of SEQ ID NO 1073 in the 10/412,699 US patent application
  misc_feature: The sequence is a functional homolog of SEQ ID NO 588 in the 10/374,780 US patent application
  misc_feature: The sequence is a functional homolog of SEQ ID NO 589 in the 10/374,780 US patent application
  misc_feature: The sequence is a functional homolog of SEQ ID NO 730 in the 11/435,388 US patent application
  misc_feature: The sequence is a functional homolog of SEQ ID NO 593 in the 10/374,780 US patent application
  misc_feature: The sequence is a functional homolog of SEQ ID NO 782 in the 11/435,388 US patent application
  misc_feature: The sequence is a functional homolog of SEQ ID NO 790 in the 11/435,388 US patent application
  misc_feature: The sequence is a functional homolog of SEQ ID NO 796 in the 11/435,388 US patent application
  misc_feature: The sequence is a functional homolog of SEQ ID NO 822 in the 10/412,699 US patent application
  misc_feature: Useful for making plants with altered alkaloid content
  misc_feature: Useful for making plants with altered lignin content
  misc_feature: Useful for making plants with modulated nitrogen use efficiency
  misc_feature: The sequence is a functional homolog of SEQ ID NO 1004 in the 11/435,388 US patent application
  misc_feature: The sequence is a functional homolog of SEQ ID NO 1118 in the 10/225,066 US patent application
  misc_feature: The sequence is a functional homolog of SEQ ID NO 1396 in the 11/479,226 US patent application
  misc_feature: The sequence is a functional homolog of SEQ ID NO 2488 in the 10/374,780 US patent application
  misc_feature: The sequence is a functional homolog of SEQ ID NO 658 in the 10/412,699 US patent application
  misc_feature: The sequence is a functional homolog of SEQ ID NO 1681 in the 10/374,780 US patent application
  misc_feature: The sequence is a functional homolog of SEQ ID NO 1056 in the 11/479,226 US patent application
  misc_feature: The sequence is a functional homolog of SEQ ID NO 144 in the 10/374,780 US patent application
  misc_feature: The sequence is a functional homolog of SEQ ID NO 458 in the 10/412,699 US patent application
  misc_feature: The sequence is a functional homolog of SEQ ID NO 756 in the 10/225,066 US patent application
  misc_feature: The sequence is a functional homolog of SEQ ID NO 266 in the 10/374,780 US patent application
  misc_feature: The sequence is a functional homolog of SEQ ID NO 536 in the 11/435,388 US patent application
  misc_feature: The sequence is a functional homolog of SEQ ID NO 640 in the 10/225,066 US patent application
  misc_feature: The sequence is a functional homolog of SEQ ID NO 856 in the 10/412,699 US patent application
  misc_feature: The sequence is a functional homolog of SEQ ID NO 126 in the 10/412,699 US patent application
  misc_feature: The sequence is a functional homolog of SEQ ID NO 2 in the 10/225,068 US patent application
  misc_feature: The sequence is a functional homolog of SEQ ID NO 22 in the 10/225,068 US patent application
  misc_feature: The sequence is a functional homolog of SEQ ID NO 230 in the 10/225,066 US patent application
  misc_feature: The sequence is a functional homolog of SEQ ID NO 258 in the 10/374,780 US patent application
  misc_feature: The sequence is a functional homolog of SEQ ID NO 442 in the 11/435,388 US patent application
  misc_feature: The sequence is a functional homolog of SEQ ID NO 842 in the 10/412,699 US patent application
  misc_feature: The sequence is a functional homolog of SEQ ID NO 98 in the 11/375,241 US patent application
  misc_feature: The sequence is a functional homolog of SEQ ID NO 36 in US patent 7193132
  misc_feature: The sequence is a functional homolog of SEQ ID NO 1564 in the 10/374,780 US patent application
  misc_feature: The sequence is a functional homolog of SEQ ID NO 196 in the 10/225,066 US patent application
  misc_feature: The sequence is a functional homolog of SEQ ID NO 2900 in the 10/374,780 US patent application
  misc_feature: The sequence is a functional homolog of SEQ ID NO 1625 in the 10/412,699 US patent application
  misc_feature: The sequence is a functional homolog of SEQ ID NO 978 in the 10/666,642 US patent application
  misc_feature: Useful for making plants with modulated biomass
  misc_feature: Useful for making plants with modulated flowering time
  misc_feature: Useful for making plants with altered cell wall content and/or composition
MGRPPCCDKVGVKKGPWTPEEDLMLVSYVQEHGPGNWRAVPTNTGLMRCSKSCRLRWTNYLRPGIKRGNFTDQEEKLIIHLQALLGNRWAAIASYLPERTDNDIKNYWNTHLKKKLKKMQAGEGGGGDDVAAGASGPDGGDAGGKIGAGARKRPDVPKGQWERRLQTDIHTARQALRDALSLEPSATPAKVAPPPTPPGSTTYASSAENIARLLEGWLRPPGGGSGGKGPEASGSTSTTATTQQRPQCSGEGAASASASHSGGAAGNTYTAAQTPEYSTETSKMAGSAAGAGSAPVFSMLESWLLDDGTGHGEVGLMADVVPLGDPSEFF

SEQ ID NO: 21679 - DNA, 1079 bp, Panicum virgatum
  misc_feature: Ceres CLONE 1817476
  misc_feature: Encodes the peptide sequence at SEQ ID NO. 21680
acgcacaactgcaggctccgctcagctatagaactcaagcttttttatctgccacagccgcggcgccgggcatacggagatatggcggactgcatgcaggagtggccggagcccgtcatgcgcgtgcaggcgctcgccgagagcggcctctccgccatcccgcgctgctacgtcaagccgccgtgcgaccgccccgtgccgccggcggcggcggcggcggaagcccatcagctggacagggagctctcgtccgacgacgtctgcattccggtggtcgacctcggcgagctgctggcgaacggcgccgccgtcggcctcggcagcgccgtcaccaaggccgtcgcggctgcctgccgtgagtgggggttcttccaggtcgtcaaccacggggtgcgcccggagctgatgcgcgcggcgcgggaggcctggcgcggcttcttccgccgcccgctcgcggagaagcagcgctacgccaactcgccgcgcacgtacgagggctacggcagccggctcggcgtgcagaagggcgccgtcctggactggggcgactacttcttcctccacctcgcgccggaggcggccaagagcccggcaaagttctggccggacaaccccggcaactgcaaggagctgtcggaggagtacggtcggtcggtggtgcggctgtgcgagctgctgatgcgggtgctgtccgtgagcctggggctggaggaggcgcacctccagcgggcgttcggcggggccgggtgcggcgcgaccctgcgcgccaactactacccgcggtgcccgcagccggacctgacgctggggctctcggcgcactcggacccgggcgtcctcaccgtgctcctcgccgacgagcacgtccgcggcctgcaggtcctccgcgccgccggggagtgggtcactgtgcagcccgtccgcgacgccttcatcgtcaacgtcggctaccaagtccagatactgagcaactccctgtacaagagcgtggagcaccgtgtgatcttgaacgccaaggaggagcgcatctccctcgcgctcttctacaaccccaagggcgacgtccccatctccccggc

SEQ ID NO: 21680 - protein, 332 aa, Panicum virgatum
  misc_feature: Ceres CLONE 1817476
  misc_feature (223)..(324): Pfam Name: 2OG-FeII_Oxy Pfam Description: 2OG-Fe(II) oxygenase superfamily
  misc_feature: SWISSPROT Homolog: EC 1.14.11.19 Leucocyanidin oxygenase
MADCMQEWPEPVMRVQALAESGLSAIPRCYVKPPCDRPVPPAAAAAEAHQLDRELSSDDVCIPVVDLGELLANGAAVGLGSAVTKAVAAACREWGFFQVVNHGVRPELMRAAREAWRGFFRRPLAEKQRYANSPRTYEGYGSRLGVQKGAVLDWGDYFFLHLAPEAAKSPAKFWPDNPGNCKELSEEYGRSVVRLCELLMRVLSVSLGLEEAHLQRAFGGAGCGATLRANYYPRCPQPDLTLGLSAHSDPGVLTVLLADEHVRGLQVLRAAGEWVTVQPVRDAFIVNVGYQVQILSNSLYKSVEHRVILNAKEERISLALFYNPKGDVPISP

SEQ ID NO: 21681 - DNA, 1142 bp, Panicum virgatum
  misc_feature: Ceres CLONE 1817491
  misc_feature: Encodes the peptide sequence at SEQ ID NO. 21682
gttctaacatatttcatttcgcgcaccatgcgtatagagagaagctttgttggagactgaacaagttcttagaaggctgtgaaagaaatatgctccgctgtgctcactcccaaactggtggttgctgacttaggctgctcttcaggagaaaacacagtcatcttcgtctctgaggtgatcaaagccatgagtgaccagcagcaactggaggtccaattcttcctcaatgatctacccggaaacgacttcaactatatcttcggttcacttggaaacttcaaggagtcgattgcagcggagcacaagggaggaacaacacctcaattttacattgctgggttgcctggttcctactacactaggcttttcccttcccaaagcgttcatctctttcactcgtcgtattgtctccattgacgctctcggcttcctgatggtctcgatgtcaacgcaaaaccttacctaaacaaaggaaacatttacattgcgaagactacaccgtcatctgtggtgaaactgtaccaagagctgttcgagacggacttgttgctcttcctcaagatgcggcatgaggaactcgtctctggtggccagatggtgctgacgtttcttgggaggaagaatgaggatatttataaaggagatctgaaccatctttgtgggctacttgcacaatctattcagtctctcgttcacaagggtcttgtgcaagaggaaaagcttgatgccttcaatctccccgtttacggcccatcggttgatgaagtggaggcagtggtcagaaagagcgagctgttcgacatcaactctgccgaactgttcgaatccaactgggatccttacgatgactctggggatcatattgtccaagatagcctccaaagtggcctgaatgttgctaagagcatcagagcagtcatggagcccttggttgcgagccatttcggtggagccgcgctggatgagctgttcagagaatacgcacgtaatgttgcaaagcaccttcagagggagaagaccatgtactcggtcatcgtcctgtccttgcaacgaagataaagttggtctatgcatgtactaaccccaaatgcctgaggattaattatcctgcaattttaatttatacataaatgtacacgatc

SEQ ID NO: 21682 - protein, 165 aa, Panicum virgatum
  misc_feature: Ceres CLONE 1817491
  misc_feature (1)..(165): Pfam Name: Methyltransf_7 Pfam Description: SAM dependent carboxyl methyltransferase
  misc_feature: SWISSPROT Homolog: EC 2.1.1.141 Jasmonate O-methyltransferase
MRHEELVSGGQMVLTFLGRKNEDIYKGDLNHLCGLLAQSIQSLVHKGLVQEEKLDAFNLPVYGPSVDEVEAVVRKSELFDINSAELFESNWDPYDDSGDHIVQDSLQSGLNVAKSIRAVMEPLVASHFGGAALDELFREYARNVAKHLQREKTMYSVIVLSLQRR

SEQ ID NO: 21683 - DNA, 706 bp, Panicum virgatum
  misc_feature: Ceres CLONE 1817495
  misc_feature: Encodes the peptide sequence at SEQ ID NO. 21684
acgctgcgagacagccgagcagagcacgaagcgcggcgcggcgcagtgcagtgcagcgcgacccctcctcggaacagccgcgcgcgcgtgcgtgcttgcttgcccccaccccatccccctcgtctctccagccatggcggcccgccgcgggtgcctccccctggtggccgtgctgctcgcgctgctctgccgcgccgaggcggcggtgagggagctcaaggtcgggtactacgccgagacgtgcccggaggccgaggggatcgtccgggaggtcatggcgcgggcgcgcgcccgcgaggcccgcagcgttgcctccgtcatgcgcctccagttccacgactgcttcgtcaacgggtgcgacgggtcggtgctgatggacgccacgcccacgatgctcggcgagaaggacgcgctgtccaacatcaactccctgcgctcgttcgaggtcgtcgacgagatcaaggaggcgctggaggagcgctgccccggcgtcgtctcctgcgccgacatcgtcgtcatggccgcccgcgacgccgtcgtcctgaccggtgggcccaattgggaggtgcggctcgggcgcgaggacagcctgacggcgagccaggaggactcggacagcatcatgccgagcccgcgcgccaacgccagcgcgctcatccgcctctttgccgggctcaacctcagcgtcaccgacctcgtcgcgctc

SEQ ID NO: 21684 - protein, 190 aa, Panicum virgatum
  misc_feature: Ceres CLONE 1817495
  misc_feature (44)..(190): Pfam Name: peroxidase Pfam Description: Peroxidase
  misc_feature: SWISSPROT Homolog: EC 1.11.1.7 Peroxidase
  misc_feature: Useful for making plants with altered cell wall content and/or composition
  misc_feature: Useful for making plants with altered carbohydrate content
MAARRGCLPLVAVLLALLCRAEAAVRELKVGYYAETCPEAEGIVREVMARARAREARSVASVMRLQFHDCFVNGCDGSVLMDATPTMLGEKDALSNINSLRSFEVVDEIKEALEERCPGVVSCADIVVMAARDAVVLTGGPNWEVRLGREDSLTASQEDSDSIMPSPRANASALIRLFAGLNLSVTDLVA

SEQ ID NO: 21685 - DNA, 1288 bp, Panicum virgatum
  misc_feature: Ceres CLONE 1817501
  misc_feature: Encodes the peptide sequence at SEQ ID NO. 21686
agaactcggcaaatcaaatggcaccatgcccgtcaaaatttccacagctcaactactccagcgccaacgccggccgtcggagctccgatacggccgtcgccgcggcgacaaatgcgcgcaccattgcactagccacagaagtacagtgcacatgcacggctgtgatacagatccagaattttttagcctccacggacgatggctctcaaagctgtctgctgctctggaacgagcggttgagaccgttgcacagcgggtgtcctacggctgcgccaactcgcgtttacttccgcacgccggctcgcgaagccctttttttttctccaagctccgagcctctcgccccgacgccagccaagctagacccggccggcgcgggcaacgcttctatatattatcagggagcaccagcgtgcgcccacgtacacgcccagcagcggcgaaaacaactccagaagattcggcagcgtgcgcgggttcgcctgtgcgtgtgtgcgcgcgagagctgggcgatggcagcggaggggccgaacaaggcggaagcggaggcggcgaaggaggtgggagaggagaaggccgacgtcccggctcccgggccgccggccgatgactccaaggcccttgtcgtcgctgacaaggtggctgacaaaccttgtgttgagaagaacactccgaggaacttaaatgaaagatacattgctctcggaaaggtggaagcagaaaagaggaactctttgattaaagcatgggaagagaatgagaaggcaaaagcagagaacaaggctgctaagaaagtgtccactatactttcatgggagaacacgaagaaggcagtcgtagatgctcagctgaaaaataaggaagaagaactagaaaagaagaaggctgaatacgctgagaagatgaagaacaagaaggcattcatccacaggcgggccgaagagaagagagcgatggttatggcccagcgtggtgaacaagttctcaaggtcgaggagatggcggcgaagtaccgcgccaccggggtagccccaaagaaatttcttgggtgctttggggcataaggaaacgtctcaagttgatgatccgggcccgggaggtaatatggccacatgtacaagtcattggcttctttgctcgctgcaagtatatggtgctgtttactcataccatgtaaatgtgccctgcttatattctctctaaaggtaaagcctaccccttcatgttgcaaaatgtgctgtgcctgagacagaaatttgtcggtaaatatatagtataactattgttc

SEQ ID NO: 21686 - protein, 183 aa, Panicum virgatum
  misc_feature: Ceres CLONE 1817501
  misc_feature (69)..(178): Pfam Name: Remorin_C Pfam Description: Remorin, C-terminal region
  misc_feature: The sequence is a functional homolog of SEQ ID NO 1492 in the 11/479,226 US patent application
  misc_feature: The sequence is a functional homolog of SEQ ID NO 644 in the 11/435,388 US patent application
  misc_feature: The sequence is a functional homolog of SEQ ID NO 716 in the 10/412,699 US patent application
  misc_feature: The sequence is a functional homolog of SEQ ID NO 496 in the 11/435,388 US patent application
  misc_feature: The sequence is a functional homolog of SEQ ID NO 1773 in the 11/479,226 US patent application
  misc_feature: The sequence is a functional homolog of SEQ ID NO 20 in the 10/286,264 US patent application
  misc_feature: The sequence is a functional homolog of SEQ ID NO 876 in the 10/412,699 US patent application
  misc_feature: The sequence is a functional homolog of SEQ ID NO 438 in the 10/666,642 US patent application
MAAEGPNKAEAEAAKEVGEEKADVPAPGPPADDSKALVVADKVADKPCVEKNTPRNLNERYIALGKVEAEKRNSLIKAWEENEKAKAENKAAKKVSTILSWENTKKAVVDAQLKNKEEELEKKKAEYAEKMKNKKAFIHRRAEEKRAMVMAQRGEQVLKVEEMAAKYRATGVAPKKFLGCFGA

SEQ ID NO: 21687 - DNA, 578 bp, Panicum virgatum
  misc_feature: Ceres CLONE 1817508
  misc_feature: Encodes the peptide sequence at SEQ ID NO. 21688
atcctcccccagcccaaactcgaacgcgatcctgagcaaaaatacatccgcggcaagcgcgcgcttccgcttccaatcctccgtacagccaggcagccagctcgaccgatctcgatccatggcgccgaggaggcccccttcgccggccggaagcagcagcagcgatgagcgcgcggcggcggagcagcagcagcagcagccgaggctccgcggcgtgcggcggcggccgtggggccggtacgcggcggagatccgcgaccccgtccgcaaggcgcgcgtgtggctggacaccttcgacacccccgaggaggccgcgcgggcctacgacgccgccgcgcggcggctccgcgggccacgcgccgccaccaactacccggccgcggcgggcaaggcaccatcctcgacagcagccgacgactcgcggccagcgacaccgccactgccgggacgtccgtcgccgtaactgttccgggagccggcacccacgacgacgacgactgaggtgcccgccgcgcctgctatgcgacatcagctcctgtctcgaaagggcgaggaggagcgtagacgctgctaccccg

SEQ ID NO: 21688 - protein, 114 aa, Panicum virgatum
  misc_feature: Ceres CLONE 1817508
  misc_feature (28)..(79): Pfam Name: AP2 Pfam Description: AP2 domain
  misc_feature: The sequence is a functional homolog of SEQ ID NO 1435 in the 11/479,226 US patent application
  misc_feature: The sequence is a functional homolog of SEQ ID NO 2504 in the 10/374,780 US patent application
  misc_feature: The sequence is a functional homolog of SEQ ID NO 618 in the 10/225,066 US patent application
  misc_feature: The sequence is a functional homolog of SEQ ID NO 674 in the 10/412,699 US patent application
  misc_feature: Useful for making plants with modulated biomass
  misc_feature: Useful for making plants with modulated flowering time
  misc_feature: Useful for making plants with altered terpenoid content
  misc_feature: Useful for making plants with altered lignin content
  misc_feature: The sequence is a functional homolog of SEQ ID NO 1028 in the 10/225,066 US patent application
  misc_feature: The sequence is a functional homolog of SEQ ID NO 2222 in the 10/374,780 US patent application
  misc_feature: The sequence is a functional homolog of SEQ ID NO 40 in the 10/412,699 US patent application
  misc_feature: Useful for making plants with altered alkaloid content
  misc_feature: Useful for biocontainment applications
  misc_feature: The sequence is a functional homolog of SEQ ID NO 1195 in the 10/666,642 US patent application
  misc_feature: The sequence is a functional homolog of SEQ ID NO 2220 in the 10/374,780 US patent application
  misc_feature: The sequence is a functional homolog of SEQ ID NO 500 in the 10/225,066 US patent application
  misc_feature: The sequence is a functional homolog of SEQ ID NO 1755 in the 10/374,780 US patent application
  misc_feature: The sequence is a functional homolog of SEQ ID NO 1448 in the 10/666,642 US patent application
  misc_feature: The sequence is a functional homolog of SEQ ID NO 1789 in the 11/479,226 US patent application
  misc_feature: The sequence is a functional homolog of SEQ ID NO 1862 in the 10/412,699 US patent application
  misc_feature: The sequence is a functional homolog of SEQ ID NO 274 in the 10/374,780 US patent application
  misc_feature: The sequence is a functional homolog of SEQ ID NO 998 in the 10/225,066 US patent application
  misc_feature: The sequence is a functional homolog of SEQ ID NO 1158 in the 10/374,780 US patent application
  misc_feature: The sequence is a functional homolog of SEQ ID NO 1361 in the 10/412,699 US patent application
  misc_feature: The sequence is a functional homolog of SEQ ID NO 164 in the 10/714,887 US patent application
  misc_feature: The sequence is a functional homolog of SEQ ID NO 164 in the 11/435,388 US patent application
  misc_feature: The sequence is a functional homolog of SEQ ID NO 32 in the 10/903,236 US patent application
  misc_feature: Useful for making plants with altered cell wall content and/or composition
  misc_feature: Useful for making plants with altered tocopherol content
  misc_feature: The sequence is a functional homolog of SEQ ID NO 1884 in the 10/374,780 US patent application
  misc_feature: The sequence is a functional homolog of SEQ ID NO 10 in the 10/412,699 US patent application
  misc_feature: The sequence is a functional homolog of SEQ ID NO 124 in the 11/479,226 US patent application
  misc_feature: The sequence is a functional homolog of SEQ ID NO 1754 in the 10/374,780 US patent application
  misc_feature: The sequence is a functional homolog of SEQ ID NO 18 in the 10/903,236 US patent application
  misc_feature: The sequence is a functional homolog of SEQ ID NO 2211 in the 10/666,642 US patent application
  misc_feature: The sequence is a functional homolog of SEQ ID NO 78 in the 10/714,887 US patent application
  misc_feature: The sequence is a functional homolog of SEQ ID NO 78 in the 11/435,388 US patent application
  misc_feature: Useful for making plants with altered lutein content
  misc_feature: The sequence is a functional homolog of SEQ ID NO 22 in the 10/903,236 US patent application
  misc_feature: The sequence is a functional homolog of SEQ ID NO 2215 in the 10/666,642 US patent application
  misc_feature: The sequence is a functional homolog of SEQ ID NO 82 in the 10/714,887 US patent application
  misc_feature: The sequence is a functional homolog of SEQ ID NO 82 in the 11/435,388 US patent application
  misc_feature: The sequence is a functional homolog of SEQ ID NO 10 in the 10/666,642 US patent application
  misc_feature: The sequence is a functional homolog of SEQ ID NO 54 in the 10/412,699 US patent application
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
  misc_feature: The sequence is a functional homolog of SEQ ID NO 16 in the 10/903,236 US patent application
  misc_feature: The sequence is a functional homolog of SEQ ID NO 2209 in the 10/666,642 US patent application
  misc_feature: The sequence is a functional homolog of SEQ ID NO 76 in the 10/714,887 US patent application
  misc_feature: The sequence is a functional homolog of SEQ ID NO 76 in the 11/435,388 US patent application
  misc_feature: The sequence is a functional homolog of SEQ ID NO 1354 in the 10/666,642 US patent application
  misc_feature: The sequence is a functional homolog of SEQ ID NO 171 in the 11/479,226 US patent application
  misc_feature: The sequence is a functional homolog of SEQ ID NO 18 in the 10/714,887 US patent application
  misc_feature: The sequence is a functional homolog of SEQ ID NO 18 in the 11/435,388 US patent application
  misc_feature: The sequence is a functional homolog of SEQ ID NO 1954 in the 10/374,780 US patent application
  misc_feature: The sequence is a functional homolog of SEQ ID NO 8 in the 10/666,642 US patent application
  misc_feature: The sequence is a functional homolog of SEQ ID NO 8 in the 10/903,236 US patent application
  misc_feature: The sequence is a functional homolog of SEQ ID NO 12 in the 10/225,068 US patent application
  misc_feature: The sequence is a functional homolog of SEQ ID NO 1247 in the 11/479,226 US patent application
  misc_feature: The sequence is a functional homolog of SEQ ID NO 168 in the 10/374,780 US patent application
  misc_feature: The sequence is a functional homolog of SEQ ID NO 574 in the 10/412,699 US patent application
  misc_feature: The sequence is a functional homolog of SEQ ID NO 628 in the 11/435,388 US patent application
  misc_feature: The sequence is a functional homolog of SEQ ID NO 732 in the 10/225,066 US patent application
  misc_feature: Useful for making plants with modulated oxidative stress sensitivity
  misc_feature: The sequence is a functional homolog of SEQ ID NO 1352 in the 10/666,642 US patent application
  misc_feature: The sequence is a functional homolog of SEQ ID NO 167 in the 11/479,226 US patent application
  misc_feature: The sequence is a functional homolog of SEQ ID NO 1718 in the 10/412,699 US patent application
  misc_feature: The sequence is a functional homolog of SEQ ID NO 1050 in the 10/666,642 US patent application
MAPRRPPSPAGSSSSDERAAAEQQQQQPRLRGVRRRPWGRYAAEIRDPVRKARVWLDTFDTPEEAARAYDAAARRLRGPRAATNYPAAAGKAPSSTAADDSRPATPPLPGRPSP

SEQ ID NO: 21689 - DNA, 718 bp, Panicum virgatum
  misc_feature: Ceres CLONE 1817518
  misc_feature: Encodes the peptide sequence at SEQ ID NO. 21690
tgatatagttgttgatgcaactgacaaccttcctactaggtatatgatcagtgattgttgtgttctactgaacaagccacttgtatccggtgcagcattaggtttagaagggcagttgactgtttatcatcacaatggaagtccatgctatcggtgcctctttccaagtccaccacctgtggcagcctgccagagatgctcagacagtggtgttcttggggttgttccgggagtaattggctgtctacaagctctggaggctataaaggttgcaactgccgttggtgaacccctctgtggaaggatgctactctttgacgcactttctgctcgtattagaattgttaagcttcgtggaagcttgccagattgcaccatttgtggcgaaaattcagttttcacagaacaagattttcagaagtttgactatgagcacttcacgcaatcaccaatgtccgataagacagcgccaagtgtgaatctgctccccgagaacgcccggatcactagtagagattacaaaagattggttaataatggcgaacctcatctgttattggacgtacgccccacgcatcacttccagatcacttcgatttctcgttctctgaacatcccactctccatgttggaagagaagctgcccacactcaaaaccttgctgaaggaaacaggagcagcatcagcctcgggtaaagagcctgccttggtttgtctg

SEQ ID NO: 21690 - protein, 238 aa, Panicum virgatum
  misc_feature: Ceres CLONE 1817518
  misc_feature (45)..(131): Pfam Name: MoeZ_MoeB Pfam Description: MoeZ/MoeB domain
DIVVDATDNLPTRYMISDCCVLLNKPLVSGAALGLEGQLTVYHHNGSPCYRCLFPSPPPVAACQRCSDSGVLGVVPGVIGCLQALEAIKVATAVGEPLCGRMLLFDALSARIRIVKLRGSLPDCTICGENSVFTEQDFQKFDYEHFTQSPMSDKTAPSVNLLPENARITSRDYKRLVNNGEPHLLLDVRPTHHFQITSISRSLNIPLSMLEEKLPTLKTLLKETGAASASGKEPALVC

SEQ ID NO: 21691 - DNA, 1276 bp, Panicum virgatum
  misc_feature: Ceres CLONE 1817530
  misc_feature: Encodes the peptide sequence at SEQ ID NO. 21692
ttctctcggactctcctccctttgctcttccttccctagcggcggcgccatttctcacgtcttcgtcacgccctttgccggcgacgagcatcctccaggttagcaaattaccttttgaaaatggatcacagttctgatgaagatacagaaatcagtgattctgagattgatgattatgaaggcaaaatatatgcaagactgatctccggagatttaaaggtcaagaagaatggagagagttacacctgtcccttctgtagcagcaagaagaagaacaattacagcaaaagtagtctggttcagcatgcttctggagtaggtgcagcacctaatcgacaggcaaaagaaaaggcagcccatcgcgcccttgtcaaacatttgaagaatgaacttgctaaatcacccgagctacggccacaggaaattcctgttgagcctcagcctcttcagaacagagatgagaagtttgtgtggccctggatgggcatcctagttaatgtgcctaccgaatggaaggatgggcgccaagttggagaaagtggaaatcgtttgaaggagcaactatcacacttctgcccactgaaggtcgtccctttgtggacttttagaggtcattcaggaaatgctattgttgagtttggaaaggactggaatggtttcagaaatgcacggaccttcgaaagccacttcgcagcaggaggatatggaaaaagggactggaatggaaaaaggaatcaaggatcagagcttcatggatggcttgcgcgggctgaagattacaattctcctgggctgataggggatcacttgagaaaaaatggtgacttaaaatctgtcaatgatcttgcgaaggaagaagcgcgtaagactgacaaacttgtggctaatttagctaaccaaattgaggtaaagaataggtatttacaggagcttgagtgcaaatacagtgagacaactgcatctcttgagaagatgatggggcaaagggaacaacttctccagtcatacaatgaagaaattcgcaagatgcagcaactagctcgtaggcattctcagaagatcattgatgagaatcaaaagctgcgttctgaacttgagacaaaaatgaatgaacttgatgcgagatccaagcagcttgacgagcttgcagcaaaaagtggttatgacagaaggaacattgagcaggagaagcagaagaatgctatcagatccagccatcttaaattggcaacattggaacagcagaaagctgatgaaaatgtattgaagcttgtgg

SEQ ID NO: 21692 - protein, 385 aa, Panicum virgatum
  misc_feature: Ceres CLONE 1817530
  misc_feature (112)..(226): Pfam Name: XS Pfam Description: XS domain
  misc_feature (43)..(84): Pfam Name: zf-XS Pfam Description: XS zinc finger domain
MDHSSDEDTEISDSEIDDYEGKIYARLISGDLKVKKNGESYTCPFCSSKKKNNYSKSSLVQHASGVGAAPNRQAKEKAAHRALVKHLKNELAKSPELRPQEIPVEPQPLQNRDEKFVWPWMGILVNVPTEWKDGRQVGESGNRLKEQLSHFCPLKVVPLWTFRGHSGNAIVEFGKDWNGFRNARTFESHFAAGGYGKRDWNGKRNQGSELHGWLARAEDYNSPGLIGDHLRKNGDLKSVNDLAKEEARKTDKLVANLANQIEVKNRYLQELECKYSETTASLEKMMGQREQLLQSYNEEIRKMQQLARRHSQKIIDENQKLRSELETKMNELDARSKQLDELAAKSGYDRRNIEQEKQKNAIRSSHLKLATLEQQKADENVLKLV

SEQ ID NO: 21693 - DNA, 642 bp, Panicum virgatum
  misc_feature: Ceres CLONE 1817540
  misc_feature: Encodes the peptide sequence at SEQ ID NO. 21694
gccgtttcggagtttcccaccacaccccccaattccaactccaagtcatcgtcaccgccccgccgcatctaggtcaccacctcgccggcgccgaccatggccggggactggcaggagctgggccaggcggccgccatcggcctcctcttcgccttcctcgtcgccaagctcatctccaccgtcatcgccttcaaggaggacaacctccgcatcacgcgctcccctccggcctcccccaccgccgccgcctcccgctccccggcgatcccggacatcccggtccccgcggagcccccgaagccctcccacggaggccacgtctccagcgacggcggcagcgacagcgacagcgactgggagggcgtggagagcaccgagctcgacgaggagttcagcgccgcctccgccttcgtcgcggcctccgccgcgtcaggcaccagcgtccccgaggaggcgcagctgcggctctacgggctctacaagatcgccaccgaggggccctgcaccgcgccgcagccgtccgcgctcaagctcaaggcccgtgccaagtggaatgcttggcataagctgggtgctatgcctacagaagaagctatgcaggagtacatcagaatagttgatgagctattccctaactgggct

SEQ ID NO: 21694 - protein, 181 aa, Panicum virgatum
  misc_feature: Ceres CLONE 1817540
  misc_feature (95)..(179): Pfam Name: ACBP Pfam Description: Acyl CoA binding protein
  misc_feature: SWISSPROT Homolog: EC 5.3.3.8 Dodecenoyl-CoA isomerase
  misc_feature: The sequence is a functional homolog of SEQ ID NO 1840 in the 10/374,780 US patent application
  misc_feature: The sequence is a functional homolog of SEQ ID NO 1846 in the 10/374,780 US patent application
MAGDWQELGQAAAIGLLFAFLVAKLISTVIAFKEDNLRITRSPPASPTAAASRSPAIPDIPVPAEPPKPSHGGHVSSDGGSDSDSDWEGVESTELDEEFSAASAFVAASAASGTSVPEEAQLRLYGLYKIATEGPCTAPQPSALKLKARAKWNAWHKLGAMPTEEAMQEYIRIVDELFPNW

SEQ ID NO: 21695 - DNA, 632 bp, Panicum virgatum
  misc_feature: Ceres CLONE 1817547
  misc_feature: Encodes the peptide sequence at SEQ ID NO. 21696
caaaacccagcgggttcgtgcccgttgccaaccctactcacgagctgatctctcacacagtcacacgttgcggggctcctcccacctcgtcttcttgtcgtcgccctcgtcctccctctcctcaaccaaggggcgcatgagctagtgtggactggagatccatccatctgctggacctggattgacttcttctttcctagggacatccgaggatgtcgactcctgcgagaaagcggttgatgagggatttcaagcggttgatgcaggaccctccggccggcataagtggcgccccgcaggataacaacatactgctatggaacgctgtgatctttggccctgacgatactccatgggatggtggtacgttcaagctaactctccagtttactgaagaatatccaaacaagccaccaactgtgcgatttgtttctcggatgtttcatcctaacacatatatggagcggatgtagtgctttcgatgtcaaaccaacgggactctgccttttcgttctcctctgacttctgctgaatcctgaaacatctgctctgcaataatatttattctcttctaatcacaacttatttcctgtattaacataatttcctcatgacgtgcagtttatgctgat

SEQ ID NO: 21696 - protein, 86 aa, Panicum virgatum
  misc_feature: Ceres CLONE 1817547
  misc_feature (8)..(86): Pfam Name: UQ_con Pfam Description: Ubiquitin-conjugating enzyme
  misc_feature: SWISSPROT Homolog: EC 6.3.2.19 Ubiquitin--protein ligase
MSTPARKRLMRDFKRLMQDPPAGISGAPQDNNILLWNAVIFGPDDTPWDGGTFKLTLQFTEEYPNKPPTVRFVSRMFHPNTYMERM

SEQ ID NO: 21697 - DNA, 528 bp, Panicum virgatum
  misc_feature: Ceres CLONE 1817578
  misc_feature: Encodes the peptide sequence at SEQ ID NO. 21698
acttttatttccgttccccttttccaaagccccatcaagtcctccgccgtcggccatggggcaagcctggggctctctccaagataaactgcaagggcggcggtggaaggagcggcaggtgcggaagatcaccgacaaggtgttcgaccgcctgacggaggacgcccagaagcgcgagaaggaggccctcaccttggaggaggtctacatcgcggtcctctgcgtctacaatgatatcaacaagtacttgccggggccgcaccacgatcccccgtccaaggagaagctcaaggagtacgacgtcaacctggacggcctcctggaccgcgaggagttcgcggagttcatccggaagctgacggcggactcgctgtgctccatcagcctgaagctcgtgatcacgctggtggccgcgccggcgctggcgatggcgaccaagcgggcgaccgagggcgtccccggcgtgggcaaggtggtgcgcaagatgccccacgcgctctacgcgtcggccctcaccctgggcgtcgt

SEQ ID NO: 21698 - protein, 157 aa, Panicum virgatum
  misc_feature: Ceres CLONE 1817578
  misc_feature: Useful for making plants with modulated cold sensitivity
MGQAWGSLQDKLQGRRWKERQVRKITDKVFDRLTEDAQKREKEALTLEEVYIAVLCVYNDINKYLPGPHHDPPSKEKLKEYDVNLDGLLDREEFAEFIRKLTADSLCSISLKLVITLVAAPALAMATKRATEGVPGVGKVVRKMPHALYASALTLGV

SEQ ID NO: 21699 - DNA, 1772 bp, Panicum virgatum
  misc_feature: Ceres CLONE 1817580
  misc_feature: Encodes the peptide sequence at SEQ ID NO. 21700
gtcggccggcggaattcggctcggctcgtcttcctcctggatctgccgcccggtggtacctcggtcgccgccggtggcaagcatggctcgggcggagaagaagcgcgccgtaagaacggccacggcggcggcggagaggccgtccgggatgtccgaccggaggccgctctacttcgccgccttcctggtgctcgccgacgccgcgctcgtcgcgctcatcatcgccttcgtcccgtataccaagatcgactgggacgcctacatgtcccaggtggatgcttttctggagggggagagggactataccaagatcgagggagacacaggaccattggtctacccggctggattcctctatgtctactccgcaattaagttccttaccggcggccaagtcttccctgctcagattttgtttggcgtcctgtacattgtcaacctgagcctcgttcttctgctttacgtcaagactgaagtgcttccatggtgggctttaggtttgctttgtttgtccaaaagggttcactccatttttgtgctccgccttttcaacgacggcttcgccatgacattgctccatgctgctatggttttgattatttatcataagtggtaccttggcctaatagttttcagtggagctgtctcggttaagatgaatgtccttcttttcgctccttctttgcttctactgatggtgaaggccatgagcatcaaaggagtcttctttgccttgtttggagctgctgtagtacaggtattgttgggtatgccattcttgctgtcacatccagttgagtacatatcaagagcattcaatctcggtcgtgtcttcatccatttctggtctgtgaacttcaaattcatcccagagaagttgtttgtgtccaaagagcttgctattgcgttgttgattcttcacctcactacccttatggtatttgcacactacaagtggttaaagcatgaaggaggcctattcggtttcttgaattccagatttaaacatgccaaatcaattctacagcttttttccagcaagcccagaccatgcattctcagtaaagaacatattgtaaccgttatgtttgtcagcaacttcattggcattgtgtgtgcccgatcattaaaaccctagcctttcacctcctctcccgcgccgccgccgctttcgacctcctcgcggtcccgccgtccgtcgaggtaaggtcagaatggtgagggtcagtgtgctcaacgatgcgctgaagtccatgtacaatgctgagaagagggggaaaaggcaggtcatgatcaggccgtcgtccaaggttatcatcaagttcttgttggtcatgcagcgtcatggctacattggtgagttcgaatacgtggatgaccaccgtgctgggaagattgtggtggaactgaacggaagactaaacaagtgtggtgtgatcagccctcgctttgatgttggtgtaaaggagattgaaggatggactaccagactgctcccatctcgtcagttcggctacatagtgctgacaacttctgctggcattatggaccatgaggaggcccggcggaagaatgttggtggcaaggtgctaggtttcttctattgaagggagtatgatgaaagtattaggatatttcctagaactcatctgagcttgtgttttttggtctgaatagtgtcttgttaagattctggaatgtgttatgtacttgagaaatttggaaccttgttatgagctgtgcttgccgttaattatcatgacctatatgcc

SEQ ID NO: 21700 - protein, 351 aa, Panicum virgatum
  misc_feature: Ceres CLONE 1817580
  misc_feature (31)..(351): Pfam Name: ALG3 Pfam Description: ALG3 protein
  misc_feature: Useful for making plants with altered carbohydrate content
MARAEKKRAVRTATAAAERPSGMSDRRPLYFAAFLVLADAALVALIIAFVPYTKIDWDAYMSQVDAFLEGERDYTKIEGDTGPLVYPAGFLYVYSAIKFLTGGQVFPAQILFGVLYIVNLSLVLLLYVKTEVLPWWALGLLCLSKRVHSIFVLRLFNDGFAMTLLHAAMVLIIYHKWYLGLIVFSGAVSVKMNVLLFAPSLLLLMVKAMSIKGVFFALFGAAVVQVLLGMPFLLSHPVEYISRAFNLGRVFIHFWSVNFKFIPEKLFVSKELAIALLILHLTTLMVFAHYKWLKHEGGLFGFLNSRFKHAKSILQLFSSKPRPCILSKEHIVTVMFVSNFIGIVCARSLKP

SEQ ID NO: 21701 - DNA, 697 bp, Panicum virgatum
  misc_feature: Ceres CLONE 1817602
  misc_feature: Encodes the peptide sequence at SEQ ID NO. 21702
ctccttcaattccctctcatctcgcgtctccgcacggagggccgccccctcctcgtccgccgcctgccgccggcgcgctctccattaccccggcgatggccggcctatccaaaaccagcctcaccaatcacgtctagcaagcacagagccacgcgtcacaacaacacatcctccgcgtcaggccggatcggcaggaagaagatggaggcgagcgtgggcatccgggcgcggcccggtgcctgggccgggctcgagaagccgcgcggcgcctactctgcaagagccccgccggtgaggctcacgccggagaagctgccggagaggctggctctgggaaccggtccgcggcggagcacggatcctgtgctccgtgccgcaaagctgaaagcttcgtgctgcaagaaatcggcaggtactgaaaaggtccactactctgctgatgaagctctcatactacagcaaaaagcccaggatgttctcccttacttggatggccgatgtgtttatctagtcggaatgatgggttcaggcaaaactacagttgggaagatattagctgaagtactaggttattctttctttgacagtgataagttggtagagaaggctgtcggtatatcatctgttgctgagatttttcagctccacagtgaagcattcttcagagataatgaggagttacatgaagaaagggctg

SEQ ID NO: 21702 - protein, 165 aa, Panicum virgatum
  misc_feature: Ceres CLONE 1817602
  misc_feature: SWISSPROT Homolog: EC 2.7.1.71 Shikimate kinase
MEASVGIRARPGAWAGLEKPRGAYSARAPPVRLTPEKLPERLALGTGPRRSTDPVLRAAKLKASCCKKSAGTEKVHYSADEALILQQKAQDVLPYLDGRCVYLVGMMGSGKTTVGKILAEVLGYSFFDSDKLVEKAVGISSVAEIFQLHSEAFFRDNEELHEERA

SEQ ID NO: 21703 - DNA, 459 bp, Panicum virgatum
  misc_feature: Ceres CLONE 1817610
  misc_feature: Encodes the peptide sequence at SEQ ID NO. 21704
acccctccttttaggacggggaggaggagcagccatggcctcgtcggtggccgccgcggcgagcacattcctgggcacccgcctggcggacccggggccgcgcagcgggcgcatcgtggcccgtttcgggttcggcgagaagccggcggccccgaataaggcggccaagacgtctaccatctcctaccggccgctgtggttccccggcgcggtggcgcccgactacctccacgggtcgctggtcggcgaccacgggttcgacccgttcaggctcggcaaggcggtggagtatctgcaggtcgacgtgtactcattgtattagaacctggacaagaacgaggccggtcgcatcatcggcacccggttcgagtcctcagaggtcaagtccacccccctccacccctacaacgagctcttcggcctccagcggttccacgagtgccagctcatccacggacg

SEQ ID NO: 21704 - protein, 95 aa, Panicum virgatum
  misc_feature: Ceres CLONE 1817610
  misc_feature: Useful for making plants with modulated water use efficiency
  misc_feature: Useful for making plants with modulated biomass
  misc_feature: Useful for making plants with modulated drought sensitivity
  misc_feature: Useful for making plants with modulated phosphate use efficiency
MASSVAAAASTFLGTRLADPGPRSGRIVARFGFGEKPAAPNKAAKTSTISYRPLWFPGAVAPDYLHGSLVGDHGFDPFRLGKAVEYLQVDVYSLY

SEQ ID NO: 21705 - DNA, 671 bp, Panicum virgatum
  misc_feature: Ceres CLONE 1817612
  misc_feature: Encodes the peptide sequence at SEQ ID NO. 21706
attccgccagctcatccgccaccgccccccacctctctgcccgctccgctcccgcgtctccacctccccgtcgtcctcttcgccccgcctctcgccgcacccgggggatcgagcccaacgtcgacccgtctcaggcatacaggcaaggagaagtcaacggggaggtcattatgcgccggtggttttgctgcacgcagtttcattcgtcataccgtgaacatgaaaatgaactccccatcagtccagatgagaaagaaggaaatggttttgctgccaatagtgatcctatcaaagcaccacctcccattgaagtccctgaattatcatttgaagaactgaaagaaaagactgataattttggatcaaaggctttgattggtgagggatcatatggaagagtgtattacgctattctggatagcggaaaacatgtggctgttaaaaagcttgatgcttcaaccgaccctgaacttgacaatgagtttctgacacaggtatccattgcctcaaagctaaaacatgataattttgtggaaatgcttggatattgtgtggaaggaaatcagcgtttagtggcctatgaatttgctacgatgggttctctacatgatattttgcatggaagaaagggcgtaccaggtgcacagcctggcccagcacttgactggatg

SEQ ID NO: 21706 - protein, 166 aa, Panicum virgatum
  misc_feature: Ceres CLONE 1817612
  misc_feature: SWISSPROT Homolog: EC 2.7.11.1 Non-specific serine/threonine protein kinase
MRRWFCCTQFHSSYREHENELPISPDEKEGNGFAANSDPIKAPPPIEVPELSFEELKEKTDNFGSKALIGEGSYGRVYYAILDSGKHVAVKKLDASTDPELDNEFLTQVSIASKLKHDNFVEMLGYCVEGNQRLVAYEFATMGSLHDILHGRKGVPGAQPGPALDW

SEQ ID NO: 21707 - DNA, 529 bp, Panicum virgatum
  misc_feature: Ceres CLONE 1817625
  misc_feature: Encodes the peptide sequence at SEQ ID NO. 21708
cggcccctccccttccccttccctcccgaggagagagagagagaagaaaagataagctccgccccgccccggctccggctccgctcccaagccagtggagatgccgagccccccaggagccgccgccgccgggcgctgccgcgccccggagcccgtccacctgatcccgggcctccccgacgacgtcgccctccactgcctggcgcgcgttccccacgcgtcccaccgcgcgctccgccgcgtctgccgcggctggcgcagcgccgccgccaagcccgccttcgcctcggcgcgcgccgccgcgggcgccaccgaggacctcgtctacctcctgcagttcggcaacccctccgccgccgacgacgacggggcgcctaaggacggcgccgacgcgccgccgcccagcgcgccggcctacggcgtcgccctctacaacgtgaccacgggcgagtggcgccgggagcgcggcgcgccccccgtgctccccgtcttcgcgcagtgcgccgcggtgggcacccgcgtggccgtg

SEQ ID NO: 21708 - protein, 142 aa, Panicum virgatum
  misc_feature: Ceres CLONE 1817625
  misc_feature (20)..(67): Pfam Name: F-box Pfam Description: F-box domain
MPSPPGAAAAGRCRAPEPVHLIPGLPDDVALHCLARVPHASHRALRRVCRGWRSAAAKPAFASARAAAGATEDLVYLLQFGNPSAADDDGAPKDGADAPPPSAPAYGVALYNVTTGEWRRERGAPPVLPVFAQCAAVGTRVA

SEQ ID NO: 21709 - DNA, 667 bp, Panicum virgatum
  misc_feature: Ceres CLONE 1817630
  misc_feature: Encodes the peptide sequence at SEQ ID NO. 21710
gaaccactccgcccccaaacccaaatccgcaccccgaaatccccaattccgctctccctcgccccctcccccaccctccctctcccccgcagcaggcgagagcgcgaaagcggagcggaggctgagagatggagtcggaccagggcaagctcttcatcggcggcatctcctgggagacgacggaggagaagctgagcgagcacttctcctcctacggcgaggtcacccaggccgccgtcatgcgcgacaagctcaccggccgcccccgcggcttcggcttcgtcgtcttcgccgaccccgccgtcgtcgaccgcgcgctgcaggacccccacaccctcgacggccgcacggtcgatgtgaagcgggcgctctcgcgggaggagcagcaggccactaaggctgcgaaccctagcggcgggcggaactctggtggtggaggcggcggcggcggcgtcggcggcgatgctggtggggcgcggacgaagaagatttttgtgggcgggctgccctccactctgacggaggaggggttccggcagtatttccagacctacggtgtagtcactgacgttgtcgtgatgtacgaccagaacacgcaacgtcccagggggttcggcttcatcacttttgactcggaggacgcggttgaccgcgtgctgcacaagac

SEQ ID NO: 21710 - protein, 179 aa, Panicum virgatum
  misc_feature: Ceres CLONE 1817630
  misc_feature (8)..(77): Pfam Name: RRM_1 Pfam Description: RNA recognition motif. (a.k.a. RRM, RBD, or RNP domain)
  misc_feature (121)..(178): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MESDQGKLFIGGISWETTEEKLSEHFSSYGEVTQAAVMRDKLTGRPRGFGFVVFADPAVVDRALQDPHTLDGRTVDVKRALSREEQQATKAANPSGGRNSGGGGGGGGVGGDAGGARTKKIFVGGLPSTLTEEGFRQYFQTYGVVTDVVVMYDQNTQRPRGFGFITFDSEDAVDRVLHK

SEQ ID NO: 21711 - DNA, 1581 bp, Panicum virgatum
  misc_feature: Ceres CLONE 1817653
  misc_feature: Encodes the peptide sequence at SEQ ID NO. 21712
accaaccctcccctctccccactcctcccactctgcagtctgcgctccacgaccccggtgctggtgggctgtggcgccacttcctcctccggcttcgccgcccagctaaccgccgctgcttaccccatatagttagctcaaactgccatttcaagtacttcccgcccggtcacccttgccataattgatgagccttctgttcctgtctggaacgtgcatttaaaaattgctggaggattgttggagttcgatttcgtagaaggccggtgtgcgatggcttctttgatcagctcgtcggcttcagttcttagcctgtcgttcgtgatcctgtcgacctttcaaggggcggtggccgggatcacgttcacgttcacgaaccggtgcggcggcacggtgtggccgggggtgctggccaactcggggagctcgccgctgcagacgacggggttcgcgctgggcgcgggcgaggagcggtcgctggcggcgcccgcggggtggtcgggccggttctgggcgcgcacgggctgcgccttcgacgcgtccggcaaggggtcgtgcgcgacgggggactgcgggtcgggcgaggtggagtgccgcggccggggcgcggcgccgccggcgacgctggcggagttcacgctgggcggcagcgggggcaaggactactacgacgtgagcctggtggacgggtacaacctgcccatggtggtggaggcggcggcgcccgggtgccccgtgacggggtgcctggtggacctcaacgagcggtgccccgcggagctgcgcgccgggcagggccccgcgcaggcgtgccgcagcgcgtgcgaggcgttcggccgccccgagtactgctgcagcggcgactacggcaacccggacacgtgccgcccctccgtctactcgcagatgttcaagacggcgtgcccgcgctcctacagctacgcctacgacgacgccacctccactttcacctgcaccgccaccgactactccatcaccttctgcccgccgcgcgccggcacgcccaacagccagaaggcgaccaaggacccctcgccgaggcccaacgacgtgcagctcgagggcgactcctggctggcgagcctggcgaccggcgagatgggcggcgcggcgtcgacggcggtggcgtcgttgcagctccaggccgcgttagccgcggccgcggtcgttgccttgctggtatgaccgaaggggctcgcagccctcgcgtggcgagacagcggctctcgatcggcagcgggagtggccggagttgctttcggaattcaatacaggattggagcaagtaggatgaagacgtgaagcatattctttttagccttttgtcttgtggatagaggagttgacgaggtggcaactacagcttctagtgttactgtgacggtgtcggtcaacaagcacgctctgcattagtttattctcgatcccttcagcaacacacatgtcactccagttcctttttttgtgtgtatacattgtttctttatttccttattcttcttctatctcttcttgtcacatgcagcattctaagtagagaagtatagtgagatttagcac

SEQ ID NO: 21712 - protein, 310 aa, Panicum virgatum
  misc_feature: Ceres CLONE 1817653
  misc_feature (35)..(245): Pfam Name: Thaumatin Pfam Description: Thaumatin family
MASLISSSASVLSLSFVILSTFQGAVAGITFTFTNRCGGTVWPGVLANSGSSPLQTTGFALGAGEERSLAAPAGWSGRFWARTGCAFDASGKGSCATGDCGSGEVECRGRGAAPPATLAEFTLGGSGGKDYYDVSLVDGYNLPMVVEAAAPGCPVTGCLVDLNERCPAELRAGQGPAQACRSACEAFGRPEYCCSGDYGNPDTCRPSVYSQMFKTACPRSYSYAYDDATSTFTCTATDYSITFCPPRAGTPNSQKATKDPSPRPNDVQLEGDSWLASLATGEMGGAASTAVASLQLQAALAAAAVVALLV

SEQ ID NO: 21713 - DNA, 1319 bp, Panicum virgatum
  misc_feature: Ceres CLONE 1817658
  misc_feature: Encodes the peptide sequence at SEQ ID NO. 21714
gcacgcgccgccgcccgcacgagccgccgcccgccggcaaggaggagcgccggctgcaatctccgctgaagctacttgtaagtctcaacccaatgttgtaagagaaaagggcaaaggaaaatctgtatcttttgctctgtcagatgcttctggggttgttactcctacagataccaattctgagacgggtaacttcagggattcctgtaatgacaaattgattgatgaaaacttaagtaacttgtctcagcagacggctgaaaaggaacataatgattatgagagctggtgccatgatggggaaccattagatcatgctgttgaaccaccaccaaaatcgggtattggagaaaacagatcatctatgaaactacggagcaggaaaaaggcacagaaagatgggacacctaagcatacagatgactattttgatgaagactgtgttgaaccttcattagttgaagaagacaatgatagcggtgatgattacactgccagtactaatcggaaggttaggaaaaaatcaagggatgatgtagaagagccacagcagcaaaatgtccaaaamgataaaagccaggtatcttcacgaggccgcaagagaaccttgaaagatgcatcagcagaaaaaacagagaagaagcttacccatagaattcgccagaggagagcgaaagctttcaatttcatgatatggatgatttggactatggagatgaggaaggaaggaacttcgacaatgacagaacagagaaccatgtacaaaatataaaaaaattaaactaccattcctacatgaacaaacaaactcgatgcaaatggtcaaaatctgatactgatgtgttttaccaggggcttcaacaatttggtagcgattttgcaatgatacagcaattactccctgataagacccgtcagcaggtgcgggcaaaatttaaaactgaggagcaaaaaaatccgttgctagtccatgatgctataattcatcgctcaggagataatttgtatttcaaaaagataattaagaatctcaacattgaagatgtcgcgcagcaagagattaacaatactcataaacaagatggcgcatcaagtgaacgaggccctgaaaaagaggatgtactggatgatttcatccatgaggaagatgattcgaattggttggatgaagagcccagcatacaaatgcctgatgtgcaagaygagcacgcttctggaaatgatgatgatgatggtgatcttggtgatatttttgaytggtactagcatgataatcacgacagaaattaggatcacgatctaattctgcttactttgga

SEQ ID NO: 21714 - protein, 190 aa, Panicum virgatum
  misc_feature: Ceres CLONE 1817658
  misc_feature (40)..(85): Pfam Name: Myb_DNA-binding Pfam Description: Myb-like DNA-binding domain
MDDLDYGDEEGRNFDNDRTENHVQNIKKLNYHSYMNKQTRCKWSKSDTDVFYQGLQQFGSDFAMIQQLLPDKTRQQVRAKFKTEEQKNPLLVHDAIIHRSGDNLYFKKIIKNLNIEDVAQQEINNTHKQDGASSERGPEKEDVLDDFIHEEDDSNWLDEEPSIQMPDVQDEHASGNDDDDGDLGDIFDWY

SEQ ID NO: 21715 - DNA, 703 bp, Panicum virgatum
  misc_feature: Ceres CLONE 1817663
  misc_feature: Encodes the peptide sequence at SEQ ID NO. 21716
tttttacctatacaggcggaagtacaaagctgcacagaagggcattattggactgaatttgtacaccatgtggttctatccattcacagattccaaaatagacattgaagcaactgaaagagcaaagaccttcttatttggctggtatatgttttgtagtgttgattcacctgtagactctagtaatacacagatgttaattttttttccaatatctatttttttgttgatgagttgctccaggtatcccttgacccctgaataattaaaaacttgtccatctttgtggttaagtgtaaatcatattttccaatatgaaactgtcagagtatatagtcgtttaaaagaatttgaagcctaagatccatcgatgtaatgtggaaagctcagttgtctgttcaccctcattcttgaattataaacaagaatttacaaaatttttaggatcctgcatccgttggtgtttggagactatccagagactatgaggaagattaccggttcccgccttccatccttctccagctatgaatctgagcttgttactcacgcatttgacttcattggattgaatcattacacttctgtatatacgagcaatcgtccaaacacaatagagggacccctgcaggacttgtctgctgacttggccattcttttcagaggtttaacgtttgtagacattcctttgcagtaccctcat

SEQ ID NO: 21716 - protein, 87 aa, Panicum virgatum
  misc_feature: Ceres CLONE 1817663
  misc_feature: SWISSPROT Homolog: EC 3.2.1.147 Thioglucosidase
FYLYRRKYKAAQKGIIGLNLYTMWFYPFTDSKIDIEATERAKTFLFGWYMFCSVDSPVDSSNTQMLIFFPISIFLLMSCSRYPLTPE

SEQ ID NO: 21717 - DNA, 607 bp, Panicum virgatum
  misc_feature: Ceres CLONE 1817671
  misc_feature: Encodes the peptide sequence at SEQ ID NO. 21718
gaccccgctctcccagtcggagaagaaggcgcagcgctctccatggcctccatctcgattcccgacccggttcctcccgcccccgaagacgccgagaacattaggaaagctgtgcaaggatggggcacggacgagaaggcgctgatcgagatactgggccaccggacggcggcgcagcgcgccgagatcgccgtggcctacgagggtctctacaacgagacgctcctcgaccggctcccctccgagctctccggcgacttccgggtaaatctcccacccaccacgttccatgattttttttttcgtggtggcttggatagccgagcgatctgacgaagcggcggctgtccctcctgtcccctcgccgccggcggcgtctccggccagagcgcgatgatgctgtggaccatggacccggcggcgcgtgacgccaagctcgcccacaaggccctgaagaagaagggcgaccggcacgtgtgggtgctcgtcgaggtcgcctgcgcgtcgtcgccggatcaccacgtcgccgtcaggaaggcctactgcgccgcctactcggcgtccctcgaggaggacgtggccgcctgcccgctctacaaggaccccc

SEQ ID NO: 21718 - protein, 96 aa, Panicum virgatum
  misc_feature: Ceres CLONE 1817671
  misc_feature (15)..(80): Pfam Name: Annexin Pfam Description: Annexin
MASISIPDPVPPAPEDAENIRKAVQGWGTDEKALIEILGHRTAAQRAEIAVAYEGLYNETLLDRLPSELSGDFRVNLPPTTFHDFFFRGGLDSRAI

SEQ ID NO: 21719 - DNA, 578 bp, Panicum virgatum
  misc_feature: Ceres CLONE 1817680
  misc_feature: Encodes the peptide sequence at SEQ ID NO. 21720
atccagctccatcagctctgccgcctggtggtatagcatctggttattaacgagcaagcgtgtggccatggcgatgttcatcagagccttgcaactggctctcagggagaagaggagcagcatcatttggccaggatcgtcaggcttcgtcgccaatgccttctcatcctcggctccgagctcgcagggtctgcagaggctggccggtaaggtcgccgtcatcactggtggcgcgagcggcatcggcaaggcgaccgccgccgagttcgtcaggaacggcgctaaggtggtgatcgccgacatccaggacgacctgggccacgccgtggccgcggagctcggcggcccgggcgcggcgtgctacacccgctgcgacgtggcggacgaggcgcaggtcgcggcggccgtggacctcgcggtcgcccgccacgggcacctcgacgtcatgttcaacaacgccggcatcggaggcaccacggggctgccgccgccgctggacgccgtggacctcgccgacttcgaccgcgtgatggcggtcaacgcccggggcgtgctggcggggctcaagcacgcggcgc

SEQ ID NO: 21720 - protein, 168 aa, Panicum virgatum
  misc_feature: Ceres CLONE 1817680
  misc_feature (46)..(168): Pfam Name: adh_short Pfam Description: short chain dehydrogenase
  misc_feature: SWISSPROT Homolog: EC 1.1.1.288 Xanthoxin dehydrogenase
  misc_feature: Useful for making plants with modulated biomass
MFIRALQLALREKRSSIIWPGSSGFVANAFSSSAPSSQGLQRLAGKVAVITGGASGIGKATAAEFVRNGAKVVIADIQDDLGHAVAAELGGPGAACYTRCDVADEAQVAAAVDLAVARHGHLDVMFNNAGIGGTTGLPPPLDAVDLADFDRVMAVNARGVLAGLKHAA

SEQ ID NO: 21721 - DNA, 598 bp, Panicum virgatum
  misc_feature: Ceres CLONE 1817681
  misc_feature: Encodes the peptide sequence at SEQ ID NO. 21722
tcgagcaccctccaatcttcaaggcgtcgcagcaggcaaggcatcgatcgatcacaccagcagcgcgtgccgcgtagagagatcgagagagagagagagagagagagagagagagagagagagagagagagagaggagtctcaccggagaagggaggaatcgtcatcgccaccgccaccgccaccgccaccgccatgggcaaggtccgctccttcttctcccgcagcggcaagcgcggcgccggtccgtcctcgccgtcctcctccgcggcgggcagcgcgccgtcgtcgccgtccccgaggaagtcgtcggcgtcggcgccggcggccccggcggcggagaccaaggacgagatggagcgcgtgttccgcaagttcgacgcgaacggcgacgggcggatctcgcggtcggagctggcggcgctgttcgagggcgtgggccacgcggccacggacgacgaggtgtcgcgcatgatggaggaggccgacgcggacggcgacggcgccatcagcctgcccgagttcgccgcgctcgtgcgctccgccgacgccgacgccgacgccggcgaggaggacctgcgccacgccttcatggtctt

SEQ ID NO: 21722 - protein, 134 aa, Panicum virgatum
  misc_feature: Ceres CLONE 1817681
  misc_feature (53)..(81): Pfam Name: efhand Pfam Description: EF hand
  misc_feature (89)..(117): Pfam Name: efhand Pfam Description: EF hand
  misc_feature: SWISSPROT Homolog: EC 2.7.11.1 Non-specific serine/threonine protein kinase
MGKVRSFFSRSGKRGAGPSSPSSSAAGSAPSSPSPRKSSASAPAAPAAETKDEMERVFRKFDANGDGRISRSELAALFEGVGHAATDDEVSRMMEEADADGDGAISLPEFAALVRSADADADAGEEDLRHAFMV

SEQ ID NO: 21723 - DNA, 716 bp, Panicum virgatum
  misc_feature: Ceres CLONE 1817687
  misc_feature: Encodes the peptide sequence at SEQ ID NO. 21724
gtcgcgtcccccctcccccaccagcacggcgagagcggagagctcgtgtcctgacacgacagcgagagcgggagcacgaaggcgaatccaccgcaccctcatggcgacggaaggcgagcagcagcagcagcaggcgccgccggcggaggaggtcgtgtccgtcgagatgcccgcgcccgaggggtggaccaagaagtttactccccagagagggggaagatctgagattgtttttgtttcaccaaccggagaggaaattaagaacaagaggcaactaagtcagtacctaaaggcacaccctggaggtcctcctgctgctgagtttgattggggaactggtgataccccaagacgttctgctcgcattagtgagaaagtcaaggtttttgatagcccggaaggtgagaagatcccgaaacgcagcaggaactcaactggcagaaagggcaagcaggagaaaaaggaggcccctgaaactgaagaagccaaagatgctaaagctggcaaggatgcaaaggaggcccctaacgaagatgctgcgaaggacactgatgtggagatgaagcctggtgaagaggtgaaggaggctcctactggaactgaagacgcagagaaggctgcagacaaggctgatgctcctgctcctgcaccagcagaagaagaaaagaaggaaactgagaaacctgctgaaactgatgttgccccttctgcgtcat

SEQ ID NO: 21724 - protein, 205 aa, Panicum virgatum
  misc_feature: Ceres CLONE 1817687
  misc_feature (15)..(85): Pfam Name: MBD Pfam Description: Methyl-CpG binding domain
  misc_feature: Useful for making plants with modulated drought sensitivity
MATEGEQQQQQAPPAEEVVSVEMPAPEGWTKKFTPQRGGRSEIVFVSPTGEEIKNKRQLSQYLKAHPGGPPAAEFDWGTGDTPRRSARISEKVKVFDSPEGEKIPKRSRNSTGRKGKQEKKEAPETEEAKDAKAGKDAKEAPNEDAAKDTDVEMKPGEEVKEAPTGTEDAEKAADKADAPAPAPAEEEKKETEKPAETDVAPSAS

SEQ ID NO: 21725 - DNA, 1299 bp, Panicum virgatum
  misc_feature: Ceres CLONE 1817706
  misc_feature: Encodes the peptide sequence at SEQ ID NO. 21726
gagaacccttcctctcctgttcgagctccgcgcagccaaaggccccatggcggacacgccctcgtcctcgtcggtgccggcgcccccggaggtggacgcggcctccatcgccgcggtggcggcgccgccggaggagatgacgctggtggtgaagtggcgcgggcaggagcagacggtgcggatggtcggggacgacacgctcggggagctcaagctgcgcatctgcgaggccacgggggtgctccccaagcgccagacgctgctctaccccaagctcatgctcaaggacatcgacgactccaccctcctctcctccatccccttcaagcccaacggcaagataagcatgatcggtactgttgaagaagaaatatttgtcggccaagaagatgatcccgggttactcgatgattttgactttgagcagaatgaagatacacccattaaggataaagatgtttacaagcaaaaattaaagcggcgtgcaagtcagtataagatcaagctcttgaatccatgccgccaaggaaagaagctgcttgtcttggacattgactacactctgtttgaccataagtcgccagctgaaaatcctaaggaacttatgcgtccatatcttcaccagttccttgcagcagcatatacaaaatatgacatcatgatatggtcagcaactagtatgaaatgggtggaattgaaaatggagcaacttggagttcttggcaaccccgactacaaaattactgctcttatggatcacttggctatgataactgtgcaatccgaaaaccaaagtagaaagaaaacttttgactgcaagcctcttggtgtcatttgggctcagttccctgagtactacaacgagaagaacaccatcatgtttgatgacctaagaaggaatttcgtcatgaatcctcagaatggtctcgtgatcaagccattcaggaaagcgcactcgaacagagacaatgataaggagcttgtgaagcttacacactatctgctttccatcggagacctagaagatctcagcaagctggaccatggtaaatgggagtccttcatagatgatagcgcaaagcgacgcaggcgctcctagtttccttcggtacagtgactggtagaaagaaaaacagaaccatcccttttgttttctgttcagtgctatgaactgaacacagacttgcattacagaatgaccaggatagcccccaggatttgtttaaccattctgcaaactgtcactcttggatttcgctttgtagttacagactcagtagtttctgaacttgcttagtg

SEQ ID NO: 21726 - protein, 350 aa, Panicum virgatum
  misc_feature: Ceres CLONE 1817706
  misc_feature: SWISSPROT Homolog: EC 3.1.3.16 Phosphoprotein phosphatase
MADTPSSSSVPAPPEVDAASIAAVAAPPEEMTLVVKWRGQEQTVRMVGDDTLGELKLRICEATGVLPKRQTLLYPKLMLKDIDDSTLLSSIPFKPNGKISMIGTVEEEIFVGQEDDPGLLDDFDFEQNEDTPIKDKDVYKQKLKRRASQYKIKLLNPCRQGKKLLVLDIDYTLFDHKSPAENPKELMRPYLHQFLAAAYTKYDIMIWSATSMKWVELKMEQLGVLGNPDYKITALMDHLAMITVQSENQSRKKTFDCKPLGVIWAQFPEYYNEKNTIMFDDLRRNFVMNPQNGLVIKPFRKAHSNRDNDKELVKLTHYLLSIGDLEDLSKLDHGKWESFIDDSAKRRRRS

SEQ ID NO: 21727 - DNA, 700 bp, Panicum virgatum
  misc_feature: Ceres CLONE 1817708
  misc_feature: Encodes the peptide sequence at SEQ ID NO. 21728
aattccctacctcacccacccaccatctcaaaatctcttgctattctagtattctactattcggcggcaattgcatccaacagtaatcctcccgacgggatcaaatcaaacagaattaagaagaagaagaatcaaggagatgccttcccgggatttcgccaccgccgccggctggaggccgaagcagcagctgcaccaccaccaccagaagctgcagatccgggaggtctgggcggacaacgtggaccgcgagttcacgctcatccgcgccgccatcgagcacttcccctacgtgtccatggacaccgagttcccgggcgtcatccaccgccccggcaacgccaagcaccccgccgccatgacccccgccgagcgctacgccctcatcaaggccaacgtcgacgcgctccacctcatccaggtcggcctcaccttggccgcctcccccaccgccccgcccgccctcgccttccagatcaacctccgcgagttcgacccgcgcctccaccgccacgcccccgactcggtcgccctcctcgccgccagcggcctcgacctcgccgcgcaccgcgccaggggcgtcagcgcgcgcgccctcgccgcgctgctcatgtcctcgggcctcgtctgcaacccggacgtggcctgggtcaccttccactccgcctacgacttcgcctacctcgtcaagctcctcatg

SEQ ID NO: 21728 - protein, 186 aa, Panicum virgatum
  misc_feature: Ceres CLONE 1817708
  misc_feature (28)..(186): Pfam Name: CAF1 Pfam Description: CAF1 family ribonuclease
  misc_feature: SWISSPROT Homolog: EC 3.1.13.4 Poly(A)-specific ribonuclease
MPSRDFATAAGWRPKQQLHHHHQKLQIREVWADNVDREFTLIRAAIEHFPYVSMDTEFPGVIHRPGNAKHPAAMTPAERYALIKANVDALHLIQVGLTLAASPTAPPALAFQINLREFDPRLHRHAPDSVALLAASGLDLAAHRARGVSARALAALLMSSGLVCNPDVAWVTFHSAYDFAYLVKLL

SEQ ID NO: 21729 - DNA, 660 bp, Panicum virgatum
  misc_feature: Ceres CLONE 1817720
  misc_feature: Encodes the peptide sequence at SEQ ID NO. 21730
aaggaagtattttcagaagaatcagggcattctcttggaacaattaatatcgtctgatgaaaatgcaagtgacaagacaaagattttctccttagaagagctagaaaaggcaacaaatgagtttgacccaacacgtattcttggccatggagggcatggcacggtatataaaggcattttgtctgaccaacgagttgtagctataaagaagtccaaggcaatcaaggacggtgagattagcaatttcatcaacgaggttgcaatcctctcacaaataaatcacagaaatatagtgagactctttgggtgctgtcttgaaagtgaagttcctttactagtatgtgacttcatcacccatggttctttacaccaaattcttcatgcccgttcaagtagcgggttctcattatcatggaacgactgtctaaggatagccagtcaagctgcaggagccctatactatctccactccgctgcctcgatatctatcttccatcgggatgtgaagtcctccagcatactcctggatgcaaactacactgccaaagtttcagatttcggcgcttcaagatccgtcccaattgaccaaacccatgttgttacaaatgttcagggcacatttggctacttagatccagaatattaccagacttggaggct

SEQ ID NO: 21730 - protein, 219 aa, Panicum virgatum
  misc_feature: Ceres CLONE 1817720
  misc_feature (41)..(218): Pfam Name: Pkinase_Tyr Pfam Description: Protein tyrosine kinase
  misc_feature: SWISSPROT Homolog: EC 2.7.11.1 Non-specific serine/threonine protein kinase
RKYFQKNQGILLEQLISSDENASDKTKIFSLEELEKATNEFDPTRILGHGGHGTVYKGILSDQRVVAIKKSKAIKDGEISNFINEVAILSQINHRNIVRLFGCCLESEVPLLVCDFITHGSLHQILHARSSSGFSLSWNDCLRIASQAAGALYYLHSAASISIFHRDVKSSSILLDANYTAKVSDFGASRSVPIDQTHVVTNVQGTFGYLDPEYYQTWR

SEQ ID NO: 21731 - DNA, 966 bp, Panicum virgatum
  misc_feature: Ceres CLONE 1817728
  misc_feature: Encodes the peptide sequence at SEQ ID NO. 21732
actcccgcggttcgcacccttttccccctgttcccatctccccctccccactccccattccttccctgcatccaccacctgagagtctgagactcgtcgtcgccctcttcctctccaggaacagcgcgacccgggaggcgaatcagatcaacccccccccccccccctccgcgcaccgaccgtccgggatcgcgaggtgggtttggaacccccgcggttgcgggccgagttaggttgtcttggtcccgtcctcgcgccggctccccttgccggccaaatccccagcggctccgctccttccccaggcagcattttgtttccttgacgtgcaagctttgttgattggagttcgcaatgggaggctgtgcggggaaggcacgtcgggaagacgatgataagcttgatttcaaaggtggaaatgtgcatatcataacaaccaaagagggctgggatcagaagattgcagaagcaaacagagatgggaaaaccgttgtggcaaatttcagcgcttcctggtgcggaccatgccgtgtcattgctcctgtctatgctgagatgtcaaagacttatcctcaactcatgttcttgacaatagatgttgatgacctgatggatttcagctcctcatgggatatccgtgcgaccccgacgttcttctttctcaagaacgggcagcagatcgacaagctggtcggcgctaacaaacctgagctcgagaagaaagtgctagcagccgctggcggcagttcgagcaagtgacagggaactggacaagcttgggctatctactgctcgtctctcattattcgatagtttcccaatgtatagtttcctgtgtctgtgtgcaagtctgtgttgtcagagatgatgctttacagttttgcccttatgcctggtttcgcacatactcaagctgtcaagttatgtgaacctgtgcttgccaaaagacgagataaagagagagag

SEQ ID NO: 21732 - protein, 134 aa, Panicum virgatum
  misc_feature: Ceres CLONE 1817728
  misc_feature (22)..(127): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MGGCAGKARREDDDKLDFKGGNVHIITTKEGWDQKIAEANRDGKTVVANFSASWCGPCRVIAPVYAEMSKTYPQLMFLTIDVDDLMDFSSSWDIRATPTFFFLKNGQQIDKLVGANKPELEKKVLAAAGGSSSK

SEQ ID NO: 21733 - DNA, 650 bp, Panicum virgatum
  misc_feature: Ceres CLONE 1817732
  misc_feature: Encodes the peptide sequence at SEQ ID NO. 21734
attcccccacagcacaaagcagctagacatccactcagctcacacactgcagctagcatttgcttagcttagcaggagcatcatatcgataataataatacaatgacaatggctttgatgatgaagaacaacaggatgcaggcggtggtggcgttggccgttgtcatggcagctgcggcgctggtggcgtcggcgtcggcggccatcacgtgcgggcaggtgggttcggcgctggcgccgtgcatcccgtacgcgacggggaaggcgagcgcgctgccgtcgtcgtgctgcggcggcgtgcgcagcctcaacagcgcggcgcggacgagcgcggaccggcaggcggcgtgccggtgcctcaagagcctggccagcaccgtcaagtcggtgaacatgggcaccgtcgccaccatccccggcaagtgcggcgtctccgtgccattccccatcagcatgtccacagactgcaacaaggtggtatgtacataccagctgatcgacgatgagaagctttggtgacgtcgtccttcacaagatctgctgtaatatacatgttgtactcgatctgtgtgtacgtgcgcatatatatacatgtgtacatgcctatgtacgatcgatgttatgtgcacatgtatgcttgtgtgtcctgc

SEQ ID NO: 21734 - protein, 136 aa, Panicum virgatum
  misc_feature: Ceres CLONE 1817732
  misc_feature (35)..(120): Pfam Name: Tryp_alpha_amyl Pfam Description: Protease inhibitor/seed storage/LTP family
MALMMKNNRMQAVVALAVVMAAAALVASASAAITCGQVGSALAPCIPYATGKASALPSSCCGGVRSLNSAARTSADRQAACRCLKSLASTVKSVNMGTVATIPGKCGVSVPFPISMSTDCNKVVCTYQLIDDEKLW

SEQ ID NO: 21735 - DNA, 566 bp, Panicum virgatum
  misc_feature: Ceres CLONE 1817753
  misc_feature: Encodes the peptide sequence at SEQ ID NO. 21736
atgcggtttttcgtttatctcctcacttcccggagaagtccagcagcgccgcgccagcgccatgaaggacttcgcggggctggggcacctgttcgtggtgtccttcttcttctacttctcctccttcatggtgatcccggcgatcaccgacgtcaccatggaggccgtctgccccggccgcgacgagtgctcccccgccttctacctcagcggcttccagaacgctgtcacccggctgggggcgctcgtggtgacccccgtcgtcggcaacctgccagacaggtacgggaggaaggcgctgctgacgctgccggtgaccgtggccatcttgccgctgtttatcttggctgtgcaaccgctcctactctgccttctacatgtattacgcggcaaacatcgtggccggtatcttctgcggcgccaacctgcattgcatctgccatgcctacgtggcggaccacgtggggccccggcatctcgcggcggcgttcggtctcctctccagagtatcgataaccaggttcgtctcgggtaccctgaacgcgcgcttcctcgccacctcttct

SEQ ID NO: 21736 - protein, 168 aa, Panicum virgatum
  misc_feature: Ceres CLONE 1817753
  misc_feature: Useful for making plants with modulated cold sensitivity
  misc_feature: Useful for making plants with modulated salt sensitivity
MKDFAGLGHLFVVSFFFYFSSFMVIPAITDVTMEAVCPGRDECSPAFYLSGFQNAVTRLGALVVTPVVGNLPDRYGRKALLTLPVTVAILPLFILAVQPLLLCLLHVLRGKHRGRYLLRRQPALHLPCLRGGPRGAPASRGGVRSPLQSIDNQVRLGYPERALPRHLF

SEQ ID NO: 21737 - DNA, 696 bp, Panicum virgatum
  misc_feature: Ceres CLONE 1817760
  misc_feature: Encodes the peptide sequence at SEQ ID NO. 21738
gacgccttttcagttcggccccggagcctggagcggagctgcgcgccggcgccgctaatctgcgcgactggagcggcacggcacccaccgcgcgtggcttgtggggctgagctgagcggagccgctgaggcgtacacttgtggcgcgagcaggcatggcggcggcgctggcgcggcgggtcgcggcggcggcggcggccgtggcgcgggggcgcgggatgtgctcggcggcggggcaagccgccgcggcgctgtcctccgaggagctcatgcggatggagcgggactgcagcgcccacaactaccatccgatccccatggtattctccaaaggagaaggttcacacatagtggaccctgaaggcaacaaatacattgattttctctctgcttattctgcagtcaatcagggtcattgccatccaaaagtcctgagagctttaatagaacaggcagaaaggcttacactcagttctagagctttctacaatgataaattcccaatctttgcggaatttctgacaagcatgtttggatatgacatgatgttaccgatgaatactggagctgaaggagttgaaactgctatcaagttggctaggaaatggggttatgagaagaaaaagataccaaagaatgaggctttgcttgtctcttgctgtgggtgtttccatggtcgaactcttggtgtcatttc

SEQ ID NO: 21738 - protein, 180 aa, Panicum virgatum
  misc_feature: Ceres CLONE 1817760
  misc_feature (56)..(180): Pfam Name: Aminotran_3 Pfam Description: Aminotransferase class-III
  misc_feature: SWISSPROT Homolog: EC 2.6.1.13 Ornithine aminotransferase
MAAALARRVAAAAAAVARGRGMCSAAGQAAAALSSEELMRMERDCSAHNYHPIPMVFSKGEGSHIVDPEGNKYIDFLSAYSAVNQGHCHPKVLRALIEQAERLTLSSRAFYNDKFPIFAEFLTSMFGYDMMLPMNTGAEGVETAIKLARKWGYEKKKIPKNEALLVSCCGCFHGRTLGVI

SEQ ID NO: 21739 - DNA, 617 bp, Panicum virgatum
  misc_feature: Ceres CLONE 1817764
  misc_feature: Encodes the peptide sequence at SEQ ID NO. 21740
accaacaaccaaaggaaagcacgcgggtatgtttagcttcgacgggcgcgcctccaacgaataaagcatcgacaccaggctcgccacccccgcgccgccgtccaagcccagaaaccccgccgcctccgcccgccgccccaggctaatcaggagcgcgccagtcttctccgcccccagcgacgtcgcggagcgaagacaagttgggcttccctggcgcccgtgcactaggagcatggacgccgtcgagcgcttgaatagcgggttcgagcagatcaagacgcaggtctacaacaagaagtcggagctgttctagccgctcaaggacagccaatgccgcaagaacatggtgttcgcctgcgtccactacagctgctgcacgtcggtgaccctgggcctgcagcccggtgaggccttcaccatcctcaacatcaccgccatggtgccgccctagcagaagaacaagtacgccggcatcagggccgccatcaagaacaccggctgcgccctcaacgtggaagtcctcagcgtcgttgggcacagccactggggtggcatcatgacgctcctctccctccaggacggcgcagccgacaccttccacttcgtcgaggactggg

SEQ ID NO: 21740 - protein, 35 aa, Panicum virgatum
  misc_feature: Ceres CLONE 1817764
  misc_feature: SWISSPROT Homolog: EC 4.2.1.1 Carbonate dehydratase
MVFACVHYSCCTSVTLGLQPGEAFTILNITAMVPP

SEQ ID NO: 21741 - DNA, 738 bp, Panicum virgatum
  misc_feature: Ceres CLONE 1817780
  misc_feature: Encodes the peptide sequence at SEQ ID NO. 21742
gctcttcgctctagcttggttccgtgctgatctttactagtagtggttgcctggtgtcgagaggaagcccccggagcacgggaggccggggagcttctcgaggagcgaggggcgcggccatgaggatccagtgcgacgcttgcgagggcgcggcggccacagtggtgtgctgcgcggacgaggcggcgctgtgcgcgcgctgcgacgtcgagatccacgccgccaacaagctcgccggcaagcaccagcgcctcccgctcggcgccgacgtccttccgccgcctaagggcagctcaaagcccgcggctgccgccgggtccgctaaggcgccggccagtaagcccgcgcagccgcaggaggtgccgtcgtcgccgttcctgccgccgtccgggtgggccgtcgaggacctcctgcagctctccgactacgaatccagcgacaagaaggactcgcctctcgagttcaaggagctggagtggttcgcggacatcgacctgttccacggccacgcgccggccaaggccacgacggccgaggtccccgagctcctcgccacgccgcagccggcgagcaacgcggggttctacaagacgagcggtgcgcgccagagcaagaagccgcgggtggagctgcccgacgacgaggacgacttcttcgtcgttcctgatcttggctgagacgtaaagtcttctcatgggtcccctcatcccctgtcatgtgatgtgtatgtatgcaaag

SEQ ID NO: 21742 - protein, 185 aa, Panicum virgatum
  misc_feature: Ceres CLONE 1817780
  misc_feature (1)..(47): Pfam Name: zf-B_box Pfam Description: B-box zinc finger
MRIQCDACEGAAATVVCCADEAALCARCDVEIHAANKLAGKHQRLPLGADVLPPPKGSSKPAAAAGSAKAPASKPAQPQEVPSSPFLPPSGWAVEDLLQLSDYESSDKKDSPLEFKELEWFADIDLFHGHAPAKATTAEVPELLATPQPASNAGFYKTSGARQSKKPRVELPDDEDDFFVVPDLG

SEQ ID NO: 21743 - DNA, 684 bp, Panicum virgatum
  misc_feature: Ceres CLONE 1817797
  misc_feature: Encodes the peptide sequence at SEQ ID NO. 21744
atcagaagaactccaacaacttgcgttggcaacacaacagggaagaaaagcggagggaggggaaagcaaggagggcgctccaatcatcactccaccagcttccctgagcggcgaggagcctaccaccgatccgatcgagttctcggagggggatctccccacgaatcgctccaaccgaaaccctggtcgcccccgcggaccggagggtccaagatgagtttcttgtttgggaagcggaagacgcccgccgagctcttgagagagaacaagagaatgttagatcgatccatcagggaaattgagcgggagaggcaaggattgcaggcccaggagaaaaagctcatcactgagatcaagaaaacagctaaagaaggccagatgggagctgtcaaagtaatggccaaagatcttatccgtacccggcatcagataacaaagttctaccaacttaaatcccagctccaaggagtttctctaagagttcagacgctaaaatcaactcaagctatgggtgatgctatgaagggtgttacaaaagcaatggctcaaatgaataggcagctaaatttgccagggttgcagaagataatgcaagagtttgagcgacaaaatgagaggatggagatggtgagcgaggtgatgggagatgccatagatgatgctttggaaggagacgaggaagaa

SEQ ID NO: 21744 - protein, 156 aa, Panicum virgatum
  misc_feature: Ceres CLONE 1817797
  misc_feature (17)..(156): Pfam Name: Snf7 Pfam Description: Snf7
MSFLFGKRKTPAELLRENKRMLDRSIREIERERQGLQAQEKKLITEIKKTAKEGQMGAVKVMAKDLIRTRHQITKFYQLKSQLQGVSLRVQTLKSTQAMGDAMKGVTKAMAQMNRQLNLPGLQKIMQEFERQNERMEMVSEVMGDAIDDALEGDEE

SEQ ID NO: 21745 - DNA, 1644 bp, Panicum virgatum
  misc_feature: Ceres CLONE 1817803
  misc_feature: Encodes the peptide sequence at SEQ ID NO. 21746
agggctgcactccactcctgaggcgcaggcgcttgtcttccaaatcgtcgccgccggtgtccgatcctccttgcccgtctctccggcggcccccgacctagccgtcgagggaccggattgattttgtttgggggcggacagggatagcctaggacctgaatcgtcggaaatggaggcctcgccgcgtcgccgcaggctccgttcgtcgcttcgccgcaggcgccgttcgccgtcgccggacgcggaggtggcgtcggggtggctggactccctcccgcctgagctgcgcaacgagatcctctcccgcctacccctccgctgcgccgtccgcaccgccgcgctcgcccgggcctggcgccgccgctgggagtccgtcccctccctccgcatcaaatggcccgccggcgcggaccccgacgccatcaccggcgtcctccgacgctactcctgccccgtccgcgagttctgcccctcgcacatcggcgaggcgtctttccgccactccgaccgctggctccgcctcctggcgctcaggggagtccaaaccctcagccttgatttcgagaggtcggatgaggagtcggcccatacgctgcacccctccatcttctcgtgccgtgggctcacggtcctgagactccgtggttgcgacatcccaaccatgcccccaggctttgcagggttcctaaccctaacaaagctgagcctgttcaatgtaggctttccagatggcccgagggagttggaagccttgattgctgcatcccctttgcttgaagaactgtggcttctgttcatacaggttcctgataacaatggcgagtaccttcaatgggaaattcaggcgcccaaactccgatacttgttcattgatcaacttcttgattatggctgggaaatcagtgatcttccatcccttgaggaagcagacattaatgttgcaatgtacaatactcatcgtgatttcgtcaagcttatgacaggactgggtagcaccaagaagctcaaattcgctataccgcctgaagatgttaatgttgtagagggactctcatgccaattcaataacctgaagagtttgtcactgcaaacaagtttgcacttattttctggtgctctatccttattttgtctgctcaggaatgctcctaaccttgaagttttggacattgagctgtatgatctctactctgtggaggaagatggtgaagtagatagtgactttctgaatgcacaatggactgacgatttgttctccaacctcatacgcgttggtgtgacccatctgatgtgcaggttaagtgagatgtgttttattaagtttattttgtccaaggcaagacgacttcgagaattccatgtgtgtctggatgaaggctgtccaaaatccaacgaagatgcagttacagagtttgtaaaatataggagagcttctccaagagccaaggttttcttcagccgcgcggagtatgactgactcctgtaaaagagtacattaggtttggatgtttggtcctaactcttgggaagtttgaagtttagaatatctgctttgtatgatgtagaatgacactttttttatcaaatatgttgtaaaatgacatgaatgaagcgaatgcatgcctttttctttcttttcttttt

SEQ ID NO: 21746 - protein, 435 aa, Panicum virgatum
  misc_feature: Ceres CLONE 1817803
  misc_feature (30)..(77): Pfam Name: F-box Pfam Description: F-box domain
MEASPRRRRLRSSLRRRRRSPSPDAEVASGWLDSLPPELRNEILSRLPLRCAVRTAALARAWRRRWESVPSLRIKWPAGADPDAITGVLRRYSCPVREFCPSHIGEASFRHSDRWLRLLALRGVQTLSLDFERSDEESAHTLHPSIFSCRGLTVLRLRGCDIPTMPPGFAGFLTLTKLSLFNVGFPDGPRELEALIAASPLLEELWLLFIQVPDNNGEYLQWEIQAPKLRYLFIDQLLDYGWEISDLPSLEEADINVAMYNTHRDFVKLMTGLGSTKKLKFAIPPEDVNVVEGLSCQFNNLKSLSLQTSLHLFSGALSLFCLLRNAPNLEVLDIELYDLYSVEEDGEVDSDFLNAQWTDDLFSNLIRVGVTHLMCRLSEMCFIKFILSKARRLREFHVCLDEGCPKSNEDAVTEFVKYRRASPRAKVFFSRAEYD

SEQ ID NO: 21747 - DNA, 1289 bp, Panicum virgatum
  misc_feature: Ceres CLONE 1817809
  misc_feature: Encodes the peptide sequence at SEQ ID NO. 21748
agacagacacgggcacacggcgagcgccgaccggggcccgccagctacgcgcgttgtggcgcaagatcttccgcgcgtgacgggcgggggcaaatcagcaaagcagaggcggagcggagcgccgggcccccgtgtgatccggtcccttcttctttcccgtccggccgtccccctccgcaccacacgacgttggatagattcgccggctcgggactggcggggcgtcggcggcggactcggcacctgcgccatgggctgcgcgtcgtcgaggcagtccggggcgcgcgacgtgatggatcccgaagtgctcgcgtccgagacctcattcacggtgaacgaggtggaggcgctgtacgagctgtacaagaggatgagcttctccatcatcaaggacggcctcatccacaaggaagagttccagctcgccttgttcaggaacagcgagaaagccaacctcttcgccgacagggtcttcgacttgttcgatctcaagcggactggggtgatcgatttcgaggaattcgtgcggtcgctcagcgtattccaccccaaagcgcccacatcggaaaagacggcgttcgcgttcaagctgtatgatctgagggggacaggttacatcgagaaagaagagctaagggagttggtcttggcgcttctagatgagtctcatctgtgcctttcagatagcacagtcgaggagattgtcgataatacattcagtcaagcggactcgaatggagatggcaagatagatcctgaggagtggaaggaatttgtgaagaagaacccggcagcattgagaaacatgtcactcccctatttgcaggacatcaccacggcatttcccagcttcataacgcgatcggaagccaaagactgacagaaatattcaggtagagaagcgtataagcaagcatagttccatcgccccgttacgcctaactttagctgcaatggagtgcatgaggtttgttgcatacgcggcagcctaacgagacatgatgaaaaaactcaggttcgctcactgctgacatactttcgtctaaacatcttgtgtgtagttgactagttgtaattgtaaggaaataataagttgtgagcagttggaattgtagctatatattgctgatggacttaatttagcaggtcagctgctgaagtgtttttgtccatgctgctgcctgtagttgtaaaaagcagcatgattggtggttggtgacgagctatgttcagctggctgtgtttggtaactggtattgatttgttattaaagaaaaatattgttggcg

SEQ ID NO: 21748 - protein, 209 aa, Panicum virgatum
  misc_feature: Ceres CLONE 1817809
  misc_feature (151)..(179): Pfam Name: efhand Pfam Description: EF hand
  misc_feature (70)..(98): Pfam Name: efhand Pfam Description: EF hand
  misc_feature: SWISSPROT Homolog: EC 2.7.11.17 Calcium/calmodulin-dependent protein kinase
  misc_feature: Useful for making plants with modulated salt sensitivity
  misc_feature: Useful for making plants with modulated drought sensitivity
  misc_feature: Useful for making plants with modulated water use efficiency
  misc_feature: The sequence is a functional homolog of SEQ ID NO 2 in US patent 7250555
MGCASSRQSGARDVMDPEVLASETSFTVNEVEALYELYKRMSFSIIKDGLIHKEEFQLALFRNSEKANLFADRVFDLFDLKRTGVIDFEEFVRSLSVFHPKAPTSEKTAFAFKLYDLRGTGYIEKEELRELVLALLDESHLCLSDSTVEEIVDNTFSQADSNGDGKIDPEEWKEFVKKNPAALRNMSLPYLQDITTAFPSFITRSEAKD

SEQ ID NO: 21749 - DNA, 1817 bp, Panicum virgatum
  misc_feature: Ceres CLONE 1817816
  misc_feature: Encodes the peptide sequence at SEQ ID NO. 21750
aggccagcaccgatccgagtgtacaatgccagctccaatcatatcgagcacccatcgctcttcaattttgatggtacacgcccgtgtcctgcatcccacccgaccgatgatgatggagctaccagcaccgtcgccgacgacatccttcctcgccgtcgtgctcgccgccgctctcttcctcgcgtccatcctccgcctccgcgggcgcgccgcgcgcaagtacaacctcccgccgggcccccggccgtggccggtgatcggcaacctggacctgctcggcccgctcccgcaccactccgcccgcgacctctccgcgcggcacggctcgctcatgtcgctccggctcggctccttccccgccgtcgtcgcctcgtcgcccgacatggccaggttcttcctcaagacccgcgacctggcgttcgtggaccgcccccggacggccgccggcaagtacatctcctacaactactccggcctcttctcctcgccctacggcgcgtactggcgtcaggggcggaagctctggcaggccgagctcttcaacgcgaggcggctcgcgtcactcgagcacgtccgcggcgaggaggtgcgctccatgctcagcgacctgcgcgccgctgctgcggcggcggcggcggcggtggcgctcagggaacacctattcatggtgaacctcaacgtcatctcgcgcatggtgctgggcaggaagtacatcgtcgatggggctggctcgccgttcacgcctgaggagttcaggtggatgatcgacgagatattctttctccacggcgtgctcaacgtcggggacgtgatcccgtggctcggctggctggacccgcaggggtacgtcaagaggatgaagaggttggccaagatggttgatcggttcctggagcacgtgctggacgagcacaacgagcggcggcggcgcgagggcgaggggttccttgccagggacatggtggacgtgcttctcgagctcgccgacgaccccaacctcgaggtccccatccaccgggactgtgtcaaggggttcattctagacctcatcggcggcggcacggatacctcggcggtgaccgtcgagtaggccatgtcggagctcctgatgaaccccgacgtccttgccaaggccaccgaggagctggaccgtgtcatcggccgcggccgcctcgtggaggaggaagacatgccgaacctcccctacgtggaggccgtcgtgaaggagaccatgcgcctgcaccctgtggcaccgctcctgacgccgcggctgtcccgggaggacgtgtccgtgggcggctacgacatcccggcaggcacgcgcatcctcatcaacatctgggccatcggccgcgacccggccgtgtgggaggctcccatggagtttcggccggagcggtttatcggccgcggcggcggcgtggacgtgaaagggcaggacttcgagctgctgccgttcgggtccggccgccggatgtgccccggcatcggcctcgggctcaagatggtgcacatgatcctggcgaacctgctgcacgccttcgcgtggaggctccccgacggtgtggcggcggaggagctgagcatggaggagacgttcgggctgaccgtgccccggagggttccacttgaggccgtcgccgagccgaagtgccctgaggcatgcagatttggctcacctctatgctgtgccctgaggcatgcagatttggcctccacatgcgtataagacatgcattgcatatgcccttgtgctgataaaacttcgtcaagactcaagacacctctattggctctatagtactagtactactact

SEQ ID NO: 21750 - protein, 325 aa, Panicum virgatum
  misc_feature: Ceres CLONE 1817816
  misc_feature (40)..(325): Pfam Name: p450 Pfam Description: Cytochrome P450
  misc_feature: SWISSPROT Homolog: EC 1.14.13.21 Flavonoid 3'-monooxygenase
  misc_feature: Useful for making plants with altered carbohydrate content
MELPAPSPTTSFLAVVLAAALFLASILRLRGRAARKYNLPPGPRPWPVIGNLDLLGPLPHHSARDLSARHGSLMSLRLGSFPAVVASSPDMARFFLKTRDLAFVDRPRTAAGKYISYNYSGLFSSPYGAYWRQGRKLWQAELFNARRLASLEHVRGEEVRSMLSDLRAAAAAAAAAVALREHLFMVNLNVISRMVLGRKYIVDGAGSPFTPEEFRWMIDEIFFLHGVLNVGDVIPWLGWLDPQGYVKRMKRLAKMVDRFLEHVLDEHNERRRREGEGFLARDMVDVLLELADDPNLEVPIHRDCVKGFILDLIGGGTDTSAVTVE

SEQ ID NO: 21751 - DNA, 1530 bp, Panicum virgatum
  misc_feature: Ceres CLONE 1817834
  misc_feature: Encodes the peptide sequence at SEQ ID NO. 21752
acgccgctcgacagcgccgcctcccctcggccccagttctctcgcggtctcgccgcgccgccggatcggcgaatccggctgcctccacctccgcacgcgcgcggtcgagctcctcctccgtgctcgccacgccgcgcacctccgagtagcagcagcagtgcccggggttctcgcgcaccgggtggcagcaacctagggcttcctggtccctggaagttgaacttacctacaaacctcaagatgttctccgctccaggcaacaattctttggctcttgcagcccctcgaccagggatggagctggctaacgttcaacagcatccaaatcaggctcctgggcctggtggaaaacaacgcacatccagtctggaggcaccgataatgctgcttacaggtcaccagagtgctatctactgcatgaagttcaaccctgctggaactgtgatagcatcaggctcccatgacaaggatatcttcttatggtatgttcatggtgagtgcaagaacttcatggtactgagagggcacaagaatgctgttcttgaccttcagtggactactgatgggacccagctaatctccgcaagtccggacaagaccgtgagggtgtgggatgtcgagactggcaagcaagttaagaagatggctgagcactcgtcgtttgtcaactcgtgttgcccagcccgcaagtggccgcctcttgttgtgagtggttcagatgatggtacagcaaagctatgggacttgcgtcagagaggtgcgattcaaactcttcccgacaaataccagatcacagctgtgagcttctcggaggcagcagataaggtattcaccggtggcctggacaatgatgtcaagtggtgggatcttcgcaagaatgaagtaacagaatatctcaaaggacatcaggacatgatcactgggatgcaacttagtcccgatgggtcttatctcctgaccaacgcaatggataatgagctcaagatctgggatctgcgtccttatgcaccagagaaccggaacatcaagacccttacaggccaccagcacaactttgagaagaacctgttgaagtgtagctggtcgccagataaccgcaaggtcactgctgggagcgcggaccgcatggtctacatctgggacacgacatctaggcggatcctgtacaagcttcctgggcacaatggttccgtcaatgagactgctttccaccccaccgagccgatcattggatcctgcggcagcgacaagcagatctatctcggggaactttagacgagtatcagtcttatcagctagaagagttctcatgatacttggatgtgaaggagaaaaggaaacgttctgttgctttgcgcctttgcctgtttttgaatgctggatttggctgaccaggatttgtcatttgtagattgtattagcctgttagggccacttggtctaccgtttacgaactgaaccatgttttgtacctgctgccttgcattgctgaaacttgttaccatgcttgaagatcactgattgcatgcc

SEQ ID NO: 21752 - protein, 344 aa, Panicum virgatum
  misc_feature: Ceres CLONE 1817834
  misc_feature (87)..(125): Pfam Name: WD40 Pfam Description: WD domain, G-beta repeat
  misc_feature (44)..(82): Pfam Name: WD40 Pfam Description: WD domain, G-beta repeat
  misc_feature (129)..(168): Pfam Name: WD40 Pfam Description: WD domain, G-beta repeat
  misc_feature (213)..(251): Pfam Name: WD40 Pfam Description: WD domain, G-beta repeat
  misc_feature (305)..(343): Pfam Name: WD40 Pfam Description: WD domain, G-beta repeat
  misc_feature: SWISSPROT Homolog: EC 2.7.11.7 [Myosin heavy-chain] kinase
MFSAPGNNSLALAAPRPGMELANVQQHPNQAPGPGGKQRTSSLEAPIMLLTGHQSAIYCMKFNPAGTVIASGSHDKDIFLWYVHGECKNFMVLRGHKNAVLDLQWTTDGTQLISASPDKTVRVWDVETGKQVKKMAEHSSFVNSCCPARKWPPLVVSGSDDGTAKLWDLRQRGAIQTLPDKYQITAVSFSEAADKVFTGGLDNDVKWWDLRKNEVTEYLKGHQDMITGMQLSPDGSYLLTNAMDNELKIWDLRPYAPENRNIKTLTGHQHNFEKNLLKCSWSPDNRKVTAGSADRMVYIWDTTSRRILYKLPGHNGSVNETAFHPTEPIIGSCGSDKQIYLGEL

SEQ ID NO: 21753 - DNA, 2131 bp, Panicum virgatum
  misc_feature: Ceres CLONE 1817837
  misc_feature: Encodes the peptide sequence at SEQ ID NO. 21754
gtctcttcgatctctagctatatatatagcacgcatattacacacaatagctaactagctagctagctagctagctaggtaataagctagtctcacacaacacaacacaaaagagtagtctctcgatctctttctcgacgatctctgccgcctcaagcagcagatagagcagcagcagcagcagcagctagcagagaaaggggtcggatcggagatgctggatgccatggacgccgcgagcatcataggctacttcaagggcaagagcgtcctcgtcaccggcgcaactgggtttcttggaaagatccttgtggagaagataatgcgcgtgcagcctgatgtccacaagatctaccttcttgtccgagcgatggatgagccatctgcaaagcaacgcgtccagcaagaggtgatagacacggagctgtttgacctcctgagagagaagcatggcaagggcttccagcagttcgtggaggagaaggtggttgcattggccggagacatcatctacgagaacctgggcctggagacacccatgctggaggcgcttgccaaggagatcgacgtcatcgtcaacattgcagcaaccaccaacttctacggaaggtatgatgtttccttggatgtgaacgtgatgggggtgaagcacctctgccagttcgccaagcagtgtgccaacctcaagatgctcatgcatgtctcgaccgctttcgtgtctggcttcagggaggggctgatcctgaagaagcccatcaagcccggcgagtcgctgcgcgaaggcacctacctggacatcgacgccgagctgcgcctcgtcagagaagtcaagaaggagctcatgacggcgatgaactccaactcctcgagcagcagcagcagcgataaggacggcgacgacgcccacaataacaataataagaagaaggcagagaggacggccatgaaggagctgggcctccagcgggctcgccacttcggctggtccaacacctacgtcttcaccaaggccatgggcgaggtgctcctcggccagctccggggcgacatcccggtggtgatcatgcgccccagcatcatcaccagcatccgggaggacccggcgcccgggtggatgcagggcacccgcaccatcgacaccatcatcatcggctacgccaagcagaacctctcctgcttcctcgccaacctcaacttcgtcatggacgtcatcccgggggacatggtggtgaacgccatgatggcggccatggtggcgcactcgggggacaagggcgcgcaggtggtctaccactccacctcgtcgctgcgcaacccggccacctacaacgtgctctaccagtccggccgccgccatttctacgagaacccgcgggtgggcaaggacggcaaagtcatccctaccagggagatgtacttcttcccaaccatcgcgcgcttccacctatacatgatcttcacgtacaagataccactagagattctgcacttggtgaatctgctgctctgcgggttcttctcgcggctctacaacgacctcaaccgcaagtacaagtttgtgatgcatcttgttgatgtctatggccccttcgccttcttcaaaggatgctttgatgatatgaacttggagcggctgaggttgacgatggcgatgaagacccccgaagatcgcatgttcaattttgaccccaagaccatcgactgggacgactacttcaccaaaatccacatacctggtgttctcaagtatttgtgcaagtgaaggctgctacgttaattactctcaacttgcttgttgcttcttcaccttcttgctatagaaaaaaggctcttattcttaatttatggaaagcgaataccatcccgtttgttgtacctgctctatggaccgggtgatcgattatcaagaaaagaaaataagacgagtagattgatatatatagttgtattggagaagctccatatacctctaatagtggccaaacgtgtgcctgtgttaggtggcagcctatcatgagcatgagtatgaagttgtaatctgtttgctgatatgtacgtgtcagtgagcatgaaaaagatctgtaatatctatctgcaatgccagtgaaattgaaggaaaaactaatatcag

SEQ ID NO: 21754 - protein, 515 aa, Panicum virgatum
  misc_feature: Ceres CLONE 1817837
  misc_feature (21)..(342): Pfam Name: NAD_binding_4 Pfam Description: Male sterility protein
  misc_feature (415)..(515): Pfam Name: Sterile Pfam Description: Male sterility protein
  misc_feature: SWISSPROT Homolog: EC 1.2.1.31 L-aminoadipate-semialdehyde dehydrogenase
MLDAMDAASIIGYFKGKSVLVTGATGFLGKILVEKIMRVQPDVHKIYLLVRAMDEPSAKQRVQQEVIDTELFDLLREKHGKGFQQFVEEKVVALAGDIIYENLGLETPMLEALAKEIDVIVNIAATTNFYGRYDVSLDVNVMGVKHLCQFAKQCANLKMLMHVSTAFVSGFREGLILKKPIKPGESLREGTYLDIDAELRLVREVKKELMTAMNSNSSSSSSSDKDGDDAHNNNNKKKAERTAMKELGLQRARHFGWSNTYVFTKAMGEVLLGQLRGDIPVVIMRPSIITSIREDPAPGWMQGTRTIDTIIIGYAKQNLSCFLANLNFVMDVIPGDMVVNAMMAAMVAHSGDKGAQVVYHSTSSLRNPATYNVLYQSGRRHFYENPRVGKDGKVIPTREMYFFPTIARFHLYMIFTYKIPLEILHLVNLLLCGFFSRLYNDLNRKYKFVMHLVDVYGPFAFFKGCFDDMNLERLRLTMAMKTPEDRMFNFDPKTIDWDDYFTKIHIPGVLKYLCK

SEQ ID NO: 21755 - DNA, 1164 bp, Panicum virgatum
  misc_feature: Ceres CLONE 1817839
  misc_feature: Encodes the peptide sequence at SEQ ID NO. 21756
acctctgggactcgtcttggctagagcgttgcgaccgaatccggcaagaggggaaagtggcgcttgcttctatccgtcctcgtctgcgatctccgtccatctagccgtcgcggagcagccacgagatcgcgagcgccgtagatctgtgcgtcaggagatgaagattaccgcccttctggtgctgaagccgtcgagttccggcgccgggagctcctcgtccggtggcgggtcgggcccggaggctgtggtgctcgcgaacgcgacggacgggagccacttcggctacttccagcgcagcgccgcccgcgagttcatcgtcttcgtcgcccgaaccgtcgcacagcgcacccagcctggccagcgtcagtccgtccagcacgaagaatacaaggtccattcacacaacagaaatggtctttgtgcggtggcattcatggacgatcactatcctgtacggagtgcattttctcttctgaataaggttcttgatgagtaccagaaggattttggggactcctggaaatctgctactgcggatggaactcaacagtggcctttcctcacggatgctttgacaaaatttcaggaccctgcagaggctgacaaattaatgaaaatccagagggacttggatgaaacaaaaatcatcctacataaaactattgagagtgttcttgccagaggagagagattggatagcttggttgagaaaagctctgacctgagtgctgcttcacagatgttttacaagcaggcaaagaagacaaaccagtgttgcactatactttaaactctggtcctgtatcattgtttcgaagtaccagagacaaaaacgatctatattgtacgaatttactgtgagttaaattgcccatgaagcgtggttgcaaggcttgaagtcgatgctggtggattgatgttagggagacagcgatttctttccttgattatctggaattgagtttttctccatgtgaaaatcgctgtgttatgatcaagctctgtaccatcattctttggtgattatgcaaccttgtagcacccactaacatcatttattgtactataaggcttaccgcaaactgcataaatcaccgacatcttcgtttcccctgcacagattgttgaattcttaacaaaaaaaaaagattgttgaattctcgg

SEQ ID NO: 21756 - protein, 210 aa, Panicum virgatum
  misc_feature: Ceres CLONE 1817839
  misc_feature (114)..(200): Pfam Name: Synaptobrevin Pfam Description: Synaptobrevin
MKITALLVLKPSSSGAGSSSSGGGSGPEAVVLANATDGSHFGYFQRSAAREFIVFVARTVAQRTQPGQRQSVQHEEYKVHSHNRNGLCAVAFMDDHYPVRSAFSLLNKVLDEYQKDFGDSWKSATADGTQQWPFLTDALTKFQDPAEADKLMKIQRDLDETKIILHKTIESVLARGERLDSLVEKSSDLSAASQMFYKQAKKTNQCCTIL

SEQ ID NO: 21757 - DNA, 696 bp, Panicum virgatum
  misc_feature: Ceres CLONE 1817842
  misc_feature: Encodes the peptide sequence at SEQ ID NO. 21758
ggacaagcacttggcaagcgttccagagccctccacgccattctcctcgcacctgcaccttatcctcttcttgctcccctcctctctccgtccagcgagcaacctgcaatcccccaaacccctcaccgagatcatccctcccggcccttctatatatccatcaccagctcatcccattcgcatcatcacctgcaacgagcaatcaatccccagatttttcacaggcggaaacacgcaaagccgtaactagcagctcatcgaccggctagcaatggcggcggcggcggcggcggaggggacgacgacgaagaagagcggcggcgagatgacggtggtgcgcgggctggacgtggcgcggtacatggggaggtggtacgagatcgcctcggtcccgtccttcttccagccccgggacggccggaacacgcgcgccacctacgcgctgctggaggacggcgcgacggtgcacgtgcttaacgagacgtggagcaagggcaagcgcgactacatcgaggggacggcgtacaaggccgaccccggcagcgacgaggccaagctcaaggtcaagttctacctcccgccgttcctccccatcatccccgtcgtcggcgactactgggtgctctacgtcgacgccgactaccagtacgcgctcgtcggcgagccgcgccgcaagaacctctggatcttgtgcag

SEQ ID NO: 21758 - protein, 141 aa, Panicum virgatum
  misc_feature: Ceres CLONE 1817842
  misc_feature (25)..(141): Pfam Name: Lipocalin_2 Pfam Description: Lipocalin-like domain
MAAAAAAEGTTTKKSGGEMTVVRGLDVARYMGRWYEIASVPSFFQPRDGRNTRATYALLEDGATVHVLNETWSKGKRDYIEGTAYKADPGSDEAKLKVKFYLPPFLPIIPVVGDYWVLYVDADYQYALVGEPRRKNLWILC

SEQ ID NO: 21759 - DNA, 1178 bp, Panicum virgatum
  misc_feature: Ceres CLONE 1817854
  misc_feature: Encodes the peptide sequence at SEQ ID NO. 21760
gattcgaatggtgaggtattgctctttcttttgtgggtccaagctgctgtccctaattaagtccaggtgtaccgtgacacaatcaaggccataattccaattatatttcacagaatggaagcaacatgttctgctcatggccaaacaggatgggaagatggtgccatcctacagctataccacccgactaatcaatttctctgagaagaggaactgggggtacagcaagttcatcaaaaggcaagtcctggagaaatcagagcatctcagggatgattctttcaccgtcaggtttgacgtaactgtcatgaaggatatccatacccagggcacaccgatcattgtggtgccaccgtcagacatgcaccgccagtttggtgacctcctgttgagcaaggagggcgcagatgtcaaattccgagtccgcaagaagacattctccacgcaccggtcagttcttgcagcacggtcgccagtcttcaagaagatgctgcttggcccgatgaaagagggcaccaccactagtgccatacccattgatgacatggaggcagaagtgtttggggctctgcttacttttatgtacacggacgaattacccgatatgcaggagcaagaggaatctgaaatggttcagcatttgcttgttgcagcagacaggtataatctggagagattgaagctgatttgtgaagagaaactgtgcaagcacattgatacaggctctgcagcgaccatcttggcattagcagagcagcacaactgccatgggcttaaggaggcatgcttcgacttcctcggcgcatctacagctctgaaagcaatcatggaaaataatggcttcgagtacttaacaaagaactgccccaacattctgaaggagctagtatccaagggtatttctggttgacttgtgagaagccaatgcatatcatcggcgtgaatatgggtttcatttatggcaatcgcaatggcgtgtaaagcttaggcaaagattctgctgttaaatattagtactattataatttatatgtagttgtccttaagaggggtgtaccgtactccttgggcatcatggagaactattagctacattactttctcacatgcatcttccagttcattgcaagaaactatgtgttatagaaggttcagatggtattgattgattcaattgg

SEQ ID NO: 21760 - protein, 257 aa, Panicum virgatum
  misc_feature: Ceres CLONE 1817854
  misc_feature (80)..(193): Pfam Name: BTB Pfam Description: BTB/POZ domain
MAKQDGKMVPSYSYTTRLINFSEKRNWGYSKFIKRQVLEKSEHLRDDSFTVRFDVTVMKDIHTQGTPIIVVPPSDMHRQFGDLLLSKEGADVKFRVRKKTFSTHRSVLAARSPVFKKMLLGPMKEGTTTSAIPIDDMEAEVFGALLTFMYTDELPDMQEQEESEMVQHLLVAADRYNLERLKLICEEKLCKHIDTGSAATILALAEQHNCHGLKEACFDFLGASTALKAIMENNGFEYLTKNCPNILKELVSKGISG

SEQ ID NO: 21761 - DNA, 1294 bp, Panicum virgatum
  misc_feature: Ceres CLONE 1817866
  misc_feature: Encodes the peptide sequence at SEQ ID NO. 21762
aatgcggagttggttccaaggtcagctccgtcacgtgctcacgggccacggttgcgctgcggcggcggcggcggaagggggcgacgccgatgggcgatgggtcgccgccgcacggtgtgcttagtcaagtacagtagatctaagtcctgaagtaggtaggctgctagaaccaaagagtgagagagccttctgcgatagagctttccgatctctccaacgccatgtctgacaccggtgccggcggcggtgacgaggtcatcctcgatgcgccgggcttcatccgcgtgtacaagagcggccgcgtcgagcgcttcgtaacggcggacttcgccccgccctccaccgatgccgccaccggcgtcgcctcaaaggacgtccccatccttccggaagccggcgtgtcggcgcgcatttacctcccggcgcccccctcctccggaggctacagcggcaggctccccgtcctggtgctcttccacggcggcgggttctgcctcggctccgcgttcgaccccagggtgcacggccacgccaaccagctcgccgcggcgaccggcgcaatcgtcttgtcggttgattaccgcctcgcgccggagcacccggtccccgcgatctacggcgacgcgtgggcggcgctccagtgggtggccacgcacgccgcgggccaggggcccgagccctggttgaccgcgcacgcggacctcggccgcgtccacgtcggcggcgagagcgcgggcgccaacatcgcgcaccacgccgcgatgcgcgccgccgccgaggagctgggccacggcgtcaagctcagctcgctcgtgctgatccacccctacttcctggggggtgacagctccgagacggacgagatgggcatggcgttgcaccgcgagctcgtccggctgtggccggtggtgtgcccgggcacgagcgggtgtgatgaagaccctttgatcaacccgatggcagagggcgcgcctaacctcgctagcttggggtgccggcgcgtgctggtttgccttgggggaaaggacccgatgaggggtagaggaagtctgtattgtgagaagctgaagggaagtggttggtgcggggagatggaggactgggaggcagatggccaggggcacggtttccatttcttgtatccaacgagtgcagaggcggaggcgcaagtcggtgtcattgctgagtttctaagctatggatgacatctccgtttatctactacttcacacggctatggtgaattgttctcgaatttgtatctgattacattttcagttctgggttttgtttc

SEQ ID NO: 21762 - protein, 327 aa, Panicum virgatum
  misc_feature: Ceres CLONE 1817866
  misc_feature (82)..(305): Pfam Name: Abhydrolase_3 Pfam Description: alpha/beta hydrolase fold
  misc_feature: SWISSPROT Homolog: EC 3.1.1.3 Triacylglycerol lipase
MSDTGAGGGDEVILDAPGFIRVYKSGRVERFVTADFAPPSTDAATGVASKDVPILPEAGVSARIYLPAPPSSGGYSGRLPVLVLFHGGGFCLGSAFDPRVHGHANQLAAATGAIVLSVDYRLAPEHPVPAIYGDAWAALQWVATHAAGQGPEPWLTAHADLGRVHVGGESAGANIAHHAAMRAAAEELGHGVKLSSLVLIHPYFLGGDSSETDEMGMALHRELVRLWPVVCPGTSGCDEDPLINPMAEGAPNLASLGCRRVLVCLGGKDPMRGRGSLYCEKLKGSGWCGEMEDWEADGQGHGFHFLYPTSAEAEAQVGVIAEFLSYG

SEQ ID NO: 21763 - DNA, 317 bp, Panicum virgatum
  misc_feature: Ceres CLONE 1817866-R
ccaacccgagggcagagggcgcgccgaaccccgcaagcagggggagccggcgcgcgcgggaacgccccgggggaaaggacccgaagaggggcagaggaagccggcacggagagaagccgaagggaaggggagggggcggggagaaggaggaccgggaggcagagggccaggggcacggacaccagcaccggaacccaacgagggcagaggcggaggcgcaagccggggccagggcggagaaacaaagccagggaggacacccccggaaaccaacaaccccacacggcaagggggaaaggcccccgaacaggcagccg

SEQ ID NO: 21764 - DNA, 1095 bp, Panicum virgatum
  misc_feature: Ceres CLONE 1817868
  misc_feature: Encodes the peptide sequence at SEQ ID NO. 21765
acacaagggggaaactcctctgctcccgccacccccatcgatcctgcctgccgctcgagaggtctggtttctcgctcgtccatggctgcacccgcggaggaggcgtccgccgccgcgtcgccgccgccgccggcctcgccgcgggacggcgtcacggaggaggcgccggcgccgcccgcgaggctccggggcttctggctccttggggaggacaagtccgtgcacagggctctcggtgggggtaaaactgctgatgtactgttgtggaaagacaagaaaacctcagctgcagtagtcggtggtgcaactatcctttgggttctgttcgaagttgtcgaataccatctcctgactctggtatctcaagtgctgattgttgcactgacgatcttgttcctctggtccaatgcaactgttttcatcaataagagtcctcctaatgttcctgaagtgcagatatctgaagatcttgctgtgaacattgcccttaggctgcgtgcagacatcaacaaagcgctcggcttgctgcgggagattgctctgggccatgacctgatgaagttcctaggagtgatcgtggccctctggattcttggggaagtcggagagctctgtgagctcctgagactgatgtacattgtggtcttgatcctccacacggtgccaatactgtaccacaagtaccaggaccaggtggacgatttcgctgcgaaggcacacacggagctctgcaagcagtataaggtcctggacgccaaggtcctgagcaagattcccagggctccacctaaagacaagaagcaaaactagaacgaagatcaaatcagtggacctggaggacgacgacacgcgacttgtattggttctgatgggtggtacatattttctgtttggttagtatctgttgtcttgtcaatagattgtgtggtgagaatctgtagaaaacagtggtctgatatggatggtggtttggttagtatctattgtcttgtcaatacgagtgcgtattttctttttggttaatctcagatgttctaccagctagtaccttacctgactgtatttctgaagatagattgtatatataatataacc

SEQ ID NO: 21765 - protein, 242 aa, Panicum virgatum
  misc_feature: Ceres CLONE 1817868
  misc_feature (56)..(239): Pfam Name: Reticulon Pfam Description: Reticulon
MAAPAEEASAAASPPPPASPRDGVTEEAPAPPARLRGFWLLGEDKSVHRALGGGKTADVLLWKDKKTSAAVVGGATILWVLFEVVEYHLLTLVSQVLIVALTILFLWSNATVFINKSPPNVPEVQISEDLAVNIALRLRADINKALGLLREIALGHDLMKFLGVIVALWILGEVGELCELLRLMYIVVLILHTVPILYHKYQDQVDDFAAKAHTELCKQYKVLDAKVLSKIPRAPPKDKKQN

SEQ ID NO: 21766 - DNA, 1054 bp, Panicum virgatum
  misc_feature: Ceres CLONE 1817871
  misc_feature: Encodes the peptide sequence at SEQ ID NO. 21767
acgccgggtgctagctagccacagagacaagccacgcgatggccacatcttcctcgacccaccatcgccggactcgccttattgggcaggcccagcagcctccggagccggtgggcaatggcgaggaggaggaggaggcgagggactgggcggagctgccggtggacgcgctgctggccgtgctccgccggctggacgccgtcgacatccttacgggggccggccacgtgtgccggccgtggcgccgcgcgacgcgggaggagcccgagctgtggcgccgcgtcgacatgcgccgccgcgccgacctgccctatgacaacgtcgacctccaggtggcggcgcgggctgccgtgagtcgcggcgcgggccggtgcgaggccttctgggctgaggccttcggggacgacgacttcttcctcttcctggccgacgcagcgccgatgctgaagagtctccggctcatctcttgcaacggaattttgccgcacaggatgaacgaggtgatcaggaagcttccattgctagaggagctcgagctctcgcactaccaccagggctccatcaccacctgcctcactggcgtcggcgcagcgtgcccgctcctgacgagcctccggctgagccacgaccgcttctactacttcaggccgggcgtcaccggcggcagcgaggccgcggagatcgctgcgatgcccgggctgcgctccctggagctcttcgccaacagcctcggcaacggcgacctcgcggccatcctcgacggctgccggcggctcgagcacctcgacatccggcactgtttcaacgtcacgatggacggcgagatgagggcccggtgcgctagggtgaagacggtaaggatgccggaggactccatggagggctacgacctccggtacgccagccctgtcagggactgcgtctactacagcagcgtcatgtatcccgatttctagagcggagctcatctcagtctcatccctgagaagttagaacgaataatcctcccgcgtgtgattggatttctggagagtttacaataatggtttgattt

SEQ ID NO: 21767 - protein, 305 aa, Panicum virgatum
  misc_feature: Ceres CLONE 1817871
  misc_feature (35)..(83): Pfam Name: F-box Pfam Description: F-box domain
MATSSSTHHRRTRLIGQAQQPPEPVGNGEEEEEARDWAELPVDALLAVLRRLDAVDILTGAGHVCRPWRRATREEPELWRRVDMRRRADLPYDNVDLQVAARAAVSRGAGRCEAFWAEAFGDDDFFLFLADAAPMLKSLRLISCNGILPHRMNEVIRKLPLLEELELSHYHQGSITTCLTGVGAACPLLTSLRLSHDRFYYFRPGVTGGSEAAEIAAMPGLRSLELFANSLGNGDLAAILDGCRRLEHLDIRHCFNVTMDGEMRARCARVKTVRMPEDSMEGYDLRYASPVRDCVYYSSVMYPDF

SEQ ID NO: 21768 - DNA, 647 bp, Panicum virgatum
  misc_feature: Ceres CLONE 1817891
  misc_feature: Encodes the peptide sequence at SEQ ID NO. 21769
atcgtgagatcgactgtcgagcagtactacgacagggatgccaccatcgccccagccctgctcagactccatttccacgactgcttcgttcaggggtgcgatgcctcggtcttgatctctggagcgtcctctgaaaggagtgcgccgcagaattttggtctgagggggtttgaggtgatagatgacgctaaatctcagctggaagccgtgtgccctggggtggtgtcctgcgctgatatactggctctcgccgcacgtgatgctgttgatctgactggtggcccaagctggtcagtgccactggggagaagagacggcagaatttcattggcttctggtgctagtgccttgccttctcctgccgatcctgtatctattcagagacagaagtttgctgaccagggcctgtcagaccatgatctcgtcacattagttggtgcccacaccatcgggcagacggactgccagttcttcagctaccgtctgttcaacttcaaggcgacgggcaacgcggacccgaccatcagccaggcgttcctgccgcagctccgggcgctgtgcccgcccggcggcgacccggggcggcgggtggcgctggacaaggacagccccggcgcgttcgacgtgagcttcttcaagagcgtccg

SEQ ID NO: 21769 - protein, 215 aa, Panicum virgatum
  misc_feature: Ceres CLONE 1817891
  misc_feature (2)..(215): Pfam Name: peroxidase Pfam Description: Peroxidase
  misc_feature: SWISSPROT Homolog: EC 1.11.1.7 Peroxidase
  misc_feature: Useful for making plants with altered carbohydrate content
  misc_feature: Useful for making plants with altered cell wall content and/or composition
IVRSTVEQYYDRDATIAPALLRLHFHDCFVQGCDASVLISGASSERSAPQNFGLRGFEVIDDAKSQLEAVCPGVVSCADILALAARDAVDLTGGPSWSVPLGRRDGRISLASGASALPSPADPVSIQRQKFADQGLSDHDLVTLVGAHTIGQTDCQFFSYRLFNFKATGNADPTISQAFLPQLRALCPPGGDPGRRVALDKDSPGAFDVSFFKSV

SEQ ID NO: 21770 - DNA, 684 bp, Panicum virgatum
  misc_feature: Ceres CLONE 1817898
  misc_feature: Encodes the peptide sequence at SEQ ID NO. 21771
tcaattccctctcatctcgcgtctccgcacggaggagggccgccctcctcgtccgccgccgcctgccgccggcgagctctccattaccccggcgatggccggcctatccgaaaccagcctcaccaatcacgtctagcacatctcgcccgagcggctgagccacacgtcacaacaacacatcaagccgcgcggatcgacaggatcacaggaagatggaggcgagcgtgggcatccgggcgcggcacggtgcctgggccgggctcgagaagccgcgcggcgcttgctctgcaagagtcccggcggtgaggctcacgccggagaagctgccggcgaggctggctctgggaaccgatccgcggaggagcacggatcctgtgctccgtgccgcaaagatgaaagcttcgtgttgcaagaaatcgacaggtactgaaaaggtccactactctgccgatgaagctctcatactacagcaaaaagcccaggatgttctcccttacttggatggccgatgcatttgtctagtcggaatgatgggttcaggcaaaactacagttgggaagatattagctgaagtactaggttattctttcttcgacagtgataagttggtagagaaggctgtcggtatatcatctgttgctgagatttttcagctccacagtgaagcattcttcagagaaaatg

SEQ ID NO: 21771 - protein, 157 aa, Panicum virgatum
  misc_feature: Ceres CLONE 1817898
  misc_feature: SWISSPROT Homolog: EC 2.7.1.71 Shikimate kinase
MEASVGIRARHGAWAGLEKPRGACSARVPAVRLTPEKLPARLALGTDPRRSTDPVLRAAKMKASCCKKSTGTEKVHYSADEALILQQKAQDVLPYLDGRCICLVGMMGSGKTTVGKILAEVLGYSFFDSDKLVEKAVGISSVAEIFQLHSEAFFREN

SEQ ID NO: 21772 - DNA, 1207 bp, Panicum virgatum
  misc_feature: Ceres CLONE 1817916
  misc_feature: Encodes the peptide sequence at SEQ ID NO. 21773
acttgtcttctctctctccctccgtgtcacgcttccctcgcctgagtcgccccgcctccgatcgaatcgaaccgggtgggcttgcttcgcctcgtttcgtctcgtctcggctctcagcctctcaggaaaccgcaacgagattcctcgcgcgcgcggctcagcagatcgcgcgagcgcgagagggaggagcatgggatcggagggacggggctggaacggcgctggcgacggcgccaggggcggggaggagaaaccgaccaccaccgcggcggtggccgcaggggcgccggcggacgtgcccacgtcggcggcctccgtcgacatctcgctgccgctcccggagatgacgcctcacatcataggtctctgcaagggatcggtcaaagggtggtcatcgctggacagctcgtgcttctccatcgagacggtgtctggcggcatcacgaatctattgctgaaggtatctgtaaaagaagaaactggaaatgagttttctgttactgttcgtttgtatgggccaaatacagacttggtgattgatcggaaaagggaattgcaggcgataccatatctctcagctgcagggtttggggctcgtctacttggaatttttgagaatggagtagttcagtcattcatccatgctcgaacactgtcacctgcagacatgagagaacctagaatagcagctgagattgccaaggagctccacagattccatcaagtagacattccagggtctaaagaaccacaactgtggaatgatatattcaagtttttgaaaaaagcttcagcactgaagtttgaggataatgagaagcggaagagatatgaaacaatctcatttagagaaatacaagatgaagttaaagaacttaaggatctttccgaccttctgcgtgcacctgtggtttttgcacacaatgacttgctttcaggaaatttgatgctcaatgattcggaagggaagctatattttattgattttgagtatgggtcatacagctaccgcggttatgacattgcaaatcatttcaacgagtacgcaggatttgattgtgactataacatgtacccagataaagatgctcagtatcactttttcaggaattatatgcaacctgacagacccagtgaggtgcaggcacaagatctggaagcactttatgtggaaacaaacactttcaggttagcatcgcacatttac

SEQ ID NO: 21773 - protein, 338 aa, Panicum virgatum
  misc_feature: Ceres CLONE 1817916
  misc_feature (99)..(300): Pfam Name: Choline_kinase Pfam Description: Choline/ethanolamine kinase
  misc_feature: SWISSPROT Homolog: EC 2.7.1.82 Ethanolamine kinase
MGSEGRGWNGAGDGARGGEEKPTTTAAVAAGAPADVPTSAASVDISLPLPEMTPHIIGLCKGSVKGWSSLDSSCFSIETVSGGITNLLLKVSVKEETGNEFSVTVRLYGPNTDLVIDRKRELQAIPYLSAAGFGARLLGIFENGVVQSFIHARTLSPADMREPRIAAEIAKELHRFHQVDIPGSKEPQLWNDIFKFLKKASALKFEDNEKRKRYETISFREIQDEVKELKDLSDLLRAPVVFAHNDLLSGNLMLNDSEGKLYFIDFEYGSYSYRGYDIANHFNEYAGFDCDYNMYPDKDAQYHFFRNYMQPDRPSEVQAQDLEALYVETNTFRLASHI

SEQ ID NO: 21774 - DNA, 117 bp, Panicum virgatum
  misc_feature: Ceres CLONE 1817916-R
ggtatctcggggccttcctctccgggaaggttgttttcaaggtatacaggctctccatctccgccggggtccaaatcttcctcttcttggtaagaaatgtatgatcccgcatgtgcc

SEQ ID NO: 21775 - DNA, 864 bp, Panicum virgatum
  misc_feature: Ceres CLONE 1817922
  misc_feature: Encodes the peptide sequence at SEQ ID NO. 21776
aggcctgaatgccattgccattgccattgccattgccattgccattgcccttgccccctcgatcaggtcgtcaggtcagtcagagctgacgacgacgaaataaaatttaagcagctagctagcgtgcccgccacgcgccatatatatggtcgtcgacatggggaagaaggaggaggacgagctgcagctgctggtccgacaagcggccgtgaatgatgatgatgatgagcaagtccaagcactggtgcgcaagatctccggtctcgccgcggccatcgccaagctgccgtccctgagcccgtcccccgaggtgaacgcgctcttcaccgagctggtgacggcctgcgtcccgcccagcgccgtcgacgtcgccaagctggggcccgagctgcaggcgatgcgcgcgcgcctcatccgcctctgcgccgacgccgagggcctgctggaggcgcactactcggacctcctggccgccttcgacagcccgctcgaccacctcgcgctcttcccctacctcagcaactacatcctgctcagcgagctggagcacggcctgctggcgcgccacctgcccggcccgccgccggcgcgcgtcgccttcctgggctccggcccgctcccgctcagctccctcgtgctggcggcgcgccacctgccggccgcgtccttcgacaactacgacatctgcggcgaagccaacgagcgggcgcggcgcctggtgcgcgccgacgccgacctgggcgcgcgcatggcgttccgcacctccgacgtggccctgctcacgcgggagctgctggcgtcctacgacgccatgttcctggcggcgctggtgggcatggccgccgaggagaaggcgcgcgtgct

SEQ ID NO: 21776 - protein, 239 aa, Panicum virgatum
  misc_feature: Ceres CLONE 1817922
  misc_feature (26)..(239): Pfam Name: NAS Pfam Description: Nicotianamine synthase protein
  misc_feature: SWISSPROT Homolog: EC 2.5.1.43 Nicotianamine synthase
MVVDMGKKEEDELQLLVRQAAVNDDDDEQVQALVRKISGLAAAIAKLPSLSPSPEVNALFTELVTACVPPSAVDVAKLGPELQAMRARLIRLCADAEGLLEAHYSDLLAAFDSPLDHLALFPYLSNYILLSELEHGLLARHLPGPPPARVAFLGSGPLPLSSLVLAARHLPAASFDNYDICGEANERARRLVRADADLGARMAFRTSDVALLTRELLASYDAMFLAALVGMAAEEKARV

SEQ ID NO: 21777 - DNA, 618 bp, Panicum virgatum
  misc_feature: Ceres CLONE 1817922-R
agccatgggttctggcatcttacttacctattgaacttgcaacacccaaacacctggttaatatctattagacgcgaatgcagattcaccaaaccttccacaactcgccaagtcctgcgtaggtggtgggcccgcgccatagccgccggccttgctcagagcgttttgatatcaggctgatattcgccctgccgcttcaactgacatgtcggcgcgccgcccttcaggataagtaaccaggtccgtcctagcacttcccgggtaacccagtcagaaatcgaagctgtcctctcggcagttcgctgaggcatggaagtgtggtggcactccggctcctcaattacaagataagactcagtgccggttgcaaccctaagagctcgaaggtgacccgcacatggctgctctcttccgaaattattaggggatatttcagagctgtgccgccatcctatccaaatatatattaataaagcagcagcagccatcttgttgctatctttttctttgtctgttaacaagtatgcatggttaattatgatggcattcatattaattttgtaatgaacggtgtgagtcttagttggtgaaaaagtttgggttttgatactgtagcag

SEQ ID NO: 21778 - DNA, 1535 bp, Panicum virgatum
  misc_feature: Ceres CLONE 1817925
  misc_feature: Encodes the peptide sequence at SEQ ID NO. 21779
acacagcacacattcgcaagactcgccaaacgctttgccgctgtcccgaaatcctccttctccttcctcgccgtcgcggcctcctcccctaatccaacccttccctccatcaatctccctcatcggcatggcgtccgacaccgagggcatcgccgccctcttctccatgtacaacgacgacgaggaagaggaggaggacgccgacgagcccaaccccccttccccggcgccgtccgccgccgccgccgcggcgcacgccgtcacttccccatcgccgctgccctcccaggccgggggcgaggatcccaacccttccatggcgcctcggtcgccttccctccccgaggagtcggcgggccgcaaaaccctagcgagcccccacccttccccggcgcgggggcagcttccgccgctgccctcgcaacgctcttcgtctccctttgcggtctcttccccgtccccgctgcgggccccatcctccgcgctgccgcccgacctgccgcgtcctccgcggcgaggggcgcttgcaatcgtggactatgcgcacgacgagatggccatgtcgcccgagcaggaggtagagccggtgaagatggggagatcatgagcggtgcactcagatctggctcagatgctcagcctgctgaggggaatcatgaagaacgaactccctcagaaccaagtagggacgaacatggcagtagatgtaactagagcagaaattgaagatgcccagatggaggaaactactgatgtttcaactaatggtgaaaatgatgatccattgagtcatttccttcctccacccgtgactagaaaatgctctgcagcattacagcaaaaaattaacagattccttgcgtacaaaagagctggaaagagctttaacgctgaagtgcgcaacaggaaggattacagaaatcctgacttcttgcagcatgctgtgcggtatcaagaaattgatcagatagggacctgtttcagcaaggatgtctttgatccttacgggtatgacaaagctgactactatgatgagatagaaactgacatgaagcgagaaattgagaggaaggaacaggaaaggaaaaaaagcccaaaagttgaatttattcctggaggagtacaacctccaattggtgcatcaatgccaaagattccagctttagctggtgttgcgacacttccggtacctgcagaaggtgtaaaaaaggagactaggccaaacaagaagtcaaagtgggataaggttgatggggatgttaagaaccctgcagttcctattgggcacaacaatttatcagcaacagtttcttcagcacttttgacttctgctgctaatgttggtgctggatatgctgcttttgcgcaacaaaagagaaaagaagctgaagagaagagaggtgattacaagtcagacagaagatcttagtgctgccttttcttttacatctgagccatcagtgtaccattgagatttttgacatagttttgtaatgtggttgaggaaaaagaaatcagcatcgatccagagttgt

SEQ ID NO: 21779 - protein, 265 aa, Panicum virgatum
  misc_feature: Ceres CLONE 1817925
  misc_feature (56)..(152): Pfam Name: HCNGP Pfam Description: HCNGP-like protein
MLSLLRGIMKNELPQNQVGTNMAVDVTRAEIEDAQMEETTDVSTNGENDDPLSHFLPPPVTRKCSAALQQKINRFLAYKRAGKSFNAEVRNRKDYRNPDFLQHAVRYQEIDQIGTCFSKDVFDPYGYDKADYYDEIETDMKREIERKEQERKKSPKVEFIPGGVQPPIGASMPKIPALAGVATLPVPAEGVKKETRPNKKSKWDKVDGDVKNPAVPIGHNNLSATVSSALLTSAANVGAGYAAFAQQKRKEAEEKRGDYKSDRRS

SEQ ID NO: 21780 - DNA, 1336 bp, Panicum virgatum
  misc_feature: Ceres CLONE 1817929
  misc_feature: Encodes the peptide sequence at SEQ ID NO. 21781
ccccgcatcctcttcccatgcacgcccgcctccgcttcagccctctgctccacttcccggcgcattaaacaagtcgcgcggcgcgccgagtttggtgcagttcagttgggttcagctcgttctttgttggagaaattgaggcgttgagtcggagatgggtatcctctcgctcatcaccggtaaggcgggcgccagcgggttcgggtcggcgtccacggcggagcaggtcatcgacggcgtcgacgccagccgccttaccgtcatcatcacaggaggagctagtggcattggtctggagacatcaagagtttttgcccttagaggagcccatgtcattattgccgcgagaaacactgaggctgcatcagaagcaaggaagaccatcttggagaagaacccaacagcacgtattgatgttctgaagcttgacctcagctccctcaagtctgtcagggcttttgcagaccagttcaactcgatgaaacttcctctgaacatcttgataaataatgcaggtgtgatgttctgcccttttcaactgtctaaagatggagtcgagatgcaattcgccaccaatcatctcggacactttctgcttaccaatctcctccttgataatatgaaagccactgccaagtctacgggtattgagggtcgcatcgtgaacttgtcatcagttgcccacgcccatacatacccaaagggaattgaatttgacagaatcaatgatgagaaaagataccatgataaaatggcttatggacaatctaagctggcaaacttactgcacgcaaatgagctctctagacggctcaaggaagaaagagcaaacatcacagttaatagtgttcatcctggattgatcatgaccaatttgatgaggcattcctacattctcttgaagatcgttcaagttgcaactttcgtactgtggaagaatgtacaccagggagcagcaactacttgttacgtaggactgaacccacagctgaggggagtgacaggaaaatactttgctgactgcaatgaggagaagacgaccaaactgggacagagcgacgaattggcaaagcaactctgggacttcagcgaggagctgatcaagtccgcgcaatgagagccataggagctggatcagaggagtgttctgattgtgcttggcatttggtgttaccagtggttataggaacctgatcaatggtggagctggtggtgttcagaaataaatctccacgcatgctttcctagcttattctggtgtgacaaagatcaacctgtgtactcttttttaatacccgtgcaatatatgtccagctgagttctggtttgaacttcg

SEQ ID NO: 21781 - protein, 320 aa, Panicum virgatum
  misc_feature: Ceres CLONE 1817929
  misc_feature (34)..(181): Pfam Name: adh_short Pfam Description: short chain dehydrogenase
  misc_feature (36)..(124): SWISSPROT Homolog: EC 1.3.1.33 Protochlorophyllide reductase
  misc_feature (112)..(187): SWISSPROT Homolog: EC 1.1.1.184 Carbonyl reductase (NADPH)
MGILSLITGKAGASGFGSASTAEQVIDGVDASRLTVIITGGASGIGLETSRVFALRGAHVIIAARNTEAASEARKTILEKNPTARIDVLKLDLSSLKSVRAFADQFNSMKLPLNILINNAGVMFCPFQLSKDGVEMQFATNHLGHFLLTNLLLDNMKATAKSTGIEGRIVNLSSVAHAHTYPKGIEFDRINDEKRYHDKMAYGQSKLANLLHANELSRRLKEERANITVNSVHPGLIMTNLMRHSYILLKIVQVATFVLWKNVHQGAATTCYVGLNPQLRGVTGKYFADCNEEKTTKLGQSDELAKQLWDFSEELIKSAQ

SEQ ID NO: 21782 - DNA, 1018 bp, Panicum virgatum
  misc_feature: Ceres CLONE 1817930
  misc_feature: Encodes the peptide sequence at SEQ ID NO. 21783
gcttcgcagatgcgcttgccgcacccgcactgcttcccagctgcgcctgccacctccaccgcctcctcctcctcctcctcctccgccgtcgctggtgcccgatgtcgagcccgtctgaagtttctcccccaccagcaacctccgccaggcgctcctccacccccactggcgctgcctagcgcccagagcgccgactacccccatagtcgaggcgacgggcttcgcctagcgactaatcgcgcctaggcgccgcctagccgaactttagttcccactatatgttactatttgtgccctttagctctaataactgactcaaattgtgcgaattgttcatgtagtatttagagaaaaccttgaagcttacttacgaggagggaattcaaatgttgaaggaagctggcacagaaattgagcctatgggtgacctcaacactgaagctgagaaaaaacttggtcgacttgtcagggagaagtatgggacggattttttcattttgtactgttatcctttggctgtacgtccgttctacaccatgccatgttatgacaatccagcttacagcaattcttttgacgtgtttatccgaggcgaagagataatttctggagcacaaagaatacacacacctgagctgttggcgaaacgtggagcagagtgtggaattgatgtgagtacaatctcggcatatattgaatcattcagttatggcacacctcctcatggtggctttggggtgggcttggagagagtcgttatgcttttctgcgccctaaacaacatcaggaaaacatcactattccctcgtgacccccaaaggcttgtcccataattttcattttaccatagctgaggacaatcccattgtgaaatccatctttgccaaccctgtctctcagctgttgatacaataggctcgttgttttggcagtagggctgttgcgcaaagctacaagtttttactagtttgattaaagccattgaacaatacataccttgacaccttgttcgtggatt

SEQ ID NO: 21783 - protein, 148 aa, Panicum virgatum
  misc_feature: Ceres CLONE 1817930
  misc_feature (1)..(144): Pfam Name: tRNA-synt_2 Pfam Description: tRNA synthetases class II (D, K and N)
  misc_feature: SWISSPROT Homolog: EC 6.1.1.12 Aspartate--tRNA ligase
MLKEAGTEIEPMGDLNTEAEKKLGRLVREKYGTDFFILYCYPLAVRPFYTMPCYDNPAYSNSFDVFIRGEEIISGAQRIHTPELLAKRGAECGIDVSTISAYIESFSYGTPPHGGFGVGLERVVMLFCALNNIRKTSLFPRDPQRLVP

SEQ ID NO: 21784 - DNA, 418 bp, Panicum virgatum
  misc_feature: Ceres CLONE 1817941
  misc_feature: Encodes the peptide sequence at SEQ ID NO. 21785
ccccgccgcgcccgcccagcacgacggcgccggccgagcagacgccgccgccacgacgccgcccgccaccggcgccgacgcacccgccgcggcgggagaggaagcccccgccgccgccgccacggggcgccccggcaggcacgagcccggcgacccccgcggccgcggcgcgcccgccaaggcgcaccgcgcgcgggaccaccccaccggccgccccgccgcgaccaagccacttttttttccccgcgccgccggggccgagaaggggcgccgccccgtggccattgagcgcgaggcggccatcctccgccgcctgcgccgccgccacgtggtgcgcctccacgagatcctaaccacgcgcaagaaggtccatttcgtcctcgacctcgccgccggcggcgagctcttctcgctcgtc

SEQ ID NO: 21785 - protein, 138 aa, Panicum virgatum
  misc_feature: Ceres CLONE 1817941
  misc_feature: SWISSPROT Homolog: EC 2.7.11.1 Non-specific serine/threonine protein kinase
PAAPAQHDGAGRADAAATTPPATGADAPAAAGEEAPAAAATGRPGRHEPGDPRGRGAPAKAHRARDHPTGRPAATKPLFFPRAAGAEKGRRPVAIEREAAILRRLRRRHVVRLHEILTTRKKVHFVLDLAAGGELFSL

SEQ ID NO: 21786 - DNA, 1209 bp, Panicum virgatum
  misc_feature: Ceres CLONE 1817954
  misc_feature: Encodes the peptide sequence at SEQ ID NO. 21787
tgccttctccctctcgagcctgagctgcaacatacgagcagcgagagaaatggcgagcgcggcatcctcgaggtgctccggcgttctcctccccccgaacctcgccggagcccgctgctgcccgcgtccgtcctcctccctccgcttccgttcgcggtcggcccggcgccgcccggggaccctcgcctgcgtcgcgccgccggactccgcggagcagcagacggatgagcagactgtgaaagcggagtcgactgtgggagaggctcagacaaccagcacgtcccaggatgctggacttccagctctcccaaataaggatctcaacagaagggtagcattactgtccactcttggggcagtagctctctttgggtcgcagaggctcaatcttactgaggcgtctcttaaagatcttgcagccaattcagttccatatgaggaggctctttcaaatggcaaacccactgttgttgagttttatgcggactggtgtgaagtttgccgagagttagctccagatatctaccaagttgagcaacaatacaaggaccgtgtcaactttgtcatgttcaatgtcgacaatacaaagtgggaacaagagcttgatgagtttggggtagaaggcatcccccattttgcctttctggataaggaaggaaatgaggaaggcaatgttgttgggagactcccaaaacagtattttcttgacaacgtggtggcacttgcttctggtgattccaacatacctcatgcacgagttgtgggtcagttctcaagtgctgaatctaggaaagttcatcaagttgccgatcccagaagtcacggctagtagttgctggctctgtgggtgctgggtagcagtataatggcaagaccatttgacaagaggcgaccctaggctatactattaagtattaacacaaccagtcttggtatcaaggcatcaagcttgcgggcgctggcaagagctggtgggtttcataataaacgccagaagaaaatgatggctgctgcagcaatcgtcaatggggtcatgaagatttccggatatgatttgttgatttgcatgtgtggattctggggacccatcttcagcgttgatttgtcagtgatgaatgacacggaaacgattgcaccttgtaccccacatgcttatatgtactgagataaatagtacagccgcggctatgcattacattacagtagggc

SEQ ID NO: 21787 - protein, 259 aa, Panicum virgatum
  misc_feature: Ceres CLONE 1817954
  misc_feature (117)..(225): Pfam Name: Thioredoxin Pfam Description: Thioredoxin
  misc_feature: SWISSPROT Homolog: EC 1.8.1.8 Protein-disulfide reductase
MASAASSRCSGVLLPPNLAGARCCPRPSSSLRFRSRSARRRPGTLACVAPPDSAEQQTDEQTVKAESTVGEAQTTSTSQDAGLPALPNKDLNRRVALLSTLGAVALFGSQRLNLTEASLKDLAANSVPYEEALSNGKPTVVEFYADWCEVCRELAPDIYQVEQQYKDRVNFVMFNVDNTKWEQELDEFGVEGIPHFAFLDKEGNEEGNVVGRLPKQYFLDNVVALASGDSNIPHARVVGQFSSAESRKVHQVADPRSHG

SEQ ID NO: 21788 - DNA, 1341 bp, Panicum virgatum
  misc_feature: Ceres CLONE 1817981
  misc_feature: Encodes the peptide sequence at SEQ ID NO. 21789
aaaaaaacgggaaaaaaattatctcccaagaactctgccaaaacccttgtccctctcccgatctccccggcggctgacccgaatccgcgttctcaggctcgggatccgggcgctcgcggcgatggacggcggcggcgggggcggcgcggaggggaagctcacggcgcaggagacggcgctctacgaccgccagatccgcgtctggggcgtcgatgcccagaagaggctaagtaaggcgcacgtgcttgtgtgcggcatgaacggaaccaccattgagttctgcaagaatattgttctagcaggagttggtagtttatccttaatggatgatcacatggtcacggaggacgatctgaatgcaaatttcctgattcctccggatgcgagcatatatggtggtagatctcgagcggaagtttgctgtgagtccttgaaagatttcaatcctatggttcgagtttctgtcgagaagggtgatccatcactggttgatggagaattcctcgacaaatttgacatcgtcgtagttagtggtgcatctcttaaaacaaagctgtttattaatgacaactgccggaagagaagcaagcgtattgcattttacgctatagactgcaaggactcctgtggtgaaatatttgttgacttacagaagcatagttatgttcagaaaaggcctggaggagatactgaacagcaggagttgacatatcctagtcttcaggaagctatctcggtacgttggaaaactctaccaaagaagacagcaaaattatactttgccatgagagtcctggagaattatgaattatctaaagggtgtaatcctggtgaaacaacactttctgatatacctgcagttttgtctcataggaaggacatgtgtgataaaatgtccttgagtgagtctcaaattcctactgcactcatggaacgactgctagcagctggaaagaaggaacatcctcctgtatgtgccatcctaggtggtattcttggtcaggaggtgattaaatcaatatcctgcaagggtgatccaatcaagaatttcttcttttttgatgcggctgacggtaaaggtgtcatcgaggatatcccaccaccaccacctacggcaaactgacatgctcagctacctaactaccaactcttcctggttcactaatccttgtacccactcattagcatcgaacatgtagcaacttagattcggagccaagtgagaaggcaagttgacttcactccaatgtggtgtcttaggatttgtatcaggcagaaaacgtggcagtatgcactaacaatttcaagctgaaatctggatggtttccatgcttttgggcg

SEQ ID NO: 21789 - protein, 333 aa, Panicum virgatum
  misc_feature: Ceres CLONE 1817981
  misc_feature (37)..(174): Pfam Name: ThiF Pfam Description: ThiF family
MDGGGGGGAEGKLTAQETALYDRQIRVWGVDAQKRLSKAHVLVCGMNGTTIEFCKNIVLAGVGSLSLMDDHMVTEDDLNANFLIPPDASIYGGRSRAEVCCESLKDFNPMVRVSVEKGDPSLVDGEFLDKFDIVVVSGASLKTKLFINDNCRKRSKRIAFYAIDCKDSCGEIFVDLQKHSYVQKRPGGDTEQQELTYPSLQEAISVRWKTLPKKTAKLYFAMRVLENYELSKGCNPGETTLSDIPAVLSHRKDMCDKMSLSESQIPTALMERLLAAGKKEHPPVCAILGGILGQEVIKSISCKGDPIKNFFFFDAADGKGVIEDIPPPPPTAN

SEQ ID NO: 21790 - DNA, 667 bp, Panicum virgatum
  misc_feature: Ceres CLONE 1818000
  misc_feature: Encodes the peptide sequence at SEQ ID NO. 21791
acaattctaggctcggtcggctcaccgccccggtgaccgccgccgcctttgacgcctgactccgccgccgtctcgcaccagaactgcgtgtttggccaaaacccacgggaagcgcttgtctttgctgagctgctcgcgcgcggagctctggctacttgacttcgggtttgttcccccatctgaagccaagattcggagcgtcgccgagggaaggcgatgaaggggaagagcggcgcgatggaccggaggtcctccaccaggtggaggatgctggtgctctgcgcattcagctttggcctcggcatgctcttcacggaccggttctggacagcaccagataccaacaaccatatcatgtctcaacgccggaggcaagatcaagagctgcagctcgtatcagaggattgcaatacaaagaggcgtggggaagacaaagatataatgggagaggtaaccaagacccatgaagctatacaatcattggataagtccatctcaactctgcagatggagcttgcagcaaagaggagcacactggagctgctccgttctagtggttcgccagtaacctctgaaactagccaaccaaggaaaaaggcatttgttgtcattggtgtcaacaccgctttcagcagccggaaacgccgtgattcagtgcgggagacat

SEQ ID NO: 21791 - protein, 150 aa, Panicum virgatum
  misc_feature: Ceres CLONE 1818000
  misc_feature: Useful for making plants with altered carbohydrate content
MKGKSGAMDRRSSTRWRMLVLCAFSFGLGMLFTDRFWTAPDTNNHIMSQRRRQDQELQLVSEDCNTKRRGEDKDIMGEVTKTHEAIQSLDKSISTLQMELAAKRSTLELLRSSGSPVTSETSQPRKKAFVVIGVNTAFSSRKRRDSVRET

SEQ ID NO: 21792 - DNA, 1889 bp, Panicum virgatum
  misc_feature: Ceres CLONE 1818014
  misc_feature: Encodes the peptide sequence at SEQ ID NO. 21793
acaagaataattaattttttttctcgctccgctcctccgctcccccttgcggcattgccctcctccccgtcgcggcctcgcccaccgcgccttcgaggagcttcgaatcgcgatcgctccggtccccgcgagctcacatggtgggcgcgcgcgtcggagcctagggttcccagttcccaccattctcctgctgattggaaccacagtgtttcggcgagcctgtggcggtggtggaggcggagatgaacggggaggtggaatgcagcgtgtgccacgcgaaggtgccggtgccggcggcggtgtccaaggcgtacgacagccaccggagcaccgtgtcgtcgcgacagcgcgcgctcaacgtgctcctcgtctccggcgactgcgtcctcgcgggcctccagcctatactagtgtacatgtcaaaggtggatgggaaattcaaatttagcccgatcagcgtgaatttcttgacggagattacaaaaattatctttgccatcatcatgctatccatccaggctcgacgtctaaaggtgggggacaagccacttctcacagtatcaacgtttatgcaggctgctcgcaataatgttcttcttgcagttcctgcttttctctatgctatcaacaactatttgaagttcataatgcagttatattttaatcctgcaagcgtgaaaatgctcagtaatctcaaggttctggtaatcgctgtgcttctgaagataataatgaggaggcgattttccacaatccagtgggaggcccttgcccttttgttaatcggaatatctgttaatcagctgaaatcattgcccgaaggttctagcgcgctaggtcttcccgttgcagctggagcctacatatatacactattttttgtaacagttcctgcattggcttcagtttacaatgagaaggctctcaaaagccagtttgataccagtatttaccttcagaacttatttctgtatgggtatggtgcaatattcaattttctggggcttgtaatcactgctatcatccaagggcccagtagctttaacattctggaaggacattcaaaggccacaatgttccttatctgcaacaatgccgcacaaggcatcctgtcatcatttttcttcaagtacgcagacactattttgaagaagtactcgtcaacaattgcaactatcttcaccggagttgcctctgctgtattgtttggacacactctgacaataaattttgttcttggaatttcaatagtaatcatatctatgcatcagtatctttcgaaccaaattaaggacgaagtgcctagcagcaaagttgaaatggctcaagttcatgatcacagcagagttacggaatctatttgcgtcaatgtaactgattcagtggcaaatgaggctaaacaccgccatggatctgacgagaggcagccactccttcctgtatgattttacagcagagcaggcacaccgtctccttggatgagcgcagcggacatctgacttaccttagtgagtttctgacctatgtctgtgaagccacattgctgccgtgctgttggccgagtaagaacatgcatgctgcacggcagaatggcgagcttcctgaaagagtaaaagatgaatgaggcaatacctttagcctagtggcggtaacactaatgtgataggatttgcgaggaataaagtctcatatttcatcatttttcgccctcatgagagcttacataaccatcagaagtggttctatcgagtgatatttttccagttgcggcaccaatgtaaatagcagttcgtcttcatgttatgtgagagttgcatgaggagatgttatggcgtgtttggtaagctttgaacatgtcttttgatttacagaggaacgacacaggttag

SEQ ID NO: 21793 - protein, 400 aa, Panicum virgatum
  misc_feature: Ceres CLONE 1818014
  misc_feature (101)..(337): Pfam Name: Nuc_sug_transp Pfam Description: Nucleotide-sugar transporter
MNGEVECSVCHAKVPVPAAVSKAYDSHRSTVSSRQRALNVLLVSGDCVLAGLQPILVYMSKVDGKFKFSPISVNFLTEITKIIFAIIMLSIQARRLKVGDKPLLTVSTFMQAARNNVLLAVPAFLYAINNYLKFIMQLYFNPASVKMLSNLKVLVIAVLLKIIMRRRFSTIQWEALALLLIGISVNQLKSLPEGSSALGLPVAAGAYIYTLFFVTVPALASVYNEKALKSQFDTSIYLQNLFLYGYGAIFNFLGLVITAIIQGPSSFNILEGHSKATMFLICNNAAQGILSSFFFKYADTILKKYSSTIATIFTGVASAVLFGHTLTINFVLGISIVIISMHQYLSNQIKDEVPSSKVEMAQVHDHSRVTESICVNVTDSVANEAKHRHGSDERQPLLPV

SEQ ID NO: 21794 - DNA, 667 bp, Panicum virgatum
  misc_feature: Ceres CLONE 1818025
  misc_feature: Encodes the peptide sequence at SEQ ID NO. 21795
accggcacacttcaattccactcaaaactttctctcttcctcctcatcttcgtcttcctctctctagctgctgcggtcatactttctctctcttcctctgccaagaacaccggccggctagcagcttgtgtttgttgttcccatggagatcgacggcgacaacctcagcgccaccgagctccggctcggcctgcccgggagcagcagcggcgacgaccggccgaggaggccggcgccctccgtcggcgccaagcgcgcgctcgaggacaccaggagcgaggcgtccggcaccacggccgccggcgacgaccacgacgacgccacgcctgctgccaagtaagcgcgacgcccaccccacgcccccccccctccgtgctcccctgcatccgaatacagagtacatgagctgaccatggttgttacttgtcaactcctcttcaccagagcgcaagtggtggggtggccgccggtgagggcgtacaggaagaacaccttccaggcggcggcgaagaaggccgagcagccgggagggctgtacgtgaaggtgagcatggacggggcgccgtacctcaggaaggtggacctccggatgtacaaggggtaccgggagctcagggaggcgctggacgccctcttcaccaagtccttctccgccgccgccgccgcc

SEQ ID NO: 21795 - protein, 84 aa, Panicum virgatum
  misc_feature: Ceres CLONE 1818025
  misc_feature (4)..(84): Pfam Name: AUX_IAA Pfam Description: AUX/IAA family
  misc_feature: The sequence is a functional homolog of SEQ ID NO 648 in the 11/479,226 US patent application
  misc_feature: The sequence is a functional homolog of SEQ ID NO 636 in the 11/479,226 US patent application
  misc_feature: The sequence is a functional homolog of SEQ ID NO 2002 in the 10/374,780 US patent application
  misc_feature: The sequence is a functional homolog of SEQ ID NO 644 in the 11/479,226 US patent application
  misc_feature: Useful for making plants with altered terpenoid content
  misc_feature: Useful for making plants with altered alkaloid content
  misc_feature: The sequence is a functional homolog of SEQ ID NO 737 in the 10/374,780 US patent application
  misc_feature: Useful for making plants with modulated nitrogen use efficiency
  misc_feature: The sequence is a functional homolog of SEQ ID NO 2004 in the 10/374,780 US patent application
  misc_feature: The sequence is a functional homolog of SEQ ID NO 660 in the 11/479,226 US patent application
  misc_feature: The sequence is a functional homolog of SEQ ID NO 890 in the 10/412,699 US patent application
  misc_feature: The sequence is a functional homolog of SEQ ID NO 652 in the 11/479,226 US patent application
  misc_feature: The sequence is a functional homolog of SEQ ID NO 656 in the 11/479,226 US patent application
  misc_feature: The sequence is a functional homolog of SEQ ID NO 738 in the 10/374,780 US patent application
  misc_feature: The sequence is a functional homolog of SEQ ID NO 290 in the 10/412,699 US patent application
  misc_feature: The sequence is a functional homolog of SEQ ID NO 674 in the 11/479,226 US patent application
  misc_feature: The sequence is a functional homolog of SEQ ID NO 736 in the 10/374,780 US patent application
  misc_feature: The sequence is a functional homolog of SEQ ID NO 667 in the 11/479,226 US patent application
MVVTCQLLFTRAQVVGWPPVRAYRKNTFQAAAKKAEQPGGLYVKVSMDGAPYLRKVDLRMYKGYRELREALDALFTKSFSAAAA

SEQ ID NO: 21796 - DNA, 1467 bp, Panicum virgatum
  misc_feature: Ceres CLONE 1818044
  misc_feature: Encodes the peptide sequence at SEQ ID NO. 21797
gaacgaggcagccgccgcccaacggccgaggagcgacgcggatcggctcccggtgatgcggtgctgctggtgcctgccttgtacgccgtgacagcgacattcttttctttacctgaccgtgtccccaagcaccacgccgacgccctcgccctcgccctcgccccccgcccccggcccggcccctgcggcctcggcttccttatatagagccccctcgcccacccgcgaccactcgcttgccctctgccatgaacggggcagtagagtagaggggctgtagtggcggcgtggttgccagcggagcggagtgcgcggcggcggcggcggcggcggggatggggctgctgtcgaaccgggtcgagcggtcggacatccggcccggcgaccacatctacacctggcgggccgtctacgcctactcccaccacggaatttatgttggaggaagcaaagtggtccattttacaagaaagaaagaaattgaaagttcagattcgtcagactccgcctccagcctgatctcagaagttccatcagagtgccaaacattccctgattgtggatttcagctgcccaatagtggcgtcgtcctcacttgcttggactgtttcctccgcaatggtaccctctactgctttgagtatggagtgccatctgcagttttccttgcaaaacttcgtggaggaacctgcaccattgccgaatcagaccctccggaggttgttgtccatcgagcaatgtacttgcttcaaaatgggtttggacattatgacatgtttgagaagaactgcgaggactttgcactctactgcaagactgggcttctaccagttgaggaacctggcattgggactagtgggcaagcttcttctgcaattggtgtgccattggcagctcttctgtccactccatttaagcttttggctgccggcccgcttggaatggccactgtcacagctgggatgtactgtgctggcagatacattactgacattggagtaaggaaggatgtggcaaaagttgaagtggagaaattgacgtcacaccctggtttccgccttgttgaagatgaagaatcggtgaacaagcgatcagaaaaaccgaagaccttgctccctatgaagaggaaacgtgaaagatgaccgcaaagtgcagcttgggaggatgaacttgtctgcccttcaattggcgctgaattgtggataatgtgggatatatagtatatgctccactgtaataaaaccgttatagatatgtaccttcagaatgtgccctaatcctaatttgattaggtgcacacctcacatgaccaattgaactgctttataaattactgaatcattatatcatctagattttcatctattttgccgtcttctgctgcgactctttcctggtctcaggaaaagatgtttaaaataaagagagatggtttccagactttgggaggccacaatttctggagtc

SEQ ID NO: 21797 - protein, 268 aa, Panicum virgatum
  misc_feature: Ceres CLONE 1818044
  misc_feature (99)..(180): Pfam Name: NC Pfam Description: NC domain
MGLLSNRVERSDIRPGDHIYTWRAVYAYSHHGIYVGGSKVVHFTRKKEIESSDSSDSASSLISEVPSECQTFPDCGFQLPNSGVVLTCLDCFLRNGTLYCFEYGVPSAVFLAKLRGGTCTIAESDPPEVVVHRAMYLLQNGFGHYDMFEKNCEDFALYCKTGLLPVEEPGIGTSGQASSAIGVPLAALLSTPFKLLAAGPLGMATVTAGMYCAGRYITDIGVRKDVAKVEVEKLTSHPGFRLVEDEESVNKRSEKPKTLLPMKRKRER

SEQ ID NO: 21798 - DNA, 726 bp, Panicum virgatum
  misc_feature: Ceres CLONE 1818050
  misc_feature: Encodes the peptide sequence at SEQ ID NO. 21799
ccccctcccaacttgacgcgcctctgaaagatcggagccgccgcccaggcctgcctccattcccccgcctccggtgccgaagggaaatagttttgaggtggtgatggcggacaaggtcaaccaaccaactgtccttcataagctcggtggccagttccatctgagctccagcttctctgaaggtgtacgggcccgtaacatctgcccttctgtctcatcctatgaaaggagttttgccacaaggaattacatgtccgtcagtggtggcataaatgtcccagtggtttcatcctccccgctttttgctaatgctccagctgagaaaggaggcaagaacttcatgattgatttcctcatgggtggtgtttcagccgctgtctcaaagactgctgctgctcccattgagcgtgtgaagctgcttattcagaaccaggatgagatgattaaggctggtaggctgtccgagccatacaagggtattggtgactgcttcaagcgcaccatcaaggatgagggtttctcctccctgtggaggggtaacacagctaatgttattcgctacttccctactcaggccttgaacttcgcattcaaggactacttcaagaggctcttcaacttcaagaaggacagggatggttactggaagtggtttgctggcaaccttgcctctggtggtgctgctggtgcttctccctgtttttcgtgtactcccttgactatgcg

SEQ ID NO: 21799 - protein, 207 aa, Panicum virgatum
  misc_feature: Ceres CLONE 1818050
  misc_feature (78)..(175): Pfam Name: Mito_carr Pfam Description: Mitochondrial carrier protein
MADKVNQPTVLHKLGGQFHLSSSFSEGVRARNICPSVSSYERSFATRNYMSVSGGINVPVVSSSPLFANAPAEKGGKNFMIDFLMGGVSAAVSKTAAAPIERVKLLIQNQDEMIKAGRLSEPYKGIGDCFKRTIKDEGFSSLWRGNTANVIRYFPTQALNFAFKDYFKRLFNFKKDRDGYWKWFAGNLASGGAAGASPCFSCTPLTM

SEQ ID NO: 21800 - DNA, 627 bp, Panicum virgatum
  misc_feature: Ceres CLONE 1818090
  misc_feature: Encodes the peptide sequence at SEQ ID NO. 21801
ctctctcatttgtcctcttcacgacgtctaaccccacggcgaggcacccactccctgagtcggcctgcctgtgcgaggggagagactgcgcgaggcggcgaagggcccgatgaagatcaactttgagaccctgacgggcacccccttctacatcgaggcgagccccgaggagacggttgctggggtgaagcggatcatccagacgactcgtggactgaccggctaccccgccgacaaccggttgctcgtttacttcgggaaaattctcaatgatgacgccactttggaaagtatcaaagttgctgagaacagcttccttgttataatgctgtccgaggctgaggcgtctgccagtggaccttctccctctactcctgcgcaatctcctgctgctccggcccaacttgctacgcctgctgcccctgctgcttcggctgcaagatcaactcctcctcaagcgcctgttgccgcggcagtagacggctcctccaactgcacagtcttcacctgctcctgctgctactgctcgatctgctacaattgctgcattctgtgatggtgacgtgtactcgtcaagcaccttcctgccttgtctctggtagcagtctagatcagactatccaacag

SEQ ID NO: 21801 - protein, 148 aa, Panicum virgatum
  misc_feature: Ceres CLONE 1818090
  misc_feature (6)..(79): Pfam Name: ubiquitin Pfam Description: Ubiquitin family
MKINFETLTGTPFYIEASPEETVAGVKRIIQTTRGLTGYPADNRLLVYFGKILNDDATLESIKVAENSFLVIMLSEAEASASGPSPSTPAQSPAAPAQLATPAAPAASAARSTPPQAPVAAAVDGSSNCTVFTCSCCYCSICYNCCIL

SEQ ID NO: 21802 - DNA, 594 bp, Panicum virgatum
  misc_feature: Ceres CLONE 1818112
  misc_feature: Encodes the peptide sequence at SEQ ID NO. 21803
cacctcatccgctcggctccgggcccccgccgctgccaccaaccctgtagaggaggaagactagggagcccacggaggataatgtcgcccttggcccccctgtccgcgaaggatagtttttctgtggtgtttctcgcatctttgcgtccttcaacgataccttcattcttgttactgatttgtctgggagggaaactctggttccgatcactggctgaatgagggtcaaggctgatcgtaatgaatcgccaccgtatgctgctatgcttgcggctcaagatgttgcacctcgttgcaaggagcttggtatgtgtgcgctgcacatttagcttcctgcgaccggaggcaacaaatcctagactcctgggcctggtcatctgtctgtgcttgaggctcttgctcgttctggtatgaaaactgggggcattgaggatgttattcccgatcccactgattggactcgttgaaagggtggtctgaggcgaaggaggctgctagcgtctttctcctggatattggccatatcatggtgcacgccatgcactactcctctttgggtagtgttgctgttcctaagctagccgagaaagcttt

SEQ ID NO: 21803 - protein, 36 aa, Panicum virgatum
  misc_feature: Ceres CLONE 1818112
  misc_feature: Useful for making plants with modulated biomass
MRVKADRNESPPYAAMLAAQDVAPRCKELGMCALHI

SEQ ID NO: 21804 - DNA, 1387 bp, Panicum virgatum
  misc_feature: Ceres CLONE 1818141
  misc_feature: Encodes the peptide sequence at SEQ ID NO. 21805
atcgctaaacattcctccactcccacccgaggaggtggtagaggtaagagattccactcctctgataaggaggaattcgtgggggtgagggggagatagagtgagtcctccgcggatgaagttcgggaaggatttccggaaccacctggaggagacgctgccggcgtggagggacaagtacctcgcctacaaggccctcaagaagctcatcaagaacctgcgggcccccgagcccgccgcccctcctctccctccgccgcccgtcgccgagggacccggggatggggccggccaggggaacgtcgcgctggggaactggttcgccagcatcctcgacatggagctccacaagctcaacgagttctacatggagagggaggagtggtacgtcatccgcctccaggtgcttaaggagaggattgagcgcgtcaaagctaagaagaatgatgcttttacatccaggaatgaatttactgaagagatgctagagatacgcaaggactttgtgatcatacacggcgaaatgattcttctgcaaacctacagctccctaaattttgctggactagtgaagatactgaagaagtatgacaagagaacaggcggtttgctcagcctgcctttcactcagcgtgttcgtcaccagccatttttcacaaccgaacctttaacaaggcttgttcgagaatgcgaggctaatcttgaactccttttcccggtcgaagcagaagttcttgagcctagttcatcttcaaatctggaaaggcatgctgtggctaagcgtgatccaacattgtctggtgacgtggaagcctcagatgtgtaccgaagcacactcgcagcaatgaaagcgatacaaggccttcggagagccagctctacttacaaccccctatctctgtctaggttcttcaatggtgaggatggcgaagcttgttctggtgccatcacttctgagagttcgttatcagattcctcaacagactcccagattcaggatgatggaaaggatgataaagaggtgcagtcaagttcaagtaagcagaatgttgctcaaagggaacataatgcaaatggcgagccacggaatgaataatgagtcttttcacgcacagttcaataaccgttgataagtgtaaatgttaataatctggatgtttaaccctctttgaagtgttgacatgcacaagattttctgatggtgccgtttccttttcttcattttcttttcaagggttgaagtcatgaaaggtagtgtttttccatgtcaattgccataagaatctgaggtgtagtgcaatttaagttttgaagctgtaggcagaaagcatgtaagttgctagcagacattttggttgacacttaatagagctattacttcccaatc

SEQ ID NO: 21805 - protein, 326 aa, Panicum virgatum
  misc_feature: Ceres CLONE 1818141
  misc_feature (1)..(175): Pfam Name: SPX Pfam Description: SPX domain
MKFGKDFRNHLEETLPAWRDKYLAYKALKKLIKNLRAPEPAAPPLPPPPVAEGPGDGAGQGNVALGNWFASILDMELHKLNEFYMEREEWYVIRLQVLKERIERVKAKKNDAFTSRNEFTEEMLEIRKDFVIIHGEMILLQTYSSLNFAGLVKILKKYDKRTGGLLSLPFTQRVRHQPFFTTEPLTRLVRECEANLELLFPVEAEVLEPSSSSNLERHAVAKRDPTLSGDVEASDVYRSTLAAMKAIQGLRRASSTYNPLSLSRFFNGEDGEACSGAITSESSLSDSSTDSQIQDDGKDDKEVQSSSSKQNVAQREHNANGEPRNE

SEQ ID NO: 21806 - DNA, 1539 bp, Panicum virgatum
  misc_feature: Ceres CLONE 1818144
  misc_feature: Encodes the peptide sequence at SEQ ID NO. 21807
accactgtgactattacctagctcatgaacatgtgagaccagacaaggggaggcttgggaaggagacacaggtgctgccaaggggcttgcggggagcataaagatgaggccggtcttggccatcgccattcttgccaccaccgctgcagcagtgctcttccttgggtctgaggcgcaggaggtgaagcaggatcaccatgcagagaggatctcaggcagtgccggcgatgttctggaggacgaccctgtcggccggctcaaggtctacgtgtacgacctcccggccagatacaacacggcgctgctggagaaggacccgcggtgcctgacgcacatgttcgccacggaggtgttcgtgcaccggtccctcctctccagcgccgtccgcaccctggaccccgaggaagccgactggttcttcgtgcccgtgtacaccacctgcgacctcaccgcctcgggccacccgatgcccttcgactcgccgcggatgatgcgcagcgcgatccgcctcgtcgccgagcgctggccgcactggaaccgctccgagggcgccgaccacttcctcgtcacgccgcacgacttcggggcctgcttccacttcaaggaggacaaggccgtggcgcgcgggatcctgccgctgctccggcgcgccacgctggtgcagacgttcgggcagcggcggcacgcgtgcctcaagggcggctccatcaccgtcccaccgtacgcgccgccggcgcgcatggaggcgcggcgcctgccccccgggaccccgcgctccgtcttcgtctacttccgcggcctcttctacgacgccggcaacgaccccgagggcgggcactacgcgaggggcgcccgcgcgtcggtgtgggagaacttccggagcaacccgctgttcgacatctcgacggagcgcccggcgacgtactacgaggacatgcagcgggcggtgttctgcctgtgcccgctggggtgggcgccgtggagcccccggctagtggaggcggtggtgttcggctgcatccccgtggtcatcgcggacgacatcgtgctgcccttcgccgacgccatcccgtgggcggacatcggcgtgttcgtcgccgaggaggacgtcccgaggctggacaccatcctcacctccatcccggcggaggtggtgctgaggaagcagcggctgctcgccaccccggccatgaagcgcgccgtgctgttctcgcagccgtcgcagcccggggacgcgttccaccagatactcaacgggctcgcgcgcaagctcccgcacggcgacggcgtcttcctgaggcccgggcagacggtactcaactggacggctggcccaccgggggacctcaagccgtggtaggtagctggtagccgtcaaatcgccatggctgaatggtgatgatgggctgctggccatcaggcaaatgaactttttttttttgctcttcttccaccatagaagatggctgcgaactgttgtgatacgtacgtgaatgttcagcgtatgtgaatgtcatagccaaaacttgcagagatttt

SEQ ID NO: 21807 - protein, 418 aa, Panicum virgatum
  misc_feature: Ceres CLONE 1818144
  misc_feature (54)..(358): Pfam Name: Exostosin Pfam Description: Exostosin family
  misc_feature: Useful for making plants with altered carbohydrate content
  misc_feature: Useful for making plants with altered cell wall content and/or composition
MRPVLAIAILATTAAAVLFLGSEAQEVKQDHHAERISGSAGDVLEDDPVGRLKVYVYDLPARYNTALLEKDPRCLTHMFATEVFVHRSLLSSAVRTLDPEEADWFFVPVYTTCDLTASGHPMPFDSPRMMRSAIRLVAERWPHWNRSEGADHFLVTPHDFGACFHFKEDKAVARGILPLLRRATLVQTFGQRRHACLKGGSITVPPYAPPARMEARRLPPGTPRSVFVYFRGLFYDAGNDPEGGHYARGARASVWENFRSNPLFDISTERPATYYEDMQRAVFCLCPLGWAPWSPRLVEAVVFGCIPVVIADDIVLPFADAIPWADIGVFVAEEDVPRLDTILTSIPAEVVLRKQRLLATPAMKRAVLFSQPSQPGDAFHQILNGLARKLPHGDGVFLRPGQTVLNWTAGPPGDLKPW

SEQ ID NO: 21808 - DNA, 2055 bp, Panicum virgatum
  misc_feature: Ceres CLONE 1818156
  misc_feature: Encodes the peptide sequence at SEQ ID NO. 21809
aagggtttttcgcggccgtttacccgtgccgccgaaccccggaccgccgccgccgccgccgcctacgcgaacacgcgaccgccgcccgttgcggcaacccgccgatagtcggctagtccctcctcttccccaaatcagcagccactgcttttggtctccgtgccgtcgtccgatggccaagcagctcgccgccgccgagaaagaggtgctagttgaggtcgtgagattcacccagaagaacgggttgaaaggctctgatggggggtgaaaggatttcctcgcgcggaacgacaagaagtttggtgattcagtaagcgaccctaggaagcgttcaagggatgtgctgctcgccttcctgcaaaccttctccaaggatttccaaaaagtacatcactgtttttcattcacttcggtctgtttgaattcacttgcagctagcctttaaacaccttggtgctgctgttgagacttgagaatttgaagcttgcgacctttttggttccagtacttcggcaaattggtgaagcgtcaaaaggaaagaagtactgttcagcagtatatgaacgattttcctgacaaggtttctcccgagcagaaacttgttcaactgacagcagagcacccagagtacaggaaaaattattgcttcccatcataccaggagggatggaaagtattacggataggagaagtctctagtttggtgagctcgagtgctatgttggcaattgactgcgagatggtcctttgtgatgatggcatggaggctgtggtccgagtatgtgttgtagacaacaatcttgaggtgaagctggacatacttgtaaatccttctaaagctattactgactatagaacacacatcactggtgtatctaagaaggatttagaaggagtcacatcatcgctagttgatgttcagaaatcgctcaagaggatcttggccaaaggaaagattttgatcggccagagcttatatagagatttatgtgccttaaagatggattactgtcaagttattgatacagcatacatctttaagtatgcaaatttacctactacagcatcagcttccttaaacagtttgtgcaagtctgttttagggtattctgttcgagaaggagaaccacataattgcttaaaggatgcagaagctgcaatgaatctagttcttgcaaagcttaagcatggatttaatgatcccattaaagttgctgcaagcagtgtatctgaatctgatgcattgaagttacttgctcatagaataccagtgcacctgccttgccaagagctgtgcaaaattttctctgggaaccccagtattgatgacaagattgattcaaggattcgaggtgaattttattcgacaagtatttcgttcaatgagatagatgagttagagatggcttttgaagcactggatggccaaatgactaaggactctggtgggcgacttcaaaagtatgtgctgatgaagcgcgacaatggagatgtggtgagtttctacgtccggaagatggtatatggtccccagccaaaccagttcgagtttccaaagaagagaccacagcctattgaggatgcagaaccaaagaaagaacaagttgatggggatcagcaaaagaagaaacgaaagagtaagaagcacgtgaactcggcacaggtgtcagtggttgaatgaagaatttccgtgatcttttggttacagattgatgctgaaagatcatgaagaggtgtttggagggaacagtttggtcggaggttggcgaaaccaattttggagaagggtgtacgagagaaatagtatcggtttgtctggttgcttaggcgggcatttgattattcttcaattagactgacgtagttgggcatgtggtttgtcaaagtatgcttttcgtcagtaaattttatttctgtaattctgtatgctctcagttgcctagcgtttctgttttatggaagagcatcgtgtttctcttggagcaaagaccaccatgttcgtcctcgccagctgacgctgccgctctttcggctttaatctgttccccgtttctc

SEQ ID NO: 21809 - protein, 373 aa, Panicum virgatum
  misc_feature: Ceres CLONE 1818156
  misc_feature (54)..(204): Pfam Name: Exonuc_X-T Pfam Description: Exonuclease
  misc_feature: SWISSPROT Homolog: EC 3.1.13.1 Exoribonuclease II
MNDFPDKVSPEQKLVQLTAEHPEYRKNYCFPSYQEGWKVLRIGEVSSLVSSSAMLAIDCEMVLCDDGMEAVVRVCVVDNNLEVKLDILVNPSKAITDYRTHITGVSKKDLEGVTSSLVDVQKSLKRILAKGKILIGQSLYRDLCALKMDYCQVIDTAYIFKYANLPTTASASLNSLCKSVLGYSVREGEPHNCLKDAEAAMNLVLAKLKHGFNDPIKVAASSVSESDALKLLAHRIPVHLPCQELCKIFSGNPSIDDKIDSRIRGEFYSTSISFNEIDELEMAFEALDGQMTKDSGGRLQKYVLMKRDNGDVVSFYVRKMVYGPQPNQFEFPKKRPQPIEDAEPKKEQVDGDQQKKKRKSKKHVNSAQVSVVE

SEQ ID NO: 21810 - DNA, 1203 bp, Panicum virgatum
  misc_feature: Ceres CLONE 1818180
  misc_feature: Encodes the peptide sequence at SEQ ID NO. 21811
gttcgcgaccggcccaccccgcgcctcctcttcccagttaccaggcgttgaagcgccgccgccccgcgcccgccctccggccttccgcacctccgcggtcgcttcctgctatcctgctgcacctcctccgcccgcgccggtcgctgctgccctgctccctgctctccctcccggcctcgcgttggagtgccaagcagccgccggacggccggagctagggtttcggccgaaagtcgctgcggccagggcgccggtcggttcgccgtcttcgtctctctcatctcattcagtggacaaagttgcatctgaactgcatttgatcctcggagaagatgatcgagtcttttcttgataggatggtttcccagcttcggtcaacatgcaagtactacactggatatcccaaggacctagggccatcaagaattataccatttacatctgagcgtcagtttgtgcagctattgcatgaaggaaggcctgtagtagttgcctttactattaagtgcacttatacacagcatcttgataaagtactggaagaggctgctgccaaattttatccacatatcaagtttgtcagagtcgagtgcccaaagtatccagggttttgcctcacaaggcaaaggaatgaatatccatttgttgaagtattttacaatccagaacaggctgcaagccaaggaaagagtgtggatcctaacatcaccaagtattctgtaaaagtgctacctttcaactatgatcagagcgtgtatggatttcgggaatatttcaagaagcatggtttcaagtattctgaaacaaactaattctgtcataagaaatctgtgatgagagaagtcctagggagttgaaccgtggggctttaccggtctctttcctagttcaattaaggaatgcctgtcatgtactcatgttagggtatagtccatgcctttagatagcgcagcaataccaaatgcgtgttgagctgtcgaccttcaatctggtaaattaaacatttccgcaaccataaggaatgagtatattgcacgtctttttttttcaaatgcgagtggtttgctatggtgtcattagttggaggtggcagtttttagagcgcaaactgtcaaagcccctggacaatttgatctcgctatattgtaaaagaaatatctgggtgactagttgctgcatgtgggtccgattgagatttgttcc

SEQ ID NO: 21811 - protein, 159 aa, Panicum virgatum
  misc_feature: Ceres CLONE 1818180
  misc_feature: SWISSPROT Homolog: EC 5.3.4.1 Protein disulfide-isomerase
MIESFLDRMVSQLRSTCKYYTGYPKDLGPSRIIPFTSERQFVQLLHEGRPVVVAFTIKCTYTQHLDKVLEEAAAKFYPHIKFVRVECPKYPGFCLTRQRNEYPFVEVFYNPEQAASQGKSVDPNITKYSVKVLPFNYDQSVYGFREYFKKHGFKYSETN

SEQ ID NO: 21812 - DNA, 671 bp, Panicum virgatum
  misc_feature: Ceres CLONE 1818217
  misc_feature: Encodes the peptide sequence at SEQ ID NO. 21813
tgttaccttagtccatacaacaaccgcaccgctaagataggagatgcaaggcactgtgacgatgaccaccttatccctgagacctgcagggcagtgcaatgggagctgcctgctcgcacctgccacaggacggcaaccacgtatttcttggtggcgtcggcagcagaggcaaaccacgctgcatcgccagcaaatgcaacagtgttcagtggcaacattacacaatgataaggttgacgatcgcttgggcaagaatccatgcaattttcatccttctatatggggagatttcttcctacactactacgacgcagcagcttcctccaaacagcagacgtggatggtagaacaagcagatgaagtgaagcaagacgtggcaaaaatagtagcaagttcagttgcttgggaccttcatcataggctacaacttatcgatgcgctggagcgtctgtgcttggatcatttgttcgaagatgacattaatgctgcactgactcaaattaggacagttaatcttactgactgtgatcttcacacggtggctatgtggttttatctgcttcgtaagcacggacacagagtttcaccagatgtgtttgtgaggttcaaagatcaagaggggagctttcttgcgaacaatccagtggagctattgagtctgtataatgctg

SEQ ID NO: 21813 - protein, 209 aa, Panicum virgatum
  misc_feature: Ceres CLONE 1818217
  misc_feature (80)..(209): Pfam Name: Terpene_synth Pfam Description: Terpene synthase, N-terminal domain
  misc_feature: SWISSPROT Homolog: EC 4.2.3.13 (+)-delta-cadinene synthase
MQGTVTMTTLSLRPAGQCNGSCLLAPATGRQPRISWWRRQQRQTTLHRQQMQQCSVATLHNDKVDDRLGKNPCNFHPSIWGDFFLHYYDAAASSKQQTWMVEQADEVKQDVAKIVASSVAWDLHHRLQLIDALERLCLDHLFEDDINAALTQIRTVNLTDCDLHTVAMWFYLLRKHGHRVSPDVFVRFKDQEGSFLANNPVELLSLYNA

SEQ ID NO: 21814 - DNA, 643 bp, Panicum virgatum
  misc_feature: Ceres CLONE 1818223
  misc_feature: Encodes the peptide sequence at SEQ ID NO. 21815
agaccgccggcgccgccgacccacccgacccgacccctccctccctcgctgacctccgccgtcgccggaggcgaagcgaccgcaaagtaacccgcccctcctcctaccccttccctccctcccccctccgccgtttcggtctgtaggtatcggctgggtgccgcgccggtcgttctggggccgcgcggcctggattgtctctgccaccggcggcggcggcgagaacccccccccccctatcgtatttcccggcgggtggggtggggtggggttccggtcgttccggccggccaccggcggcggacttgattttggtgagggaggctgcagaagaattaggtggtgaaatcactcagagaactgtgcaatagtttcaatggctgctaccaagcttcaggccttttggaaccatcccgctggccccaaaaccattcatttctgggcgccaacgttcaaatggggtatcagcattgccaacattgctgactttgctaagccacctgaaaagatatcttatcctcagcaaattgctgttacttgtactggactcatttggtcaaggtacagcttggttatcaaaccgaaaaactggaaccttttcagcgttaatgttgcaatggctggtacgggcctgtatcaactt

SEQ ID NO: 21815 - protein, 88 aa, Panicum virgatum
  misc_feature: Ceres CLONE 1818223
  misc_feature: Useful for making plants with modulated biomass
  misc_feature: Useful for making plants with modulated flowering time
MAATKLQAFWNHPAGPKTIHFWAPTFKWGISIANIADFAKPPEKISYPQQIAVTCTGLIWSRYSLVIKPKNWNLFSVNVAMAGTGLYQ

SEQ ID NO: 21816 - DNA, 1703 bp, Panicum virgatum
  misc_feature: Ceres CLONE 1818226
  misc_feature: Encodes the peptide sequence at SEQ ID NO. 21817
ggggaagcggaggaagccctgcgcgattctcttcttgatacggaagcaaaactagagagagagagagagagagagagagagacaggccgagactgcgggagcacgagatggccgacggggaggacgccgccgccgcgcgccgccggtccgccatcaccgactaccggaagaagctgctcaactgcagggagctcgagtcgcgcgtcggcaccgtgagagaaagcctaaaaaatgcgaagaaggactttgccaagactgaagacgacttgaaatctctgcaaagcgtgggtcaaataattggagaggtcctccggcctcttgataatgaacgtttcattgtgaaggccagcagtggtccccgatatgtggttggttgccgaagtaaagtggacaaggagaagctgacttctggaactcgtgttgtacttgacatgacgaccttgacaataatgcgtactctaccacgggaggttgatcccgtggtatacaacatgcttcatgaagacccaggaaatgtcagttactctgctgtaggtggtttgtctgatcagattagagaactcagggagtccattgagttaccgcttatgaaccctgaactctttcttcgggtggggattaagcctcctaagggtgttctactctacggtcctccagggaccgggaagacactattggcgagggctatcgccagtaacatcgatgccaactttttgaagatcgtttcaagtgctattattgacaagtacattggagaaagtgctcgtttgattagagaaatgtttggctatgcacgagatcaccaaccatgcatcatcttcatggatgaaattgatgccattggtgggcgaagatttagtgagggaactagtgctgatcgtgagatccagcggacattgatggagctccttaaccagctagacggatttgatgagcttgggaaggttaagatgatcatggctacgaaccgacctgatgttctggacccggcactcctgcgtcctggacgtttagacagaaagattgagattccactacccaacgagcaggcaagaatggaagttcttaaaattcatgctgctggtattgccaaacatggggaaattgattatgaagctgtcgtgaaacttgcagaaggtttcaatggggctgatcttcggaatgtctgcacggaagctggtatgactgcaattcgggcagaaagggactatgtggtccatgaagacttcatgaaggctgtgcgcaagctaaatgatgcaaagaagctggaatcgagtgcgcactacagcgcagactttgggaaggagtagtaacgcccgattttgctactaaggcgtatgctgtgtatcactggggagctcagccatcaccatgcgaaagcaagaaagaaattggctatttatgttcaggctcctggacattcctctttttctgatattcgcaatcttattgaggaagattgtcaagctgaccactgggagaaaccattcgagattttactaattttgaactagttgctgtttgcttcagtgatcatcatacgttatcagcttccctgtgtattagtctggtaactcttgttcgggctgtttcatttccgtcattccatgtacttggacagtgtgcttgcctgctcggtaacagaggaagcggcgaggctaactttgtggcgatcaaggacccaacggagcctgatctcgcgg

SEQ ID NO: 21817 - protein, 400 aa, Panicum virgatum
  misc_feature: Ceres CLONE 1818226
  misc_feature (176)..(363): Pfam Name: AAA Pfam Description: ATPase family associated with various cellular activities (AAA)
  misc_feature: SWISSPROT Homolog: EC 3.6.4.3 Microtubule-severing ATPase
MADGEDAAAARRRSAITDYRKKLLNCRELESRVGTVRESLKNAKKDFAKTEDDLKSLQSVGQIIGEVLRPLDNERFIVKASSGPRYVVGCRSKVDKEKLTSGTRVVLDMTTLTIMRTLPREVDPVVYNMLHEDPGNVSYSAVGGLSDQIRELRESIELPLMNPELFLRVGIKPPKGVLLYGPPGTGKTLLARAIASNIDANFLKIVSSAIIDKYIGESARLIREMFGYARDHQPCIIFMDEIDAIGGRRFSEGTSADREIQRTLMELLNQLDGFDELGKVKMIMATNRPDVLDPALLRPGRLDRKIEIPLPNEQARMEVLKIHAAGIAKHGEIDYEAVVKLAEGFNGADLRNVCTEAGMTAIRAERDYVVHEDFMKAVRKLNDAKKLESSAHYSADFGKE

SEQ ID NO: 21818 - DNA, 1092 bp, Panicum virgatum
  misc_feature: Ceres CLONE 1818235
  misc_feature: Encodes the peptide sequence at SEQ ID NO. 21819
aagtcacccctcgacacctccagccagagtccaagtgcgcaggcagcactcgtgtcgcgtctcttctccccgagctccgggcgaagcgagctagctgaagcgcgtgcgttccggtcatggcgaggtcgctgggcctggggctcgcctgcttcgcgctcgcggtcgcggcggccagcgcgacgcagttccgggtcggcggccagaaaggctggagcgtgccggacgccggcttcgagccctacaacacctgggcggggaggctccgcttccagatcggcgatcagctcctgttcgtgtaccccaaggagacggactccgtgctcctggtggacccggcggcgtacaacgcgtgcaacgtctcctcgtacctccagaagttcgacgacggcagcacggtgttcacactcgaccgctcgggccccttcttcttcatcagcggcaacgaggccagctgccgggccaacgagaagctcatcgtcgtcgtcctcgccgaccgcaccggcgcgcgcaccccgcccagggccccgcccacgatgtccccgccgtctcccgcgcctctgccgagcccgtcctcgccgactcctgcggccccgcctgcgctgagcccctcgtcgccaccaccctcaggcgccacccctctgccggcgcccgcggccgccccagcctcaccgccgtccccggccgtttcagctcccgcgcctgctcccaccaccaccccgggctcgccaccgccgcccatggccccggcgccgtccacaaccccgggaggtggcgcgtcgcagccgccgtccgcttccgccaacgcgccgggcgccgagggcaacgccacgccgcctccgccttccgccagcgacgcgaacgccgccgccctggtggtcgcgggcttggtcggctcgctcggcgccatcgtcggcttcgccatgcttgctgcctgaaacgatctttctacgaggcgttcttttgtgcagtagtgtaattcgagatttcgagtgggataacttacactgtgaagaggatcatgatcatttgtatttgaatttgttgtcatgtttgtgaaataataaatgtacgcacgattgcgtttgcatttgt

SEQ ID NO: 21819 - protein, 272 aa, Panicum virgatum
  misc_feature: Ceres CLONE 1818235
  misc_feature (32)..(117): Pfam Name: Cu_bind_like Pfam Description: Plastocyanin-like domain
MARSLGLGLACFALAVAAASATQFRVGGQKGWSVPDAGFEPYNTWAGRLRFQIGDQLLFVYPKETDSVLLVDPAAYNACNVSSYLQKFDDGSTVFTLDRSGPFFFISGNEASCRANEKLIVVVLADRTGARTPPRAPPTMSPPSPAPLPSPSSPTPAAPPALSPSSPPPSGATPLPAPAAAPASPPSPAVSAPAPAPTTTPGSPPPPMAPAPSTTPGGGASQPPSASANAPGAEGNATPPPPSASDANAAALVVAGLVGSLGAIVGFAMLAA

SEQ ID NO: 21820 - DNA, 1365 bp, Panicum virgatum
  misc_feature: Ceres CLONE 1818247
  misc_feature: Encodes the peptide sequence at SEQ ID NO. 21821
agtcgggtcagtctcctctctcccagatctgtcatccggcggaggatccaccatggcgcctccaccgcgtggccgcctgctcctcctcctccctctcctactcctcgccgcggccgcggccgcctccacggcccgcgccgacgacctggtcgcggagctccagtccctccgcgcgcggtccccgtcgggcgtgatccacctcaccgacacctccgtcacccgcttcctctcgggccccgccgcgcgccgcccctactccgtgctcgtcttcttcgacgccgcctcgctccactccaagcccgacctccacctgccccagctccgcgccgagttcgcgctcctctccgcctccttcctcgcccgcaaccccgcctccggcgacctcttcttcgccgacatcgagttcgccgagtcgcagcactccttccaccagttcggcgtcaactcgctgccccacgtccgcctcgtccgccccgaccacgccgccctcgccgggtccgagcagatggaccagtcccacttctcccgcctcgccgactccatggccgagttcgtcgagtcccgcaccggcctcgaggtcggccccatcgtccgcccgccgctcctctcccgcaaccaggtcatcctgctcggcatcctcttcctcgcctccatcccattcatgatcaagaggatcgtcgagggggagaccctgctccacgaccgccgggtctggatggccggggcgctcttcgtctacttcttcagcgtgtctgggggcatgtacgggatcatcaggcacacgcccatgttcctcaccgaccgcgcggatcccaacaagctcgtgttcttctaccaggggtcggggatgcagcttggggctgaggggtttgccgtagggttcttgtacacgctcgtgggtctcatgatcgctggggtgacgcacttgttggtgagggtggagagcctgcagacgcagcgctttgcgatgctggctgtcatggtcattggatggtgggctgttcggaaggtgatctacctggataactggaagactggttatagcattcataccttctggcctagcagctggaggtgaaatgctggccttgaggcgatggatgcttccttcctttggttccagaggtcatggactcatccaaattgacattgctgaaatagagcatcgtttggattgcgatgacatgccacaagtttgaggttgcagttctcagctgctgtagtatgaaatagagaaagaacccaagtcattttagcagaatttgtgtctctgtcacgcaaacagagaggtcctgattttgaactccgatatattatatggtacttttatatggtttaacaagacaatggtaaatcttagttgac

SEQ ID NO: 21821 - protein, 341 aa, Panicum virgatum
  misc_feature: Ceres CLONE 1818247
  misc_feature (16)..(334): Pfam Name: OST3_OST6 Pfam Description: OST3 / OST6 family
MAPPPRGRLLLLLPLLLLAAAAAASTARADDLVAELQSLRARSPSGVIHLTDTSVTRFLSGPAARRPYSVLVFFDAASLHSKPDLHLPQLRAEFALLSASFLARNPASGDLFFADIEFAESQHSFHQFGVNSLPHVRLVRPDHAALAGSEQMDQSHFSRLADSMAEFVESRTGLEVGPIVRPPLLSRNQVILLGILFLASIPFMIKRIVEGETLLHDRRVWMAGALFVYFFSVSGGMYGIIRHTPMFLTDRADPNKLVFFYQGSGMQLGAEGFAVGFLYTLVGLMIAGVTHLLVRVESLQTQRFAMLAVMVIGWWAVRKVIYLDNWKTGYSIHTFWPSSWR

SEQ ID NO: 21822 - DNA, 2308 bp, Panicum virgatum
  misc_feature: Ceres CLONE 1818266
  misc_feature: Encodes the peptide sequence at SEQ ID NO. 21823
aggagcaggcgcgaggagagtgaggctgagagttggaggcgagctaggccgccgccgccgcttcgatcgactcggatcgactcgccgccaccgctcgcgttcgctatgatgggctcttcttcatcttggtctgcccaaacctttgggtcctcttcatcttgtgttggcgcaggctttgggcaaaccgtgggctccgtctcctccactccatgggctaccttcccttggccttctccaacctttatggtgtcacatacacctccttcagggtccccatgctgtaattttatgggggtatctgaacagggcagcagggtatgtgcttatgcgccaaccgctgttgatggtcctcctaatttgtatcagattcaatcgatttcggcaatgctggtaaactgcaacaagtctcatgaagagcttcgacacgaagattataagagaggggacagaggaggtgacagtctgcagaaaagcattaatccaactcctatatttcctgtgttctcatcaccatcatttggtttatcctgttcaagtacaccagcatttcactttgaggcccacgactcatctcattgctccatttcaggtactgtttcaccatcatttgcacgtgcacgtccatttccagagtccactgagcacccccctgcagaattactgccctcaacacgaggctccaccttcagttcccacccattctgcgccgttcgagaaaaaaaaagttccaacccattctggctcccatctgctcagtcatcattttcatctggagatttgcaatccttaacacaaggtcatagttcttacactcctggactgccattttatcattacctgccctcaaagctagcatccatgggaataacaccacctctatcacacactgagtttctaaagaatccctccacctattgtcctagctcataccagtcaccttttactgcacaagtaggaggtgcacattcagcttcagcatcaacacaatctatgaccactgcaacgttaccgtgcccccattttgcaacctccacgtctgtacctactatgtgtcgggacaatatattcagcaactcagcaggtgcattaaatacagatttagcagaagcaacttctactcagcagggtacattcggtcaaaacttccccacaacatatactcagcctggaaaaactccattgattggttcttcaattgcccattcaaaaccagctctatcttcagatgctcattgtactagcgtcaatcttgattatcccaataacactttagagttgcatcttccggtcaatgtcagattattacgcattcatttttcgtcaagcaatgatggcgctggaatttcacaggttcattctggtcatgttgctaaatctacagaagcacctatttctctatctatctatcctggggagaatcatgagctgattatccaatcggttgcgagacctgctaaggatcaaatgggcaaacagtctagttcaacgggtggatctgatcccagcaaagttcacaatagcattggtcgtccaccatccaaatctgctgggaatcaggaggggagcaacggtgatgcccactcgatccagaaatcattagctgcaccagaacgtcaagtgatcaccaggagtgtgctgcctcggctctacaatgcagattactacactgtgccgtcaattgtggaacttgctgtgaacgagagcgaagagccaggttactgctcccgagtgccgcacttcactgtaggcaggcatggctatggcagcgtcaggtttgatggggagactgatgtgcggaagctcgatatcgcatcaattgtggagtttaacaaccgtgagatccttgtatacagagatgagagcaacacgccacctgttgggcagggattgaacaaacctgcagaggtcactctcctgaacgtgaagtgcatcgaccagaagactgggttgcagttcacagggggcccaacggtcgacaggtacaaggagaccctggttcagtggaccaaggagcacgacgccgagttcgtgtcctttgacccgatgaagggggagtggaagttcaaggtcaagaatttcagccagtagggtgcatgcagcttaagatcctagtctgtacagtaagctctcaccccctctggtttctcagaaatagctatgcactcatgcactctaggcaggcgtgttagcattaactgctgaggcaaaatacttagaaacagtgaaatcaacttgggaatattgaactccaatgtacggttgacgcagggtccagctctggtgacattttagtttcgtgccgtggttt

SEQ ID NO: 21823 - protein, 660 aa, Panicum virgatum
  misc_feature: Ceres CLONE 1818266
  misc_feature (494)..(660): Pfam Name: Nucleoporin2 Pfam Description: Nucleoporin autopeptidase
MMGSSSSWSAQTFGSSSSCVGAGFGQTVGSVSSTPWATFPWPSPTFMVSHTPPSGSPCCNFMGVSEQGSRVCAYAPTAVDGPPNLYQIQSISAMLVNCNKSHEELRHEDYKRGDRGGDSLQKSINPTPIFPVFSSPSFGLSCSSTPAFHFEAHDSSHCSISGTVSPSFARARPFPESTEHPPAELLPSTRGSTFSSHPFCAVREKKSSNPFWLPSAQSSFSSGDLQSLTQGHSSYTPGLPFYHYLPSKLASMGITPPLSHTEFLKNPSTYCPSSYQSPFTAQVGGAHSASASTQSMTTATLPCPHFATSTSVPTMCRDNIFSNSAGALNTDLAEATSTQQGTFGQNFPTTYTQPGKTPLIGSSIAHSKPALSSDAHCTSVNLDYPNNTLELHLPVNVRLLRIHFSSSNDGAGISQVHSGHVAKSTEAPISLSIYPGENHELIIQSVARPAKDQMGKQSSSTGGSDPSKVHNSIGRPPSKSAGNQEGSNGDAHSIQKSLAAPERQVITRSVLPRLYNADYYTVPSIVELAVNESEEPGYCSRVPHFTVGRHGYGSVRFDGETDVRKLDIASIVEFNNREILVYRDESNTPPVGQGLNKPAEVTLLNVKCIDQKTGLQFTGGPTVDRYKETLVQWTKEHDAEFVSFDPMKGEWKFKVKNFSQ

SEQ ID NO: 21824 - DNA, 495 bp, Panicum virgatum
  misc_feature: Ceres CLONE 1818288
  misc_feature: Encodes the peptide sequence at SEQ ID NO. 21825
tggggggggcacttccgtcctcttcgttgtcccctcctgccggtccaaatcatgagcagcggcgcaagatgttgggggagtaatttaccccacaacagttaaggagtagggatgggggctgatagcttcctcttgacctccgaggcgacgagcgatgggcggccgaaccagctgtgcgaccatgtgtcggacgccttcctggacgcgtgcatggcgcatgacccccacggcatggtgggccgcaagacctgcaccatcacgaacatgggaatggtgttcggccagatcgccaccaacttcaccgtggactacgataagagcgtgcgctgcacctgccgcgatatcggcttctcctcctacgacacgtgactcgacggtgacagctgctatgtgctcgtcaacatcgaataacagtcccccgaattctggcatgacgtgtagtgccactgaaccaagcaccacgaggagatcggcgccggcaacgagctccacatg

SEQ ID NO: 21825 - protein, 85 aa, Panicum virgatum
  misc_feature: Ceres CLONE 1818288
  misc_feature (4)..(85): Pfam Name: S-AdoMet_synt_N Pfam Description: S-adenosylmethionine synthetase, N-terminal domain
  misc_feature: SWISSPROT Homolog: EC 2.5.1.6 Methionine adenosyltransferase
MGADSFLLTSEATSDGRPNQLCDHVSDAFLDACMAHDPHGMVGRKTCTITNMGMVFGQIATNFTVDYDKSVRCTCRDIGFSSYDT

SEQ ID NO: 21826 - DNA, 1585 bp, Panicum virgatum
  misc_feature: Ceres CLONE 1818297
  misc_feature: Encodes the peptide sequence at SEQ ID NO. 21827
cccattccccttcccttcacactctactgccaacgccgccgcccctccaccagacctccccgttccccttccccggcggccgaacctgcgaggctgccgaccgagacgccccctccgccttgccgaggcaccctccgctccctccgaggcacgcacccgcgcggcgccgcggctacgtcccgtcgactcggatcgaggcgtagagagggatggcgagtctgaccggcctcaccgcgaaccctaacccgaacaagtcattcgagatcctgcccaacccgggtgactccatctcgagcctcagcttcagccccaagagcaatctgctggtggcaacctcctgggataaccaggtgaggtgctgggagattgttggcgggaacagtcagccgaaggtatccatatcgcatgatcagccggtcctctgctcggcttggaaggatgatggaacaactgtcttctctggaggctgtgacaagcaggtcaaaatgtggcctttgctgtcaggtggccagcctcagacggttgcgatgcatgatgcgcctgtcaaggagattgcgtggattcctcagatgaatcttcttgtctctggaagctgggataagactctgaggtactgggacacaaggcaagcaaatcctgtgcatgtccagcaacttccagagcgttgctatgctcttacagtgaattacccccttatgattgtgggaactgctgatcgtaatcttgtagtattcaacttgcagaatcctcagacggagttcaagcgtattcaatcaccactaaaataccagacacggtgccttgctgcattccctgatcaacaaggatttctggttggctccatagaaggaagagttggtgttcaccatatcgatgattcacaacaaagcaagaatttcactttcaaatgtcacagggaaggaaacgatatattctctgtcaattcactgaacttccaccctgtccatcacacatttgcaactgctggatctgatggtgctttcaacttctgggataaggacagcaagcagaggctgaaggcttttagcagatgccctcttcccattccttgcagcacctttaacagtgatggttccatatttgcttatgcggtctgctatgattggagccgtggggctgaaaaccacaatcctgcagctgcaaagacatccatctacctccacagtccacaggaatctgaggtcaaaggaaagccgcggattgcaacaggcaggaaatgatttggctaactttcgggatctgttcgtctttaggccagtcaccagttttgtcatgcccccctcctgcattggaagtctggtagatgtaaatttcagggtacctgtagtgtctagacactgaatatagggtttccgatgcaagattaacatgtagtagtacctgatgtttgcaatgtcttagtcctcttaaggaattgtgtcttgaggtggtcttcagggtagctgggtatgatttgtcagtatcgtttatgtgatatgctatattagttgctaccatggtcaaaaagaaatcctgtgcttcaggaaggtttatttatacaagacctggcagtatatttaacagc

SEQ ID NO: 21827 - protein, 343 aa, Panicum virgatum
  misc_feature: Ceres CLONE 1818297
  misc_feature (99)..(137): Pfam Name: WD40 Pfam Description: WD domain, G-beta repeat
  misc_feature (14)..(52): Pfam Name: WD40 Pfam Description: WD domain, G-beta repeat
  misc_feature (57)..(95): Pfam Name: WD40 Pfam Description: WD domain, G-beta repeat
  misc_feature: SWISSPROT Homolog: EC 2.3.1.48 Histone acetyltransferase
MASLTGLTANPNPNKSFEILPNPGDSISSLSFSPKSNLLVATSWDNQVRCWEIVGGNSQPKVSISHDQPVLCSAWKDDGTTVFSGGCDKQVKMWPLLSGGQPQTVAMHDAPVKEIAWIPQMNLLVSGSWDKTLRYWDTRQANPVHVQQLPERCYALTVNYPLMIVGTADRNLVVFNLQNPQTEFKRIQSPLKYQTRCLAAFPDQQGFLVGSIEGRVGVHHIDDSQQSKNFTFKCHREGNDIFSVNSLNFHPVHHTFATAGSDGAFNFWDKDSKQRLKAFSRCPLPIPCSTFNSDGSIFAYAVCYDWSRGAENHNPAAAKTSIYLHSPQESEVKGKPRIATGRK

SEQ ID NO: 21828 - DNA, 1465 bp, Panicum virgatum
  misc_feature: Ceres CLONE 1818298
  misc_feature: Encodes the peptide sequence at SEQ ID NO. 21829
ataattatcgtctacccgatcccctccaaccttcccttccgcaagcagagcaaccatcacagcggcgagcatcacactgggactggatgggaagcgcgggggcgctgctctcgcacccgcggccactgctgcaccctggcggcgtcctcatcagccggagccggcctctccggagcgcgcgccagctgcccctattatctctcgctgccgcggcgcctggactccagcgcggccgctgccgctgccgccgcctctgctgcgctgctgtcaacggggaaggcggacaacgggaggcagggccaccgccgcagatggagaagtctccatccagcggtctcggcgccgcactcgaggacccgcctccagtggaaaatggttcctttgaaggcctctcgcaagaacaagaacaagaacaagaacagagtcctctgtataattttctttatccaagcaaagagttacttcctgatgacaaggagatgagtatatttgatcatctagaggagcttcgtgagagaatattcatctcagttttggctgttggagctgcaatacttggctgttttgctttctcgaaagatttgattctgcttctagaggcaccagtgactgttcagggtgttcgttttttgcagctctcccctggggaatttttctttacaacattaaaggtctctggttattgtggccttttacttggaagtcctatcattttgtatgagatcattgcatttgttctcccaggtttaacaagggatgaacgcaaattcctagggcctattgttctgggttcttctgttttattctaccttggcattttcttctcctacacagttcttagccctgctgcattgaacttcttcgtgaactatgcagatggggcagtggaatcattgtggtcaatagaccagtactttgaattcatacttgtgcttatgttcagcactggattatcctttcaggtaccagttatccagctattgctgggacaagttggattggtttctggtgaccaaatgctttcaatctggagatttgttgttgttggtgccgttgttgctgctgccgtgcttacaccctccacagatccattgacacagatgctgttggcaggtcctctgctaggtttgtacttgggtggtgcatggatggtcaagctaattgggcgataagtggtccatgtatgtcagaggatcgttgttcatgagtgtagctgcaccataggtgaggtgaccccacagtcactgacagtggcatatgtagcatataaggaatttagggcatataagggatttagggtttaaccagtagcatgtgaggaatttctccttgtattattaaaaatgattgaacccccctggccctctagatcattgtgttgccatttgagtttctaaagttcaagagcatcagaaaatggagttaattattttcgtgtactaacaataaagtaatacttgaatgc

SEQ ID NO: 21829 - protein, 361 aa, Panicum virgatum
  misc_feature: Ceres CLONE 1818298
  misc_feature (143)..(344): Pfam Name: TatC Pfam Description: Sec-independent protein translocase protein (TatC)
MGSAGALLSHPRPLLHPGGVLISRSRPLRSARQLPLLSLAAAAPGLQRGRCRCRRLCCAAVNGEGGQREAGPPPQMEKSPSSGLGAALEDPPPVENGSFEGLSQEQEQEQEQSPLYNFLYPSKELLPDDKEMSIFDHLEELRERIFISVLAVGAAILGCFAFSKDLILLLEAPVTVQGVRFLQLSPGEFFFTTLKVSGYCGLLLGSPIILYEIIAFVLPGLTRDERKFLGPIVLGSSVLFYLGIFFSYTVLSPAALNFFVNYADGAVESLWSIDQYFEFILVLMFSTGLSFQVPVIQLLLGQVGLVSGDQMLSIWRFVVVGAVVAAAVLTPSTDPLTQMLLAGPLLGLYLGGAWMVKLIGR

SEQ ID NO: 21830 - DNA, 1960 bp, Panicum virgatum
  misc_feature: Ceres CLONE 1818310
  misc_feature: Encodes the peptide sequence at SEQ ID NO. 21831
cttccccctccctcaagtcccaaccccccgtcccgtctcaatcacttcacaagtgaatgagacgaccaggaggaattcttcttcctccctcatcgtctcctcgtcttctcacgagcgtttcgcggaccaagcgaagaaaattcggccgcagtcaaatactgttaataaggtctataataatactaaaagaagcagtctttgcttcgcagtttcttggttggtgacccaacaccagcggaggaggagcgggggagaaaaaaatatcagccgagctcccaactttgacgctgccgccgccgccgccgccgtgctcgctgcgtagtcccgcagccttctcttcccccgtctcctcccggatcggagctcccctccccgggacaccgctggccgcctccccttggatcagctccgcctccgtaagataggcgagcaatgaggtgcctgcctttcttgcatggagaggtcaaagaggaggatcctgtcaccatgtctgcatctgtacggtccatcagcacaacatcaacggaccgtgatgtccgctccggttcagacttcacctccttgaatgtatccgacatgagcgccgagtcaataaggaggacacagtaccccagcttcactgaccggccgtctaacttgagggtgttctccttctctgaattgaagagtgccacgcgcaacttcagccggtcactcatggttggcgagggtggctttggctgtgtgtacaggggcatcatcaagacatctgacgaacctagtgaacgaattgagattgctgttaagcagttgaatcgtaaaggacttcaggggcagaaggagtggttaacagagatgaatgtgcttggaattgttgaccatccgaacctagttaaactaataggctactgtgctgatgatgatgagcggggagtacaacgccttctagtgtacgaatatatgcctaatggaagtgtggacgatcacttgtcaagtaggtcaacttcaactctatcatggcctatgagactgaaagtagctcttgattctgcccggggactgaagtatctgcatgaagaaatggaattccaggtcatttttcgagatctgaaaacatctaacattctgttggatgagaactggaacgccaaattgtcagactttggtttggctaggcatggaccaacggaaggtctgacccatgtctccacagcggtagttggaactctagggtatgcagcgcctgagtacatgcaaactggacgcctcactgcaaagagtgatatatggagctatggcgttttgctgtacaagctcatcaccggccgccggcccattgaccggaacccgccaaagagcgagcagaagctcctggattgggtgaagccatacatcgcggacaagaagcggttccccatcatcattgacccgaggctggaggggcgctacaacctcaagtccatgacaaagctggccagcgtggcgaaccgctgcctggtccggatgccaaagtctcggccaaagatgagcgaggtgtacgagatggtccagaagatcgtcgacagcatcgagactggcccaccgcagccgcctctgcactaccatggctcagtctcagagccaggtgcgaagcggaccaagaaaggatccctgaagagaaggctccaggagttcaaattcggttgccggaatatcgtgtggcggggctggaagcctgagatggtaaacaccttctgagacaccgtaggctccttgctgtaagtatagctgtgcatagggatgagggttgttcctctgtgtgttccccattcgggtgagttgaaacctgtgtgatacgcctggttctgaccaacacagtgcgtgagctgcaagatggtgatggattagccaggcccccttgtgttttcagtgcagtgccgggtgtttcccacttacgaactgctttgtttctgcagtggaattcctggcctttccttctgtt

SEQ ID NO: 21831 - protein, 427 aa, Panicum virgatum
  misc_feature: Ceres CLONE 1818310
  misc_feature (84)..(365): Pfam Name: Pkinase Pfam Description: Protein kinase domain
  misc_feature: SWISSPROT Homolog: EC 2.7.11.1 Non-specific serine/threonine protein kinase
MRCLPFLHGEVKEEDPVTMSASVRSISTTSTDRDVRSGSDFTSLNVSDMSAESIRRTQYPSFTDRPSNLRVFSFSELKSATRNFSRSLMVGEGGFGCVYRGIIKTSDEPSERIEIAVKQLNRKGLQGQKEWLTEMNVLGIVDHPNLVKLIGYCADDDERGVQRLLVYEYMPNGSVDDHLSSRSTSTLSWPMRLKVALDSARGLKYLHEEMEFQVIFRDLKTSNILLDENWNAKLSDFGLARHGPTEGLTHVSTAVVGTLGYAAPEYMQTGRLTAKSDIWSYGVLLYKLITGRRPIDRNPPKSEQKLLDWVKPYIADKKRFPIIIDPRLEGRYNLKSMTKLASVANRCLVRMPKSRPKMSEVYEMVQKIVDSIETGPPQPPLHYHGSVSEPGAKRTKKGSLKRRLQEFKFGCRNIVWRGWKPEMVNTF

SEQ ID NO: 21832 - DNA, 1406 bp, Panicum virgatum
  misc_feature: Ceres CLONE 1818315
  misc_feature: Encodes the peptide sequence at SEQ ID NO. 21833
gtcggtcccttctctctcccattctccctccttgctgtggatccccaaggacggtggccaggtacacatcccgccggccgccgctacaagatctcgacgacggcgcgctggtgtgcagccgctacctcctctttgattccgtttgccgccgctggtgtggacagggcctccgaggtccgcgtgtgccaccgccgccagctccgcgtgcgccatggcgatgcgagcagctacggcggcggccacaggcttcttttcttcgccctcctccgtctccccgaggcgtttctcgtcctcctcgccgccggcgtcgctctccgccgggcgctgcatccgtcgccatcgtctccgcgcctttccgagttcggaattgcctctggaggaactcaacccatccgttgatctactgagaaaaactgctgaggccgtcggtgatttcaggaaaacgccaatctatatcgttggcacggactgcacagccaagcgcaacattggcaagctccttgccaattctataatataccgctacctctgcagcgaggaactgctcgaggatgttcttggtggcaaggatgcccttagagccttcaaggaatcagatgagaagggctatcttgaagtcgagaccgaagggttaaagcagctcacgtccatgggtagccttgtgctttgctgtggggatggcgctgtcatgaactcaactaatctgggcttactgaggcatggtgtctccatttggattgacgttcctctcgagatggcagcgaacgatatgctgaagagcacgggaacacaagctactacagatccagactctttctcacaggcaatgagcaagctccgtcagcagtatgatgaactgaaagaacgctatggaatttctgatattactgtttcagtacaaaaagtggcttctcagctgggctacagcagtgttgactctgtgacccttgaggacatggttcttgaaattgtgaggcaaattgagagactgatccgagcaaaagcgatgatggaagctgcagggaagcccttctagacaataggcgcgacattccgctccggcatttacatattatctccagttgccagagcaggcatttggctcttccatggagctgattacagttaacccacgaatcaagcacaagcattttcaaatccgaggagcagaatcacactgttgtgctcgaatatgcttatttcgtattgtaaaatcgcatgtcatttgatagcccattgtgtaaatctgccatggtgcagcaactttcagattgtatttactgtcaatggaaatgacagatctgcctgtccatgctccaaaggccgaaatctggagaattttgagaagggaaaaatttgagaatccctttacgatgaacatgttgccctgttggaggcttttgcgg

SEQ ID NO: 21833 - protein, 274 aa, Panicum virgatum; identical to SEQ ID NO: 10472
  misc_feature: Ceres CLONE 1818315
  misc_feature (90)..(258): Pfam Name: SKI Pfam Description: Shikimate kinase
  misc_feature: SWISSPROT Homolog: EC 2.7.1.71 Shikimate kinase

SEQ ID NO: 21834 - DNA, 1545 bp, Panicum virgatum
  misc_feature: Ceres CLONE 1818328
  misc_feature: Encodes the peptide sequence at SEQ ID NO. 21835
atttggtttcttgattcctctgttaaaaaaaaaacatactttgcacatcatcagctgacccttccgagcaaaagagaaatcctttttctgccctctgctatttcgccatttctgttcgtcccaccagacaaaaatccccatcttccccaaccggttgtgccgtgtgcgtcactgaacaagaacacgaccggttcctattccctagatctgcgtggaggcggcgtggagcctgaatccggcaaaagggttgcagttgcagttggttggccggagcgcccgagcccgccgtcaacatccaatcttggcgccggaccggccgtgcgccgccgccgtcttcctgcggcgacaaggaacaggcaaagtcggcggagatggtgccgtgggaagggtacgtgagcgacgagacgatgggcaccttcgcgcccatcgtgctctactgggtgtacgccggcggctaccagcttatcctgcaccgccggccgctcgagcggtacaggctccacacgcgggctgaggaggaggagaagaacctcgtcagcctacccgccgttgtccgcggcgtgctcctgcagcagctcgtgcaggccatcgtcgcgatgatcctgttcatggtcacatcagatagctcagtaactgtagttcagccacctattgtcgttcagatctttcagtttttaatcgcgatgctcgtgatggattcatggcaatattttgtgcatcgctacatgcatcaaaacaagttcctttatcggcacatccactctcaacatcatcggctcattgttccttatgctattggggctctctacaaccatccattggaggggctgcttttggacaccttaggtggtgccatctccttcttggtatccggtatgacaccaagaacagctgtgttctttttctgttttgctgtcctcaagacggtcgacgatcactgtggactttggttaccgtataacatcttccagaacctgtttcaaaataatactgcctatcatgatatccaccatcaactccaaggcacaaaatacaattactcccagcccttcttctcgatctgggacagaatactggggacccacatgccgtacaacttagtcagcaggaaggaaggtggatttgaagcaagactgttgcgagactagcttgagctcaatgcaagtgtacagatctccagtgaaagagtgagatacaatggtcagcctccccttcacatgattagaagctcacagtgaaaccggcacttgtaagacgatgaaactgtgccggtgctgcttttggcatctcggtccaagccatatgttacttgggaatggactgaagctcctgcatcgcttgttctcctgcagttcatctagatgggagggtccatttcgaagtctgaatgtgtgatacggttgtttgtatgcatggtacctgttatatatggttatttttcttccttttgtgcagagcttccattacatcgctgtgcagatagtgtatttgaaaatcacgcttctgtatgtacccaattatattcgtgtaattgtatctctgggc

SEQ ID NO: 21835 - protein, 258 aa, Panicum virgatum
  misc_feature: Ceres CLONE 1818328
  misc_feature (101)..(215): Pfam Name: FA_hydroxylase Pfam Description: Fatty acid hydroxylase
  misc_feature: SWISSPROT Homolog: EC 1.14.13.72 Methylsterol monooxygenase
MVPWEGYVSDETMGTFAPIVLYWVYAGGYQLILHRRPLERYRLHTRAEEEEKNLVSLPAVVRGVLLQQLVQAIVAMILFMVTSDSSVTVVQPPIVVQIFQFLIAMLVMDSWQYFVHRYMHQNKFLYRHIHSQHHRLIVPYAIGALYNHPLEGLLLDTLGGAISFLVSGMTPRTAVFFFCFAVLKTVDDHCGLWLPYNIFQNLFQNNTAYHDIHHQLQGTKYNYSQPFFSIWDRILGTHMPYNLVSRKEGGFEARLLRD

SEQ ID NO: 21836 - DNA, 676 bp, Panicum virgatum
  misc_feature: Ceres CLONE 1818329
  misc_feature: Encodes the peptide sequence at SEQ ID NO. 21837
acttcctttcttcctcttccgcctcctcccctctctgccgccgattcctgctgcaccccaatccaccagccagcctccgtttcctcgccatgagcgccgccgcctcaagctcctcgtcccggcaggtgcgcggtgcggcggtgccggtgccttctctcagcgccgacgagaccggcgcagtggctgacgaggccttccagaggcatacgtcgccgagcttgaggagaggcggggccggggtggccgtagtgtggttcaggaacgacctccgggtcctcgacaacgaggcgctggtgcgcgcgtgggcggcgtccgaggcggtcctgccggtgttctgcgttgatcctcgggtcttccaggggagcacgcactacttcgggttccccaagactggagcattgagggcacagttcttgatagagtgtctgggagatctgaagtataatttgaagaaaaagggtctcgatttactagttcgcaccggcaagcctgaagagatccttccttcgattgcaaaggctgtcagtgcacatactgtttatgctcaaaaggaaacctgcagtgaggagctcctcgtcgagtgcctcgtgagcaaaggcctagagcaaattcagattactcaaggaggaacatctggccagaagaaatctccgaaccccaagctgcagctcatctg

SEQ ID NO: 21837 - protein, 224 aa, Panicum virgatum
  misc_feature: Ceres CLONE 1818329
  misc_feature (79)..(224): Pfam Name: DNA_photolyase Pfam Description: DNA photolyase
  misc_feature: SWISSPROT Homolog: EC 4.1.99.3 Deoxyribodipyrimidine photo-lyase
FLSSSSASSPLCRRFLLHPNPPASLRFLAMSAAASSSSSRQVRGAAVPVPSLSADETGAVADEAFQRHTSPSLRRGGAGVAVVWFRNDLRVLDNEALVRAWAASEAVLPVFCVDPRVFQGSTHYFGFPKTGALRAQFLIECLGDLKYNLKKKGLDLLVRTGKPEEILPSIAKAVSAHTVYAQKETCSEELLVECLVSKGLEQIQITQGGTSGQKKSPNPKLQLI

SEQ ID NO: 21838 - DNA, 380 bp, Panicum virgatum
  misc_feature: Ceres CLONE 1818334
  misc_feature: Encodes the peptide sequence at SEQ ID NO. 21839
atagatgtgtacccaacagtaacttccacacgagttaataagcaacagattgccctcgaggttgcattgaacctgacacagtatcccttcctcgccgccgcagccagccctaacgtcatcgccgccagcgcccgtgtgtcacggaatctcagaagaaaaaaggacgttggatgcgcccactaccgacctggtcattctggatccgaccgatcactcacgccggaggatgcacaatggaaactccggctgcactaccaaacgaccccgcgcccaccctgtggagggactcagcggcggcgagattaaccccatctgggccatcgtcaaatccaccggcaagcttaggaacttccgctcccacttccactacctcccacaaa

SEQ ID NO: 21839 - protein, 51 aa, Panicum virgatum
  misc_feature: Ceres CLONE 1818334
  misc_feature: SWISSPROT Homolog: EC 1.5.3.11 Polyamine oxidase
MHNGNSGCTTKRPRAHPVEGLSGGEINPIWAIVKSTGKLRNFRSHFHYLPQ

SEQ ID NO: 21840 - DNA, 1756 bp, Panicum virgatum
  misc_feature: Ceres CLONE 1818336
  misc_feature: Encodes the peptide sequence at SEQ ID NO. 21841
aactcccccacgtctcgccacaccaatggagccgccaccgccgccagcggcgattccccgggaggcgtgggagggctgcagcgtcctcctcgacatcaacgacggcgaccaccttgccttcttccgcctcacccccgcagcgacggtgaagatcgggaacaagacctgctcgctgcagccgctcgtggggcgccctttcggctccctcttccgcgtcggtgctgacgggctcgtcccctgcgccgccgcagatgccccatcccgtgattatagcatgcaagatggtgccgacggccaagtgagggatgaaaccagggacaataggtccctggttgataataatacagcccagaatttatctagcgatgacatagaggcaatgaagagggatggtgcaactggtgatgagattgtggaagctttgatagcgaatagttcaacatttggaaagaaaactgtattctcacaagagaaatacaagttaaagaaacaaaagaaatatgcgcctaaagttcttttgcgacgcccctctacccgaagcatttgcgagacatacttaaagaaaagtccagctcgaatagggtttatgcgagttgacacactatctctcttattgtctatggcaaacattggtccatattcagatgtgcttgtggttgatatggttggaggcttaattgttggagctgttgctgaacgtttaggaggtacaggatatgtttgcagcacatatcttggtacagcacccagctccatagacattataagaatgtacaatctgggcagtgatatggtcagcaggattgttcaggtgccacttagtgaactatgctcaattcaaagttctgggaataccccttctgttctcaatggtaacgctgaaggggaggtggtcgaacctgctgtagtacaagatgaggatgcacaggcatctctagcacaggcagttgacacagcagatgagaaggcgcagttatcaacagaacaaacaactgatatggaggtctcgaacccttctttggatgttcaagatgaaaactcttcatttgaatgcaaaggtggtgatggtgattcaattgcctccaaatctaaacctggaaaagcaccatcaccagagaagatgaaatattggaatgaacatggctttagcagtttaattgttgctgccccgagccatgaggtagagagttttgttgctgatctgcttccgttattgtcttattcagctccgtttgctatctatcatcaatatcttgagcctcttgcaaagtgcatgcacaccttgcaggtatcaaaaagggctattggattgcagctttcggaaccctggctacgtgaataccaggtgctttcatcacggactcaccctcacatgcaaatgaatgcatttggcggttatatcttgagtggcatgaggattcaaagtgaacaagtgagtcatcaataagccatgcttccgtcccttaagaaggagcacaccattgtgtaatttttgtgctacctgaaaaggtggacaaaatatttgtagtcgagagaggagctaatgtgctatgtgcatgttaaaaggaatgtgttatcaaacagaaatttccatgcttactatggataacattgagtagaaggaaatgagcattgctgcctagatgcgctcacatccttgtagcctgtaatatgataattgttgtactttaaaaattctggaggattcaaactgaacttgtacatttttgaatcatttgatgcgtccagttgtagt

SEQ ID NO: 21841 - protein, 473 aa, Panicum virgatum
  misc_feature: Ceres CLONE 1818336
  misc_feature (11)..(316): Pfam Name: Gcd10p Pfam Description: Gcd10p family
MEPPPPPAAIPREAWEGCSVLLDINDGDHLAFFRLTPAATVKIGNKTCSLQPLVGRPFGSLFRVGADGLVPCAAADAPSRDYSMQDGADGQVRDETRDNRSLVDNNTAQNLSSDDIEAMKRDGATGDEIVEALIANSSTFGKKTVFSQEKYKLKKQKKYAPKVLLRRPSTRSICETYLKKSPARIGFMRVDTLSLLLSMANIGPYSDVLVVDMVGGLIVGAVAERLGGTGYVCSTYLGTAPSSIDIIRMYNLGSDMVSRIVQVPLSELCSIQSSGNTPSVLNGNAEGEVVEPAVVQDEDAQASLAQAVDTADEKAQLSTEQTTDMEVSNPSLDVQDENSSFECKGGDGDSIASKSKPGKAPSPEKMKYWNEHGFSSLIVAAPSHEVESFVADLLPLLSYSAPFAIYHQYLEPLAKCMHTLQVSKRAIGLQLSEPWLREYQVLSSRTHPHMQMNAFGGYILSGMRIQSEQVSHQ

SEQ ID NO: 21842 - DNA, 2048 bp, Panicum virgatum
  misc_feature: Ceres CLONE 1818347
  misc_feature: Encodes the peptide sequence at SEQ ID NO. 21843
atgtgcgagcaatcaataacctgataattgaagcgcccttcctctctcacaccacaaaaatctagctaccatttcactttgagcgagtgcttgggagtcgagatggcctatgtgatggcgagcgccaccacgagcgtgatgggctccgtcatcggcaagctgaccgccatgctcggcgagaagtaccagcacgcccgagatgctaagccagggatccgcttcttgaaggaggagctgagcaccacggacgccgtgctgcagaatctcgccagcaaggacgacgaccagatcgatccactggccaaagattggaggagcaaggtgcgtgagctatccctcgacatcgaggattgcatcgactgtttcaggctcaatcacagccatggaggttccaaggcaaacttcgtgcgcaaggccgtgcggaaggtgaagatcttgttgcaggaccggggattagcagaggagatccagaaactcaagagcctcgtcgtcgagcagagcgagcgggccaaacgctacgacatccacaagtgcctcggcgccacacctccgcccgtgcccttagatcctcgtgcgtctgctctctttcaagaggcgacaaatcttgtggggatcgatggtcctcgcaaggagatcatggagttgttgaaatgtgaagagatgcagcacaaggtggtgtccatctatcatctatggcaggggaagaccactctggccgtggagttgcaccgcaaaatcactgaagcatttgattgccgggccttcgtgtctgtatctcagactccagatattaagaagcgccttagtgatatattgtctcaaataagcaacaagaagtttgacgaggagtcgcaatggtgggaggaacagcagctcatccgcaatatgagagactacttaattgacaagaggtacctcatcttgattgatgatatctggagtgtatcagcatgggagcttgtgcgatctgccttaccgctcaatgacaatggaagcagaataattactacaacacgcagtaaagcagtagccaaatcatgtagtactggtattgctgaacaaatgtacgaagcaaagccacttggagatgacgactctcagagattattctttaaaagactcttttgctcccctgaagattgtccccaagatttgatgaaagtatccagtgatattctgaagaaatgtggtggcttaccactagccataatcagtatagctggtttattagcaaacagaaggcagacggtagaagtctgggtcaatacattgaagtccatttctgctgcagttgacaaagattcttacattgataagatgaaaagaattttgctgcttagttactttgaccttcctccccatctaaagagctgtttgttatatctgagtgtgtttccagaggattatttgattgattgcagacagttgatattgttatgggtagccgaagctctgattcctggacaagacagggaaagtatggaggagcttgcgacaagttatttgaatgatctcatcaatagaagtttggttcagccagtcaaggttggagcagatggcgcaacagtgaaaacttgcagagttcatgatgtcatacttgagtttattgtatcaaaggctgtcgaggacaattttgttacaatatggaatcgaaatgggttttctgacaattattcttccaacaagattcgtcgtttgtcaatccaggaagacatttctggccaggctgaagagatgttgaagacaataaaaaatgcagctcatattcgatcaattagcatttttggcgataataattcggtgctctgagtttttaagtagccaagtcttgcgagtgctgaacataagaggtggtgggcttagagaattctatcttggacatgtcaaaagaatcagtcaaatgaagtactgccggataaccggtaaaccccatgagctcccagaagatatagagagggaaaagtccattttacaccctcgtactagtcaagaagtctggttttcaacctcgtactacaaaaccgggtattgtgcacccttgaactggc

SEQ ID NO: 21843 - protein, 568 aa, Panicum virgatum
  misc_feature: Ceres CLONE 1818347
  misc_feature (153)..(457): Pfam Name: NB-ARC Pfam Description: NB-ARC domain
MAYVMASATTSVMGSVIGKLTAMLGEKYQHARDAKPGIRFLKEELSTTDAVLQNLASKDDDQIDPLAKDWRSKVRELSLDIEDCIDCFRLNHSHGGSKANFVRKAVRKVKILLQDRGLAEEIQKLKSLVVEQSERAKRYDIHKCLGATPPPVPLDPRASALFQEATNLVGIDGPRKEIMELLKCEEMQHKVVSIYHLWQGKTTLAVELHRKITEAFDCRAFVSVSQTPDIKKRLSDILSQISNKKFDEESQWWEEQQLIRNMRDYLIDKRYLILIDDIWSVSAWELVRSALPLNDNGSRIITTTRSKAVAKSCSTGIAEQMYEAKPLGDDDSQRLFFKRLFCSPEDCPQDLMKVSSDILKKCGGLPLAIISIAGLLANRRQTVEVWVNTLKSISAAVDKDSYIDKMKRILLLSYFDLPPHLKSCLLYLSVFPEDYLIDCRQLILLWVAEALIPGQDRESMEELATSYLNDLINRSLVQPVKVGADGATVKTCRVHDVILEFIVSKAVEDNFVTIWNRNGFSDNYSSNKIRRLSIQEDISGQAEEMLKTIKNAAHIRSISIFGDNNSVL

SEQ ID NO: 21844 - DNA, 705 bp, Panicum virgatum
  misc_feature: Ceres CLONE 1818364
  misc_feature: Encodes the peptide sequence at SEQ ID NO. 21845
attccaacagcttcttcccctcaaagaccactccggcgagattcttcccagaccggccggcgaatcacagctcgatcgatcgttctccggcgagctagcaaccactccctgatcggaatggacttcggaggggcgctgcagctgccgccggggttccggttccacccgacggacgaggagctggtgacgcactacctcctgcgcaagtgcggcgggctggcgccggcggcgccggtgatcgcggaggtggacctgtacaagttcgacccgtggagcctgccggagcgggcggccggcggggagaaggagtggtacttcttctcgccgcgggaccgcaagtaccccaacgggtcgcgccccaaccgcgccgccggcgccgggtactggaaggccaccggcgccgacaagcccgtgggcgcgccgcgccccgtcgccatcaagaaggcgctcgtcttctacgccggcaagccgcccaggggcgtcaagaccaactggatcatgcacgagtaccgcgcgccgatgaaggtggagatggccgactacggcgggtactacgacgacgggtacgacctcgagacgccgtccgcggggatgctgtgcttcgaccgcccggcggccgtggcccctgtcccggctctcgcgccggcgccggcgctgtcgccggcggcggagcccgacccggaccgcgactccacctccatgccg

SEQ ID NO: 21845 - protein, 195 aa, Panicum virgatum
  misc_feature: Ceres CLONE 1818364
  misc_feature (9)..(134): Pfam Name: NAM Pfam Description: No apical meristem (NAM) protein
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: The sequence is a functional homolog of SEQ ID NO 612 in the 11/435,388 US patent application
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: Useful for making plants with modulated light quality sensitivity
  misc_feature: The sequence is a functional homolog of SEQ ID NO 2472 in the 10/374,780 US patent application
  misc_feature: The sequence is a functional homolog of SEQ ID NO 520 in the 11/435,388 US patent application
  misc_feature: The sequence is a functional homolog of SEQ ID NO 974 in the 10/225,066 US patent application
  misc_feature: The sequence is a functional homolog of SEQ ID NO 2590 in the 10/374,780 US patent application
  misc_feature: The sequence is a functional homolog of SEQ ID NO 286 in the 10/225,066 US patent application
  misc_feature: Useful for making plants with modulated biomass
  misc_feature: The sequence is a functional homolog of SEQ ID NO 1816 in the 11/479,226 US patent application
  misc_feature: The sequence is a functional homolog of SEQ ID NO 2112 in the 10/374,780 US patent application
MDFGGALQLPPGFRFHPTDEELVTHYLLRKCGGLAPAAPVIAEVDLYKFDPWSLPERAAGGEKEWYFFSPRDRKYPNGSRPNRAAGAGYWKATGADKPVGAPRPVAIKKALVFYAGKPPRGVKTNWIMHEYRAPMKVEMADYGGYYDDGYDLETPSAGMLCFDRPAAVAPVPALAPAPALSPAAEPDPDRDSTSM

SEQ ID NO: 21846 - DNA, 1599 bp, Panicum virgatum
  misc_feature: Ceres CLONE 1818368
  misc_feature: Encodes the peptide sequence at SEQ ID NO. 21847
acgccatgtgctcgacgatttgccgctgacacgagtccatggcgcttgctctcctcctgccctcccccgcatcccaccgccgctcgcttcgttctgtctcctctccgcctctcgcgcgtgtcaccaccgccgccagcttcggcctcgcgtttttctcccatctctcctccggctgctgctctctgcagaggactggcgccgcgggcggcgacggcgatggcgccggcgagacctcatcggaagagccggtggctggatggctcgacacggacctgctcaggcgggtctcaggcgcggggaatgcggaccaggcgctggacattgtcgcagagtcggcgggaagttcgggcgccgctctggaagcgcccgaatgcaacgcgatcatcgccgcggcacttgaccgaggcaacgtcgagctcgcgctctcggtgttcgaagccatgcgatccggctttgcgggagtaggaggctgggggtgggcgagaccggacattcggacatatgccttgctcgtacaggggttggcagcctccctgcgtgtttctgatgcaatcaggataatcgattatgtgtcttgcgctggtgtttcttctacagaggagattcctttcgggattattgttcgctgtccaacctgcatggtagcagttgctgttgctcaaccgcaggatggaactcaggttgtttcctgttcgaagtgtcgatatcaatatgaattattttctggagacattacgagcattgaatctgaagaagttagcatggatatttcagctctggagaaggcattgagattcattaatataagaaaagatggtcttccagctgctgtccactctattgtgatccgcgcaccttcaggaatagcacgtactcatagatttgctacccagaatgtagaactccctgctcgagaaggagaaagagtaaccatttcgttggcagccccatccaatatttatcgtgaagtgggtcccctcaagattgccgcacgctcacaaggatttaaaccagacgaacctatgtgtctgactaatcacagaaatggacaaatctcaaagttgctaagaactccatcaaagaatgaaggatcatttttccttagcccatatttattggtcggtgctcttgctttgcttgcttctggagatgctgcttccgtattcattgacccaagtcttcctagacttattacagcaactgcagttgcatcagctgccatcggaacaactctaaatcaagtggtcctgccagaaattcaaaagcttccacaaaaggcggtggatatagttgctgtacggcagcagcttttgtctcagtatgacattcttcagagccgtcttaaggaactgaaacagtttgcacaaaaagaggtgtggatgctcgcaaggatgtgtcaattggacaacaaaatactagcagtgggcgaaccatcttatcgtgctagacgaggtagagtaaagagggtacgggaaagcttggaaagcacactctctgcaaggattgagctaatggaaagttatgcaaaattgtgttcaatgattgaaattgaaattgagatggactctgatgttattgctgctgaagcgggcagcagtg

SEQ ID NO: 21847 - protein, 520 aa, Panicum virgatum
  misc_feature: Ceres CLONE 1818368
  misc_feature: Useful for making plants with altered lignin content
MALALLLPSPASHRRSLRSVSSPPLARVTTAASFGLAFFSHLSSGCCSLQRTGAAGGDGDGAGETSSEEPVAGWLDTDLLRRVSGAGNADQALDIVAESAGSSGAALEAPECNAIIAAALDRGNVELALSVFEAMRSGFAGVGGWGWARPDIRTYALLVQGLAASLRVSDAIRIIDYVSCAGVSSTEEIPFGIIVRCPTCMVAVAVAQPQDGTQVVSCSKCRYQYELFSGDITSIESEEVSMDISALEKALRFINIRKDGLPAAVHSIVIRAPSGIARTHRFATQNVELPAREGERVTISLAAPSNIYREVGPLKIAARSQGFKPDEPMCLTNHRNGQISKLLRTPSKNEGSFFLSPYLLVGALALLASGDAASVFIDPSLPRLITATAVASAAIGTTLNQVVLPEIQKLPQKAVDIVAVRQQLLSQYDILQSRLKELKQFAQKEVWMLARMCQLDNKILAVGEPSYRARRGRVKRVRESLESTLSARIELMESYAKLCSMIEIEIEMDSDVIAAEAGSS

SEQ ID NO: 21848 - DNA, 321 bp, Panicum virgatum
  misc_feature: Ceres CLONE 1818368-R
agagcaatggcgtatacaagctgaagctaatgatgaagctgaaaggcttctgagttctgattcttcagaaacattgcctgctggacatatgtaatgcaattttggtaatgcgcaagcattattctcctatttcctatttagatatttatatctctgcaattttaatgttctttaccaaattacaaacaaatttctagtttaggattttgaaggaaaatattgctacagaacattagaaaaaacgaactgtatgataacagtgagatgacatcatgaatcctgcaacagaataatacagaatattgattggaaccgtgtagc

SEQ ID NO: 21849 - DNA, 1373 bp, Panicum virgatum
  misc_feature: Ceres CLONE 1818407
  misc_feature: Encodes the peptide sequence at SEQ ID NO. 21850
aaatcaaatccccaaacacacagccaaaccccgggcctgctccgccgctccgcgccgcggggtcgagcgccgctgccgacgaggccgccagcaccgccgccccctatggccatggaggtcagccgcagagtcccgccgccgcacgggggggcggctcccgcggggcgccagccgcggcgccgggcggcggccgggggcgagggggagcgggagcgggtgcgggtgcaggccggggacgcgctgccgctcccgatccggcacacgaacctcttcttctcggccctcttcgccgcctcgctcgcgtacctgatgcggcgctggagggagaagatccgcgcctccacgccgctccacgtcgtctccctcgccgagatcttcgccatctgcggcctcgtcgcatctctcatctacctactgagtttcttcgggatcgcgttcgtccagtccgtcgtctccaacagcgacgacgaggaggactacctcatcgacgcccgccacgagccgtcgccggccccggccccggccccgtgcgcgctgctggggaaccccgccgccgcgccggagaaaatgccggaggaggacgaggagatcgtggccgcggtcgtggccgggaagatcccgtcctacgtgctagagaccagcctgggggactgccgccgcgccgccgggatccggcgggaggcgctgcggcggatcacggggagggacatggacggcctcccgctcgacgggttcgactacgcgtccatcctcggccagtgctgcgagctgccggtgggctacgtgcagctgcccgtgggcgtcgctggcccgctcctgctcgacggccgccgcctctacgtccccatggcgaccaccgagggctgcctcgtcgccagcaccaaccgagggttcaaggccattgccgaatccggcggcgcctccagcgtcgtgctcaaggacgggatgacgcgagcaccggccgtccggttcccgtctgcccgccgcgccgctgagctcaagggattcttggagaatcccgccaacttcgacaccctggctacagtgtttaacaggtcgagcagatttggcagactgcagggagtgaagtgcgcgatggcagggaggaacctttacatgaggttcacctgcagcacaggggatgccatggggatgaacatggtctccaaaggcgtccagaatgtgctggactacctccaggatgacttccctgatatggatgtcatcagcatatcaggtaacttctgttctgacaagaagtcagctgctataaactggattgaagggcgtggaaagtctgtggtttgtgaggcagtaatcaaggaagatgttgtgaaaaaagttctcaagactaacgttcaagcactagtaga

SEQ ID NO: 21850 - protein, 420 aa, Panicum virgatum
  misc_feature: Ceres CLONE 1818407
  misc_feature (168)..(420): Pfam Name: HMG-CoA_red Pfam Description: Hydroxymethylglutaryl-coenzyme A reductase
  misc_feature: SWISSPROT Homolog: EC 1.1.1.34 Hydroxymethylglutaryl-CoA reductase (NADPH)
MEVSRRVPPPHGGAAPAGRQPRRRAAAGGEGERERVRVQAGDALPLPIRHTNLFFSALFAASLAYLMRRWREKIRASTPLHVVSLAEIFAICGLVASLIYLLSFFGIAFVQSVVSNSDDEEDYLIDARHEPSPAPAPAPCALLGNPAAAPEKMPEEDEEIVAAVVAGKIPSYVLETSLGDCRRAAGIRREALRRITGRDMDGLPLDGFDYASILGQCCELPVGYVQLPVGVAGPLLLDGRRLYVPMATTEGCLVASTNRGFKAIAESGGASSVVLKDGMTRAPAVRFPSARRAAELKGFLENPANFDTLATVFNRSSRFGRLQGVKCAMAGRNLYMRFTCSTGDAMGMNMVSKGVQNVLDYLQDDFPDMDVISISGNFCSDKKSAAINWIEGRGKSVVCEAVIKEDVVKKVLKTNVQALV

SEQ ID NO: 21851 - DNA, 774 bp, Panicum virgatum
  misc_feature: Ceres CLONE 1818407-R
tctctgctcaagccgctggccatctggtccagagccacatgaaatacaacagatccagcagagacatgtccaaggctgcagaggaagcagacggacccaaaaaatgctgaatactgcctatttgtttgatgccccttgggaaaatggaagagaaagggtttcgtaggtttgattccttgtggcatgcgcaggcccgcatgagggttaaaaggaagaaaacccttcaggtaaaagcgaagattcagtcgacttgtcatatatttaccaggccgtgaaagctctaggtgtcaaacacctcatggatcctggagtatgacgtatttgattattcgttggtgttgtagctgttcgtctcctgtcgttggcacttgatccctttccgccacccctcactcattcttagcatcttgttttgcccgtcccctgcgactttggagaatcagacctgaccaaggggtttgtcgtggaaccatcacagcaaggcagtcgcagccactggatacttcctccgctttggcgagaagttcgcgtcggcagaggtgcctgatgcctttgtattttcagctctgtaaatttacctttattctttttcttttaaaacttttgaaccgtagagtcgtcgtcggtgatgtgggttgtaaagaaaagatgtggtccggaacagtttttatatcttcttgtctccctcgctcgctcatctcaattgtatgttccagttgcctgcctacccacggatcgggctttcttttttaacaataaagctgacacttcggc

SEQ ID NO: 21852 - DNA, 663 bp, Panicum virgatum
  misc_feature: Ceres CLONE 1818422
  misc_feature: Encodes the peptide sequence at SEQ ID NO. 21853
ataccgcaactccacccaaagccataaaaaccagtgcagcaacaatgagagctaaagtttccaggctctgaattttcagcatgttggcgcccgcatcagcccaggtgcctcacaccatacgacctgttgcaaactgctttgggcttcatcgacgatctgaccgatatcacagatggcgagggactggaaagaagatgattctttccactcgtggtgtgctcgaatccagcaatggtgcaccatccggtggccttgtgaaaaaaagaaagattgtggagcacattattctgcttcgagccaagccaaacatctcagatgctgaagagaaagatatgctggattatctatatacatcacaataccagatgagagggatactcacaatctcgttgggccgcatagaggagccaaatagcgagaactttacgcacgctgtcttcatgcgttttcagcagaaagaagacattgtgaagttctacagtagtgcctactattccaaaattcttgatgaccacgtaaaacctgtttcctatggctcagtttctgtagatttcgagtctgaggtggaagatgacattattcccctctttcgtaggggagaggtatctcaagctgccttattctggcgtaaattggtaccattctttactatgtaaaataccc

SEQ ID NO: 21853 - protein, 191 aa, Panicum virgatum
  misc_feature: Ceres CLONE 1818422
  misc_feature (65)..(160): Pfam Name: Dabb Pfam Description: Stress responsive A/B Barrel Domain
MLAPASAQVPHTIRPVANCFGLHRRSDRYHRWRGTGKKMILSTRGVLESSNGAPSGGLVKKRKIVEHIILLRAKPNISDAEEKDMLDYLYTSQYQMRGILTISLGRIEEPNSENFTHAVFMRFQQKEDIVKFYSSAYYSKILDDHVKPVSYGSVSVDFESEVEDDIIPLFRRGEVSQAALFWRKLVPFFTM

SEQ ID NO: 21854 - DNA, 450 bp, Panicum virgatum
  misc_feature: Ceres CLONE 1818435
  misc_feature: Encodes the peptide sequence at SEQ ID NO. 21855
ctctttccccattaccttctctccctcttcctcttcatcctccttcccagcctctggtcctgacgacccccggcatgggatggctcaccgagcgcttgctcctacttctccctgacccctcgttcaatattgtcaactaccacatgtgtgtcggtggatctggcgtgcatctagcgagccaacccctgatcctctcgcgcgcggtgactgatcccaccaagctgcccgagtgcaacttcgagggctcccgcaccaaccaggctcccgggaaggacagtgaggtcctcctgttccaccgggctatcttcgccgacgctgtcacgaatgccaacaacgttctcgtcatgtgtgattgcttcacccgagatggcgagccaattccccccgatctgaagctcaccacccttcagattttcagtcaccctgaagatgcctctgaggacccctctt

SEQ ID NO: 21855 - protein, 125 aa, Panicum virgatum
  misc_feature: Ceres CLONE 1818435
  misc_feature (16)..(97): Pfam Name: Gln-synt_N Pfam Description: Glutamine synthetase, beta-Grasp domain
  misc_feature: SWISSPROT Homolog: EC 6.3.1.2 Glutamate--ammonia ligase
MGWLTERLLLLLPDPSFNIVNYHMCVGGSGVHLASQPLILSRAVTDPTKLPECNFEGSRTNQAPGKDSEVLLFHRAIFADAVTNANNVLVMCDCFTRDGEPIPPDLKLTTLQIFSHPEDASEDPS

SEQ ID NO: 21856 - DNA, 1435 bp, Panicum virgatum
  misc_feature: Ceres CLONE 1818454
  misc_feature: Encodes the peptide sequence at SEQ ID NO. 21857
gtgatgaagccgatggccaccaatggcatggccccctccttcttccccgcaaacttcctgctccaaatgcagcagcccctccctcaccatccccagcagcaggaacaccaccaccaccaccaccaccatgacgccggccaccacgagcacgaggcggcgcaccatctcctcgctccccctccccccgccctcgtcagccccttcctccacgacttcggcggcgccatggccgcgccgccaatgctgggcggcggcctcggcaagcgcatgtaccccgacggcgcgggcgacgacagtaacagcctgcagcagcacgcggcggcggcggatccgcagcagcaggacggcggcgcggggtcggacgacgaggaaggctccgccgcggcgggcggcgggtgcggcggggagcggaagcggcggctgagcgtggagcaagtgcgcacgctggagcggagcttcgaggtggccaacaagctggagccggagcggaaggcgcagctggcccgcgcgctggggctgcagccccggcaggtggccatctggttccagaaccggcgcgcgaggtggaagacgaagcagctggagaaggactacgacgcgctccgccgccagctcgacgccgcccgcgccgagaacgacgccctcctcgcccacaacaagaagctccacgccgaggtcatggcgctcaagggaggcggaggcggcggcggaggagggaggcaggaggcggcgtcggagctcatcaacctcaacgtcaaggagacggaggcgtcctgcagcaaccgcagcgagaacagctccgagatcaacctcgacatctccaggccgccggcgccggcgcccggcgccgacgagagccccgccgccatgaacagccaccggggcctcccgttctacgcctccgccgccgtcgaccagctcctgcatagcggccacccgtccccggccgccgccgcggcgcccaagatggagctcggccacggcgccgccgccgacacgccctccgccgcgggggcggccggcagcttcggcagcctcctctgcggcgccgtcgtcgacgagcagccgccgttctggccctgggccgacggccaccacaacttccagtgatcgctcgcacatcctccgatccgcgcgaggatgattgatcgagacaatgcatgcgtgtcacgaatgaatctgatcaccggatacattcaactaagagtaatcgatcggtgtggctgctctccattttgttggcatcgatcgaggccagcaggaggagagatcgccgatatcagaatgagttagttgttgaacaaatcactactacaaaacaggcctttgttcctggccatttgtcccggcagcctttgggcccgggacaataggtggcttttgtcccgggtccaacggctagccgggccagcgggggggacgggggcctttttgt

SEQ ID NO: 21857 - protein, 365 aa, Panicum virgatum
  misc_feature: Ceres CLONE 1818454
  misc_feature (133)..(187): Pfam Name: Homeobox Pfam Description: Homeobox domain
  misc_feature (188)..(232): Pfam Name: HALZ Pfam Description: Homeobox associated leucine zipper
MATNGMAPSFFPANFLLQMQQPLPHHPQQQEHHHHHHHHDAGHHEHEAAHHLLAPPPPALVSPFLHDFGGAMAAPPMLGGGLGKRMYPDGAGDDSNSLQQHAAAADPQQQDGGAGSDDEEGSAAAGGGCGGERKRRLSVEQVRTLERSFEVANKLEPERKAQLARALGLQPRQVAIWFQNRRARWKTKQLEKDYDALRRQLDAARAENDALLAHNKKLHAEVMALKGGGGGGGGGRQEAASELINLNVKETEASCSNRSENSSEINLDISRPPAPAPGADESPAAMNSHRGLPFYASAAVDQLLHSGHPSPAAAAAPKMELGHGAAADTPSAAGAAGSFGSLLCGAVVDEQPPFWPWADGHHNFQ

SEQ ID NO: 21858 - DNA, 1754 bp, Panicum virgatum
  misc_feature: Ceres CLONE 1818465
  misc_feature: Encodes the peptide sequence at SEQ ID NO. 21859
gcaccactcgcaagtcgaagccaaatccaaatcggcatggaactttccctgacaccaccccttgctctccagctcctgctcctcctacccctcctccctctgttcagttttctcctgcgccgggaccccaagaagcagcatcgcgctcatggcctcaaggcctacccgctcctcggcacactcccgcacttcttcaagaaccaggaccgcttcctcgaatggtgcaccgacgtcatcaagcgcgaccccacgcacaccatgtccttcaaggcgctcggcttcaccggcggcgccatcaccgccaacccggccaacgtcgagcacatcctcaagaccaacttcgccaactaccccaagggcgaggccacggtgtccatgatcgaggacttcctcggccgtggcatcttcaactccgacggggaacagtggctgtggcagcgcaaggccgccagctacgagttcagcaagcgctcgctgaggagcttcgtcgtcgacgccgtccgcttcgaggtcgtcgagcggctgctgcccctgctcgaccgggcgcgccaggacgggcgcacgctggacgtgcaggacgtgctggagcgcttcgcgttcgacaacatctgccgcgtggcgttcggcgaggacccggcgtgcctcgccgaggagagcatggcggcgccccagagcgccgagttcatgcgcgccttcaacgacgcgcagagcgccatcacggcccggttcctgtcgccgttcaggtcgctgtggcgcctcaagaggcttctcaacatggagcccgagaggcgggtgagcgaggcgctccgcaccatccacggctacgccgaccggatcgtctgggagcgccgggagagaggcgacgccgggctggcggccagggacgacttcctgtcgcgcttcgccgcgagcggcgagcacagcgacgagagcctccgggacgtggtcaccaacttcctcctcgcggggcgcgacacgacgtcgtcggcgctgtcctggttcttctggctggtgtccacccggcccaacgtggagggcaggatcgtgcgcgagatcgccgcggtgcgggcgtccggaccggggagcgcgcgcgccggcgcggcgacgttcagcttcgacgagctgcgcgacatgcactacctccacgccgccatctccgagtccatgcggctgtacccgccggtggccatggactcgcacagctgcaaggaggacgacctgctgccggacggcacgttcatcgggagagggtggctggcgacctactccgcgtacgcgatggcgcgggtggaggatgtgtggggcaaggactgcgaggagttcaggccggagcggtggctcggcgaggacggcgcgttccggccggagagcccgttcaagtacccggtcttccacgccgggccgcggatgtgcctcggcaaggagatggcgtacatccagatgaaatccatcgtggcgtgcgtgttcgagaggttcggcctccagtttgtcggcggcgaggagccgccggggctcgtgctctccttcacgctgcggatggaaggcggcttgccgatgaaagtgatcgagaggtcggtaatctaggctggacttgtccacttcgtcgctagccgttgttcccacttggagtttttttttagataagggaatattaatattcccacttggagttggtccggcaaataataagtgatgtggggctttcattcttggaacatagtttcattttatttaaaaaaaacatagtttcatag

SEQ ID NO: 21859 - protein, 515 aa, Panicum virgatum
  misc_feature: Ceres CLONE 1818465
  misc_feature (37)..(509): Pfam Name: p450 Pfam Description: Cytochrome P450
  misc_feature: SWISSPROT Homolog: EC 1.14.14.1 Unspecific monooxygenase
MELSLTPPLALQLLLLLPLLPLFSFLLRRDPKKQHRAHGLKAYPLLGTLPHFFKNQDRFLEWCTDVIKRDPTHTMSFKALGFTGGAITANPANVEHILKTNFANYPKGEATVSMIEDFLGRGIFNSDGEQWLWQRKAASYEFSKRSLRSFVVDAVRFEVVERLLPLLDRARQDGRTLDVQDVLERFAFDNICRVAFGEDPACLAEESMAAPQSAEFMRAFNDAQSAITARFLSPFRSLWRLKRLLNMEPERRVSEALRTIHGYADRIVWERRERGDAGLAARDDFLSRFAASGEHSDESLRDVVTNFLLAGRDTTSSALSWFFWLVSTRPNVEGRIVREIAAVRASGPGSARAGAATFSFDELRDMHYLHAAISESMRLYPPVAMDSHSCKEDDLLPDGTFIGRGWLATYSAYAMARVEDVWGKDCEEFRPERWLGEDGAFRPESPFKYPVFHAGPRMCLGKEMAYIQMKSIVACVFERFGLQFVGGEEPPGLVLSFTLRMEGGLPMKVIERSVI

SEQ ID NO: 21860 - DNA, 1331 bp, Panicum virgatum
  misc_feature: Ceres CLONE 1818489
  misc_feature: Encodes the peptide sequence at SEQ ID NO. 21861
actctatcctcttccactccggcctcttccacgccgcctccgccgccgccacctcgccggcgaccaccgtagcatcagagattccagagctcgcgcctctcgcgcatggttcttagcttctcgcttgctcgaccagcactgtaactgactgaataagcgtggtgacgagatgatgccggtggaggcggcggcggcggaggactggtcggcgtgcgcgttctcgctcacctgcgaggaagacggcgccgacctcggcgacggctccgtcgacgacggcgagctcttctcgccctacaatgcccgcgacgaggaggaagaggagtacttggagcagctggtgttcaaggaggctagcttctgctgctcctccgactccgccgccgactgcgacggcgacggcgacggcgatgtggacggggacggggaccaccagctcgtcttctccgaggagtggttccggcaagctcgcctcgccgccgtcaagtggattcttgaaacgcgcgggtacttcgggttcggccaccggacggcgtacctcgccatcgcctacttcgatagcttcctcctccggcgatgcgtcgatagggaggccatgccgtgggcggcgcggctgctgtccgtggcgtgcgtgtccgtggccgccaaaatggaggagtgccaggtgccggcgctgtcggagttcgacgccggcgactacgacttctgctcggcgtccatccgccggatggagctgctcgtgctgtccacgctcgggtggcgcatgggcgccgtcacgcccttcgacttcctcccctgcttctcctcgcggctccacccgcacggcggcgccggcgccggcggccgcgtcgccctcaaggccatcggcttcatctttgccacggccgaagctggtagcgtgcttgatcacaggccgtccactgtggctgcagctgcaatcttggcagcaacccatggacctctactgaccaaagaggcactggattccaagatgagctatcttcctccatcttgtcttattgagaaggagcatgtacatgcttgctacagtatgatggttggagacatgaacaggaggggtaacaagagatcattgccatgttcaggctccaacgaggttgccactagtacatatgattctgttcttcttgatgatgttaccgacaacgccgcctttgcgacgggcgtggcggcgaggaataagcggatcgggctggagctgccgggcatccgttgagaagctagcaccaccggggacacaatttttagccagatgtctaggggggcttggtttgatcttccctttttttcattcttttaacttatatgtttgc

SEQ ID NO: 21861 - protein, 354 aa, Panicum virgatum
  misc_feature: Ceres CLONE 1818489
  misc_feature (68)..(199): Pfam Name: Cyclin_N Pfam Description: Cyclin, N-terminal domain
MMPVEAAAAEDWSACAFSLTCEEDGADLGDGSVDDGELFSPYNARDEEEEEYLEQLVFKEASFCCSSDSAADCDGDGDGDVDGDGDHQLVFSEEWFRQARLAAVKWILETRGYFGFGHRTAYLAIAYFDSFLLRRCVDREAMPWAARLLSVACVSVAAKMEECQVPALSEFDAGDYDFCSASIRRMELLVLSTLGWRMGAVTPFDFLPCFSSRLHPHGGAGAGGRVALKAIGFIFATAEAGSVLDHRPSTVAAAAILAATHGPLLTKEALDSKMSYLPPSCLIEKEHVHACYSMMVGDMNRRGNKRSLPCSGSNEVATSTYDSVLLDDVTDNAAFATGVAARNKRIGLELPGIR

SEQ ID NO: 21862 - DNA, 2639 bp, Panicum virgatum
  misc_feature: Ceres CLONE 1818494
  misc_feature: Encodes the peptide sequence at SEQ ID NO. 21863
cagcacctcctcccactgaccgctgccacttccattccgttccacttgggcacctgggttgccttcttcaacctccctctcatctggcatctttcccctccctttccgttggattggtagatagattcattgctgttccccctgaactgtagactgagactgaggctggaaatggactttgatttccgttatgaatggaaatgaaatgaaatctccactccactgatcgatctttctggccgttcctcttccttgggagagaagagagaggagagaggaggggggaaaagaggccgtcgaattcttgcatcgtcgtcttctcgctttgcttggcgttggttccacttgcacacaattcgatttctctggtggcgtccgcaagtcaaggccacctcgtcaaagcaagcaaacctctctctctctctctctctctctctctctctctcgccatcagtcagagtcaagcaagctcccatttttcccttgcagcgacagccctccctctgccatgtccggcaccaccaccgcggcggcgacgcagcccaagccccaccacctcccaaaagcctgattcatggccccggccccgggcccatccccggcgcccgggtcctcgcggcccactgccacaccggccgacgccgctgccactccgccggccgcggcggcgcccccgccgcgcgccgcccctccgccctcacactcgcaggcttctccacctccgaggcctactgcctcgccgccgcccgccccgccgcggacagttgctcctcctccaaagcccacgccgctctcgcccccgccaacgtccccgccgccgtccgccccgccgacgccctcgctctcaccgccaagaacgcatccaccagagtccccggcccctgcatcacctcctgccgccgctccgccgcccgttccggtgccatcagcatcgactagccacaagccattgcctacgcctgctaccgcggctgatccggtccgccccagcacgagcaagaactcaagttccaacaggccgtcgagcccggtttcgcggcacgggaacccacctggctcccctggccctggcggccttggtaatggtgtcattgtagccatcgctgcggtgcttgccgttcttgtgcttagcctccttgtcacagcagtttggttcacgaacaagcgcaagaggaagaaagctgatggttacagagctggtttcatgtcgcctacctcgcctttttcttcgcagcaaccttccggtgacacggcaaatgcaggcttgccaatcgatccttctgtccagaccagcttgtccaatggtgctgggagccccaggctgaatcaatgcttgtccgatatcagcatgggcaactccaggttcttctcatatgaggagctgtatcagattaccgatggtttctcagcacataagcttctaggggagggaggttttgggtctgtgtacaagggccgtctgccagatggcacagatgtcgccattaaacgactaaaggatggtggcggacaaggggaacgtgagttccaggctgaagtggagataattagtcgggtgcatcaccgtcatttagtttcccttgtgggctattgcagttccaataaccaaaggttacttgtatatgactttgtgcctaataacacactacattaccatcttcacggacacagaatgcctgtgttagaatggtccaccagaattaaaattgctgctggtgctgctcgtggaattgcttacctacatgaagattgccatcctaggataattcatcgagacatcaagtcgtcaaacattttgttggataacaactttgaagcaaaggttgctgattttggtcttgcgagattggctttggatgctgtaacccatgtaacaacccgtgttatgggcacatttgggtacatggctccggagtatgcatcgagtgggaaattgactgagagatcagacgtattctcttttggtgtagttctcttagagcttattactggtagaaaacctgttgatgcatcgagaccactgggtgacgagagcctcgtcgagtgggctaggccattgctttctcgagctcttgatacaggcaatttggaagggttggttgaccacaggcttgagaagaagttgaatcaagcggagatgttccgtatgatcgaggctgctgcagcctgcattaggcactcggcatcaaggaggcccagaatgagccaggtggtacgggttcttgaaagcttggcagacatcgacctaacaaatggagttcaacctgggcagagccagcttttcaacgtggccaacacggcggagataaggatgttccggcggatggtggccggcgcgcaggatgatgacagctccgacttgagcctatacggttggagcagaggcacggacgccgacccgagttccaggattttgtgatgatggccttctaagctttctgactgtctgtagtaactcttcagttccctagtagcgaatttaggtgattgtaccgagtgaaagtggttcaatgaccaaccttatattctttaggaaatcaaagtggtctgtagattacacaggtgagaagatagtgcttgttctctttgtttttgtatgatggaagatattgactggtcacagtttatgcagatttttt

SEQ ID NO: 21863 - protein, 404 aa, Panicum virgatum
  misc_feature: Ceres CLONE 1818494
  misc_feature (67)..(340): Pfam Name: Pkinase_Tyr Pfam Description: Protein tyrosine kinase
  misc_feature: SWISSPROT Homolog: EC 2.7.11.1 Non-specific serine/threonine protein kinase
  misc_feature: Useful for making plants with altered carbohydrate content
MSPTSPFSSQQPSGDTANAGLPIDPSVQTSLSNGAGSPRLNQCLSDISMGNSRFFSYEELYQITDGFSAHKLLGEGGFGSVYKGRLPDGTDVAIKRLKDGGGQGEREFQAEVEIISRVHHRHLVSLVGYCSSNNQRLLVYDFVPNNTLHYHLHGHRMPVLEWSTRIKIAAGAARGIAYLHEDCHPRIIHRDIKSSNILLDNNFEAKVADFGLARLALDAVTHVTTRVMGTFGYMAPEYASSGKLTERSDVFSFGVVLLELITGRKPVDASRPLGDESLVEWARPLLSRALDTGNLEGLVDHRLEKKLNQAEMFRMIEAAAACIRHSASRRPRMSQVVRVLESLADIDLTNGVQPGQSQLFNVANTAEIRMFRRMVAGAQDDDSSDLSLYGWSRGTDADPSSRIL

SEQ ID NO: 21864 - DNA, 251 bp, Panicum virgatum
  misc_feature: Ceres CLONE 1818496
  misc_feature: Encodes the peptide sequence at SEQ ID NO. 21865
gatgggctggtcacgcatgaagtcggcctgaaggagatcaacaaggccttcgacctgctcctgcaggggaagagcctcaggtgcatcatatggatggacaagtgaagtgacggcagccgctgagttcgcgattctgaataaaatcagcagtgtgtttcagtttgcatgccttactgatgtgctgttctggaggtcgtgtattatgtcattgtcattttgagaaaataaaaataaaaaacgcagtggagctc

SEQ ID NO: 21865 - protein, 34 aa, Panicum virgatum
  misc_feature: Ceres CLONE 1818496
  misc_feature: SWISSPROT Homolog: EC 1.1.1.1 Alcohol dehydrogenase
  misc_feature: Useful for making plants with modulated heat sensitivity
DGLVTHEVGLKEINKAFDLLLQGKSLRCIIWMDK

SEQ ID NO: 21866 - DNA, 1765 bp, Panicum virgatum
  misc_feature: Ceres CLONE 1818502
  misc_feature: Encodes the peptide sequence at SEQ ID NO. 21867
gaaggaagggaaagcttccgcatcgcatccttgaaaaaactgaaaagagaaggggaaaatccccaactcctccccacataaaccctaatatccttggattcgcaccagaagccccccgaatcgaagccccctccggcgctccagctgcctgcaggagttgagccgtgctcgatctggtggaaaaatccaggtttttccgcgctcagagccgcgtcggagcgcttcgggttctccggtgctcgccggcgctggatccgtgcatgttccggcgagaggtcgggtttcgcgtggggtcggttccgcttcgagctcgattcgcccgcttgagttgggtcgcggctgccgtggcggtgattgaggtagtcgcgtcgatttgacgggtgcttcttgccattttggcgagccattcgggggaccgaagggttcgccgcaaggcagcagcgtttcttgataatcctgggccatttgcgtggctgaaaggcgtgacctttgtgccgtgcgatgcaccccaaggctcgaatccacgcggaccctgtgctcgaggtcgaccagttcgactgcctgccggattcgctcgtcctgcacatcctgaacaaggtggaggacgtgcggtcgctgggccggtgcttcaccgtctcgaagcggttctgcgggcttgtctccctcgtccacgatgtgtatgtcaagattgaccgcgtcgtggcggtcgatggcgacgccgaggacacgctcaacctgtcctcgccgaagcctcggaacatcttctcgcacttcctgaagctgatgctcttcacaatcatcaagccgttccacaacatgcgcaacccgaatggtaatgggaggccactgttcgcgcagctctcacagcactccccagcccaggtgctctggaacttcacgcacatccggaatcttcgggttgagctcccctctggggatgtgggtaccgaggagggagtgctcctgaaatggcgggcagagtatgggagtacacttcagagttgcgtgattctgggcggtacccgagttgatcgcaggcctgttggtggagagcaagaaccatctttggaggataatggaagcatgccagagtctttctataccaatggtgggctgaaactccgtgtcgtctggacaatcagctctctgattgcggcatcaacgagacactatcttctccggtcaattatcaaggaccatcccacacttacaagcctggtactaactgacgccgatggccaaggcacattatgcatgggggcggaacagctgaaggagttcagggagaaccagttatcagcctcagcatgctccaacaggactcaggtcccagcctgcaacatgaagcttaagtatgccccatatctcgagctgcctggtggtatagcgttgcaaggtgctacgttggtggctatcaagccatcaactgagggaagcaatggaggccatacctgccgtaaggaaactgatgctttcatctctggagcatttgatgggccattcaaggttgctgtgaaggcgctgatgaagagacgtacttacctcctcgagatgaatggcttctaggtgtccctagttttctgggggtatctagcatggtggtgccaggcatggcacctttagttgacctttccatctgtgtaatatccaagatggcgccatctctagatctctagattgtgcctatctgctttttagctctttgtacagtggtgacgtttggctatatgaaaatcacataagttagtgtatcccttttttgctc

SEQ ID NO: 21867 - protein, 354 aa, Panicum virgatum
  misc_feature: Ceres CLONE 1818502
  misc_feature: Useful for making plants with modulated low light sensitivity
  misc_feature: Useful for making plants with modulated nitrogen use efficiency
MHPKARIHADPVLEVDQFDCLPDSLVLHILNKVEDVRSLGRCFTVSKRFCGLVSLVHDVYVKIDRVVAVDGDAEDTLNLSSPKPRNIFSHFLKLMLFTIIKPFHNMRNPNGNGRPLFAQLSQHSPAQVLWNFTHIRNLRVELPSGDVGTEEGVLLKWRAEYGSTLQSCVILGGTRVDRRPVGGEQEPSLEDNGSMPESFYTNGGLKLRVVWTISSLIAASTRHYLLRSIIKDHPTLTSLVLTDADGQGTLCMGAEQLKEFRENQLSASACSNRTQVPACNMKLKYAPYLELPGGIALQGATLVAIKPSTEGSNGGHTCRKETDAFISGAFDGPFKVAVKALMKRRTYLLEMNGF

SEQ ID NO: 21868 - DNA, 700 bp, Panicum virgatum
  misc_feature: Ceres CLONE 1818503
  misc_feature: Encodes the peptide sequence at SEQ ID NO. 21869
atctcattccgctttgagcttgcttgcagctccagctcccctcgtctcttggtggctacgccatggccaccgtagtcctgatgagctgcagcctccgcgcgccggcctgcagcggcttatctggcgtccgcgccgccccggcaccggccatcgtcgccatgcccgccgccaagcagcaggttgttggccgcggcgccaggctgcgcgcgcaggccacctacaacgtgaagctcatcacgcccgacggcgaggtagagctgcaggtgcccgacgacgtgtacatcctggaccaggccgaggaggaagggatcgacctgccctactcgtgccgcgcggggtcctgctcctcctgcgccggcaaggtcgtctccggcagcgtcgaccagtccgaccagagcttcctcgaagacgaccaggtcgccggcggctgggtgctcacctgcgccgcctaccccacctccgacgtcgtcatcgagacgcacaaggaggaggagctcacctcctcttcgtaatccgatccagtatatgcggctttcattgcttattaattatctcagctcccttgattatatatatatatatatatatatatatatatatatatatatatatatatatatatatatatatatatatatatatatatatatatatatatatagatatatatatatatatatatatatatatatatatatgt

SEQ ID NO: 21869 - protein, 149 aa, Panicum virgatum; identical to SEQ ID NO: 10105
  misc_feature: Ceres CLONE 1818503
  misc_feature (58)..(133): Pfam Name: Fer2 Pfam Description: 2Fe-2S iron-sulfur cluster binding domain

SEQ ID NO: 21870 - DNA, 714 bp, Panicum virgatum
  misc_feature: Ceres CLONE 1818506
  misc_feature: Encodes the peptide sequence at SEQ ID NO. 21871
atttccctagcccctgcgccagcacacacacccacccggcagggagagggagcccctcggcggcggagaagatggtgtcgctcaagctgcagaagcgcctcgcctccagcgtgctcaagtgcggcaagggcaaggtctggctcgaccccaatgaagtcagcgagatctccatggccaactcccgccagaatatccgcaagttggttaaggatggttttatcatcaggaagcctcagaagatccactccaggtcccgtgcaaggagggcgcatgaggccaagcagaagggacgtcattctggatatggtaagcgcaggggtacgagggaggctaggctccccaccaagattctttggatgaggaggatgcgtgttctgaggcgcctgctgtgcaagtaccgtgaagccaagaagatcgacaagcacatgtaccatgacatgtacatgaaggtcaagggtaacagtttcaagaacaagagggtgctcatggagagtatccacaagtccaaggctgagaaggctagagagaagacactctctgatcagtttgaggccaagcgcgccaagagcaaggcaagccgtgagaggaagattgccaggagggaggagaggttggcccagggccccaaagaaggcaaagaagtgaaggggttgatctgaagctttagctttctggtaccaggagtagcctaattttggagcgcctctaaactgt

SEQ ID NO: 21871 - protein, 195 aa, Panicum virgatum
  misc_feature: Ceres CLONE 1818506
  misc_feature (2)..(149): Pfam Name: Ribosomal_L19e Pfam Description: Ribosomal protein L19e
MVSLKLQKRLASSVLKCGKGKVWLDPNEVSEISMANSRQNIRKLVKDGFIIRKPQKIHSRSRARRAHEAKQKGRHSGYGKRRGTREARLPTKILWMRRMRVLRRLLCKYREAKKIDKHMYHDMYMKVKGNSFKNKRVLMESIHKSKAEKAREKTLSDQFEAKRAKSKASRERKIARREERLAQGPKEGKEVKGLI

SEQ ID NO: 21872 - DNA, 1631 bp, Panicum virgatum
  misc_feature: Ceres CLONE 1818570
  misc_feature: Encodes the peptide sequence at SEQ ID NO. 21873
atagatcgcgcgcggctcgttgacaggcacagcccagtgccatccgcttccacacctcgcagactccgccgaccgggaccacgcgcggacacccctccggtccgatctcatctccatcgagccccaggtgtagcggcgcgaggcaagggatccaatggcggcgccggaggggcagtgggtgctcatggcaacggggcggtcgccgaccaacatcgcggtgatcaagtactgggggaagcgcgacgaggccctcattctccccgtcaacgacagcatcagcgtcacgctcgaccccgaccacctctccgccaccaccaccgtcgccgtcagcccctcattcccctccgaccgcatgtggcttaacggcaaggagatctcgctgtcaggaggaaggtttcagagctgcctgagagagatcagaaagcaggcctgtgagtttgaggatgagaagaaggggatcaagatcaagaaagaggactgggagaacttgcacgtccacatagcctcctacaacaacttccccaccgctgctggtttagcctcttcggctgctggcttcgcttgtctcgttttcacccttggaaagctgatgaatgtgaaagaagattatggagaactttcatcaatagcaaggcagggatctgggagtgcatgccgcagtttatttggtggatttgtgaaatggtgtatgggaaagaaagatgatggaagtgacagtttggccgtgcagcttgctgatgaaacacattggaatgatcttgttattattattgcagtggtcagttcaaagcaaaaggaaaccagtagcaccagtgggatgcgagatagtgttgtaacgagtcccctcttgcagtacagggcccagactgtagtgccaagccgggtgttgaaaatggaagaggctattaagaatcgagactttgattcctttgccaaattaacttgtgcagatagcaaccagtttcatgctgtatgcttggacacgagccctcccatcttctatatgaatgatacatctcaccggataattagcctagtagagaagtggaaccactcacaaggaaccccacaggttgcctacaccttcgatgctgggcctaatgcggtccttattgcaccaaaccgtaaaactgcaatacttctcctccagaagctcctgtactatttccctccgcaagacaaggatttgagcagctatttggttggcgataaatcaattctaggtgatgctggattgcattccattgaagacgtagacgcccttcctgcacctccagaggtgaagataccggatcagaaattcaagggcgacgttagctacttcatctgtagcaggcttggatctggcccaaaggttattgccgatgaaaaccaagcactgatcgattcagtcaccggacttccaaaaggggtgtaattagattacgtgtttgatgcattagcctcgtgtatcggtcggctttcatgctgtcaattagacatatcctactgtaatttgtaagactgtacatcgtatcatcatgtacaatccatttggccctggtgtctgttgttgctgtaaggtgaagggcataactagctgttttcagcaagtttcgataacacgtggaataaagtctccctgttaagcc

SEQ ID NO: 21873 - protein, 420 aa, Panicum virgatum
  misc_feature: Ceres CLONE 1818570
  misc_feature (115)..(173): Pfam Name: GHMP_kinases_N Pfam Description: GHMP kinases N terminal domain
  misc_feature (247)..(340): Pfam Name: GHMP_kinases_C Pfam Description: GHMP kinases C terminal
  misc_feature: SWISSPROT Homolog: EC 4.1.1.33 Diphosphomevalonate decarboxylase
MAAPEGQWVLMATGRSPTNIAVIKYWGKRDEALILPVNDSISVTLDPDHLSATTTVAVSPSFPSDRMWLNGKEISLSGGRFQSCLREIRKQACEFEDEKKGIKIKKEDWENLHVHIASYNNFPTAAGLASSAAGFACLVFTLGKLMNVKEDYGELSSIARQGSGSACRSLFGGFVKWCMGKKDDGSDSLAVQLADETHWNDLVIIIAVVSSKQKETSSTSGMRDSVVTSPLLQYRAQTVVPSRVLKMEEAIKNRDFDSFAKLTCADSNQFHAVCLDTSPPIFYMNDTSHRIISLVEKWNHSQGTPQVAYTFDAGPNAVLIAPNRKTAILLLQKLLYYFPPQDKDLSSYLVGDKSILGDAGLHSIEDVDALPAPPEVKIPDQKFKGDVSYFICSRLGSGPKVIADENQALIDSVTGLPKGV

SEQ ID NO: 21874 - DNA, 359 bp, Panicum virgatum
  misc_feature: Ceres CLONE 1818580
  misc_feature: Encodes the peptide sequence at SEQ ID NO. 21875
ggccactccaacgtctggaactcccaccccaagaactacgggcccggctcccgcgtctgccgggtctgtgctaacccccatggattgatcaggaagtatgggctcatgtgctgcaggcagtacttccccagcaacgccaaggacattggcttcatcaagtaccgctaaaggcattgccttgctggcgtccagaacttcacctgggttgaaaagaaatggatccctcaatagaaggctcaacttatgtgcattagattttcgttcagacttgagactgctagtaaactacttgttaaagttttgatgggtactatatgcctgttaaactaattataattaagtgattggagtattttgtc

SEQ ID NO: 21875 - protein, 55 aa, Panicum virgatum
  misc_feature: Ceres CLONE 1818580
  misc_feature (2)..(55): Pfam Name: Ribosomal_S14 Pfam Description: Ribosomal protein S14p/S29e
  misc_feature: Useful for making plants with modulated nitrogen use efficiency
GHSNVWNSHPKNYGPGSRVCRVCANPHGLIRKYGLMCCRQYFPSNAKDIGFIKYR

SEQ ID NO: 21876 - DNA, 354 bp, Panicum virgatum
  misc_feature: Ceres CLONE 1818597
  misc_feature: Encodes the peptide sequence at SEQ ID NO. 21877
cttttgccgctcgcgtcccctctcgccctcccgcctcccccagctcgcctcagccgcagctgctgcctcaagaccccgccctgcccgccgcggactacaaaccccctgacggagacatggggcgtatgcgcaggggcgtgaagggtctatcttcgtgggcgctgccggaagataatactcccccaacttggctcaagactgccgcctccgatgtgcaggaaatgatcacctacgccgcggagaatggccagatgccatcacgaattggcgtcctcctgcgtgaccagcacggtatcgctctagtcaatagcgtcactggcaatgagattctccgcgtcctcgacgctactgggc

SEQ ID NO: 21877 - protein, 79 aa, Panicum virgatum
  misc_feature: Ceres CLONE 1818597
  misc_feature (1)..(60): Pfam Name: Ribosomal_S13_N Pfam Description: Ribosomal S13/S15 N-terminal domain
  misc_feature: Useful for making plants with modulated nitrogen use efficiency
MGRMRRGVKGLSSWALPEDNTPPTWLKTAASDVQEMITYAAENGQMPSRIGVLLRDQHGIALVNSVTGNEILRVLDATG

SEQ ID NO: 21878 - DNA, 2246 bp, Panicum virgatum
  misc_feature: Ceres CLONE 1818599
  misc_feature: Encodes the peptide sequence at SEQ ID NO. 21879
atttcgaaattacgtcgaacaccttgtaggcagcaggaaccctgtcctctcatgtcggccccctgacacccaccggcgatcacgcaccggcggcggcacggcaagatgcttccccgcgcgcggcgcctacacccagccctccgccgccttctcctcctaaccacccctgcaccctcacatgctccaccgcgccgacctcaccaccccgccgccgcccaaacctctaaaccctccccaatccccttccgccgccacctctgttccccgccgccgccggcaccgcagcctccagcggtggtctcctctgacctcccagccgtcagcgccaaatctgtctgcccgggatgcggcatcaccatgcagtcctcggaccccgccctaccggggttcttctcgctcccctcccccaaatccccggactaccgcgcgcgcctcgcgccaatcactgccgacgacacccggatttccgcctcccttaagtccggtcagctccgggagggattagagccctcgcggggcgccgagccggccgcggcggcgactgagacggcggaggccaagggagagggcaaggtgttggtgtgcgcgcggtgccactcgctgcggcactacggccgcgtcaagcaccccgacgccgagcgcctcctcccggattttgatttcgtcgcagccgtcggcccgcgcctcgcgtcgccgtcgggggccaggtcgctcgtgctactcctagcggacgcctcggacttcgacggctccttcccgcgggccgtcgcgcgtctggtggccgccgccggcgaggcacacagcgcggactggaagcacggggcgccggctaacctcccgcgcgcgctgctcgtggtcaccaagctcgacctgctcccaacgccgtctctgtcccccgacgacgtgcacgcgtgggctcactcccgcgctcgcgccggtgcgggtgccgatttgcggctcgccggggtgcacctggttagcgccgcgcgcgggtggggcgtgcgcgacctgctcgaccatgtgcgcgacctcgccggggcgcgcgggaatgtctgggccgtcggcgcgcggaacgttggcaagtcgacgctgctcaatgcgattgccaggtgctctggcatagtcgggcgacccaccttgacggaggcaccagttcctggaacaacccttgatgtgattaaggtggacggcgttcttggagctcaagcaaagctgttcgacacaccaggacttctccatgggcatcaattgacatccagactgacaagcgaggagatgaagctggttcaagtgagaaaggagatgcgccccaggacctacagagtaaagacaggacagtctatacatattggtggattggtgcgcctggacattgaagagttaactgtaggatcaatctacgttacagtatgggcatcaccacttgtcccacttcacatgggaaagacagaaaatgcagcaacgatgataaaagaacactttggcttacaactacagcctcccataggccagggtcgggtaaaggagctcggtaaatgggtgaggaaacagttcaatgtttctgggaacagttgggatatgaactctaaggatatagccattgctggtcttggctggtttggagttggactgaaaggagaggcagtgctgggattatggacatatgatggtgttgatgtcgtctccaggagctccctagtccatgagagggcttcagtttttgaggaagctggtttcacagtttcacagattgtctctcaggcagatagcatgaccaataaactgaagggcaccaagaagacaaacaagaaaaaagagaacaagatgagtacttcacccatcacagctccagaaactgcaaaatctgcttccaccatagatgcttgagtgttttcatgcagtcttgtgaccggagtactgcttcggtggccatgttctaggtgactggagtattgctttggtgatcatgttctagcccacaatgttctgctttggccctagaagctgtaactcaattcagaagcatacataggctttgacccacaatgttcttcagaaggagcttgtgtccgttgaaggtttcctggtagggaactgggttttctaacgccttaaattttgaaccttcacttatttgtttggatggtaagacctatctggagagtcagtcagtcatttaggagtactccatatgacatgtttgtgaacttataatagttcaacacgagtacttgtgttccaggttt

SEQ ID NO: 21879 - protein, 509 aa, Panicum virgatum
  misc_feature: Ceres CLONE 1818599
  misc_feature (230)..(322): Pfam Name: MMR_HSR1 Pfam Description: GTPase of unknown function
  misc_feature: SWISSPROT Homolog: EC 1.14.13.39 Nitric-oxide synthase
MQSSDPALPGFFSLPSPKSPDYRARLAPITADDTRISASLKSGQLREGLEPSRGAEPAAAATETAEAKGEGKVLVCARCHSLRHYGRVKHPDAERLLPDFDFVAAVGPRLASPSGARSLVLLLADASDFDGSFPRAVARLVAAAGEAHSADWKHGAPANLPRALLVVTKLDLLPTPSLSPDDVHAWAHSRARAGAGADLRLAGVHLVSAARGWGVRDLLDHVRDLAGARGNVWAVGARNVGKSTLLNAIARCSGIVGRPTLTEAPVPGTTLDVIKVDGVLGAQAKLFDTPGLLHGHQLTSRLTSEEMKLVQVRKEMRPRTYRVKTGQSIHIGGLVRLDIEELTVGSIYVTVWASPLVPLHMGKTENAATMIKEHFGLQLQPPIGQGRVKELGKWVRKQFNVSGNSWDMNSKDIAIAGLGWFGVGLKGEAVLGLWTYDGVDVVSRSSLVHERASVFEEAGFTVSQIVSQADSMTNKLKGTKKTNKKKENKMSTSPITAPETAKSASTIDA

SEQ ID NO: 21880 - DNA, 643 bp, Panicum virgatum
  misc_feature: Ceres CLONE 1818600
  misc_feature: Encodes the peptide sequence at SEQ ID NO. 21881
cagagagggcgcgcacgggcgggctaagctcggcggagcgtgatggcggggaacgactggatcaatagctacctggaggcaatccccgcctccgccgcccgccgcaggctcatcatgagcaagcccgtcttcgccgcccacagcgccgtcgcgggcatggacgccgtcgagcgcttgaagagcgggttcgagcagttcaagacccaggtctatgacaagaagccggagctgttcgagccgctcaaggccggccaatcccccaggtacatggttttcgcctgcgccgactcccgctgctgcccgtcggtgaccctgagcctgcagcccggcgaggccttcaccatgcgcaacatcgccgccatggtcccgccctacgacaagaacaagtacgccggcatcggggccgccatcgagtacgccgtctgcgcgctcaaggtggaggtcctcaccgtcattggccacagccgctgcggtggcatcaaggcgctcctctccctccaggacggcgcagccgacaccttccacttcgtcgaggactgggtcaggatcggcttccaggccaagaagaaggtgctgaaagagcacccccatgctccgttcgatgaccagtgctccatcttggagaaggaggccgtgaacgtgt

SEQ ID NO: 21881 - protein, 200 aa, Panicum virgatum
  misc_feature: Ceres CLONE 1818600
  misc_feature (68)..(200): Pfam Name: Pro_CA Pfam Description: Carbonic anhydrase
  misc_feature: SWISSPROT Homolog: EC 4.2.1.1 Carbonate dehydratase
MAGNDWINSYLEAIPASAARRRLIMSKPVFAAHSAVAGMDAVERLKSGFEQFKTQVYDKKPELFEPLKAGQSPRYMVFACADSRCCPSVTLSLQPGEAFTMRNIAAMVPPYDKNKYAGIGAAIEYAVCALKVEVLTVIGHSRCGGIKALLSLQDGAADTFHFVEDWVRIGFQAKKKVLKEHPHAPFDDQCSILEKEAVNV

SEQ ID NO: 21882 - DNA, 672 bp, Panicum virgatum
  misc_feature: Ceres CLONE 1818625
  misc_feature: Encodes the peptide sequence at SEQ ID NO. 21883
agctccggcgaattcaattcgagcatcgcatcgcatcgcatgctgtctctgcgtgcgcctgcgcctgttcttcgccgccgcctcctctctatatcatcgccctctccgggcagaatcggcatcggcagcagcagcagcagcagcagcagcagcttcggcagaggagaagtgaagcgcggccgcatttctagcgcggcggctccgtcggacatggcgaccgacagcggctgcgccctgaagaagctggccccgctggaagccatcctgttcgacatcgacggcaccctctgcgactccgaccccatccacttctgcgccttccgcgagctcctgcagcagatcggtttcaacgacggtgtccccatcaccgaggagttctacagcgccaacatcagcggcgggcacaacgacgacctagcccggtccctgttcccggacatggatcacgagaaagctttgcagttcatggatgacaaggaggcgttcttcagaaagttggcaccaggacagttgaaggccgtggatgggctgcacgacctgtgcagatggatcgaagaccgcaacctcaagcgcgctgcggtgacgaacgctccgagggcaaacgccgagcttatgctgtcactgctggggctcaccgacttcttcccggtgctcgtcatcggaagcgagtgc

SEQ ID NO: 21883 - protein, 153 aa, Panicum virgatum
  misc_feature: Ceres CLONE 1818625
  misc_feature: SWISSPROT Homolog: EC 3.1.3.18 Phosphoglycolate phosphatase
MATDSGCALKKLAPLEAILFDIDGTLCDSDPIHFCAFRELLQQIGFNDGVPITEEFYSANISGGHNDDLARSLFPDMDHEKALQFMDDKEAFFRKLAPGQLKAVDGLHDLCRWIEDRNLKRAAVTNAPRANAELMLSLLGLTDFFPVLVIGSE

SEQ ID NO: 21884 - DNA, 1925 bp, Panicum virgatum
  misc_feature: Ceres CLONE 1818637
  misc_feature: Encodes the peptide sequence at SEQ ID NO. 21885
aacgccactgagaaatccgcttgcataacgagcacagtgagacagagtagtagagcgatctttgtcttccatggcgaccgcgtctgaggaagttgcacccgccgtcgccgttgacgaggcgccggcgccggagaaggtggctgaggtgacggaggcggccgctgtggagacgccggagaaggtggaggaggcgccgaaacctgcggaggacgaggcgaagaaggcagaggaaggggaggagaagaaggcagaggaggggaagaagaaggcgaggaagccgcggagcaggaagcccaggtccgccgggccgcaccacccgccctacttcgagatgatcaaggaggcgatcctgtcgcaggacagcaaggcgggggcgagcccgtacgcgatcgccaagcacatgggggagaagcaccgggacgtgctcccggccaactaccgcaagatgctggccgtgcagctgcgcaacttcgccgccaagggccgcctcgtcaaggtcaaggcctccttcgggctcgccgcggccgaggagaagaaggccgcctccgtcgcgaaggcgaaggcgccggtgccggcggcagcggctcccaagcgcaagagggcggctgcctccgccgcgcccgccaagaagaagaagccggcggcccccgcggaggcgaagaaggcgcgcgcgaagcgggcgaggaaggcggccccggcgcagccgaagccgaagcagcggcagcagaccaggcccgtccgcgccgccgtcgccaagaaggccgccgccaacaaggccagcgcctgatgaaccgccgccgccagctctttgtttcgttttggtcccgtacgcgcgcccccgtgtacgcgcgtgatcgcgtgttgtattgtaaataccgaaacccagcggggtgtgatgccaataagcgcgcgcttggagcttctgctggtggtaaaaaaaaatctcaagccagctgcaagtctcactcctaatcctaaaccacaagacacctcagtgttagcagtgcaatggcgaccagcaccatggccctctcctctacggccttcgccggcaaggccgtcaacgtgccatcgtctctcttcggcgaggcccgcgtgaccatgcgcaagaccgcggcgaagcccaagccggccgcctccggcagcccgtggtacggcccagaccgcgtgctctacctcggcccgctctccggcgagcccccgagctacctgaccggcgagttccctggcgactacggctgggacaccgccgggctctcggccgaccccgagaccttcgccaagaaccgggagctggaggtcatccactcccgctgggccatgctcggcgcgctaggctgcgtcttccccgagctgctcgcccgcaacggcgtcaagttcggcgaggccgtctggttcaaggcgggttcccagatcttcagcgagggcgggcttgactacctcggcaacccaagcctgatccacgcgcagagcatcctcgccatctgggcctgccaggtcgtgctcatgggcgccgtcgaggggtaccgcatcgccggcggcccgctcggcgaggtcgtcgacccgctctaccccggcggcagcttcgacccgctcggcctcgccgacgaccccgaggccttcgccgagctcaaggtcaaggagctcaagaacggccgcctcgccatgttctccatgttcggcttcttcgtgcaggccatcgtcaccggcaagggcccgctcgagaacctcgccgaccatctcgccgaccccgtcaacaacaacgcctgggcctacgccaccaacttcgtgcccggcaagtgaggcgtctgttcccgaactgttcgatttgtaggaggtccggatgtgagcgcgcattggtttcagtttgtgccatgatgtaaattattggggtccatccaaccgagaactgtgttcgttgtctc

SEQ ID NO: 21885 - protein, 264 aa, Panicum virgatum
  misc_feature: Ceres CLONE 1818637
  misc_feature (63)..(231): Pfam Name: Chloroa_b-bind Pfam Description: Chlorophyll A-B binding protein
MATSTMALSSTAFAGKAVNVPSSLFGEARVTMRKTAAKPKPAASGSPWYGPDRVLYLGPLSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGAVEGYRIAGGPLGEVVDPLYPGGSFDPLGLADDPEAFAELKVKELKNGRLAMFSMFGFFVQAIVTGKGPLENLADHLADPVNNNAWAYATNFVPGK

SEQ ID NO: 21886 - DNA, 1296 bp, Panicum virgatum
  misc_feature: Ceres CLONE 1818642
  misc_feature: Encodes the peptide sequence at SEQ ID NO. 21887
ctaaccctagatcccccaccatggatctcctccagtcctcgtacgcgccggacgacgcctcctcgccggaggagtcggcggccgcttcctcgccggactcctccccgctccgcctcccctccaagtccgccgcccccgccgtcgacgacaccgcgctcgcgctctccgccgccgcctccgcctcccgcccgctcgacccctcgctccatctcgtcgccttcaaccccaccgccgaccagctctgggcgcccatcgtcgggccccagcacccccacgcccccatctcctccgcctccggcaaccgcaaccacaagctcggccacgtcgaggacgccgcggtgctgcccttcctcttcgacgagcagtacaacaccttccacaggttcggctacgccgccgatccctccggcctccacatcgttggcgacgcgcagccgcaggcgcccgagcccgacaccgtctacaacctcgccccctccgagcacaagcgccgccgcctcctggccaaggcggacaaccaggacgagacgctgccccccgaggccaaaaaccccgcatccgaggagtggatcctccacaacaagcagagcccctgggcgggcaagaaggaagcgccgcccgctgagctcaccgaggagcagaagcagtatgccgaggcccacgcagccaagaaggccgagaaggaggctcgcggcgaagggaagggcgagagggcagaggtcgtggtcaagagcaccttccacgggaaggaggagagagactaccagggacggtcctggatcacgccgcccaaggatgccaaggccaccaacgaccactgctacattcccaagaggtgtgtgtatgagtgggttgggcacaccaagggggtttcagccatcagattcttccccaagtatgagcatctgctactatctgcgagtatggattgtaagattaagatctgggacgtgctcgggtcgcggacatgtatgcgcacatatatgggtcactcaaaggccgtaagggatatatccttctccaatgatgggaccaaattcttgagtgctgggtatgacaggaatatacagtactgggatactgagacagggcaggtgatctcgaccttctcaactgggaaggtcccatatgttgtgaagctgaatcctgatgaggataaacagcatattctccttgctggaatgagcgacaagaagattgtgcaatgggatatgaaatcagggcagatcacgcaagagtatgatcagcatttaggggctgtgaacaccataacttttgtcgataacaacaggaggt

SEQ ID NO: 21887 - protein, 425 aa, Panicum virgatum
  misc_feature: Ceres CLONE 1818642
  misc_feature (271)..(310): Pfam Name: WD40 Pfam Description: WD domain, G-beta repeat
  misc_feature (315)..(353): Pfam Name: WD40 Pfam Description: WD domain, G-beta repeat
  misc_feature: SWISSPROT Homolog: EC 2.7.11.7 [Myosin heavy-chain] kinase
MDLLQSSYAPDDASSPEESAAASSPDSSPLRLPSKSAAPAVDDTALALSAAASASRPLDPSLHLVAFNPTADQLWAPIVGPQHPHAPISSASGNRNHKLGHVEDAAVLPFLFDEQYNTFHRFGYAADPSGLHIVGDAQPQAPEPDTVYNLAPSEHKRRRLLAKADNQDETLPPEAKNPASEEWILHNKQSPWAGKKEAPPAELTEEQKQYAEAHAAKKAEKEARGEGKGERAEVVVKSTFHGKEERDYQGRSWITPPKDAKATNDHCYIPKRCVYEWVGHTKGVSAIRFFPKYEHLLLSASMDCKIKIWDVLGSRTCMRTYMGHSKAVRDISFSNDGTKFLSAGYDRNIQYWDTETGQVISTFSTGKVPYVVKLNPDEDKQHILLAGMSDKKIVQWDMKSGQITQEYDQHLGAVNTITFVDNNRR

SEQ ID NO: 21888 - DNA, 760 bp, Panicum virgatum
  misc_feature: Ceres CLONE 1818642-R
  misc_feature: Encodes the peptide sequence at SEQ ID NO. 21889
tctgggagtttggcatccctgtggtgatcaagtatataagtgaggcgcacatgcactcaatgccatcaattgccctgcacccaaactccaactggctggcagcacagagcttggacaatcaaatactgatatacagcaccaaggagaggttccagctcaataagaagaagcaatttgctggccacattgtagcaggttatgcttgtcaggtgaacttctcacctgatgggagatttgtgatgtcaagtgatggtgaaggtagttgctggttctgggattggaaaagctgcaggaggtttaagacattgaagtgccacaatggggtttgcattggatgcgagtggcatccgttggaaactagcaaggttgcgacatgcggatgggatggtgtaattaaatactgggattgagctgggacagggaccgcttgagatgctcgaagttcacaacagtgcaatcctcaagggctaatcttcatggtatactgtaagttgacatgtgggatggagcaaaaaaaaagaaatgccacacatttcagccaccggctagttctttttgcccttgcaaggatgtgatgtatcatacatgtggcagcaactcgattttttgaactgtaccttggccgccagtaacttgtgttgttttcagtttccgttcatcttgttgaatcctacttttttgtagtccctgagctgagaagcagacttgtatactaaagagtattaatacacttggggtggtgtccccctcttgcttgcgc

SEQ ID NO: 21889 - protein, 135 aa, Panicum virgatum
  misc_feature: Ceres CLONE 1818642-R
  misc_feature (96)..(135): Pfam Name: WD40 Pfam Description: WD domain, G-beta repeat
  misc_feature: SWISSPROT Homolog: EC 2.3.1.48 Histone acetyltransferase
WEFGIPVVIKYISEAHMHSMPSIALHPNSNWLAAQSLDNQILIYSTKERFQLNKKKQFAGHIVAGYACQVNFSPDGRFVMSSDGEGSCWFWDWKSCRRFKTLKCHNGVCIGCEWHPLETSKVATCGWDGVIKYWD

SEQ ID NO: 21890 - DNA, 433 bp, Panicum virgatum
  misc_feature: Ceres CLONE 1818660
  misc_feature: Encodes the peptide sequence at SEQ ID NO. 21891
gttcctctctcattttccgttgtcgcgcgctcccgccgcgaccaacccccaaacttccccttttcttccaagtctagcctctccaaggcttcctgatccggctgggaccgcaagaaaggagcttggaaggatggcgtcggttaccagagctgtctgccccctgcagataccgcgcttaaaggggaggaaggcccccgcccggcgccgatcgatcgcggcaccgaaggccaagaacacgaaaagaggggtcatccgctcaatatcagtctcaggatccgtctcaggccgcggccagcattgcgcgcctgccgacgccgtcccccaccccgctgatattacaggcactactatggtgtgccccttcggcaagggcaagaccgagcgcaatcggggcatgaatgatctactgggcgggaaaggcgctcacctgcca

SEQ ID NO: 21891 - protein, 100 aa, Panicum virgatum
  misc_feature: Ceres CLONE 1818660
  misc_feature: SWISSPROT Homolog: EC 2.7.9.1 Pyruvate, phosphate dikinase
MASVTRAVCPLQIPRLKGRKAPARRRSIAAPKAKNTKRGVIRSISVSGSVSGRGQHCAPADAVPHPADITGTTMVCPFGKGKTERNRGMNDLLGGKGAHL

SEQ ID NO: 21892 - DNA, 1679 bp, Panicum virgatum
  misc_feature: Ceres CLONE 1818661
  misc_feature: Encodes the peptide sequence at SEQ ID NO. 21893
gcgagctgctcctgctcctcctcttcttccctcctccactcgcctccaaattttccctctcttcctcggcagaaccacaccccctccctccctctctctctatctctctccggtgcgcggctgaagtgaaggtcaggtcaggaccatgcaggcggcggcggtgaatggcgggggcgacgtgcagaagcctcagcagcagccgcagccggtggtggtgggggcgccgcatccgccggcggcggccgtggtgccgccccattgggtggccatgccgttcacgccgccgccaggggccgcggccatggtgatgccgccgcaccagatggcgccggcgccgccccagttcgcgcccgcgcacttcgtcccgttccacgccgtcgcgccgccgccgccgccgccgtcgcgggcggcgcccatggccgccgtcgccctgggctcccccgcgccgcatcaggccgggcaggaggagaacaagaccatctgggtcggcgacctccattactggatggacgagaactacctccacagctgcttcggctacaccggcgaggttgtggccattaaagttattcgcaataagcagactggacagtctgaaggatatggatttgttgagttctacagccatgctgcagctgaaaaagttcttgaaggcttttctggtcatataatgccaaatactgaccaaccttttaggttaaattgggcatcgtttagcatgggagataggcgctcggatgttgcttcagatcattccatattcgtaggcgatcttgcttctgatgtcaatgatgccacacttctggagactttctccagcaggtactcctctgtcaaaggtgccaaagttgttattgatgctaacactggcagatccaagggctatggtttcgtgagatttggagatgacagtgagaagacacatgccatgactgagatgaatggtgtatattgctcttctaggcccatgagaattggccctgcaactcccagaaaatcatcaggtacttctggatcaaatggttcatctgctcgttcagatggaggagacttgacgaacacaaccgtatttgtcggcgggcttgacccaaatgttagtgaagaggaccttaggcagaccttctcccagtatggcgaaatatcttccgtaaagattccagtcggtaaacaatgcggcttcgtgcaatttgctcagagaaagaatgcagaggatgcattgcaaggactaaacggaagcaccattggcaagcagaccgtgcgcctttcatggggccgcaacccggcaaacaagcagtttaggggcgacaacgggaaccagtggagtaacgggatgtactacgcggcgtccccgttctacaacggctacggctaccctgcggcgccgttccctgaccccggcatgtacgccgctccggcctacggcgcctacccgttctacggcaaccagcaacaggtgagctgagccgctcgatctgaactgagctgccggcgcgtcccggccgaagctggagctggaggtattaggctgttaggtgtagcaaagctcatggtagaagaagatgaagaagaaggtagacgacgacggtttcttaggtgagctagatgcggtgacttttttttttgaaaagggaaattttattgatttcaagcacaatacatcaaggtgatacatcgtcttg

SEQ ID NO: 21893 - protein, 438 aa, Panicum virgatum
  misc_feature: Ceres CLONE 1818661
  misc_feature (308)..(373): Pfam Name: RRM_1 Pfam Description: RNA recognition motif. (a.k.a. RRM, RBD, or RNP domain)
  misc_feature (205)..(277): Pfam Name: RRM_1 Pfam Description: RNA recognition motif. (a.k.a. RRM, RBD, or RNP domain)
  misc_feature (112)..(183): Pfam Name: RRM_1 Pfam Description: RNA recognition motif. (a.k.a. RRM, RBD, or RNP domain)
  misc_feature: The sequence is a functional homolog of SEQ ID NO 536 in the 10/666,642 US patent application
  misc_feature: The sequence is a functional homolog of SEQ ID NO 252 in the 10/714,887 US patent application
  misc_feature: The sequence is a functional homolog of SEQ ID NO 252 in the 11/435,388 US patent application
  misc_feature: The sequence is a functional homolog of SEQ ID NO 568 in the 10/666,642 US patent application
  misc_feature: The sequence is a functional homolog of SEQ ID NO 1484 in the 10/666,642 US patent application
  misc_feature: The sequence is a functional homolog of SEQ ID NO 278 in the 10/714,887 US patent application
  misc_feature: The sequence is a functional homolog of SEQ ID NO 278 in the 11/435,388 US patent application
MQAAAVNGGGDVQKPQQQPQPVVVGAPHPPAAAVVPPHWVAMPFTPPPGAAAMVMPPHQMAPAPPQFAPAHFVPFHAVAPPPPPPSRAAPMAAVALGSPAPHQAGQEENKTIWVGDLHYWMDENYLHSCFGYTGEVVAIKVIRNKQTGQSEGYGFVEFYSHAAAEKVLEGFSGHIMPNTDQPFRLNWASFSMGDRRSDVASDHSIFVGDLASDVNDATLLETFSSRYSSVKGAKVVIDANTGRSKGYGFVRFGDDSEKTHAMTEMNGVYCSSRPMRIGPATPRKSSGTSGSNGSSARSDGGDLTNTTVFVGGLDPNVSEEDLRQTFSQYGEISSVKIPVGKQCGFVQFAQRKNAEDALQGLNGSTIGKQTVRLSWGRNPANKQFRGDNGNQWSNGMYYAASPFYNGYGYPAAPFPDPGMYAAPAYGAYPFYGNQQQVS

SEQ ID NO: 21894 - DNA, 542 bp, Panicum virgatum
  misc_feature: Ceres CLONE 1818663
  misc_feature: Encodes the peptide sequence at SEQ ID NO. 21895
ccaattaccagagctcgctgccatcatggttgacttgaggcgcgcgcgcgctccactcgccgccggcgtcttcctcgccgtcttggccggcgtcgcggtgctcggcgccggcgaggagcagttcgtgttctcgggcttccccggcgcgccgctgatcctggacggcacggccgtcatcacgccgacggggatgctggagctgaccaacggcacggcgcagctcaagggccacgcggtgtacccgacgccgctgccgttccggcggtcccccggcgggcccgtgcgctccttctcggcgtccttcgttttcggcatcatcccgccctacgccgacctcagcggccacggcatcgtcttcttcgccggcaacaccagcagcttctccactgcgctgcccagccagtacctcggcttcctcaacccctccaacaatggcaacgccagcaaccacatcttcggcgtcgagctcgacaccatcccgagcaccgagttcaaggatccccacgacaaccacgtcggcatcgacatcaacagcctcacct

SEQ ID NO: 21895 - protein, 172 aa, Panicum virgatum
  misc_feature: Ceres CLONE 1818663
  misc_feature (29)..(172): Pfam Name: Lectin_legB Pfam Description: Legume lectin domain
MVDLRRARAPLAAGVFLAVLAGVAVLGAGEEQFVFSGFPGAPLILDGTAVITPTGMLELTNGTAQLKGHAVYPTPLPFRRSPGGPVRSFSASFVFGIIPPYADLSGHGIVFFAGNTSSFSTALPSQYLGFLNPSNNGNASNHIFGVELDTIPSTEFKDPHDNHVGIDINSLT

SEQ ID NO: 21896 - DNA, 608 bp, Panicum virgatum
  misc_feature: Ceres CLONE 1818675
  misc_feature: Encodes the peptide sequence at SEQ ID NO. 21897
aagaacctcccactctactccaccccgcacccaccgcatgcgagaggtgagagccagcagccaagaagcagcagcagcagccatggtggcgcatcgccgggatgcctaggcggagctgaacctgcccccggggttccgcttccaccccaccgacgaggagttggtggcgcactatctctgcgctcgcgccgcctggcgcggcccgccggtgcctatcatcgccgaggtcgacctctacctcttccacccctgggacctcccccagcgcgccctcttcggtcgccgtgagtggtacttcttcacgcccagggaccgcaagtaccccaacggctcccgccccaaccgcgccgccgggacgggctactgtaaggccaccggcgccgacaagcccgtccaccacgccggccgcaccctcgggatcaagaaggcgctcgtcttctaccacggcaagccgccgctcggggtcaagaccgagtggatcatgcacgactaccgcctcgccgacgccggcgccaagaagcccggcaacggctcgctcaggctggacgactgggtgctgtgccgcctgtacaactagaataactattgggagaagatgcttcatcata

SEQ ID NO: 21897 - protein, 31 aa, Panicum virgatum
  misc_feature: Ceres CLONE 1818675
  misc_feature: The sequence is a functional homolog of SEQ ID NO 891 in the 10/374,780 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 890 in the 10/374,780 US patent application
  misc_feature: The sequence is a functional homolog of SEQ ID NO 853 in the 10/374,780 US patent application
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: Useful for making plants with altered terpenoid content
  misc_feature: Useful for making plants with modulated oxidative stress sensitivity
  misc_feature: Useful for making plants with modulated water use efficiency
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: Useful for making plants with modulated light quality response
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: Useful for making plants with altered cell wall content and/or composition
  misc_feature: Useful for making plants with altered lignin content
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: The sequence is a functional homolog of SEQ ID NO 851 in the 10/374,780 US patent application
MHDYRLADAGAKKPGNGSLRLDDWVLCRLYN

SEQ ID NO: 21898 - DNA, 1452 bp, Panicum virgatum
  misc_feature: Ceres CLONE 1818691
  misc_feature: Encodes the peptide sequence at SEQ ID NO. 21899
ggtaacccaaaaattcagaagaactctaattcagaaaaaccgaagaaattactgaagtatgagtggggagctgaagagggactacgagatcggcgaggagatcggtcgcggccgcttcggggtggtccaccggtgcacgtcccgcgccaccggcgaggccttcgccgtcaagtccgtggaccgttcgcagctggccgacgacctcgaccgcgagctcgcgcagctggagccgaagctggcccagctcgccagcgcgggcaaccccggcgtggtgcaggtgcacgcggtgtacgaggacgaggcgtggacgcacacggtgatggacctgtgcacgggcccggacctgctcgactggatgggcctccgccgcggcgagccggtgccggagcccgtggcggccgccatcgtggcgcagctcgcccaggcgctggcgctgtgccaccgccgcggggtggcgcaccgcgacgtcaagcccgacaacatcctcatcgacgccgccgccgaggaggacgaggaggaggaggacggccgcggggcggcgccgcgcgcgcgcctggcggacttcgggtccgcggcgtgggtgggcgcggggggcctgggccgcgcggaggggctggtggggacgccccactacgtggcccccgaggtggtggccggcggcgagtacggcgccaaggccgacgtgtggagcgccggggtggtgatgtacgcgctgctgtccggcggcgcgctccccttcgtcggcgagagcgccgcggaggtgctggcggccgtgatgcgcggcagcgtgcggttcccgcccaggctgttcggcggcgtgtccccggcggccaaggacctgatgcggcgcatgatctgccgcgacgagtggaggaggttcaccgccgagcaggtcctcggtgagtagtctgcttccgccctccccttctcctcgattcgcgcttgtttcgcgtcgattccgaatccgatccggcgatctaaatctctaacaagtctgccgttaatgcagctcacccgtggatcgtgaccggcggcggagcccgggcaatggagcagccgacctgaggagacatacccccccaccggcggaccatggccagcgggcgggcgtgtatcgccgtacagataagatacggcgacgaataccgacgttgtgtatacggttttgtacgtacggactacggagcagggatgtacgctgccgccggctgcagagtagcatcgcgtcccggtgccgccgcagcagagcaggtcgatcggcgacgaagcttccaggcttctggttctcttcgcccggtttttgggatgctcttttgcctaacagagcgcccttccggttttcggctctttttttttttgaagtactttagtagctgggtgtatatacactgaccgtcttgtataaatggaagcttgaataataaacggagccggccctcgcgctccctttcc

SEQ ID NO: 21899 - protein, 282 aa, Panicum virgatum
  misc_feature: Ceres CLONE 1818691
  misc_feature (9)..(282): Pfam Name: Pkinase Pfam Description: Protein kinase domain
  misc_feature: SWISSPROT Homolog: EC 2.7.11.1 Non-specific serine/threonine protein kinase
MSGELKRDYEIGEEIGRGRFGVVHRCTSRATGEAFAVKSVDRSQLADDLDRELAQLEPKLAQLASAGNPGVVQVHAVYEDEAWTHTVMDLCTGPDLLDWMGLRRGEPVPEPVAAAIVAQLAQALALCHRRGVAHRDVKPDNILIDAAAEEDEEEEDGRGAAPRARLADFGSAAWVGAGGLGRAEGLVGTPHYVAPEVVAGGEYGAKADVWSAGVVMYALLSGGALPFVGESAAEVLAAVMRGSVRFPPRLFGGVSPAAKDLMRRMICRDEWRRFTAEQVLGE

SEQ ID NO: 21900 - DNA, 633 bp, Panicum virgatum
  misc_feature: Ceres CLONE 1818705
  misc_feature: Encodes the peptide sequence at SEQ ID NO. 21901
acaaaatcccccacccaaaacccacgtcaggagcgagccagcgcagccaggagcagcaaaccggccgccccctcctccccccgcccgccgcttcgcccccatggagccggtgccgccggcgacggccgccgacatggggggccccgggcccgggcccgggtaccccgagtccacggagtcctccccccgcagccgcggcggggactcgtgggacgagccctccccgtcctccgcggcggccgcggccgccgcggccggcggcgggggccggctccgcctgatgtgcagcttccggggccggatcgtcccgcgcccgacggacaagtccctctgctacctgagcggggagacccggatcgtggacgtcgaccgccacgcctcgctcgccgacgtccacgcgcgcctctcgcggtcgctgctcggcggccagcccttcacgctcaattaccacctccccaacgaggacctcgactcgctcatctccgtctccaccgaccaggacctcgacaacctcgacgacgagtacgaccgcatcgccgcctcctcctccggcggcggatcctcacgcacctcgcggatcctgctattcctcttccccgccaagcccgagtcctcctcctcccttcgctccct

SEQ ID NO: 21901 - protein, 177 aa, Panicum virgatum
  misc_feature: Ceres CLONE 1818705
  misc_feature (72)..(167): Pfam Name: PB1 Pfam Description: PB1 domain
MEPVPPATAADMGGPGPGPGYPESTESSPRSRGGDSWDEPSPSSAAAAAAAAGGGGRLRLMCSFRGRIVPRPTDKSLCYLSGETRIVDVDRHASLADVHARLSRSLLGGQPFTLNYHLPNEDLDSLISVSTDQDLDNLDDEYDRIAASSSGGGSSRTSRILLFLFPAKPESSSSLRS

SEQ ID NO: 21902 - DNA, 1834 bp, Panicum virgatum
  misc_feature: Ceres CLONE 1818719
  misc_feature: Encodes the peptide sequence at SEQ ID NO. 21903
aaatccgttcgacaccattgctggagctcacagggtgccatggaagcagcatcagatgaggagaggccactgattcctcatctgccctcacaggatgaagaaggttcgctttatactagcgatggaacggttgatgttaacaatcagcctgctctgaagcgaaccacggggaactggagagcgtgcttcttgatcttaggcaccgaattcgtcgagtgctttgtcttcttcggagtcgcaaagaacctggtcaccttcctcacgggtgaactccacgagagcaatgtcgatgccgcgaagagtgtgtctacctggatcggcacttgcttcttcacaccagtcatcggagccttcttggccgacacctactggggaaaatactggacactagtaatcttcctctccatctacaccattggtatgctaacactgacaatctcagcatcactacccctgcttatggacacaccacacaacaatggcattcgtcatttcacggtgtacctggggctctaccttgtcgcccttggcgaaggtagcattaagccctgcacctctgccctcggtgccgaccagtttgatggcgccgacccggtggagaaggtcaccaaggcctccttcttcaactggtactacttctccatcagcatcggttcactgctgtccgggaccgtgctagtctgggtgcaggacaatgttgggtggggagtggggttcttgatcccgactgtgctcatggtgtttgggctcgtcgctttcgtcgccggtcggagggtgtacaggtacaagaaactggaagggagtcctctgaaaagagtcacccaggtggtggttgcagctgtaaggaactacaatttggggttgcctgaagactgttctgctctgcatgaggtgccttccccaactggaccaaattgcaagattcagcatacccctcaattcagattctttgacaaggctgccatcgtagcgacatcgtccgacgagaaaggcgtagaagtgtcaaagaacccatggaggctctgcaccgtctctcaggttgaggagctgaagatgctgctccggatgttccccgtgtgggcatcaatggtgctgttcttcacggtgaccgcgcagatgtcgtcaacgttcatcgagcagggcgcgatgatggacacccgcgtcggtccgttatcggtgccgccggcgtccctggcgaccttcgacgtcatcagcgtcatggtctgcatccccgtctacgacgccgtgctggtgccgctggcccggcgcgccacgggcaaggaccggggcctgtcacagcggcagcggctcggcgtcggcctcgcgctctccgtggtcgccatggtgtacgcggcgcttgtcgaggcgaggcggctgtcgctcgcccgtagcgcggcagccgggcagctgccgatgatgagcatcatgtggcaggcgccggcgttcgccgcgctgggcgcaggggaggtgttcacggccatcggcatcctcgagttcttctacgaccagtcgcccggcggcatgaagagcctgggcactgcgcttgcgcagctcaccatcgcggccgggaactacctcaactcggcggtgctcggtgccgtcgccgccctcacggcgcgcggagggaagaccgggtggatcccggacgacctgaacgaggggcacctggactatttcttctggttgatggctgctctgggcgtggtgaatctgctgcacttcgtgcattgctccatgagatacagaggcaataacaacaatacagctttgtgacaagcatgcgtcaatctatggaatcaagacaacaaacatctgcagtaattcctccaagccc

SEQ ID NO: 21903 - protein, 577 aa, Panicum virgatum
  misc_feature: Ceres CLONE 1818719
  misc_feature (114)..(507): Pfam Name: PTR2 Pfam Description: POT family
MEAASDEERPLIPHLPSQDEEGSLYTSDGTVDVNNQPALKRTTGNWRACFLILGTEFVECFVFFGVAKNLVTFLTGELHESNVDAAKSVSTWIGTCFFTPVIGAFLADTYWGKYWTLVIFLSIYTIGMLTLTISASLPLLMDTPHNNGIRHFTVYLGLYLVALGEGSIKPCTSALGADQFDGADPVEKVTKASFFNWYYFSISIGSLLSGTVLVWVQDNVGWGVGFLIPTVLMVFGLVAFVAGRRVYRYKKLEGSPLKRVTQVVVAAVRNYNLGLPEDCSALHEVPSPTGPNCKIQHTPQFRFFDKAAIVATSSDEKGVEVSKNPWRLCTVSQVEELKMLLRMFPVWASMVLFFTVTAQMSSTFIEQGAMMDTRVGPLSVPPASLATFDVISVMVCIPVYDAVLVPLARRATGKDRGLSQRQRLGVGLALSVVAMVYAALVEARRLSLARSAAAGQLPMMSIMWQAPAFAALGAGEVFTAIGILEFFYDQSPGGMKSLGTALAQLTIAAGNYLNSAVLGAVAALTARGGKTGWIPDDLNEGHLDYFFWLMAALGVVNLLHFVHCSMRYRGNNNNTAL

SEQ ID NO: 21904 - DNA, 404 bp, Panicum virgatum
  misc_feature: Ceres CLONE 1818722
  misc_feature: Encodes the peptide sequence at SEQ ID NO. 21905
gtagaaccgcggcaggcaaggacacctccgccagcctcacatccttccccaacatggggtacccggtagacccctgtcttccccgcataccgcacggtcagggaggaccccgtcccgggggttacgcgttgctttctacatggatcctggccccgggaaggtcaacctctgcgtcggcgcctaccggaccgagaacggcaaccccctcgtgctcagagtggtgccgcccgccgagacgctgcctatcccctccccgcctccatataacgagcccctccccatcactggattgcccgcgccccaaaagccgagcgctcctcttatcatgagagcttacaggcctgctattcgggagaatagggctgtggcgatgccgccgctatcgcgaattgcgccttcaagaa

SEQ ID NO: 21905 - protein, 88 aa, Panicum virgatum
  misc_feature: Ceres CLONE 1818722
  misc_feature: SWISSPROT Homolog: EC 2.6.1.1 Aspartate transaminase
MDPGPGKVNLCVGAYRTENGNPLVLRVVPPAETLPIPSPPPYNEPLPITGLPAPQKPSAPLIMRAYRPAIRENRAVAMPPLSRIAPSR

SEQ ID NO: 21906 - DNA, 1549 bp, Panicum virgatum
  misc_feature: Ceres CLONE 1818723
  misc_feature: Encodes the peptide sequence at SEQ ID NO. 21907
aagatcagcatcctatttcctcgaacgtttacggggatctccctcaaatacacttctcaggaacgagaacaaacttacacactagacatatggccaattcctaccgccttaagttgcccatgcaatgcctcctcgtcgtgctactctcgtacgttgctacgatacgggcaggccctgcacctcagccacaggatttcccaaacgagcggctctaccgtgcctaccttgtcatccagcgattcaagagcaccatcacttccgaccccaagaatgtcaccgctacttggatcggacacgatatctgcggcgagacaacctacctcggattctactgcgggacaccgtccaggcgagttaataaggagctcaccgtcacggctttcattctcaacggctacaacctgcgggcgccgaagctgcaaggtttcatcgatcagcttcccgacctcgcccttttccatgctgcttccaacgactttggcagagacatcccccgtctctctagcctctcttacttgtacaggatcaatgttgatcaaaatcttgagcttccagaggataatcttgctgacgggacagtgaatgggaacgcgcatgctggatgcgttactgccactataaattttagttttaatatcaaaaccgacccccgtaaaaaaggagggggctccggaggtttcttcccgtttgctacagatggtaaggcgctcctcctcaaccacaacaacttatccgggccacttccatcgaacctcggtttctccaagctgagctacctcgccctcgccaacaacaagctcacggggccaatcccaccgtcgatcgagcacctgcaagactccctcttcgagctgctcctcctcaacaatcagctctccggctgcctcccccacgagctcggcatgctccacaaggcagctgtgatcgacgtcggcatgaaccagctcaccggcccgatcccgtcgtccttctcctgcctcagcagcgtcgagcagctcaacctcgccgggaaccgcctctacggcccggtgcccgacgcgctctgcaagctcgccgggcccgccggccgcctcgccaacctcacgctgtccggcaactacttcacctccgtcgggccggcgtgcgcggcgctgatcaaggacggcgtcctcgacgtgaagaacaactgcatcccgggcctcgccaaccagaggcgcccggcggagtgcgcggcgttccagagccagcccaagacttgctcggcggcgagcactccggtggcatgccccgctgcagctgccgcgggcgcggcggcgccgggggagaggaaggctagggactactccagctacgtgacctacgctactctgcatgagtgagcggcctcagctcggcatgcagaaggagacagatcgtctcggtggcgttttggctatttgttctttgtattcttatgtagtaccccgcatgtgtgttggtgtgattgtgattgttgtctattttctcagcacgtgttgctgtccaggttgctgtcacacctagatatatttgtatccattatatttgagcg

SEQ ID NO: 21907 - protein, 422 aa, Panicum virgatum
  misc_feature: Ceres CLONE 1818723
  misc_feature: SWISSPROT Homolog: EC 2.7.11.1 Non-specific serine/threonine protein kinase
MANSYRLKLPMQCLLVVLLSYVATIRAGPAPQPQDFPNERLYRAYLVIQRFKSTITSDPKNVTATWIGHDICGETTYLGFYCGTPSRRVNKELTVTAFILNGYNLRAPKLQGFIDQLPDLALFHAASNDFGRDIPRLSSLSYLYRINVDQNLELPEDNLADGTVNGNAHAGCVTATINFSFNIKTDPRKKGGGSGGFFPFATDGKALLLNHNNLSGPLPSNLGFSKLSYLALANNKLTGPIPPSIEHLQDSLFELLLLNNQLSGCLPHELGMLHKAAVIDVGMNQLTGPIPSSFSCLSSVEQLNLAGNRLYGPVPDALCKLAGPAGRLANLTLSGNYFTSVGPACAALIKDGVLDVKNNCIPGLANQRRPAECAAFQSQPKTCSAASTPVACPAAAAAGAAAPGERKARDYSSYVTYATLHE

SEQ ID NO: 21908 - DNA, 558 bp, Panicum virgatum
  misc_feature: Ceres CLONE 1818746
  misc_feature: Encodes the peptide sequence at SEQ ID NO. 21909
ggtctattaatacatcctcgcacgcgcttcttcccagcggcactagcactacacgtacttcgctcgttcctgacgggagatggcggcctccaaggtcaaggacgacgggccggcggttggcatcgacctgggcacgacctactcctgcgtggccgtctggcgccctgaccgcggcgagctcatcgccaacgaccagggcaaccgcctcacgccgtcctgcgtcgcgttcaacggcgacgagaggcacgtcggcgacgcggccgtgaaccaggccgccttgaaccccaccaacacaatcttcgaagtgaagcgactgataggacgaagatttaatgacgagtctgtacaaggagacatcaaattgtggcccttcaaagtcgctgcaggtcgtgacgaccggcccatgatcgtggtgcagtatgaaggcaaggagaaggagttcatgcctgaggagatctcctccatggttcttgccaagatgaaagaaacagcagaggcctacctcgctaaaacagtcaaggacgccgtgatcacagtccctgtctacttcagcaactc

SEQ ID NO: 21909 - protein, 159 aa, Panicum virgatum
  misc_feature: Ceres CLONE 1818746
  misc_feature: Useful for making plants with modulated heat sensitivity
MAASKVKDDGPAVGIDLGTTYSCVAVWRPDRGELIANDQGNRLTPSCVAFNGDERHVGDAAVNQAALNPTNTIFEVKRLIGRRFNDESVQGDIKLWPFKVAAGRDDRPMIVVQYEGKEKEFMPEEISSMVLAKMKETAEAYLAKTVKDAVITVPVYFSN

SEQ ID NO: 21910 - DNA, 1820 bp, Panicum virgatum
  misc_feature: Ceres CLONE 1818753
  misc_feature: Encodes the peptide sequence at SEQ ID NO. 21911
atcccctgccatcacctcacccccgtcccaaatccgcggcgacctcaacagaaaactaaaagccgcctcctttacctaacggagaagcaaaaattcgcggattgccccgtccgatcgccggggaatcgacccgacgcggcccgaccgaacggctcatggccggaaccgagcggccccaccgcccgatcggcgcgccgcggccaggcgccggcggcggcgactcgccggcgaggtgggacgacgacggcggccgcgtcgaaggcctggctggattcaatatatttgaccaagaggaagaagagtcaccagacaaaaatggcacagccaacggccatgatacaaccgaaactgtcatagagacagaaccaggaaagtgtttctatgatgaaccgcttcacgagcatacaggcatctgggtgcctgtttctgtccctccgatgactgcgcaggaccgtgaggagtggcacagggggtttggttacaatagcgggtacttcccggaagaagagtttagctgggagctggatgaagagaataaagagatgacaatgtgggatgtgtttgccgatatggttgttgcagcaaaagataaagtgatatctgctgcaacatatgattttgggaggtgcgggatgtcagtggtatccaacttctttctccaagaagcctggaaggatatggcgcaaacacttgcagatgccaatgctggtattgcaaacgagctacttgagacagagccaacaaagtggttgcctgacagtgctgctacctcttgcatgctctgtggcatgcggtttcatcctataatgtgctctcgccatcattgtcgtttctgtggtggagtattttgcaatggttgtacaaagggtagaagcttaatgcctccaaaatttaggacttcagaacctcaaagggtttgtgatgtctgtggagtgcggcttgagagtatacaaccacaattgatgaatcagatcagtcgtgcatctcaacttccaactcgggatgtgacagacctgagtaccttgaggtcatggttgaacttcccttgggcacacacaatggaatatgagatatacaaagctgcaaattctttacgcagctactgcaaggtgggaagactgaagccagagaaggctatccctgatgctattcttagacaagcaaaaggttttgctatagttactgtggtaaaggtcggaatgatggttacatataagcttggtactgggctggttgttgctcgaagggctgatggctcctggtcacctccttcagcaatctccacctgtggtgttggatatggagctcaggctggaggtgagatagctgacttcatcattgtgctgaggaatacggatgccatcagaacattcagtgggaaggcacatctatctgttggtgctggtgttagtgcttctgctggtcatgtcggacgagtagctgaggctgacttccgtgctggtgatggtggttatgctgcatgttacacatacagttgtagcaaaggtgcctttgtgggctgtgcattcaatggcagcatagtatcaactcgagacactgagaacgctcgattttacggcggccctgtcaaggccgctgacatccttctcggatccatggccaggccgcctgcagcctcccctctgtacaaagctctttcagaattgatggacagggttcggaagtaaccctctcatgctttaggcatctggcatgctatcaccgcctccttgtaaatacattcagggcttcagatttgtgctcatcacacattcattggaagcgatttcgcaactgtacagtatgccattcttcaacac

SEQ ID NO: 21911 - protein, 510 aa, Panicum virgatum
  misc_feature: Ceres CLONE 1818753
  misc_feature (196)..(264): Pfam Name: FYVE Pfam Description: FYVE zinc finger
  misc_feature: SWISSPROT Homolog: EC 3.1.3.48 Protein-tyrosine-phosphatase
MAGTERPHRPIGAPRPGAGGGDSPARWDDDGGRVEGLAGFNIFDQEEEESPDKNGTANGHDTTETVIETEPGKCFYDEPLHEHTGIWVPVSVPPMTAQDREEWHRGFGYNSGYFPEEEFSWELDEENKEMTMWDVFADMVVAAKDKVISAATYDFGRCGMSVVSNFFLQEAWKDMAQTLADANAGIANELLETEPTKWLPDSAATSCMLCGMRFHPIMCSRHHCRFCGGVFCNGCTKGRSLMPPKFRTSEPQRVCDVCGVRLESIQPQLMNQISRASQLPTRDVTDLSTLRSWLNFPWAHTMEYEIYKAANSLRSYCKVGRLKPEKAIPDAILRQAKGFAIVTVVKVGMMVTYKLGTGLVVARRADGSWSPPSAISTCGVGYGAQAGGEIADFIIVLRNTDAIRTFSGKAHLSVGAGVSASAGHVGRVAEADFRAGDGGYAACYTYSCSKGAFVGCAFNGSIVSTRDTENARFYGGPVKAADILLGSMARPPAASPLYKALSELMDRVRK

SEQ ID NO: 21912 - DNA, 2306 bp, Panicum virgatum
  misc_feature: Ceres CLONE 1818760
  misc_feature: Encodes the peptide sequence at SEQ ID NO. 21913
accaccgaaccagaccccaatacacgtcaaagcggaaaacctcagataacccccaggaaatcgtattataatctcgccctccactcccctgctccgctgcaactgcaactccactcggccggccgccccccaccctcctgatcctccccccaaccattggtgcttgatcggatccatggacacccacatcggatccttggacgggccggcgctggcggcggcgaacgtcacggtgggctgcccggcgtcggcgccagggtgcccgatggcgtccacgccggcgcagcccgcggcggcgctgacggccggggaggcgtcgctggggcgccacctcgctcgccgcctcgtgcaggtcggcgtcggcgacgtcttcgccgtccccggggacttcaacctcacgctgcttgaccacctgatcgccgagcccgggctgcgcctcgtcggctgctgcaacgagctcaacgccgggtacgccgccgacgggtacgcccgcgcgcggggcgtcggggcctgcgccgtcaccttcaccgtcggggggctcagcgtgctcaacgccatcgcgggcgcctacagcgagaacctgcccgtcatctgcatcaccggcgggcccaactccaacgactacgggaccaaccgcatcctccaccacaccatcggcctcccggatttctcgcaggagctccgctgcttccagaccgtcacctgccaccaggcggtggtgaccaatctggacgacgcgcacgagcagatcgacacggccatcgccacggcgctgagggagagcaagccggtgtatctcagcattagctgcaacctccccgggctacctcaccctacctttagccgcgatcccgtgccgttcttcctcccccccagaatgagcaacaagatggggctcgaggctgcgattgaggcaaccgttgagttcttgaacaaggccgtgaagccggtgcttgttggtggccccaaactgcgtgtggcaaaggcaggaaaggcatttgtggatcttgtagatgccagcggctatgcttatgcagtgatgccatcggccaagggtcttgtaccagaaacgcacccccatttcatcggcacctactggggtgccgttagcactgccttctgtgctgagattgttgagtcggctgatgcctacctctttgccggccccattttcaatgactacagctctgttggctactctttcctcctcaagaaggataaggccatcatcatccagcctgaacgtgtgatagtcgggaatgggccagcattcggatatgtcatgatgaaggatttcttgtctgaattggctaagagggttaagaagaataccactgcctatgagaactacaagaggatctttgtgcccgagggacagccgctggaaagtgagccgaatgagccgttgcgtgtcaatgtgcttttcaagcacatccagaagatgattacaaatgacagcgcggtgatcgctgagactggtgactcctggttcaactgtcagaagctgaagctgcccgagggctgtgggtgagcattgtgatgtcatactgttctactatctgtcttgttctttgccttgttctgatgatgattctttgcatgctgcaggtatgaattccagatgcagtatggttcaatcggatggtcagttggtgcattgcttggctatgctcagggggcgaacaccaagcgtgtgattgcctgcattggtgacggaagcttccaggttacagcacaggatgtgtcaactatgctgcggtgccagcagaacagcataattttcctgatcaacaatggtgggtacaccattgaggtggaaatccacgacgggccatacaacgtcatcaagaactggaactacacgggccttgtggatgccattcacaatggagagggcaagtgctggacttccaaggtaaagtgcgaggaggagctgacagccgcgatcgagacggcgctgggggagaagaaggactgcctgtgcttcatcgaggtgatcgcgcacaaggatgataccagcaaagagctgctggagtggggctccagggtctctgctgccaactcccgcccaccgaatcctcagtagagcagtcttgcaagctccaagcctcaaagactcggtagtggtggtagaactatggggctcgatcgaataacgtgaacgctttgccctttctgttatgttctcctcgtttagtgcctggttctcattgttcttgatggtcctgtatctatttgtgacaattcccctgtttctcgtgcgtgaatgccgtagagaattatgagaaatttcaggtttcgggacc

SEQ ID NO: 21913 - protein, 451 aa, Panicum virgatum
  misc_feature: Ceres CLONE 1818760
  misc_feature (47)..(223): Pfam Name: TPP_enzyme_N Pfam Description: Thiamine pyrophosphate enzyme, N-terminal TPP binding domain
  misc_feature (245)..(378): Pfam Name: TPP_enzyme_M Pfam Description: Thiamine pyrophosphate enzyme, central domain
  misc_feature: SWISSPROT Homolog: EC 4.1.1.1 Pyruvate decarboxylase
MDTHIGSLDGPALAAANVTVGCPASAPGCPMASTPAQPAAALTAGEASLGRHLARRLVQVGVGDVFAVPGDFNLTLLDHLIAEPGLRLVGCCNELNAGYAADGYARARGVGACAVTFTVGGLSVLNAIAGAYSENLPVICITGGPNSNDYGTNRILHHTIGLPDFSQELRCFQTVTCHQAVVTNLDDAHEQIDTAIATALRESKPVYLSISCNLPGLPHPTFSRDPVPFFLPPRMSNKMGLEAAIEATVEFLNKAVKPVLVGGPKLRVAKAGKAFVDLVDASGYAYAVMPSAKGLVPETHPHFIGTYWGAVSTAFCAEIVESADAYLFAGPIFNDYSSVGYSFLLKKDKAIIIQPERVIVGNGPAFGYVMMKDFLSELAKRVKKNTTAYENYKRIFVPEGQPLESEPNEPLRVNVLFKHIQKMITNDSAVIAETGDSWFNCQKLKLPEGCG

SEQ ID NO: 21914 - DNA, 1876 bp, Panicum virgatum
  misc_feature: Ceres CLONE 1818775
  misc_feature: Encodes the peptide sequence at SEQ ID NO. 21915
cttccaggcttccacacgcatctcatcttcttccccgacctcgccgcctccgccgttgaccccggcggccgacgccggcgaggcagcacctcgccggacgcccacccctgctccttgatctgcctattccccctccagcaattcctgtagccgcctccggccgccctcccgcggaaccctagatctccgataccccgcgcgccctcccgccgacggccacccgatcggaatgggccgccatctccagtaaggtccagcgacccaggagtacccgcctccgccttcgcgcgtgcgcgaggcgccgccgcgatggcgatccgcatcaccgtgtcctactcgggctacgtggcgcagaacctggccgcgtccttcggcctgcgctgcaccagcgccgccgctgccggcgctggcgcggcgcccggcccggggtgccgcttcctccaggacgcgctatcccgccccttctacctcttcgcaacctcccgccgcgccgactcccaccatgacgccgaggatcacaagattcacaaccacccgaagcccaggcccagggctctgcctccggccgcctccgcgggaggcggccactcgctgttgctgccgcggtcgtcctccaccaaaccgccggtggatgacccgccaacgtcgctggccgtgggcctgctgtcagtgttcgcgtccgagatgggttcgactggtggcattgcgggggcctcctccctcgcggcgtccccgtcaatatcagccggattcaaccctgcggcgctgctcccgttcctgcaggcgaccaagtggctcccctgcagtgacatcgtcaccgctgccacggcgtcccgcggctcaagacgcccagcaggtgcctcgacggcgcctgcaccgcgagcaacaggtgcctcgatagcgcctgcaccgcctgcagctgcaccatcaccccgtcctgctccacgcagagctgtcccatcgcctggtccttcacctgtgccgtcacctgctgtggctgctccgtccaaggtgggcattcaagctttggttggaagtgccagcattgcctcaggttcagctggaattggtagtggcgcgattgcctcgggtgcagctgggatggtgaggaagagtggtgctagtcttgctgccggtgcaagggtaagcaggaaggctggttggctctcgaggtgggtgagctcatgctcggatgatgcgaagactgtctttgctgctgtgactgtgccgttgctctatagatcatccctagctgagccaaggtccatcccatccaaatcaatgtacccaacatttgatgttggtgaccgaatccttgctgagaagatttcttacattttccgggagccagaagttttggacattgttatctttcgtgcacctccagtccttcaggcattgggctacagctccaatgatgtgttcatcaagagagttgtggcgaagggtggggacatcgttgaagtacgtgatggtaacttgttggttaatggagtaatccaggatgaagaatttgtgctggagccggctgactatgaaakggatccactgactgtccctgaaggctttgtatttgtactaggggacaacagaaacaacagctttgattcacataactggggaccgcttccagtgaatagcattctagggagatctgtgcttcgatactggccaccgtcgaaaataacagatacaatatatgagcatgatatggcgcaattcacagtcgccacatcctgagatatgcattgtggctgtaccacattgaaaatgcagtcccattttttccttttctttttccggccgagctttactgacaagtgtaaagctgagccgcagtttttgcattcttatttattggatgtcgccttgcctc

SEQ ID NO: 21915 - protein, 476 aa, Panicum virgatum
  misc_feature: Ceres CLONE 1818775
  misc_feature (319)..(396): Pfam Name: Peptidase_S24 Pfam Description: Peptidase S24-like
  misc_feature: SWISSPROT Homolog: EC 3.4.21.89 Signal peptidase I
  misc_feature (411)..(411): Xaa is any aa, unknown, or other
MAIRITVSYSGYVAQNLAASFGLRCTSAAAAGAGAAPGPGCRFLQDALSRPFYLFATSRRADSHHDAEDHKIHNHPKPRPRALPPAASAGGGHSLLLPRSSSTKPPVDDPPTSLAVGLLSVFASEMGSTGGIAGASSLAASPSISAGFNPAALLPFLQATKWLPCSDIVTAATASRGSRRPAGASTAPAPRATGASIAPAPPAAAPSPRPAPRRAVPSPGPSPVPSPAVAAPSKVGIQALVGSASIASGSAGIGSGAIASGAAGMVRKSGASLAAGARVSRKAGWLSRWVSSCSDDAKTVFAAVTVPLLYRSSLAEPRSIPSKSMYPTFDVGDRILAEKISYIFREPEVLDIVIFRAPPVLQALGYSSNDVFIKRVVAKGGDIVEVRDGNLLVNGVIQDEEFVLEPADYEXDPLTVPEGFVFVLGDNRNNSFDSHNWGPLPVNSILGRSVLRYWPPSKITDTIYEHDMAQFTVATS

SEQ ID NO: 21916 - DNA, 1565 bp, Panicum virgatum
  misc_feature: Ceres CLONE 1818777
  misc_feature: Encodes the peptide sequence at SEQ ID NO. 21917
gtagcagagcaggcacgcggcccaaaccccttcccctttctctctcccttcctccaaatccacatcaccccgtgcgcctccagatttggcgaccgccgcctccgacgtcgccagatcggagcgggcgcggcctcgcttcgcctccccgcgcggccctcgcctgctgcagggtcatgggaatggaggtcgctggagctgaaacagcaccggcagaggtcaaagtatctgatggagaagtgaacctattccaagagaaggaaagcaaagcaactgctaaagaacgtgaggaggcagctgtttttggttcagagacaactacaaatgttactgatctggcacctccaaaggatgcgaaggatgagtggcctgaacctaagcaaacttatgccttctacttcgtcaagatccgttcgtttgaggatcctaagctgagggcaaaacttgagcaagctgacaaagaattccagaagaagatccaagctcgttctaaacttatcgaggcactaagagccaagaagtcagagcgctctagtattatctcggagctgaagccattgtctgctgagaacaaacaatataatgaagttgtgaatgagaagataaaggagatggagcctcttcggaacagtttaggcaggtttcgtgaggaaaacaatgccatgagggcacagggtgcaggtttatgctcttctatcgaagagcttgaacaaacgatcaagatgcttaatgaccgtatagtacatgagagcatatccttagctgaggagaaacgtctggtcaaagaaatcaaggaccttgaaaaaaccagatcaaaagtcatatcaaatgctgctaatcgggccaaactgcaagatacagtggttgaaaaagaggccatacaggaccaggtcaaaataattggggagggcattgatggaataaagaaggaaagacaagcagtcagatctaagattaaggtcctggaggatgagctaaaagttgttgatgctgagattgcatcacttcaagaagatttagatgcagcaactgccagaaaggataaggcatacgaatcattgcaagaattgagggcagtgcgagatgcgaaaaatgcatccttccttcaaaaccgcactgttttaaacaaggctagggactattcgtcaaggaatatgctgacagaattgcaagagctccacaagactgaggtcgacaagttcatgacccaatggtgtgaaagcaaggccttcagagaggactatgagaagaggattcttgcctccctcaacagccgactactgagccgtgatgcccggatgaggaatcctgatgagaagcccatattcattgagtcgcaggcaccagcaccagctgcagaaccagagcctgttccagtaaagttacctgcaaaacaagccaaggaagtgcctgctccccaagcagatgaagctcccaaggttgaagtccgttcgaaagggtctgtgaagccgcccaaggcaaaagctgcactagatgctgatgatgattacgaggctgagcctccaaaggaaaaggctaagcctacagaggctgatgtggcaaagttg

SEQ ID NO: 21917 - protein, 463 aa, Panicum virgatum
  misc_feature: Ceres CLONE 1818777
  misc_feature: SWISSPROT Homolog: EC 2.7.11.1 Non-specific serine/threonine protein kinase
MGMEVAGAETAPAEVKVSDGEVNLFQEKESKATAKEREEAAVFGSETTTNVTDLAPPKDAKDEWPEPKQTYAFYFVKIRSFEDPKLRAKLEQADKEFQKKIQARSKLIEALRAKKSERSSIISELKPLSAENKQYNEVVNEKIKEMEPLRNSLGRFREENNAMRAQGAGLCSSIEELEQTIKMLNDRIVHESISLAEEKRLVKEIKDLEKTRSKVISNAANRAKLQDTVVEKEAIQDQVKIIGEGIDGIKKERQAVRSKIKVLEDELKVVDAEIASLQEDLDAATARKDKAYESLQELRAVRDAKNASFLQNRTVLNKARDYSSRNMLTELQELHKTEVDKFMTQWCESKAFREDYEKRILASLNSRLLSRDARMRNPDEKPIFIESQAPAPAAEPEPVPVKLPAKQAKEVPAPQADEAPKVEVRSKGSVKPPKAKAALDADDDYEAEPPKEKAKPTEADVAK

SEQ ID NO: 21918 - DNA, 703 bp, Panicum virgatum
  misc_feature: Ceres CLONE 1818795
  misc_feature: Encodes the peptide sequence at SEQ ID NO. 21919
gcgtcgaactgggagatcaatcagtattcttgatatctacggctttgaatcatttgataagaacagtttcgaacagttctgcatcaattatgccaatgagaggctacaacaacatttcaatcgtcatttgtttaagcttgaacaagaggaatatgttgaggatggcattgactgggcaaaggttgattttgaggacaatcaagactgtttgaatctctttgagaaaaaaccactggggttattgtctctgctggatgaggaatcaactttccccaacgccacagatcttacttttgcaaacaagcttaagcaacatcttaactcgaactcttgcttcagaggagaaagaggcaaggcattcgctgtccgtcactacgcaggagaggtggcttatgattcttcgggttttctggagaaaaatagagatttgttgcacatggactccatacagctccttgccaaatgcaaatcttctctgccacaaacgtttgcatctaagatgctagctcaatcggataattctatatctgttccatatagatccagtgctgccgattctcaaaagctaagtgttgctatgaagtttaagggacaactattccaacttatgcagagactggaaagtacaacaccacactttattcgctgcattaaaccaaataatctacagcttccagcaatttacgaacaaggtcttgtgctt

SEQ ID NO: 21919 - protein, 233 aa, Panicum virgatum
  misc_feature: Ceres CLONE 1818795
  misc_feature (1)..(232): Pfam Name: Myosin_head Pfam Description: Myosin head (motor domain)
  misc_feature: SWISSPROT Homolog: EC 2.7.11.1 Non-specific serine/threonine protein kinase
RRTGRSISILDIYGFESFDKNSFEQFCINYANERLQQHFNRHLFKLEQEEYVEDGIDWAKVDFEDNQDCLNLFEKKPLGLLSLLDEESTFPNATDLTFANKLKQHLNSNSCFRGERGKAFAVRHYAGEVAYDSSGFLEKNRDLLHMDSIQLLAKCKSSLPQTFASKMLAQSDNSISVPYRSSAADSQKLSVAMKFKGQLFQLMQRLESTTPHFIRCIKPNNLQLPAIYEQGLV

SEQ ID NO: 21920 - DNA, 581 bp, Panicum virgatum
  misc_feature: Ceres CLONE 1818798
  misc_feature: Encodes the peptide sequence at SEQ ID NO. 21921
cccctttctccccgccgccacctcgccctcgcgctcgcgctcgccttcgccctcgcgctcgccttcgccctcgctccctccctccgattgcaaaagcgctcaaggcggcgaccgcatctccaagatggtgctccagaacgacatcgacctgctcaacccgccggcggagctcgagaagctcaagcacaagaagaagcgcctcgtccagtcccccaactccttcttcatggatgtcaagtgccagggctgtttcagcataaccactgtgttcagccactcccagaccgtggtggtgtgtcctggctgccagacggtgctctgccaaccgaccggtggaaaggccaggctcactgagggctgctccttccgccgcaagggcgactaggctgctggtgtgtgcaacagggaggaaaaagatcgatgtcctgctgagcaaagtttaaccttcccagtagaggattttgttaattatgcctgttaagctcctgtgatgaaacctgcactttgtttgagttctgaaagatttcatacatactcttaacctccttttcctttgcttatttctattgaattcatgatgg

SEQ ID NO: 21921 - protein, 86 aa, Panicum virgatum; identical to SEQ ID NO: 9875
  misc_feature: Ceres CLONE 1818798
  misc_feature (30)..(84): Pfam Name: Ribosomal_S27e Pfam Description: Ribosomal protein S27

SEQ ID NO: 21922 - DNA, 704 bp, Panicum virgatum
  misc_feature: Ceres CLONE 1818828
  misc_feature: Encodes the peptide sequence at SEQ ID NO. 21923
gatgttctcccatctctctctctctctctctcctctttgcttgcggcgacgcctgggagagcgccgccgccattcgccgggtcgtcgcccacggcgagcaccaccagttgatcttctggctggaaaatcgcgttgacggtggcggagtaggggttctaccatcggcagcttcatctcaaggagcagagttcttacatgatccctttaaaccggagggcaagcctgcctagggctgggatggagtacttcgatgcaaggcggaagcctcataatgttgggaaaatcattgcagctatggtcctcacaagtctctgtatatttgttctgaagcaatctcctggttttggtggcaatagtgtgttttctcgccatgaacctggtgttacccacgtcttagtaacaggaggagctggttatattggatcacatgcctctttaaggctcttaaaggataactatcgagttaccattgtggataatctctctagaggaaacatgggagcagtaaaggttctgcaggagttatttccgcagcctgggaggctacaattcatctttgctgatctgggggaccagaaatctgtcaacaagatatttgctgaaaatgcatttgatgctgtgatgcactttgcggctgttgcttatgtgggtgagagcacactggaacccccttaggtagtctgtagtcgttaccttggtgacag

SEQ ID NO: 21923 - protein, 159 aa, Panicum virgatum
  misc_feature: Ceres CLONE 1818828
  misc_feature: SWISSPROT Homolog: EC 5.1.3.5 UDP-arabinose 4-epimerase
  misc_feature: Useful for making plants with altered carbohydrate content
  misc_feature: Useful for making plants with altered cell wall content and/or composition
MIPLNRRASLPRAGMEYFDARRKPHNVGKIIAAMVLTSLCIFVLKQSPGFGGNSVFSRHEPGVTHVLVTGGAGYIGSHASLRLLKDNYRVTIVDNLSRGNMGAVKVLQELFPQPGRLQFIFADLGDQKSVNKIFAENAFDAVMHFAAVAYVGESTLEPP

SEQ ID NO: 21924 - DNA, 1719 bp, Panicum virgatum
  misc_feature: Ceres CLONE 1818833
  misc_feature: Encodes the peptide sequence at SEQ ID NO. 21925
attctcaccatcgtcaccattggagctctgctcctcttattgttctctgagcttttagggtctaccaaacaccctgtgacagtcggggaatggaggagcagagcactctgccattgctgcagaaggagtaccaccttgactgccctggttgtgattatgaccggaagagggacctccaagagggtctgccttacaaggagttctcgtatatctggatgatctgccttgctgctgctttaccggtgtcattgctattcccatttttgtatttcatgacaagagacttgcatgttgcagaaagaacagaagatatagggttctatgcaggatttgtgggcgcttcatttatgcttggtagatgcttaatttcaactgtttggggaatagcagcagatcgcattgggagaaaaccaattgtcatgtttggcattttctccgtggtcgtatttaatactttgtttgggcttagtactagttattggatggcaatagctacaagatttctccttggcgctctaaatggtttgcttgggccaattaaggctaccaaagtttgcagaactgaacatcaagctctgggcctatcacttgtcagcacggcttggggaataggtttgatcattggtcctgctcttggtggttaccttgcactgcctgcagaaaaatttccaaacgtgttttcacctgactcattctttggaaggttcccgtatttgttgccatgcttatgctcatcgctctttgctgttgttgttcttgtgagctgcatatggatgccggagacgttacacatgcataatgtatgtgaaaatgaaaataaaaattttgaagctttggaggcccacctgaatggctacgaagagaggtttgaacaaacttctagtttcgatgacaggaagagtttattcaagaattggcccttgatgtcatccataattatgtattgtgtattctcatttcatgatatggcttatacagaggtgttctctttatgggctgaaagtgacaaaaagtatggtggccttagtttatcatctgaggatgtaggtcaagtgctttcagttacaggtatcagtcttcttgtatatcaactctttgtatatcctcatattaataagattcttggacctctcaattcttctcgaattgcagctattttgtgtatacctattctatttgcctatccctatatgacatatctgtcaggaattggactatcgatcattttgaatattgcatcagtgctaaaaaataaccttggtattacaatcattacaagcagtttcatcctccaaaataatgctgtgcatcaagaccaaagaggagctgcaaatggactgtccatgacagtaatgtccttattcaaatcagtcgctcctgcaggggcaggcattgtgttttcttgggcacaaaaacgccatcatgctttcttctttccaggtgatcaaatggtgttccttctgctgaatgtcatcgcgtttcttggccttatccttacattcaaaccctttatggccatatcagaacaacaacgtggaagggattagtattagttacaaaaacaatgggtcattcggatggtgggtcaagagtgtttactagacgatggctgggttataatcaacaacaaatggtggcataattgagtgcttatatttgtatcactataattgtgtgtcacaacattttcacaaaggaatgattattgtttctacgttc

SEQ ID NO: 21925 - protein, 485 aa, Panicum virgatum
  misc_feature: Ceres CLONE 1818833
  misc_feature (41)..(430): Pfam Name: MFS_1 Pfam Description: Major Facilitator Superfamily
  misc_feature: Useful for making plants with modulated flowering time
MEEQSTLPLLQKEYHLDCPGCDYDRKRDLQEGLPYKEFSYIWMICLAAALPVSLLFPFLYFMTRDLHVAERTEDIGFYAGFVGASFMLGRCLISTVWGIAADRIGRKPIVMFGIFSVVVFNTLFGLSTSYWMAIATRFLLGALNGLLGPIKATKVCRTEHQALGLSLVSTAWGIGLIIGPALGGYLALPAEKFPNVFSPDSFFGRFPYLLPCLCSSLFAVVVLVSCIWMPETLHMHNVCENENKNFEALEAHLNGYEERFEQTSSFDDRKSLFKNWPLMSSIIMYCVFSFHDMAYTEVFSLWAESDKKYGGLSLSSEDVGQVLSVTGISLLVYQLFVYPHINKILGPLNSSRIAAILCIPILFAYPYMTYLSGIGLSIILNIASVLKNNLGITIITSSFILQNNAVHQDQRGAANGLSMTVMSLFKSVAPAGAGIVFSWAQKRHHAFFFPGDQMVFLLLNVIAFLGLILTFKPFMAISEQQRGRD

SEQ ID NO: 21926 - DNA, 2752 bp, Panicum virgatum
  misc_feature: Ceres CLONE 1818870
  misc_feature: Encodes the peptide sequence at SEQ ID NO. 21927
agcagtcgtcgtccccgatgatgataagcagggggtggtggagcactccaacctaataagtgagcttccaggtcgaggagagggaccgccggaggaaaacttcggaggcgcccggcttccaagatacccactagctccctgcctcccaccgcgttcttttcccccttggctggtgctagaaagatgcgattttttggctctggggccacttgttcttctgattcttacgttgcgggcacccccttggcttctcgtctggtgtctgttttctcgtggcgaggaactctctatcttccttcgtggggataatttgaggtgatatttggctcgtcctttggtgcctttagagggtgggcgagaggtctcgattccaaaatctgcaagcgtcttctgtgtatgggtctggtagccgccctgtaggagacctgtatggacgaatttgggggcgatccctagtctatctgtcaagcagccaaagtgattttcgtgtgagccaaagctaggggagatgcagaaattgatgaggagacagtagaggggcttgttggactctgcaaggacttgctaagcttttgtccttcttgtgatctagaggcctgatatttttccatcagctgagccgtatttgccgaagtgcacagatagaggggtttattggagtaagcaagaacaaggcatcccaattttgggattcgtcacaatatcttcagagtgaacaagtaaggaaccatttgatcctgagacatggagaagcaatccagcacgcggcatggtccgctagaaaaactgaagagcttccgggggatagagaagcagagaagctttaagttcttgtccatggagaagcagcacaacttcaaaaggaacaaggacagccctgggaagcggggtgacactgcactccaccttgcggcgagggctggcagtgttgcccatgtccagaagatccttgtggagtgcgacccagaactagtggtggagttagctgcccgtcagaatcaggacggtgagactgcactgtatgtgtctgctgaaaaggggcatgttgaggttgtctgtgagattttgaaggcttgtgatgtgcagtcagcagggctcaaggccagcaacagcttcgatgcattccatattgcagcaaagcagggccatctggatgttttgaaggagctgctgcaagcctttccctcattagctatgacaacaaattctgtaaatgccactgctttggacactgctgcaactcagggccacattgatattgttaatcttttcctagaaacagatgcaagccttgctaggattgcaagaaataatggcaaaacagttttgcattcagcagcaagaatgggccatgtggaggtggtcactgcactgttgaataaggatccagggattagtttcagaacagataaaaagggacagacagcgctacacatggcttcaaaaggccagaatgctgaaattctgctcgagttgttgaagcctgatgtctcagttatccatgtggaagacagcaaggggaacagaccattgcatgttgcaactcggaaggggagcaccattatggtccagaccctaatatcagttgaagggattgaaatcaatgcagttaatagagctggagagactgcttttgctattgcagagaaacaaggtaatgaagagcttattaacatccttagagaggttggtggagtaacttcaaaagagcaagtgaatcctcctaatccagcaaagcagctcaagcagactgtcagtgatatcaggcatgatgttcagtcacagatcaagcaaacacaccagaccaagatgcaattccaaaaaatcaagaagagaatccaaaagctccacattggtgggctaaacaatgccatcaactccaatactgtagttgcagtgcttattgccactgttgcctttgcagccatattccaactccctggtaattttctggagaatatgaaagacgcaccagatccagacatgaccttggggcaagctttggtagccagcaatccagcctttataatcttcttggtctttgatgccttggctctcttcatctcccttgctgttgtcattgttcagacatctctaattgtcgtagaacagaaggctaagaagaagatggtctttgtgataaacaagttgatgtggctcgcatgcctatgcatctcggcagccttcatagcactgacctacgttgtcgtgggccgaaatgatgagtggttggcttggtgtaccatggcgattggcactgtcatcatggtggccactctcggttccatgtgttattgcattgttgctcacaggatggaagagaagaacatgaggaaaattaggaggacctccacaagccagtcatggtccgtatcaattgactcggaaacggagcttatgaacagtgaatataagaagatgtacgccctttagggtgccatccttgcttgtcatcgagtcctgtatatatgtacccatttgccagagactactccatggcactaagtgggattgactagaactatatttaggcctagaacatggcacctgtatgtaactgcagtcagcagcctccttccatgagcagaggggtgaattccaggtgataggagtagccactttttgtaggcaaatatgactatttgccaagcaagatgtttatcttatatgcttattattactgtgatggaaattaaaaccatgaaattgtatcagtatagtagaatagtgtgagataagttgcccttatatc

SEQ ID NO: 21927 - protein, 562 aa, Panicum virgatum
  misc_feature: Ceres CLONE 1818870
  misc_feature (190)..(222): Pfam Name: Ank Pfam Description: Ankyrin repeat
  misc_feature (258)..(291): Pfam Name: Ank Pfam Description: Ankyrin repeat
  misc_feature: SWISSPROT Homolog: EC 2.7.11.1 Non-specific serine/threonine protein kinase
MEKQSSTRHGPLEKLKSFRGIEKQRSFKFLSMEKQHNFKRNKDSPGKRGDTALHLAARAGSVAHVQKILVECDPELVVELAARQNQDGETALYVSAEKGHVEVVCEILKACDVQSAGLKASNSFDAFHIAAKQGHLDVLKELLQAFPSLAMTTNSVNATALDTAATQGHIDIVNLFLETDASLARIARNNGKTVLHSAARMGHVEVVTALLNKDPGISFRTDKKGQTALHMASKGQNAEILLELLKPDVSVIHVEDSKGNRPLHVATRKGSTIMVQTLISVEGIEINAVNRAGETAFAIAEKQGNEELINILREVGGVTSKEQVNPPNPAKQLKQTVSDIRHDVQSQIKQTHQTKMQFQKIKKRIQKLHIGGLNNAINSNTVVAVLIATVAFAAIFQLPGNFLENMKDAPDPDMTLGQALVASNPAFIIFLVFDALALFISLAVVIVQTSLIVVEQKAKKKMVFVINKLMWLACLCISAAFIALTYVVVGRNDEWLAWCTMAIGTVIMVATLGSMCYCIVAHRMEEKNMRKIRRTSTSQSWSVSIDSETELMNSEYKKMYAL

SEQ ID NO: 21928 - DNA, 1579 bp, Panicum virgatum
  misc_feature: Ceres CLONE 1818874
  misc_feature: Encodes the peptide sequence at SEQ ID NO. 21929
gcgagccgagggtttttctctcttgtctcgcgccgcggctaagctaagctacctctcgacgccgcgcgatcctgttgattccccggtttcctccgcgatttgagtcagatgggggatggggcagagactggcggcggtgatggcgcgaggaccacggcggcgagggcgggggcgcctcggagggatatacgtcggtacaagtgcgagttctgcggcgtggttcggtccaagaagagtttgatccgcgcccatgtcctccagaaccataaggatgaagtgaatggtctggaggattaccaagaaggaggagatggtgcttcgcgcaaggaggtcagccatgattgcaaagagtgtagcatgaggttcaagaagccggcccatctgaagcagcatatgcagagccattcactcgagtctatttgttcagacatggatgtgtgaagcattggatcccaaagaactccaaaatgcgagaagggcttgaatggactagtaccgggatggggagaccctcctgagaagctccatcaagaatgcctctttcacgctgttcttcagagaccctttgtttgccatgtcgatggttgtcccttaaggtatagcaggaaggaccatttaaacagacatctacttactcatcaagggaaactatttgtgtgccccatcgaaggatgcgaccgtaagttcaatatcaagggtaatatgcagagacatgtccaggaaatccataaagatggttctccttgtgaaagcaagaaggaattcatttgtccggaggttaactgcgggaagactttcaaatatgcttccaagttaaaaaagcatgaagaatcacatgtcaagctggactacacagaggttatctgctgcgaaccaggctgcatgaaaacttttacaaatgtagaatgcctcaaagcacataaccaatcctgccatcaacatgttcaatgtgatgtctgtggcactaaacaactaaagcggaattttaagcgccatcgccaaatgcatgaaggctcctgcattactgaaagggtcaagtgctgctttgaggactgcaaatgttcattttcaaagaaatccaatttagagaagcatgttaaggctgtccacgagcagcgccgacctttcgtgtgccagttctctgggtgtggcaagaagttttcttacaagcatgtaagggacatccatgagaagtctagtgctcatgtgcacactgagggtgattttgttgaggcggatgaacagcgatcgcattcagcaggtgggcgaaagagaaagcctgtatctgtcgaaactttcatgcggaagagggtagctgctcctgatgatgcacctgctcatgttgatggaactgagtatctgagatggcttctctctggttgatccgtccaggactccgaagggagaagagacgcaatcacaagatgtgttggatgttcaattgaaaatatctgtaatttactttgtatgtataggcagaggaaagcaacatgttagatatttatataggattcagacatggtggggattattagatcctggatataaatacaatgtgccatactagattttgaggcgc

SEQ ID NO: 21929 - protein, 110 aa, Panicum virgatum
  misc_feature: Ceres CLONE 1818874
  misc_feature (77)..(99): Pfam Name: zf-C2H2 Pfam Description: Zinc finger, C2H2 type
MGDGAETGGGDGARTTAARAGAPRRDIRRYKCEFCGVVRSKKSLIRAHVLQNHKDEVNGLEDYQEGGDGASRKEVSHDCKECSMRFKKPAHLKQHMQSHSLESICSDMDV

SEQ ID NO: 21930 - DNA, 3255 bp, Panicum virgatum
  misc_feature: Ceres CLONE 1818887
  misc_feature: Encodes the peptide sequence at SEQ ID NO. 21931
aaaccaaaccaaacccgctgctccactgccaggtgccaacttcctctccaagcctcgctctcgcggactcctctcatcggggggccggcggcggcgactaagccgcgatggactcgaggccccgcgagaccgacgcccccggcgacccggccaacggcgccgcccctccgccggccgcggcggtggcggctgctgcgacggggggcgtcgagatcaccaagccccgcaacgacaagcgcgggtaccgccgcgtggtgctccccaacgcgctcgagtgcctgctcatcagcgaccccgacaccgacaaggcggcggcgtcgatgagtgtttcggtggggtacttctgcgaccccgatggtctggaggggctcgcccacttcctcgagcacatgcttttctatgctagcaaaaaatatccaatagaagatagttactcaaagtacattgcagagcatggtggttcaaccaatgcgttcacaagtactgaacgcacaaatttttattttgatgtgaacagtgatagccttcatgatgctttagataggtttgcacaattctttatcaagccattgatgtctccagatgctgtacatagggaaataaaagctgttgactctgaaaatcagaaaaaccttttatcagatccttggcgaatgagtcagcttcagaaccatctttgcgatgagaatcacccttatcataagtttggcactgggaattgggatactcttgaagttaaagcaaaggagaaaagattagacacaaggcttgagcttattaaattctatgattcacactactctgccaacttgatgaaacttgttgtttatggaaaagatagtctcgataacttgcagaaccttgttgaaaataagttctgtgatattagagacatcgggaggaagccattttcatttcctggtcatccatgttcaagtgaacatctccagatccttgtcaaagcagttcccataaaacaaggtcacacgttgagaatcctgtggccaatcactcccaatgtccggtgttacaaagaaggcccttgcaagtacattagccatctaattggccatgaaggagaagggtctcttttttacatacttaaaaagttaggatgggctataagtttggaagctggtgaaggggattggagttatgatttttctttcttctctgttgttatacggctcacagatgaaggccaggagcacatggaggatgctgtcggactactattcagatatataactctgctgcagacatctggaactccgaagtggatctttgatgaacttcaaactatctgtgagacaggattccactaccgagacaagggcccccctatccattatgttgtaaatatttcttcaaacatgcagatttttccaccagaagattggttgattgcatcatctatgccatcaaagttttcgccagatgctattcagaatattttaaatgaattgactcctgggaatgtaaggatattctgggaatcgaaaaggtttgaaggacagacaaacttaacagagccatggtatggtacatcgtattctgttgaagctgtccctccatccattatacagaaatgggtagcggaagcccctgaggaagatttacacctgccaaaacctaacatcttcattccacgtgatctctcattaaaaaatgtagaggaaaaggtaagtgttcctttcatgctgaggaagacaccgctctccagattgtggtacaagcccgatacaatgtttttcacacccaaagcttatatcaagatggattttcactgtccactgtcccaaagctcacccgagtcagcagttcttaccgatgtattcacaaggttgctaatggattatttaaatgattatgcttatgacgctcaagttgctggcctttattacgctgttaagccaaatgatactggttttcaggtaactatggttggatacaatgacaaaatgagaacccttctggagactgttattggcaaaattgcagagtttgaagttagggttgaccgtttttctgtgataaaggaagctatgacaaaggagtatgagaatttcaaatttcggcagccatatcagcaagtcttgtattattgttcgctgatgctagatgaacaagcatggccatgggatgaggaattttctgcactttctcaccttgaagctagtgatctgggaaattttttgcctcatttgctggcaaagactttcattgagtgttattttgcaggtaacattgaacccaatgaagcaaagagtgtcatccagcatgtcgaagatgtcttgttcaatgcacccattagcgtttgcaagccattatccccatcacagcatcttgcaaggcggattgtaaagcttgaaaagggtttgagatactattatccagcaatgtgcttgaatcaccaagatgaaaattctgctcttctgcactatattcagactcatcaggataatgtcaagcaaaatgttctacttcatctacttgcacttattggcaagcagccagctttccatcaattgcgatcagttgagcaacttggctacatagcgctgcttaggcaaagaaatgattcaggtgtccgggggttgcaatttataatccagtcaactgtgaaggatcctgccaatctggatgctagagttgaaaattttcttaagatgtttgaaagcaccctttaccagatgtctgatgcagaattcaagagtaatgtcagagctcttattgatatgaaactggagaaatacaaaaacatacgcgaggaatcagcattcttctggggagagatttctgaaggaacccttaaatttgatagaaaagaagcggaggttgctgcactgagggagctcaagaaggaagagttgatagacttcttcaatgatcatgtgaaagtcaatgcaccacaaaagaagattcttagtatacaagtgtacggtggtctccatactgccgagtaccaaacgatagtgcaaaatgctccaccaccgcaatcgtgtgagataactgatatatacagcttcaggaggtcacggcctttgtatggatcgttcaggggaggttttggccagatgaagttataagacaaccttttcttttcttttgcaaaaatctgacaaataatctgtgtgattgccttatttgtaaaagaatgttttttttcatttggactaggttggcttgcatgtattttggcggtttatttgattaaggatagtactccaagatctagtgagttttcacaccgac

SEQ ID NO: 21931 - protein, 993 aa, Panicum virgatum
  misc_feature: Ceres CLONE 1818887
  misc_feature (56)..(194): Pfam Name: Peptidase_M16 Pfam Description: Insulinase (Peptidase family M16)
  misc_feature (219)..(400): Pfam Name: Peptidase_M16_C Pfam Description: Peptidase M16 inactive domain
  misc_feature (687)..(875): Pfam Name: Peptidase_M16_C Pfam Description: Peptidase M16 inactive domain
  misc_feature: SWISSPROT Homolog: EC 3.4.24.56 Insulysin
MDSRPRETDAPGDPANGAAPPPAAAVAAAATGGVEITKPRNDKRGYRRVVLPNALECLLISDPDTDKAAASMSVSVGYFCDPDGLEGLAHFLEHMLFYASKKYPIEDSYSKYIAEHGGSTNAFTSTERTNFYFDVNSDSLHDALDRFAQFFIKPLMSPDAVHREIKAVDSENQKNLLSDPWRMSQLQNHLCDENHPYHKFGTGNWDTLEVKAKEKRLDTRLELIKFYDSHYSANLMKLVVYGKDSLDNLQNLVENKFCDIRDIGRKPFSFPGHPCSSEHLQILVKAVPIKQGHTLRILWPITPNVRCYKEGPCKYISHLIGHEGEGSLFYILKKLGWAISLEAGEGDWSYDFSFFSVVIRLTDEGQEHMEDAVGLLFRYITLLQTSGTPKWIFDELQTICETGFHYRDKGPPIHYVVNISSNMQIFPPEDWLIASSMPSKFSPDAIQNILNELTPGNVRIFWESKRFEGQTNLTEPWYGTSYSVEAVPPSIIQKWVAEAPEEDLHLPKPNIFIPRDLSLKNVEEKVSVPFMLRKTPLSRLWYKPDTMFFTPKAYIKMDFHCPLSQSSPESAVLTDVFTRLLMDYLNDYAYDAQVAGLYYAVKPNDTGFQVTMVGYNDKMRTLLETVIGKIAEFEVRVDRFSVIKEAMTKEYENFKFRQPYQQVLYYCSLMLDEQAWPWDEEFSALSHLEASDLGNFLPHLLAKTFIECYFAGNIEPNEAKSVIQHVEDVLFNAPISVCKPLSPSQHLARRIVKLEKGLRYYYPAMCLNHQDENSALLHYIQTHQDNVKQNVLLHLLALIGKQPAFHQLRSVEQLGYIALLRQRNDSGVRGLQFIIQSTVKDPANLDARVENFLKMFESTLYQMSDAEFKSNVRALIDMKLEKYKNIREESAFFWGEISEGTLKFDRKEAEVAALRELKKEELIDFFNDHVKVNAPQKKILSIQVYGGLHTAEYQTIVQNAPPPQSCEITDIYSFRRSRPLYGSFRGGFGQMKL

SEQ ID NO: 21932 - DNA, 1581 bp, Panicum virgatum
  misc_feature: Ceres CLONE 1818895
  misc_feature: Encodes the peptide sequence at SEQ ID NO. 21933
atctatctataaagaaacggatcaaccccccattctgattggcacatccaaagctcccctccaccgatcttctcgtcgcgctcgcctccgattcgatccggttcttccaacccgcgggagtgatggcgaccaagaggagcgtgggcaccctcggggaggcggatctgaaggggaagaaggtgttcgtgcgcgccgacctcaacgtgccgctcgacgacgcccagaagatcaccgacgacactcgcatccgcgcgtccgtccccaccatcaagttcctcctcgagaagggcgccaaggtcgtcctcgccagccacctgggtcgtccaaaaggtgtcaccccgaagtacagcttgaagcctcttgttccacgcttgtctgagctccttggtgtcgatgtggtgatggccaatgattgcattggtgaggaggttgagagattagctgctgctttgccggaaggtggagttctgctccttgagaatgtcagattctacaaggaggaagaaaagaatgaccccgagtttgctaagaagctagcatctgttgctgacctttatgtaaatgacgcttttggcacggctcacagagcccatgcttcaacagaaggagttaccaagtttttgaagcctgctgttgctggtttcctcatgcagaaggaacttgactatcttgttggagctgttgccaacccaaagaagccatttgctgccattgttggtggatcaaaggtctccaccaagattggggtcattgagtctctgctggcgaaggtcgatatcctcattcttggtggtggtatgatctacacattctacaaggcacagggatatgctgttggaaagtctcttgtcgaggaagacaaacttgagcttgcaacctcacttattgaaaaggcgaaggcaaagggtgtttctcttttgcttcccactgatattgtagtagctgacaagtttgcacccaatgctgagagcaagattgttccagccactgctatccctgatgattggatgggtcttgatattggccctgatgccatcaaaaccttcaatgctgcgttggacaccacccagactattatttggaacggtccgatgggcgtgtttgagtttgagaagtttgctgcaggcactgatgccattgcgaagaagttggctgagcttacaacctcaaagggtgtcaccaccatcattggaggtggtgactctgttgctgctgttgagaaggctgggctggctgacaagatgagccacatttctaccggtggtggtgcgagcttggagctgttggaaggcaagccgctcccaggtgtccttgcccttgacgatgcgtaagctatggagctaagtcagctgcccttgtcagccttggtgtcattttgttttggaccatggtgtaacattgaaagttatggacatgagatagaggcttgtcatcgtgttttgctagatgagtcgagaataagtttagacttccttgctggtgcgagtgaagtgatcggaatttggaaaattggaactaacaaactcccatggatgtgtatgatattttgttttgcagttttcagctcagttgctgttgctt

SEQ ID NO: 21933 - protein, 402 aa, Panicum virgatum
  misc_feature: Ceres CLONE 1818895
  misc_feature (3)..(399): Pfam Name: PGK Pfam Description: Phosphoglycerate kinase
  misc_feature: SWISSPROT Homolog: EC 2.7.2.3 Phosphoglycerate kinase
MATKRSVGTLGEADLKGKKVFVRADLNVPLDDAQKITDDTRIRASVPTIKFLLEKGAKVVLASHLGRPKGVTPKYSLKPLVPRLSELLGVDVVMANDCIGEEVERLAAALPEGGVLLLENVRFYKEEEKNDPEFAKKLASVADLYVNDAFGTAHRAHASTEGVTKFLKPAVAGFLMQKELDYLVGAVANPKKPFAAIVGGSKVSTKIGVIESLLAKVDILILGGGMIYTFYKAQGYAVGKSLVEEDKLELATSLIEKAKAKGVSLLLPTDIVVADKFAPNAESKIVPATAIPDDWMGLDIGPDAIKTFNAALDTTQTIIWNGPMGVFEFEKFAAGTDAIAKKLAELTTSKGVTTIIGGGDSVAAVEKAGLADKMSHISTGGGASLELLEGKPLPGVLALDDA

SEQ ID NO: 21934 - DNA, 627 bp, Panicum virgatum
  misc_feature: Ceres CLONE 1818910
  misc_feature: Encodes the peptide sequence at SEQ ID NO. 21935
cttggtctcttcgctcccagtcctccccccaccgatccgaagcttccacgcctcgcctcgcctctccaggctcccccgcgcgcgctccgagggcagatccgcaccgccgctctgctcgagggcggcggatgccggcgcggaggaggcggcaggcaaagtatcttccggccgggtaggcgggcgggctagcgagctacctagctacctgagctgtggctgctatggctgaggagaagacggcgcctggcgcggccactgccgccggggcgggaaagatcatgctggtcactggcggggcaggctacatcaggagccacaccttgctgcatctcctcctcgtgggcttccgcgtctacatcatcaacaacctcaacaactcctccgatctcgtcgtccgccccgttgccccactcgcttggcaccactcccgcaacctatccttccatcatatccatctccgtgacaagggagcactgtaaataggttttgcttctacaagatttgatgctgtcctccacttcgctgggctaacagctgtgggtgaaagtgtacagaaatcattgctatattatgacaacaatgtcattgagacactaaatcttctagaacttatgtctgctcacggtc

SEQ ID NO: 21935 - protein, 85 aa, Panicum virgatum
  misc_feature: Ceres CLONE 1818910
  misc_feature: SWISSPROT Homolog: EC 5.1.3.2 UDP-glucose 4-epimerase
  misc_feature: Useful for making plants with altered carbohydrate content
  misc_feature: Useful for making plants with altered cell wall content and/or composition
MAEEKTAPGAATAAGAGKIMLVTGGAGYIRSHTLLHLLLVGFRVYIINNLNNSSDLVVRPVAPLAWHHSRNLSFHHIHLRDKGAL

SEQ ID NO: 21936 - DNA, 679 bp, Panicum virgatum
  misc_feature: Ceres CLONE 1818938
  misc_feature: Encodes the peptide sequence at SEQ ID NO. 21937
aggctgttcccagcttccctcctccccttctcaccgagtacgaggagcgagaaagaaagcgactttcctccaagcatggcgggcgccggcgccggcgccgatgacgatgtgatggaggttagctgcggcggtggagacggccgcgaccccggcgcgtacgcggcggtgctcaagaggaggctcgacctgtactgcgccgccgttgccaaatccatggaagctaaatcacaagaattttcgttgggctaccgcaactcacaagcttcagacacttcacaattgatttctcaagcttcctttgatgatgctggagatgggggaaccctagttacaaactcaaatatcatagaccatgaggattttcgaggaaatccagctaacagtggtacatcaaaggaacaatcagatgatgatggcgatcttgaggagaatactgaccctgccaatacaaagaagatgaggagaatgctgtcaaatcgagaatcagctaggcgatcaagaaagaggaagcaagcgcacctgaccgatcttgaatcacaggtttccaagttaacatctgagaatgcatctttgctaaagcgcctggctgatatgactcagaaatacgaagatgcgacccttgacaatagaaatcttacagttgatgttgagactatgaggagaaaggtgtgaggagttg

SEQ ID NO: 21937 - protein, 198 aa, Panicum virgatum
  misc_feature: Ceres CLONE 1818938
  misc_feature (122)..(185): Pfam Name: bZIP_1 Pfam Description: bZIP transcription factor
MAGAGAGADDDVMEVSCGGGDGRDPGAYAAVLKRRLDLYCAAVAKSMEAKSQEFSLGYRNSQASDTSQLISQASFDDAGDGGTLVTNSNIIDHEDFRGNPANSGTSKEQSDDDGDLEENTDPANTKKMRRMLSNRESARRSRKRKQAHLTDLESQVSKLTSENASLLKRLADMTQKYEDATLDNRNLTVDVETMRRKV

SEQ ID NO: 21938 - DNA, 709 bp, Panicum virgatum
  misc_feature: Ceres CLONE 1818943
  misc_feature: Encodes the peptide sequence at SEQ ID NO. 21939
aacgacggctccccccgttccgttccgttccgttccgttcccgacgactcctgtgagaggcgtgggcgaagccatggcctccgccaccggctccggctccggccagcagcaattccctagcacagcagcagcagatgctgacccgggagctggggccgacaagctcgtgttcgaggcggcgtcgcagcccatgagggaggactacgtcgagaacgccgtcaagttcctctcccaccccaaggtcaggggctcccccgtcgtctacaggcggtccttcctcgagaagaagggcctcaccacccaggagatcgacgaggccttccgaagagtccctgatccgcaaccaagtgccactactgctacagcttcacaaccacagcagcaggcaaacatccagaatcaatccaccggagtccaaacttacacaccactgcagtctctgcagccaggaactgctggccctgtagtccttcgtacgcagcccaggttcagctggtaccgagcattccttgctgcagggctgttgcttggttttggtgccagtgctgctgtctttatcaagaaactgttccttcccaggctcaagtcttggatacgcaaagttgtagcagaaggcgatgaaactcaaggcaaccaacttaaggccaagattgatgaggaaacggcagaggctgtaaaggcttctgcgtctgctgtttctgctattgct

SEQ ID NO: 21939 - protein, 211 aa, Panicum virgatum
  misc_feature: Ceres CLONE 1818943
  misc_feature (40)..(170): Pfam Name: Pex14_N Pfam Description: Peroxisomal membrane anchor protein (Pex14p) conserved region
MASATGSGSGQQQFPSTAAADADPGAGADKLVFEAASQPMREDYVENAVKFLSHPKVRGSPVVYRRSFLEKKGLTTQEIDEAFRRVPDPQPSATTATASQPQQQANIQNQSTGVQTYTPLQSLQPGTAGPVVLRTQPRFSWYRAFLAAGLLLGFGASAAVFIKKLFLPRLKSWIRKVVAEGDETQGNQLKAKIDEETAEAVKASASAVSAI

SEQ ID NO: 21940 - DNA, 686 bp, Panicum virgatum
  misc_feature: Ceres CLONE 1818956
  misc_feature: Encodes the peptide sequence at SEQ ID NO. 21941
gtttcttaaagcttttcccttctctcggactctctcctcccttgctcttccttccccggcggcgacgactgggcgagcggcggcgccattcgtcctgtcttctccctgccctttgccggcgatgagcgcatcctccagggttctttgcaagttcttcatgcatggagcttgcttgaaaggagagtattgtgagttctcccatgactggaaagatcaagcgaataatgtttgcacattctaccagaaaggtgcatgctcatatggtagccgttgcagatatgaccatgtcaaagtttctcgtaaccctacagtgcctctgccatcaccatcaccatcgtcaagtactgcaagacttgcgtctacttctcgtcaactttcaagtttcggtcatcctcctcgcacgggacaccaaacagattcaagcactcaaagaaatcagatatctgtggatgtgccagcacattctgccagtaagcctgcatggagaaatgattttcaacatgttgtttcagaggatggaattgactggtcctctaaccaaactttgcaaaaccagacatcattgaaacctgctgatcttcctatttgttcttttgctgctgctggcaattgtccttatggggaaaggtgccctcaaatgcatggagatctttgcagtacctgtggaaaaatgtgcttgcatcctt

SEQ ID NO: 21941 - protein, 188 aa, Panicum virgatum
  misc_feature: Ceres CLONE 1818956
  misc_feature (32)..(57): Pfam Name: zf-CCCH Pfam Description: Zinc finger C-x8-C-x5-C-x3-H type (and similar)
  misc_feature (151)..(176): Pfam Name: zf-CCCH Pfam Description: Zinc finger C-x8-C-x5-C-x3-H type (and similar)
MSASSRVLCKFFMHGACLKGEYCEFSHDWKDQANNVCTFYQKGACSYGSRCRYDHVKVSRNPTVPLPSPSPSSSTARLASTSRQLSSFGHPPRTGHQTDSSTQRNQISVDVPAHSASKPAWRNDFQHVVSEDGIDWSSNQTLQNQTSLKPADLPICSFAAAGNCPYGERCPQMHGDLCSTCGKMCLHP

SEQ ID NO: 21942 - DNA, 2100 bp, Panicum virgatum
  misc_feature: Ceres CLONE 1818984
  misc_feature: Encodes the peptide sequence at SEQ ID NO. 21943
aggaaaaaaaaccacaagtcttcctgccagctcgcaaccacaaaccctagtcgctcctcgcgactcagacgacgggctcgattcgttcctgtgtcctgttggcttcgctcaagcctgtatcttttactgcaacactatgaactcccctggcgctggaaggcggattccgaagaggcgacggacgactaagccgctttcacagccttttgacctgaactgcccccctgctgaaggggctggtgaggggggttcacctttcagcattatgcctgtctcacacatccaggcttccagcagtatgcctgtctcacacagccaggcttccagtagcatgccacctgctactaatgagccacatattggcatgcatagttgccccattgatgtggaagccattgatgatgatgttgttatctattcttcaagatcactccctcaagtatgttattgtgcctttttctagtctctatttgtacatttgcatatttattttagtcaaattttgtttcttatatgattgtttaaagcggaagaatgacactgataatcaagttgtttgctttaaagtttcaggcaagacaacagtcgaccaggactgaacgtattactgtgataatagatgatgattctgaaacgaacccagaaccagcaggtttgatgatatccccagcatgaattctttgaagcattccagtcatttgaatgcaactgtctagttattttgtactcataattttcattttacatacagtagtatatagttctactctgctggactgccctcttcactctctagtagttgtgatgttttgcctgctattcatgatgtaacttctgttactcacagttcagcttgctaagcataaaaagaattgcgatgtgtgttagtacgtcataatgtagctccttttttttatgtggctacttgttagatgcccatgcaactacagaatcttattgatatgtctgatattccacatggtagcaagttagcacttcatgtactgcaatcatagatgtctttcaatgggctgaatttgaaagtaagacttgaaccccaaaaatctggttggcattgttcgtcttgaaggtgaatagcatgagcatgttcacataaccattctgtgttgcgtagtggtgttggatatcaatgtatacaagaactgtcgtagtaaaagctgtgtgaccatggagcatggtattattaatcttttcccgtttcagttggtttggttcagtctgcctcgtgaaattttggtttgcctggtcagttgtggatgcactaagtgtttaggtaatatgatcatagccttagtaatgcatttccttttctaagaaaataagtgttaaatatcaccttatagatttttgttcttaattttgctcaagtatgctaagcttgtagaaatgtaatctaaaagacaacatattcgtttctgtttcatatatgataacttggcatatgttgcattctttttaggggatgctcttgatgagcatgtgaatacactgctatccctgggcataaaccgtaggaatctgcctctaagaccaattagcacttgccctgtaataagtttagtggacactccagaagttaaggcaccccctgaacctgtgaaggaggttcccaaggagccaaagttcacctgccctatatgcatgaatgagctgacagaagcagcatccactgtctgcggtcacattttctgccagaagtgcatcaaggctgccattcaggctcagaagaagtgccctacctgccgaaagagccttaataaaaaccagcaccaccgggtatacctcccgacaacggagtaatccgatagtcattttggagcaagctgtgcagcacctgaccttcaccacattgtggcgattgtatggcggagctatttagagaggcttatcgatagcaatagagtattactgtgatttaacaagtggttttgccctcgcatgtgggacatcatgccaagctgtatcctcagtaaggtatatcctagtatcatctggatgtgggtgttattatgttcgacgcagtatcttatcctttctgtttgggatgtgaaatgtggtgcgacgtgaagttttgctggt

SEQ ID NO: 21943 - protein, 52 aa, Panicum virgatum
  misc_feature: Ceres CLONE 1818984
  misc_feature (1)..(34): Pfam Name: zf-C3HC4 Pfam Description: Zinc finger, C3HC4 type (RING finger)
  misc_feature: The sequence is a functional homolog of SEQ ID NO 2446 in the 10/374,780 US patent application
  misc_feature: The sequence is a functional homolog of SEQ ID NO 736 in the 10/225,066 US patent application
MNELTEAASTVCGHIFCQKCIKAAIQAQKKCPTCRKSLNKNQHHRVYLPTTE

SEQ ID NO: 21944 - DNA, 701 bp, Panicum virgatum
  misc_feature: Ceres CLONE 1818999
  misc_feature: Encodes the peptide sequence at SEQ ID NO. 21945
tcccgattccaaagccgctctcgcccccaaaaataaagcagctcctcccgggggcggcgaacaactccccatcgccaaaaccctagccccgatccgatcgaggagcactgcttccttcccatggcgggcaccgctagccaggcgagcctcctgctccagaagcagctcaaagatctcgcgaagaaccccgtggatgggttctctgccgggctggtggatgatagcaacgtcttcgagtggcaggtcaccatcatcggcccgcctgacaccctatatgacggaggctacttcaatgcaataatgaccttccctcagaattatcccaacagcccaccatctgtgagatttacttctgagatgtggcatccaaatgtttatcctgatgggcgtgtgtgcatttctattcttcatccacctggtgaagatcccaatggctatgaacttgcaagtgaacggtggacaccagtgcacacggtaggcttcttataaggcaacataatgtttctcccgctatttacttttacagggcagggttttttctgtgtgatccttttatatactgttaaactcaatcaattaaccctgcattgtgtggtgcatgcctgagtgtctgggtgtgttgcgcgcgcgcatgtgtgtggggtgtgtgtgtcttggtgacgttctggttaatgtagtgtgttcaggtgtaattttgttgg

SEQ ID NO: 21945 - protein, 122 aa, Panicum virgatum
  misc_feature: Ceres CLONE 1818999
  misc_feature (11)..(122): Pfam Name: UQ_con Pfam Description: Ubiquitin-conjugating enzyme
  misc_feature: SWISSPROT Homolog: EC 6.3.2.19 Ubiquitin--protein ligase
MAGTASQASLLLQKQLKDLAKNPVDGFSAGLVDDSNVFEWQVTIIGPPDTLYDGGYFNAIMTFPQNYPNSPPSVRFTSEMWHPNVYPDGRVCISILHPPGEDPNGYELASERWTPVHTVGFL

SEQ ID NO: 21946 - DNA, 722 bp, Panicum virgatum
  misc_feature: Ceres CLONE 1819002
  misc_feature: Encodes the peptide sequence at SEQ ID NO. 21947
cttgccgcacagcgccccttcccgcatccccctcccgccgccgcccccgcctccgcgccgccgcccccgccggagaagatgggtcgcgtcatccgcgcgcagcgtaagggtgcggggtccgtgttcaagtcccacacccaccaccgcaagggccccgcccggttccgctccctcgactttggcgagcgcaacgggtacctcaagggcgtcgtcaccgacgtcatccacgacccgggccgcggcgcgccgctcgccaaggtcaccttccaccaccccttcaggtacaagcaccagaaggagctcttcgtcgccgcggagggcatgtacacgggccagttcgtgtactgcggccgccgcgccacgctctccatcggcaacgtgctgccgctccgcgggatccccgagggtgccgtcgtctgcaacgtcgagcaccacgtcggcgaccgcggcgtcttcgccagggcctccggggactacgccatcgtcatcagccacaaccctgacaacggaacctccaggattaagctcccctctggtgccaagaagattgtccccagcagctgccgtgccatgatcggtcaggttgctggtggaggcaggactgagaagcccatgctgaaggctggtaacgcttaccacaagtaccgcgtgaagaggaactgctggccgaaggtccgtggtgtggccatgaaccctgtggagcatccccacgaaggaggtac

SEQ ID NO: 21947 - protein, 214 aa, Panicum virgatum
  misc_feature: Ceres CLONE 1819002
  misc_feature (96)..(214): Pfam Name: Ribosomal_L2_C Pfam Description: Ribosomal Proteins L2, C-terminal domain
  misc_feature (11)..(90): Pfam Name: Ribosomal_L2 Pfam Description: Ribosomal Proteins L2, RNA binding domain
  misc_feature: Useful for making plants with modulated nitrogen use efficiency
MGRVIRAQRKGAGSVFKSHTHHRKGPARFRSLDFGERNGYLKGVVTDVIHDPGRGAPLAKVTFHHPFRYKHQKELFVAAEGMYTGQFVYCGRRATLSIGNVLPLRGIPEGAVVCNVEHHVGDRGVFARASGDYAIVISHNPDNGTSRIKLPSGAKKIVPSSCRAMIGQVAGGGRTEKPMLKAGNAYHKYRVKRNCWPKVRGVAMNPVEHPHEGG

SEQ ID NO: 21948 - DNA, 615 bp, Panicum virgatum
  misc_feature: Ceres CLONE 1819010
  misc_feature: Encodes the peptide sequence at SEQ ID NO. 21949
accgactttcgatcatacggactcgaaagacatactacctcttgcttgactgcaccgccagtccgccatggcgactaccttcgctcgaacatctctccgcaatgaagccgcgggcgctcgaacccgtcgggaaaccgccggggggagcgcaaacgctccccgctgctggcggggagatccatccggccctgtcttcttcttccttttgccccggctcatgactgaagatccattggtcaactacattcgcgccgacaacaattgagaggtgcccgtctgaacttcccggaccatcacagcggtcggcaggagggcgtccagacgtcctccgcgcccgacctgccgaagccgctcctcaacacacggagctggtaacgaatgccgccgctcgggggcataatgggttcacggcaatccaccctcatggagcgcctaggctcctcccccttctccatccgcgacgtctctgtcgcgcccacgctctgcatgctcatcgtcgctgtaggacccatcgtattcgacttcacctgcgcatactactcgcccacccaggacgccactgattgctgacctcggtctcatcctctccgagttttccctgtccggatcactgac

SEQ ID NO: 21949 - protein, 63 aa, Panicum virgatum
  misc_feature: Ceres CLONE 1819010
  misc_feature: Useful for biocontainment applications
MPPLGGIMGSRQSTLMERLGSSPFSIRDVSVAPTLCMLIVAVGPIVFDFTCAYYSPTQDATDC

SEQ ID NO: 21950 - DNA, 623 bp, Panicum virgatum
  misc_feature: Ceres CLONE 1819012
  misc_feature: Encodes the peptide sequence at SEQ ID NO. 21951
gggacctcgtgccgcgtccatctggttgcaatgttttgactggcaagtggatctggacgcataagcgtcgggctgatggcacgctggagcgctacaaggctcgctgggttttccgggggttcactcagcggcctggtgtggactatgatgagaccttcagcccagtcgtgaagcccgctacggtgcgcacggtcctctcgcttgcgctatcgcgctcttggtctgtgcaccaactggacgtgaagaatgtgtttcttcacggcactctgtcagagactgtctactgctatcagccagcgggatttgtggattcgagtcgtccggatatggtctgccggctcaacaagtctctctatgggctgaagcaggctcctcgggcttagtactctcggttcgccacgttcttgctgacattggggttcaccgaggccaagtctgacacgtctctcttcgtctaccgccgtggggatgagacttcctatctgctgctatacgtcgacgacattgtgctcacagtctccagtcagcggttgcttcagagtgtcatctcctctctgcagcaggagttcgctatgaaggatctcggtcagctccaccactttctgggcgtcactgttgagcct

SEQ ID NO: 21951 - protein, 126 aa, Panicum virgatum
  misc_feature: Ceres CLONE 1819012
  misc_feature (1)..(126): Pfam Name: RVT_2 Pfam Description: Reverse transcriptase (RNA-dependent DNA polymerase)
  misc_feature: SWISSPROT Homolog: EC 2.7.7.49 RNA-directed DNA polymerase
DLVPRPSGCNVLTGKWIWTHKRRADGTLERYKARWVFRGFTQRPGVDYDETFSPVVKPATVRTVLSLALSRSWSVHQLDVKNVFLHGTLSETVYCYQPAGFVDSSRPDMVCRLNKSLYGLKQAPRA

SEQ ID NO: 21952 - DNA, 599 bp, Panicum virgatum
  misc_feature: Ceres CLONE 1819014
  misc_feature: Encodes the peptide sequence at SEQ ID NO. 21953
gagaggcaacctccggtcggtttcttcccacgccgctaatggcgtccccggcatccgcctcggcgcggcccctatccctaaccctaaccggaccattcccccgttattcctcgcgcgtcctacccttgccttcctcccgcctcctcccgagccgccgcgtcacgctagcgccggggcggcctgacgccgcgctcctctccagcctcagcgacgcgcgggagcaggatgaggaggaagaagaggaattctacgaggatggggatgaacggcaggaataccacgacgaccaggaagaacaggaatacgaccaggaggacgaggagctggtggaggtgggctacgtgtccggcgcgcacggggtgcgcggcgacgtcctcgtcacgccacgcaccgacttccctgagctccgcttcgccacgccggggacgcgatggctgagggctcgggctgctgggaaacaacacgtcagggaattcgagcttgttcgaggaagggcccacacggggaagaagtgttggatcgtcagctttgatggcatcgataatctggatgaggctaggcaaatagtcggttcagctatactcgtgaaagctggagat

SEQ ID NO: 21953 - protein, 186 aa, Panicum virgatum
  misc_feature: Ceres CLONE 1819014
  misc_feature (98)..(185): Pfam Name: RimM Pfam Description: RimM N-terminal domain
MASPASASARPLSLTLTGPFPRYSSRVLPLPSSRLLPSRRVTLAPGRPDAALLSSLSDAREQDEEEEEEFYEDGDERQEYHDDQEEQEYDQEDEELVEVGYVSGAHGVRGDVLVTPRTDFPELRFATPGTRWLRARAAGKQHVREFELVRGRAHTGKKCWIVSFDGIDNLDEARQIVGSAILVKAG

SEQ ID NO: 21954 - DNA, 548 bp, Panicum virgatum
  misc_feature: Ceres CLONE 1819015
  misc_feature: Encodes the peptide sequence at SEQ ID NO. 21955
acgtgtctttgacgcatctctgtgggtttccgcagtggcagcaggcgatgggatctcacgccgcgggcgggagccaggcgccaccgccgccggcggcggcggcggcggcggcggcgggaggaggcgagacgcagcggacgcagtatccgtatgtgactggtacttctgtcattgccttgaagtacgaggatggtgtgatcatggcatgtgatactggagcctcctatgggtcaactttgagatacaagagtgtggaacgcattaaggcagttggtaagcataccctcattggagcaagcggagagtacagtgatttccaggagattttgcgctatctcgatgaactaactttgtctgatcatatgtgggatgatgggaactctttgggcccgaaagagatccacagttatttgacaagggtaatgtacaacagacgcaacaagtttgatcctctctggaacacccttatccttggtggagttaaaaagggcccaaagggcgatgagaaatatcttgggatggttaacatgattggtacccactttgag

SEQ ID NO: 21955 - protein, 181 aa, Panicum virgatum
  misc_feature: Ceres CLONE 1819015
  misc_feature (50)..(180): Pfam Name: Proteasome Pfam Description: Proteasome A-type and B-type
  misc_feature: SWISSPROT Homolog: EC 3.4.25.1 Proteasome endopeptidase complex
VSLTHLCGFPQWQQAMGSHAAGGSQAPPPPAAAAAAAAGGGETQRTQYPYVTGTSVIALKYEDGVIMACDTGASYGSTLRYKSVERIKAVGKHTLIGASGEYSDFQEILRYLDELTLSDHMWDDGNSLGPKEIHSYLTRVMYNRRNKFDPLWNTLILGGVKKGPKGDEKYLGMVNMIGTHF

SEQ ID NO: 21956 - DNA, 1583 bp, Panicum virgatum
  misc_feature: Ceres CLONE 1819041
  misc_feature: Encodes the peptide sequence at SEQ ID NO. 21957
agtcgccgcaagatcttccaagcttcgtcctcctcccttcgcttggctcggggtcgctgctccgaaattccccaaaaccaggaaaaccctcctcccttttcccgcggcatccactctttcaaaatcctcacgcatccgtcctagcctctacgccctccagtcctagcgcctcgcgtcgcctccgcaccctagggtttccccgccgccggccatgaaggcggtggtcgtcgacgcgggctccaagctgctcaaggccggcatcgcggcgcccgaccagttgcccccgctggtgatgccgtcgaagatgaagctggaggtcgaggaccagcaactcgcggacggcgcggtgatggaggaggtggtgcagccggtggtgcgcggcttcgtcaaggactgggacgccatggaggacctgctcaactacgtcctttacaggaacattggctgggagattggggacgagggtcagatcctcttcaccgagccactcttcacgcccaagactcttcgcgagcaattagtgcagcttatgtttgagaaattcaacgtttcaggcttttatgcctctgaacaggctgtattgtcactctatgctgttggacgcatttcaggatgcacagttgacattgggcatgggaaaatagatatcgctccagtttgtgaaggagctgttcaacatgtagcatcaaagagattggagattggaggaggtgacttgacaaatctgtttgcacaagaactgaaaaaatctaatccatcagtaaatcttgatacttctgatgttgagaggctgaaagagcaatacgcatgctgcactgaagatcagttggcctttgaagatatagaaagctcatgccagccagaaaggcacactcttcctgatgggcaggttataacaattgaaaaagagcggtatattgttggtgaagctttgtttcaaccaagtattttgggtttggaagattatggtatcgttcaccaactagttaccagtgtctcaaatgtttcatcagaataccatcggcagctgctagaaaacaccatgttatgtggtgccactgcatcgatgactggttttgaagacagattccaaagagaagcaaatctttctgcttcagcaatttgcccatctcttgtaaagcccccagaatacatgcctgagaacctagcaaggtactcggcctggatgggtggtgcgatactggccaaggttgtcttccctcagaaccagcatgtcaccaagggcgagtatgatgagactggcccatccattgtgcataagaagtgcttttagaaacagccgccttgacttggcacggtgctgatgctgggatctacaacttactgcactgagctcaccccaacctgcagcgccaatgcccttcggcgctgctgttctcagcttttcgtggtcttttcatgcatccggccctctggccaggtgaggttgtattgcccctaggttatttggagtgcagtagattgtaagattaactctatttgtttggtgttgtagccaattgttcaattgtacctgtagtatcagaaagtttcctaaaataattatttgcaatttgcattat

SEQ ID NO: 21957 - protein, 360 aa, Panicum virgatum
  misc_feature: Ceres CLONE 1819041
  misc_feature (2)..(360): Pfam Name: Actin Pfam Description: Actin
  misc_feature: SWISSPROT Homolog: EC 2.7.10.2 Non-specific protein-tyrosine kinase
MKAVVVDAGSKLLKAGIAAPDQLPPLVMPSKMKLEVEDQQLADGAVMEEVVQPVVRGFVKDWDAMEDLLNYVLYRNIGWEIGDEGQILFTEPLFTPKTLREQLVQLMFEKFNVSGFYASEQAVLSLYAVGRISGCTVDIGHGKIDIAPVCEGAVQHVASKRLEIGGGDLTNLFAQELKKSNPSVNLDTSDVERLKEQYACCTEDQLAFEDIESSCQPERHTLPDGQVITIEKERYIVGEALFQPSILGLEDYGIVHQLVTSVSNVSSEYHRQLLENTMLCGATASMTGFEDRFQREANLSASAICPSLVKPPEYMPENLARYSAWMGGAILAKVVFPQNQHVTKGEYDETGPSIVHKKCF

SEQ ID NO: 21958 - DNA, 1518 bp, Panicum virgatum
  misc_feature: Ceres CLONE 1819049
  misc_feature: Encodes the peptide sequence at SEQ ID NO. 21959
ggaacggcagcgtgttggtgccggtgccaccgtccgagtagcgtcgacggcggtttgggcaattgtgcgtgggtgtcagagcgaaagcggagcgagagggagctgggggagggatggaggcgctgaggaagcaggcgagcaagttcaaggagcaggtcgccaagcagcagcaggctgttataaagcagttcagtactactggttatgagcactcagattctgttgtaattgatgaggttgaactacagagacatctacagcttgacaaattgtatagctctactcgttctggaagggatttccagaaggacattgttagagcagctgaaggtttggtatctattggaaacaagcatattgaagtgggaacaaaattttcggaggactgctatagatatggaggtgaaaataatgcaagtgatgaagcccttgcaaaagctgcatcattatacggaggtgctttgagaaatattgagaaagagtatgaagatttcaacaaaactttatcttcccagactatagacccattgaaggcaatgtctatgggcacacccctggaagatgctcgtggccttgcacagcgttatagccggatgagacatgaagctgagatcctttctgctgaaattgctagaagaaaggcacgggtcagagaagctccaattccggagcacactacaaagcttcaacagtctgaagctaaaatgatagagcacaaagctagtatggctgtgttaggaaaggaagcagcagctgcacttgcggctgttgaatctcagcagcaacgggtaacccttcagcggctggttggcatggtagaagcagaaaaattattccatctgagattagctgcaatacttgatgatgttgaggctgagatgtcctctgagaagcaaaagagagaatccgcgccacctattatatcttctcataagcgtgctgagaaatcccaatatttccttgctgaggcagtgcataacttcaatggaaccacagataaggaactgagcttaattgttggcgattatgttgttgttcgtcagattgctcccaatggttgggctgaaggagaatgccgagggaaggccgggtggttcccggctgcctatgttgagcggcgtgaaaatatcccacccaataaagttttcccacaagcataagatcataagcctgtcatctgtttccactgtgcagtgcttactggtagcaaataacattccttgacgtcaatgcacagtttggcattagggagccgtaagtctgtgtaacttgtgaaccgtttgatgcttgtatcttgtacatcttatactctggttgtggtctagactttagagaaggcctgtctgcacactgtgcctgcaagcacactgaagatttcgccttgcgtatgtataactacccttgatgtatccatcatgtgatcgcggaagcataggtcgaagactgagcctatcccttcctctgctactgacgcctttcgaatgtaaagtgattcttgatccgttttttctttttgcc

SEQ ID NO: 21959 - protein, 348 aa, Panicum virgatum
  misc_feature: Ceres CLONE 1819049
  misc_feature (282)..(336): Pfam Name: SH3_1 Pfam Description: SH3 domain
MEALRKQASKFKEQVAKQQQAVIKQFSTTGYEHSDSVVIDEVELQRHLQLDKLYSSTRSGRDFQKDIVRAAEGLVSIGNKHIEVGTKFSEDCYRYGGENNASDEALAKAASLYGGALRNIEKEYEDFNKTLSSQTIDPLKAMSMGTPLEDARGLAQRYSRMRHEAEILSAEIARRKARVREAPIPEHTTKLQQSEAKMIEHKASMAVLGKEAAAALAAVESQQQRVTLQRLVGMVEAEKLFHLRLAAILDDVEAEMSSEKQKRESAPPIISSHKRAEKSQYFLAEAVHNFNGTTDKELSLIVGDYVVVRQIAPNGWAEGECRGKAGWFPAAYVERRENIPPNKVFPQA

SEQ ID NO: 21960 - DNA, 1648 bp, Panicum virgatum
  misc_feature: Ceres CLONE 1819062
  misc_feature: Encodes the peptide sequence at SEQ ID NO. 21961
ccactccgccgtgcctcccgtcgcttcctccgccgcgctccgaccgcccgtgcgccgcgcgctcccgttcgtgctggtgggcggccggccccgtcgaggagatggactcggtcatgaccgcccccgacgcgccgccgccggccgtcgtgctcgtctccgccggcgccagccactccgtcgcgctgctcacgggcaatgcgctgtgctcgtggggcaggggcgaggacgggcagctcgggcacggcgacgcggaggaccggctcgtgcccacggtgctgagcggcttcgacgcgcccgggatcacgtcggtcatctgcggcgccgaccacaccaccgcctactccgaggaggagctgcaggtctacagctgggggtggggagacttcgggaggctggggcatggcaactccaccgacgtcttcacgccccagccagtcaaggcgctgcaggggctcaagatcaagcagattgcctgcggggacagccattgtctcgccgtcaccatggccggagaagtgcagagttggggccgtaaccaaaatggacagctaggatttggaactactgaagactcgctgctcccacaaaagattcaggcttttgagggtgtttgtgtgaaaatgattgctgctggtgctgagcatactgctgcagtaactgaagatggtgacctctatggatggggctggggtcgatatggaaacctaggtcttggggaccgtaatgatcgtctgtttccagaaaaagtatcttctgtggagggtgagaagatggtgcttgttgcatgtggatggcgccataccattactgtttctgaatctggtactacgtacacttacggttggagcaaatatggtcaactgggacatggtgattttgaagatcatttagttccacgtaaacttgaagctttgaaagatagcactatatcccagatttcaggtggttggaggcatacaatggcacttacattggagggaaagctttatgggtgggggtggaacaagtttggacaagttggagttggcaacaatgatgatcactgttccccagtacaggttcattttccagaggaacagaaaatttcccaagttgcttgtggatggagacatacgcttgccctttccgaaaagaaaaatgttttctcctggggaaggggcactagcggacagcttggcaatggagaaatagtcgacaggaacacgcctgtgctgattgatgccttaagcccagacggttctggctgcaagaagttagagtcatccacagcagctccattcacagccaaagtctgggtctccccgtcagagagatacgcaatagtccctgatgaaaacgttccgaaatcaggcgaaggcaccgcgcgcggcaacggggcggacgcgaacgtgccggagaacgatgtaaagaggatgcgcgtgcagtcgtagctctaccatctcctcccctaaccctagtaccactataaaggaagaactggtgcccttagtctccgctgttcccatccagcggtgtccgattttgtgcatcccgttcagcccaagtgctctctcttctctatctctctcggtccacgaacctcctgctgttgagacctgggatggtgacattgtctctcctggtgttaagaagtaagaacttcgatcag

SEQ ID NO: 21961 - protein, 442 aa, Panicum virgatum
  misc_feature: Ceres CLONE 1819062
  misc_feature (292)..(341): Pfam Name: RCC1 Pfam Description: Regulator of chromosome condensation (RCC1)
  misc_feature (188)..(237): Pfam Name: RCC1 Pfam Description: Regulator of chromosome condensation (RCC1)
  misc_feature (136)..(185): Pfam Name: RCC1 Pfam Description: Regulator of chromosome condensation (RCC1)
  misc_feature (84)..(133): Pfam Name: RCC1 Pfam Description: Regulator of chromosome condensation (RCC1)
  misc_feature: SWISSPROT Homolog: EC 2.7.11.1 Non-specific serine/threonine protein kinase
MDSVMTAPDAPPPAVVLVSAGASHSVALLTGNALCSWGRGEDGQLGHGDAEDRLVPTVLSGFDAPGITSVICGADHTTAYSEEELQVYSWGWGDFGRLGHGNSTDVFTPQPVKALQGLKIKQIACGDSHCLAVTMAGEVQSWGRNQNGQLGFGTTEDSLLPQKIQAFEGVCVKMIAAGAEHTAAVTEDGDLYGWGWGRYGNLGLGDRNDRLFPEKVSSVEGEKMVLVACGWRHTITVSESGTTYTYGWSKYGQLGHGDFEDHLVPRKLEALKDSTISQISGGWRHTMALTLEGKLYGWGWNKFGQVGVGNNDDHCSPVQVHFPEEQKISQVACGWRHTLALSEKKNVFSWGRGTSGQLGNGEIVDRNTPVLIDALSPDGSGCKKLESSTAAPFTAKVWVSPSERYAIVPDENVPKSGEGTARGNGADANVPENDVKRMRVQS

SEQ ID NO: 21962 - DNA, 1512 bp, Panicum virgatum
  misc_feature: Ceres CLONE 1819070
  misc_feature: Encodes the peptide sequence at SEQ ID NO. 21963
aagcagaactccatcctcctcgtcctccccgtgcgtgctgccgtgggggcggaggtccatccaccgtccaggccgggcaacctctccacccgcccgctggtgcatttgatccacgagcggcggcggcggcggcgaggggttcacgatgtcaaaggcaggagccctggatcttgcgtctggccttggagggaagataaacaaggcggaagttaagtcggcagtcgatgagtatgagaaatatcatggatattatggagggaaggaggaagcaagaaaatccaactacactgatatggttaataaatattatgatctagccactagcttctacgagtatggttggggtgaatccttccactttgctcacagatggagtggagaatccttacgtgaaagcatcaagcgacatgagcattttcttgctctgcagcttggtttgaaaccaggaatgaaggttttggatgtgggctgtggaataggtggaccactacgagaaatttcaagatttagctcaacttcagttattgggttgaataacaacgattaccagataaccaggggaaaggagctcaatcggttggcaggagttagtggaacctgtgattttatcaaggcagacttcatgaagatgccatttgacgacaacacttttgatgctgtttatgccattgaggcaacatgtcacgcacctgatccagttggctgctataaggagatatatcgtgtattgaagcctggtcagtgctttgctgtatatgagtggtgcattactgatcactatgatccaaacaatgcaacccataaaaggattaaggatgaaattgagcttggcaatggcctgccagatattagaagcactcggcaatgtcttcaggcggtaaaagatgctgggtttgaggttgtttgggataaggatcttgccgaagattcccccttgccttggtacttgcccttggatccaagccgattttccttaagtagcttccgtttgacgtctgtgggacgtatggtcactcgcacaatggtcaaggcgttggaatacattggtcttgctccacaaggcagtgagagggtctccaatttcctagagaaggctgcagaaggtcttgtagagggtggcaagaaggaaattttcacgccaatgtacttctttctggttcggaagcctcttacagaatgagcccttcggagcacatttcagagagaaagcaaggagtaattgcgaggaagctgaatgaagatgcagaatgagaaagctgtgatcaagatactggagttagctgtgatcaagatactggagttcttctccctaggaaaagtagtggaatatgctaactgttgagcatatgtttgttcagttgttttgtttgcgtgagcttccttggtatagtatttgtgctgttcttggactgacaatttgaaccccttttcttgtcctaagctcagtagtataaaataagttggcttatacaattcctttgattgatgtactaaatgtcgaaataattttgg

SEQ ID NO: 21963 - protein, 344 aa, Panicum virgatum
  misc_feature: Ceres CLONE 1819070
  misc_feature (212)..(341): Pfam Name: Sterol_MT_C Pfam Description: Sterol methyltransferase C-terminal
  misc_feature (105)..(203): Pfam Name: Methyltransf_11 Pfam Description: Methyltransferase domain
  misc_feature: SWISSPROT Homolog: EC 2.1.1.41 Sterol 24-C-methyltransferase
MSKAGALDLASGLGGKINKAEVKSAVDEYEKYHGYYGGKEEARKSNYTDMVNKYYDLATSFYEYGWGESFHFAHRWSGESLRESIKRHEHFLALQLGLKPGMKVLDVGCGIGGPLREISRFSSTSVIGLNNNDYQITRGKELNRLAGVSGTCDFIKADFMKMPFDDNTFDAVYAIEATCHAPDPVGCYKEIYRVLKPGQCFAVYEWCITDHYDPNNATHKRIKDEIELGNGLPDIRSTRQCLQAVKDAGFEVVWDKDLAEDSPLPWYLPLDPSRFSLSSFRLTSVGRMVTRTMVKALEYIGLAPQGSERVSNFLEKAAEGLVEGGKKEIFTPMYFFLVRKPLTE

SEQ ID NO: 21964 - DNA, 729 bp, Panicum virgatum
  misc_feature: Ceres CLONE 1819074
  misc_feature: Encodes the peptide sequence at SEQ ID NO. 21965
aaccttccctgcctcacaaacaactccaccctgtcatttagccctgttctggtaccagctgggtcttcactcctgctctgccgtttcaactagggggtgccagaagtgatcgactgcaggtatgggcaacttgtgctgctgtgttcaagttgatcagtcaaccgtggccatcagggagcagtttggcaagtttgacagcgtgcttgagccaggatgccactgcttgccttggttcatcggcaagcgtgtagctggtcatctcacactcaggctgcagcaactggatgtgcgctgtgagaccaagactaaggacaatgtctttgtgaacgtcgtggcatctattcagtaccgtgctctggctggcaaagcaagtgatgcgttctacaaactgagcaacacaaggtcccagatccaagcatacgtctttgatgttatccgagcaagcgttcccaagctcattttagatgacgctttcgagcagaaggatgagatcgcaaaggcagtggaggaggaactcgagaaggccatgtcagcttacggctttgagatcgtgcaaactctgattgtggacattgagccagatgagcacgtgaagcgcgcaatgaatgagatcaacgcagcggcgaggctgagggtggctgcgaacgagaaggccgaggcggagaagatcgtgcagatcaagcgcgcggaggctgaggcggaggcccagtacctgtccgggctgggcat

SEQ ID NO: 21965 - protein, 202 aa, Panicum virgatum
  misc_feature: Ceres CLONE 1819074
  misc_feature (8)..(182): Pfam Name: Band_7 Pfam Description: SPFH domain / Band 7 family
MGNLCCCVQVDQSTVAIREQFGKFDSVLEPGCHCLPWFIGKRVAGHLTLRLQQLDVRCETKTKDNVFVNVVASIQYRALAGKASDAFYKLSNTRSQIQAYVFDVIRASVPKLILDDAFEQKDEIAKAVEEELEKAMSAYGFEIVQTLIVDIEPDEHVKRAMNEINAAARLRVAANEKAEAEKIVQIKRAEAEAEAQYLSGLG

SEQ ID NO: 21966 - DNA, 683 bp, Panicum virgatum
  misc_feature: Ceres CLONE 1819082
  misc_feature: Encodes the peptide sequence at SEQ ID NO. 21967
acgcctcccaacccctctctcctctgctcccaagatctcctcatctcccggcccggcagcagcgcgcgtgggggcagagagatcgagatccggaggtcgagatccggaggaggcgcggcacctcgcggcaccagcaatggcgggcacggtgacggtcccgggggcgaacgtcccctccacgccgctgctcaaggacgagctcgacatcgtgatcccgacgatccgcaacctcgacttcctggagatgtggcggcccttcttccagccgtaccacctcatcatcgtgcaggacggcgacccgaccaagaccatcaaggtgccggagggcttcgactacgagctctacaaccgcaacgacatcaaccgcatcctcggccccaaggcctcctgcatctccttcaaggactccgcctgccgctgcttcggctacatggtctccaaaaagaagtacatctacaccatcgacgacgactgcttcgttgccaaggatccatctggcaaggacatcaatgctcttgagcagcacatcaagaacctcctcagcccatccaccccgttcttcttcaacacgctgtatgacccctaccgcgagggtgctgactttgtgcgtgggtaccccttcagcctcagggagggcgcccacactgctgtctcccacggcctgtggctgaacatccctgact

SEQ ID NO: 21967 - protein, 182 aa, Panicum virgatum
  misc_feature: Ceres CLONE 1819082
  misc_feature (13)..(182): Pfam Name: RGP Pfam Description: Reversibly glycosylated polypeptide
MAGTVTVPGANVPSTPLLKDELDIVIPTIRNLDFLEMWRPFFQPYHLIIVQDGDPTKTIKVPEGFDYELYNRNDINRILGPKASCISFKDSACRCFGYMVSKKKYIYTIDDDCFVAKDPSGKDINALEQHIKNLLSPSTPFFFNTLYDPYREGADFVRGYPFSLREGAHTAVSHGLWLNIPD

SEQ ID NO: 21968 - DNA, 638 bp, Panicum virgatum
  misc_feature: Ceres CLONE 1819084
  misc_feature: Encodes the peptide sequence at SEQ ID NO. 21969
gttcacgaaaagctcgcgccgcagaggaacacacaccaccgcgtcgccaccgagcttgcaacagaggcgccgcgcccggcccgtcgtcctcgtcttcattccgcgccgccggagcaagcaagggcgggcgacgggagaggaggggaggggagccttgtcttgtgacggccggccggcatggggaggtccccgtgctgcgagcaggcgcacacgaacaagggcgcgtggaccaaggaggaggaccagcgcctcgtcgcctacatcaaggcccacggcgagggctgctggaggtcgctccccaaggccgcagggctgctgcggtgcgggaagagctgccggctgcggtggatcaactacctgcggccggacctcaagcgcggcaacttcacggaggaggaggacgagctcatcatcaagttccacgagctcttcggcaacaagtggtcgctcatcgccgggaggctgccgggccggacggacaacgagatcaagaactactggaacacgcacatcaagcgcaagctcctcgcccgcggcatcgacccgcagacgcaccgcccgctcgccgccgccgccggcgcctcgccaggccaccaccagcagcagcagcattaccagctggaggcagcgcagaagcg

SEQ ID NO: 21969 - protein, 153 aa, Panicum virgatum
  misc_feature: Ceres CLONE 1819084
  misc_feature (67)..(112): Pfam Name: Myb_DNA-binding Pfam Description: Myb-like DNA-binding domain
  misc_feature (14)..(61): Pfam Name: Myb_DNA-binding Pfam Description: Myb-like DNA-binding domain
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 1002 in the 11/435,388 US patent application
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 1073 in the 10/374,780 US patent application
  misc_feature: The sequence is a functional homolog of SEQ ID NO 1004 in the 11/435,388 US patent application
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: Useful for making plants with altered alkaloid content
  misc_feature: Useful for making plants with altered lignin content
  misc_feature: Useful for making plants with modulated nitrogen use efficiency
  misc_feature: The sequence is a functional homolog of SEQ ID NO 1010 in the 11/435,388 US patent application
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: The sequence is a functional homolog of SEQ ID NO 2394 in the 10/374,780 US patent application
  misc_feature: The sequence is a functional homolog of SEQ ID NO 544 in the 10/225,066 US patent application
  misc_feature: The sequence is a functional homolog of SEQ ID NO 999 in the 11/479,226 US patent application
  misc_feature: The sequence is a functional homolog of SEQ ID NO 2564 in the 10/374,780 US patent application
  misc_feature: The sequence is a functional homolog of SEQ ID NO 276 in the 10/225,066 US patent application
  misc_feature: The sequence is a functional homolog of SEQ ID NO 818 in the 10/412,699 US patent application
  misc_feature: The sequence is a functional homolog of SEQ ID NO 122 in the 10/412,699 US patent application
  misc_feature: The sequence is a functional homolog of SEQ ID NO 126 in the 11/375,241 US patent application
  misc_feature: The sequence is a functional homolog of SEQ ID NO 148 in the 10/286,264 US patent application
  misc_feature: The sequence is a functional homolog of SEQ ID NO 34 in the 10/374,780 US patent application
  misc_feature: The sequence is a functional homolog of SEQ ID NO 438 in the 10/225,066 US patent application
  misc_feature: The sequence is a functional homolog of SEQ ID NO 1684 in the 11/479,226 US patent application
  misc_feature: The sequence is a functional homolog of SEQ ID NO 2582 in the 10/374,780 US patent application
  misc_feature: The sequence is a functional homolog of SEQ ID NO 30 in the 11/375,241 US patent application
  misc_feature: The sequence is a functional homolog of SEQ ID NO 854 in the 10/412,699 US patent application
  misc_feature: The sequence is a functional homolog of SEQ ID NO 824 in the 10/412,699 US patent application
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
  misc_feature: The sequence is a functional homolog of SEQ ID NO 2572 in the 10/374,780 US patent application
  misc_feature: The sequence is a functional homolog of SEQ ID NO 636 in the 10/225,066 US patent application
  misc_feature: The sequence is a functional homolog of SEQ ID NO 838 in the 10/412,699 US patent application
  misc_feature: The sequence is a functional homolog of SEQ ID NO 18 in the 11/375,241 US patent application
  misc_feature: The sequence is a functional homolog of SEQ ID NO 426 in the 10/374,780 US patent application
  misc_feature: The sequence is a functional homolog of SEQ ID NO 458 in the 10/225,066 US patent application
  misc_feature: The sequence is a functional homolog of SEQ ID NO 296 in the 11/479,226 US patent application
  misc_feature: The sequence is a functional homolog of SEQ ID NO 110 in the 10/412,699 US patent application
  misc_feature: The sequence is a functional homolog of SEQ ID NO 259 in the 11/479,226 US patent application
  misc_feature: The sequence is a functional homolog of SEQ ID NO 1041 in the 11/479,226 US patent application
  misc_feature: The sequence is a functional homolog of SEQ ID NO 112 in the 10/225,066 US patent application
  misc_feature: The sequence is a functional homolog of SEQ ID NO 20 in the 11/375,241 US patent application
  misc_feature: The sequence is a functional homolog of SEQ ID NO 2052 in the 10/374,780 US patent application
  misc_feature: The sequence is a functional homolog of SEQ ID NO 450 in the 10/412,699 US patent application
  misc_feature: Useful for making plants with altered carbohydrate content
  misc_feature: The sequence is a functional homolog of SEQ ID NO 134 in the 10/412,699 US patent application
  misc_feature: The sequence is a functional homolog of SEQ ID NO 321 in the 11/479,226 US patent application
  misc_feature: The sequence is a functional homolog of SEQ ID NO 1094 in the 10/225,066 US patent application
  misc_feature: The sequence is a functional homolog of SEQ ID NO 386 in the 10/374,780 US patent application
  misc_feature: The sequence is a functional homolog of SEQ ID NO 1052 in the 11/479,226 US patent application
  misc_feature: The sequence is a functional homolog of SEQ ID NO 456 in the 10/412,699 US patent application
  misc_feature: The sequence is a functional homolog of SEQ ID NO 271 in the 11/479,226 US patent application
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 58 in the 10/666,642 US patent application
  misc_feature: The sequence is a functional homolog of SEQ ID NO 442 in the 10/412,699 US patent application
  misc_feature: The sequence is a functional homolog of SEQ ID NO 136 in the 10/412,699 US patent application
  misc_feature: The sequence is a functional homolog of SEQ ID NO 325 in the 11/479,226 US patent application
  misc_feature: Useful for making plants with altered cell wall content and/or composition
  misc_feature: The sequence is a functional homolog of SEQ ID NO 168 in the 10/412,699 US patent application
  misc_feature: The sequence is a functional homolog of SEQ ID NO 377 in the 11/479,226 US patent application
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: The sequence is a functional homolog of SEQ ID NO 1011 in the 11/479,226 US patent application
  misc_feature: The sequence is a functional homolog of SEQ ID NO 434 in the 10/412,699 US patent application
  misc_feature: The sequence is a functional homolog of SEQ ID NO 148 in the 10/412,699 US patent application
  misc_feature: The sequence is a functional homolog of SEQ ID NO 2266 in the 10/374,780 US patent application
  misc_feature: The sequence is a functional homolog of SEQ ID NO 341 in the 11/479,226 US patent application
  misc_feature: The sequence is a functional homolog of SEQ ID NO 58 in the 11/375,241 US patent application
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 1901 in the 11/479,226 US patent application
  misc_feature: The sequence is a functional homolog of SEQ ID NO 310 in the 10/374,780 US patent application
  misc_feature: The sequence is a functional homolog of SEQ ID NO 842 in the 10/225,066 US patent application
  misc_feature: The sequence is a functional homolog of SEQ ID NO 569 in the 10/374,780 US patent application
  misc_feature: The sequence is a functional homolog of SEQ ID NO 1118 in the 10/225,066 US patent application
  misc_feature: The sequence is a functional homolog of SEQ ID NO 1396 in the 11/479,226 US patent application
  misc_feature: The sequence is a functional homolog of SEQ ID NO 2488 in the 10/374,780 US patent application
  misc_feature: The sequence is a functional homolog of SEQ ID NO 658 in the 10/412,699 US patent application
  misc_feature: Useful for biocontainment applications
  misc_feature: Useful for making plants with modulated biomass
  misc_feature: The sequence is a functional homolog of SEQ ID NO 1411 in the 11/479,226 US patent application
  misc_feature: The sequence is a functional homolog of SEQ ID NO 2492 in the 10/374,780 US patent application
  misc_feature: The sequence is a functional homolog of SEQ ID NO 52 in the 10/225,066 US patent application
  misc_feature: The sequence is a functional homolog of SEQ ID NO 1033 in the 10/412,699 US patent application
  misc_feature: The sequence is a functional homolog of SEQ ID NO 540 in the 10/374,780 US patent application
  misc_feature: The sequence is a functional homolog of SEQ ID NO 156 in the 10/412,699 US patent application
  misc_feature: The sequence is a functional homolog of SEQ ID NO 164 in the 10/412,699 US patent application
  misc_feature: The sequence is a functional homolog of SEQ ID NO 1754 in the 10/412,699 US patent application
  misc_feature: The sequence is a functional homolog of SEQ ID NO 1978 in the 10/374,780 US patent application
  misc_feature: The sequence is a functional homolog of SEQ ID NO 353 in the 11/479,226 US patent application
  misc_feature: The sequence is a functional homolog of SEQ ID NO 369 in the 11/479,226 US patent application
  misc_feature: The sequence is a functional homolog of SEQ ID NO 40 in the 10/374,780 US patent application
  misc_feature: The sequence is a functional homolog of SEQ ID NO 776 in the 10/225,066 US patent application
  misc_feature: The sequence is a functional homolog of SEQ ID NO 836 in the 10/412,699 US patent application
  misc_feature: The sequence is a functional homolog of SEQ ID NO 116 in the 10/412,699 US patent application
  misc_feature: The sequence is a functional homolog of SEQ ID NO 280 in the 11/479,226 US patent application
  misc_feature: The sequence is a functional homolog of SEQ ID NO 1681 in the 10/374,780 US patent application
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: The sequence is a functional homolog of SEQ ID NO 822 in the 10/412,699 US patent application
  misc_feature: The sequence is a functional homolog of SEQ ID NO 796 in the 11/435,388 US patent application
  misc_feature: The sequence is a functional homolog of SEQ ID NO 1680 in the 11/479,226 US patent application
  misc_feature: The sequence is a functional homolog of SEQ ID NO 202 in the 10/666,642 US patent application
  misc_feature: The sequence is a functional homolog of SEQ ID NO 852 in the 10/412,699 US patent application
  misc_feature: The sequence is a functional homolog of SEQ ID NO 1917 in the 10/374,780 US patent application
  misc_feature: Useful for making plants with altered terpenoid content
  misc_feature: The sequence is a functional homolog of SEQ ID NO 594 in the 10/374,780 US patent application
  misc_feature: The sequence is a functional homolog of SEQ ID NO 784 in the 11/435,388 US patent application
  misc_feature: The sequence is a functional homolog of SEQ ID NO 592 in the 10/374,780 US patent application
  misc_feature: The sequence is a functional homolog of SEQ ID NO 786 in the 11/435,388 US patent application
  misc_feature: The sequence is a functional homolog of SEQ ID NO 184 in the 10/412,699 US patent application
  misc_feature: The sequence is a functional homolog of SEQ ID NO 397 in the 11/479,226 US patent application
  misc_feature: The sequence is a functional homolog of SEQ ID NO 46 in the 10/374,780 US patent application
  misc_feature: The sequence is a functional homolog of SEQ ID NO 590 in the 11/435,388 US patent application
  misc_feature: The sequence is a functional homolog of SEQ ID NO 6 in the 10/225,068 US patent application
  misc_feature: The sequence is a functional homolog of SEQ ID NO 1074 in the 10/412,699 US patent application
  misc_feature: The sequence is a functional homolog of SEQ ID NO 590 in the 10/374,780 US patent application
  misc_feature: The sequence is a functional homolog of SEQ ID NO 726 in the 11/435,388 US patent application
  misc_feature: The sequence is a functional homolog of SEQ ID NO 794 in the 11/435,388 US patent application
  misc_feature: The sequence is a functional homolog of SEQ ID NO 428 in the 10/374,780 US patent application
  misc_feature: The sequence is a functional homolog of SEQ ID NO 54 in the 11/375,241 US patent application
  misc_feature: The sequence is a functional homolog of SEQ ID NO 870 in the 10/225,066 US patent application
  misc_feature: The sequence is a functional homolog of SEQ ID NO 593 in the 10/374,780 US patent application
  misc_feature: The sequence is a functional homolog of SEQ ID NO 782 in the 11/435,388 US patent application
  misc_feature: The sequence is a functional homolog of SEQ ID NO 792 in the 11/435,388 US patent application
  misc_feature: The sequence is a functional homolog of SEQ ID NO 788 in the 11/435,388 US patent application
  misc_feature: Useful for making plants with modulated low light sensitivity
  misc_feature: The sequence is a functional homolog of SEQ ID NO 1656 in the 11/479,226 US patent application
  misc_feature: The sequence is a functional homolog of SEQ ID NO 834 in the 10/412,699 US patent application
  misc_feature: The sequence is a functional homolog of SEQ ID NO 263 in the 11/479,226 US patent application
  misc_feature: The sequence is a functional homolog of SEQ ID NO 478 in the 11/435,388 US patent application
  misc_feature: The sequence is a functional homolog of SEQ ID NO 54 in the 10/666,642 US patent application
  misc_feature: The sequence is a functional homolog of SEQ ID NO 743 in the 10/666,642 US patent application
  misc_feature: The sequence is a functional homolog of SEQ ID NO 1031 in the 11/479,226 US patent application
  misc_feature: The sequence is a functional homolog of SEQ ID NO 1804 in the 10/412,699 US patent application
  misc_feature: The sequence is a functional homolog of SEQ ID NO 2050 in the 10/374,780 US patent application
  misc_feature: The sequence is a functional homolog of SEQ ID NO 444 in the 10/412,699 US patent application
  misc_feature: The sequence is a functional homolog of SEQ ID NO 598 in the 10/225,066 US patent application
  misc_feature: The sequence is a functional homolog of SEQ ID NO 620 in the 11/435,388 US patent application
  misc_feature: The sequence is a functional homolog of SEQ ID NO 112 in the 11/375,241 US patent application
  misc_feature: The sequence is a functional homolog of SEQ ID NO 2398 in the 10/374,780 US patent application
  misc_feature: The sequence is a functional homolog of SEQ ID NO 466 in the 10/412,699 US patent application
  misc_feature: The sequence is a functional homolog of SEQ ID NO 580 in the 10/225,066 US patent application
  misc_feature: The sequence is a functional homolog of SEQ ID NO 178 in the 10/412,699 US patent application
  misc_feature: The sequence is a functional homolog of SEQ ID NO 389 in the 11/479,226 US patent application
  misc_feature: The sequence is a functional homolog of SEQ ID NO 790 in the 11/435,388 US patent application
  misc_feature: The sequence is a functional homolog of SEQ ID NO 1071 in the 10/412,699 US patent application
  misc_feature: The sequence is a functional homolog of SEQ ID NO 587 in the 10/374,780 US patent application
  misc_feature: The sequence is a functional homolog of SEQ ID NO 728 in the 11/435,388 US patent application
  misc_feature: The sequence is a functional homolog of SEQ ID NO 2570 in the 10/374,780 US patent application
  misc_feature: The sequence is a functional homolog of SEQ ID NO 634 in the 10/225,066 US patent application
  misc_feature: The sequence is a functional homolog of SEQ ID NO 832 in the 10/412,699 US patent application
  misc_feature: The sequence is a functional homolog of SEQ ID NO 1100 in the 10/225,066 US patent application
  misc_feature: The sequence is a functional homolog of SEQ ID NO 158 in the 10/412,699 US patent application
  misc_feature: The sequence is a functional homolog of SEQ ID NO 2268 in the 10/374,780 US patent application
  misc_feature: The sequence is a functional homolog of SEQ ID NO 357 in the 11/479,226 US patent application
  misc_feature: The sequence is a functional homolog of SEQ ID NO 480 in the 11/435,388 US patent application
  misc_feature: The sequence is a functional homolog of SEQ ID NO 124 in the 10/412,699 US patent application
  misc_feature: The sequence is a functional homolog of SEQ ID NO 1742 in the 10/412,699 US patent application
  misc_feature: The sequence is a functional homolog of SEQ ID NO 1966 in the 10/374,780 US patent application
  misc_feature: The sequence is a functional homolog of SEQ ID NO 299 in the 11/479,226 US patent application
  misc_feature: The sequence is a functional homolog of SEQ ID NO 170 in the 10/412,699 US patent application
  misc_feature: The sequence is a functional homolog of SEQ ID NO 1756 in the 10/412,699 US patent application
  misc_feature: The sequence is a functional homolog of SEQ ID NO 1980 in the 10/374,780 US patent application
  misc_feature: The sequence is a functional homolog of SEQ ID NO 750 in the 10/225,066 US patent application
  misc_feature: The sequence is a functional homolog of SEQ ID NO 2556 in the 10/374,780 US patent application
  misc_feature: The sequence is a functional homolog of SEQ ID NO 272 in the 10/225,066 US patent application
  misc_feature: The sequence is a functional homolog of SEQ ID NO 528 in the 11/435,388 US patent application
  misc_feature: The sequence is a functional homolog of SEQ ID NO 1572 in the 10/374,780 US patent application
  misc_feature: The sequence is a functional homolog of SEQ ID NO 2 in the 10/225,068 US patent application
  misc_feature: The sequence is a functional homolog of SEQ ID NO 22 in the 10/225,068 US patent application
  misc_feature: The sequence is a functional homolog of SEQ ID NO 230 in the 10/225,066 US patent application
  misc_feature: The sequence is a functional homolog of SEQ ID NO 258 in the 10/374,780 US patent application
  misc_feature: The sequence is a functional homolog of SEQ ID NO 442 in the 11/435,388 US patent application
  misc_feature: The sequence is a functional homolog of SEQ ID NO 842 in the 10/412,699 US patent application
  misc_feature: The sequence is a functional homolog of SEQ ID NO 98 in the 11/375,241 US patent application
  misc_feature: The sequence is a functional homolog of SEQ ID NO 186 in the 10/412,699 US patent application
  misc_feature: The sequence is a functional homolog of SEQ ID NO 168 in the 10/225,066 US patent application
  misc_feature: The sequence is a functional homolog of SEQ ID NO 2718 in the 10/374,780 US patent application
  misc_feature: The sequence is a functional homolog of SEQ ID NO 36 in US patent 7193132
  misc_feature: The sequence is a functional homolog of SEQ ID NO 126 in the 10/412,699 US patent application
  misc_feature: Useful for making plants with modulated flowering time
  misc_feature: The sequence is a functional homolog of SEQ ID NO 200 in the 10/666,642 US patent application
  misc_feature: The sequence is a functional homolog of SEQ ID NO 830 in the 10/412,699 US patent application
  misc_feature: The sequence is a functional homolog of SEQ ID NO 1565 in the 10/374,780 US patent application
  misc_feature: The sequence is a functional homolog of SEQ ID NO 1746 in the 10/412,699 US patent application
  misc_feature: The sequence is a functional homolog of SEQ ID NO 1970 in the 10/374,780 US patent application
  misc_feature: The sequence is a functional homolog of SEQ ID NO 452 in the 10/225,066 US patent application
  misc_feature: The sequence is a functional homolog of SEQ ID NO 584 in the 11/435,388 US patent application
  misc_feature: The sequence is a functional homolog of SEQ ID NO 1916 in the 10/412,699 US patent application
  misc_feature: The sequence is a functional homolog of SEQ ID NO 2176 in the 10/374,780 US patent application
  misc_feature: The sequence is a functional homolog of SEQ ID NO 1541 in the 10/374,780 US patent application
  misc_feature: The sequence is a functional homolog of SEQ ID NO 1635 in the 10/412,699 US patent application
  misc_feature: The sequence is a functional homolog of SEQ ID NO 1075 in the 10/412,699 US patent application
  misc_feature: The sequence is a functional homolog of SEQ ID NO 591 in the 10/374,780 US patent application
  misc_feature: The sequence is a functional homolog of SEQ ID NO 1672 in the 11/479,226 US patent application
  misc_feature: The sequence is a functional homolog of SEQ ID NO 846 in the 10/412,699 US patent application
MGRSPCCEQAHTNKGAWTKEEDQRLVAYIKAHGEGCWRSLPKAAGLLRCGKSCRLRWINYLRPDLKRGNFTEEEDELIIKFHELFGNKWSLIAGRLPGRTDNEIKNYWNTHIKRKLLARGIDPQTHRPLAAAAGASPGHHQQQQHYQLEAAQK

SEQ ID NO: 21970 - DNA, 687 bp, Panicum virgatum
  misc_feature: Ceres CLONE 1819108
  misc_feature: Encodes the peptide sequence at SEQ ID NO. 21971
atccaccgcgacaagtgtccagcgagaggccaggcggcgccatgtgtgatgcctgagcgggtggctggcaactggtggctagcgagggaggcagcgtcggcggtgatggggctctggagctggccgtgggggcggcgtggcccgtcgggcttcggctcggcctccaccgccgaggaggtcaccgccggcgtcgacgccaccaatctcaccgccatcgtcacaggagcaacaaacgggattggaaaggaaacggccagagttctagcgctgaggggagcgaatgtgatcataccagcaaggacactggagagtggacaaaaggtgaaagagagccttgcagatcaggtcccaagctccaagctgcatgtcatggagatggacctgagctccctcagctccgtccgcaatttcgcgcggtccttcaacacgtcgcataagcacctgaacatcctcataaacaatgcagggattatggcctgcccttaccagctatccgaggatgggattgagctgcagtttgcaacgaatcatgttggccatttcttgctgacaagtctcctacttgacaagatgaaatcaactgtctcagagaccggtgtgcaaggaaggatcataaacgtatcttcagtcgcacataaaagaagtgatggtacatgctttgagctgaaaaagctaaacgacaaggct

SEQ ID NO: 21971 - protein, 212 aa, Panicum virgatum
  misc_feature: Ceres CLONE 1819108
  misc_feature (53)..(207): Pfam Name: adh_short Pfam Description: short chain dehydrogenase
  misc_feature: SWISSPROT Homolog: EC 1.3.1.33 Protochlorophyllide reductase
MPERVAGNWWLAREAASAVMGLWSWPWGRRGPSGFGSASTAEEVTAGVDATNLTAIVTGATNGIGKETARVLALRGANVIIPARTLESGQKVKESLADQVPSSKLHVMEMDLSSLSSVRNFARSFNTSHKHLNILINNAGIMACPYQLSEDGIELQFATNHVGHFLLTSLLLDKMKSTVSETGVQGRIINVSSVAHKRSDGTCFELKKLNDK

SEQ ID NO: 21972 - DNA, 719 bp, Panicum virgatum
  misc_feature: Ceres CLONE 1819113
  misc_feature: Encodes the peptide sequence at SEQ ID NO. 21973
agcgggcagctagctttggtggaatcggacggaccccgccgacggagcgcgaggaataatggcgatgcagagagccgccgcggccgtcctcctcctccctctcctcgcggcggcgcggacctccgccctgcccttcatcgtcctgcacgggattggggaccagtgcgccaaccatggcgtcgcccagttcacaaaacttctcgccgaatggtcgggctccgaaggccactgcctagaaatcgggagcggaacatgggactcttgggtcatgcctcttcaacaacaggctgacatcatctgcaacaaggtcaaggaaatggagcagctgagaagcggctacaacatagttggtctgtctcaggggaacttgattggtcgagcagtggttgagtattgtgacgatggaccacctgtcaagaatttcatctctctaggaggtcctcatgctggtactgcttcagtgccactttgtggttctggtattttttgcattattgtcgatgctctgattaaattggagatctactcagactatgtgcaggaacatcttgctcctagtggttacctcaaaatcccaactgacatggcagattatttgaagagttgcaggtttcttccaagacttaacaatgaaattccagataaaagatatgctacctacaagaaaaggttcagcagcctggagaatttggtactaatcatgtttcaggatgatgcag

SEQ ID NO: 21973 - protein, 220 aa, Panicum virgatum
  misc_feature: Ceres CLONE 1819113
  misc_feature: SWISSPROT Homolog: EC 3.1.2.22 Palmitoyl-protein hydrolase
MAMQRAAAAVLLLPLLAAARTSALPFIVLHGIGDQCANHGVAQFTKLLAEWSGSEGHCLEIGSGTWDSWVMPLQQQADIICNKVKEMEQLRSGYNIVGLSQGNLIGRAVVEYCDDGPPVKNFISLGGPHAGTASVPLCGSGIFCIIVDALIKLEIYSDYVQEHLAPSGYLKIPTDMADYLKSCRFLPRLNNEIPDKRYATYKKRFSSLENLVLIMFQDDA

SEQ ID NO: 21974 - DNA, 627 bp, Panicum virgatum
  misc_feature: Ceres CLONE 1819118
  misc_feature: Encodes the peptide sequence at SEQ ID NO. 21975
ctagctagctaggtagctaataaatccatcacatccccgcgccatggcgaagaaccaccaccgcattgtggcgctcctgctcgtcgcggccacgctggtcgcgcagctcatcgcgccggccgcggcctgcccgtcctgcccgacgcctaagcctccgccgccgcccccgacgcccgtgccgtgcccgccgccgccgtcgtccgcgccgccgtccacgggcaagtgccccctgaacacgctgaagctgcttcgtcggcggcctcgcctgggccaccgacaacgcgtccctccagcaggccttcgcctcctacggcgacgtcctcgactccaaggtcatcaccgaccgtgagacggggaggtcccgcgggttcggcttcgtcaccttctcaaccgagcagtcgatgctcgacgccatcgaagccatgaacggcaaggagctcgacggccgcaacatcaccgtcaaccaggcccaatcccgcggcggtggcggcggcggcggcggttacggcggcggtcgccagggaggctacggcggcggcggcggctacggcggcggtcgccgtgagggcggctacggtggcggcggctacgacggtggcggtggcggatacggcggcggtcgccgcg

SEQ ID NO: 21975 - protein, 75 aa, Panicum virgatum
  misc_feature: Ceres CLONE 1819118
  misc_feature: Useful for making plants with altered alkaloid content
  misc_feature: Useful for making plants with modulated flowering time
  misc_feature: Useful for making plants with altered lignin content
  misc_feature: Useful for making plants with modulated biomass
  misc_feature: Useful for making plants with modulated nitrogen use efficiency
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
MLDAIEAMNGKELDGRNITVNQAQSRGGGGGGGGYGGGRQGGYGGGGGYGGGRREGGYGGGGYDGGGGGYGGGRR

SEQ ID NO: 21976 - DNA, 1320 bp, Panicum virgatum
  misc_feature: Ceres CLONE 1819123
  misc_feature: Encodes the peptide sequence at SEQ ID NO. 21977
agagtcggccgaggaattctccctcccccaaacttgaaaccccaaatcgcacctatgccgcgctcaaaacgcccgccgcctggctttttcaacgagtccgggcccccgcggcggcggaaggacgcggaagctccgtcttccggaggcggcgcgggaggttctccggtagggttagagtcgggaaccggcggagaaattcccctccgcccaaacttgaaaccgcagaacccagcgatgccgcgcccaaagcgcccgccgcctggctttttcgatgagtcccggcacaagcggcgggagacggcggcggacgcggacgcggacgctccgccttccggtggcggcgcgggaggatcgggccgccgctgcgatctcggccgcgcgttcgggcgctgccgcgcgctcctggacgacctgctgcggcacgacgacgggtgggtgttcgaggcccccgtggacgcgcgcgccctcggcctccgcgactactacaccgtcatcgccgaccccatggacctcggcaccgtgctccgccgcctcgagcgccgccgctacgccgacccgtccgcgttcgccgccgacgtccgcctgacgttccgcaacgccatgtcctacaacaaccagggcgaccccgtgtacgagagcgctgccgagctctccgggatcttcgaggacggctgggcctccatccaagcagagctcccacccccgccgccgacggacgccgagcgcagggtgaagttcagcgacgatctgaaggagctgccggtggccgcgcagcggaccgtggccggagtcctgaaaagccggggtgcgtgcctggtggagaagaatgggaaagtggaggtcgatctgggcaaggcggatgccgcgacgctggatgagctcgctcgactggtcgcaaagcatcgcgccgctgacactgacgtggatgcccggagcccccgatccaggatccatgagcgccgccgatctgaagaaccaacccccaataggtgatgcatggttttacctgagtagcctattgtattgatcttagctgcttccattatagcattggtcttgccgtcatgccgtagtcccaaattctggtggcttggactcgacttgaaggcaccttgtcatagttagtactgatcgttcattttgggcgggttcattggattaccctgtggtaaaaatgttgccttttgtattgatggaggtgcttaatagctgttgtatgtgcagaattgagtgttctgatcctaaaatactttggggatcaggcgtaggaatggaaaggaaaatcaaagatttcttaattataagatgtttttgaagtag

SEQ ID NO: 21977 - protein, 252 aa, Panicum virgatum
  misc_feature: Ceres CLONE 1819123
  misc_feature (49)..(138): Pfam Name: Bromodomain Pfam Description: Bromodomain
  misc_feature: SWISSPROT Homolog: EC 2.3.1.48 Histone acetyltransferase
MPRPKRPPPGFFDESRHKRRETAADADADAPPSGGGAGGSGRRCDLGRAFGRCRALLDDLLRHDDGWVFEAPVDARALGLRDYYTVIADPMDLGTVLRRLERRRYADPSAFAADVRLTFRNAMSYNNQGDPVYESAAELSGIFEDGWASIQAELPPPPPTDAERRVKFSDDLKELPVAAQRTVAGVLKSRGACLVEKNGKVEVDLGKADAATLDELARLVAKHRAADTDVDARSPRSRIHERRRSEEPTPNR

SEQ ID NO: 21978 - DNA, 1892 bp, Panicum virgatum
  misc_feature: Ceres CLONE 1819126
  misc_feature: Encodes the peptide sequence at SEQ ID NO. 21979
aacctctgcagcccctgcctctgccgccgctggagtggacggactctctcctccatttcctcctgacctcctcgcttcgcccaaacacaaccggaccctgctgctgctgctgctcgtggcggtgctgatatatctcggaggcggaagccgttgctgcttcttgtgatggttgtttgggtttgcgagcttgcgatgaggtgagagttgcatggtgattgatggtggccgatagagagtaggcaaggaggttcggcggcggcggcggcggaagatgcgggcggggcgatgcggagcttcgggcctcctcagcactccatccacacagatatgaacagcatgcaaccttctcaagttaccaactttggggcgcttgcacagtctgccggattccgaatagaagatcttgctaatcttaatactagcactttgttcaatctgaagacaaatacaattaacaacaatcctcttcagtttggaagttacggaaagcctatttctccatctcatataaatactacaaccacagcaacagctgcagtgagaattgaccctcagtcactagaacagcaaacaggagctcaacaaaatctagtggctttaccaactggtaacatcgagaactggggagagtcagctatggctgatagtcctatgattgacacatcaacagatccagatactgatgagaggaatcagatgtttgaacaaggactggttgctggccccacagcttctgattctagtgacaaatcaagggacaaattagatcagaagacacttcgtcgtcttgcccaaaatcgtgaagctgccaggaaaagccgtttaagaaagaaggcgtacatccaaaaccttgagagtagcagactgaaacttactcagttagagcaagagcttcagcgggctcgccaacagggtatatttatttcaacatcaggagatcaacctcaatcagcaaacggaaatggagctttggcatttgacatggagtatgcacgctggttggaggagcacaataaacatgtaaatgagttgagggctgctgtcaatgcacatgctggagacaatgatcttcgaggtattgttgatagcatcatggcacactacgacgaaattttcaggctcaagggtgtggcagcaaaagcagatgttttccatgtgctgtccgggatgtggaagacccctgctgagaggtgtttcatgtggttaggtggtttccgatcatctgagcttctgaagttattggcaggtcagctagagcctcttactgatcagcagcttgttggtatatccaacctgcaacagtcctcccaacaagcagaggatgctctttcccaagggatggaagcattacaacagtcacttgcagaaactctagcatctggatccctgggccctgctggatcttctggcaatgttgcgaattacatgggacaaatggcgatggctatgggaaaacttggcacccttgaaaacttcctacgacaggctgataatctgcggctacaaacacttcagcaaatgcaacgcatcttaaccacgcggcaatctgcacgagctctacttgcaataagcgactacttctctcggctgcgtgctctgagttctctttggcttgctcgtccacgggaataaattcaattaattcatgataggataattttaggtactctctagtatgcccattagtttcttcacattgctcatgtgttggtgcgttatttggatcagaaacttctcgtgtatgtgttcaagtgaacgttcagttcatattgtaggtcattatggaattattgggcaagtttgtaacaattttgggaaaaaaacagagttgtaaatagatgcggaataatctgagatcttattaggggatgacattggcggatatgatccac

SEQ ID NO: 21979 - protein, 448 aa, Panicum virgatum
  misc_feature: Ceres CLONE 1819126
  misc_feature: The sequence is a functional homolog of SEQ ID NO 1496 in the 10/374,780 US patent application
  misc_feature: The sequence is a functional homolog of SEQ ID NO 1566 in the 10/412,699 US patent application
  misc_feature: The sequence is a functional homolog of SEQ ID NO 1792 in the 10/412,699 US patent application
  misc_feature: The sequence is a functional homolog of SEQ ID NO 2030 in the 10/374,780 US patent application
  misc_feature: The sequence is a functional homolog of SEQ ID NO 206 in the 10/225,068 US patent application
  misc_feature: The sequence is a functional homolog of SEQ ID NO 356 in the 10/412,699 US patent application
  misc_feature: The sequence is a functional homolog of SEQ ID NO 831 in the 11/479,226 US patent application
  misc_feature: The sequence is a functional homolog of SEQ ID NO 934 in the 11/435,388 US patent application
  misc_feature: The sequence is a functional homolog of SEQ ID NO 1492 in the 10/374,780 US patent application
  misc_feature: The sequence is a functional homolog of SEQ ID NO 1562 in the 10/412,699 US patent application
  misc_feature: The sequence is a functional homolog of SEQ ID NO 1788 in the 10/412,699 US patent application
  misc_feature: The sequence is a functional homolog of SEQ ID NO 2026 in the 10/374,780 US patent application
  misc_feature: The sequence is a functional homolog of SEQ ID NO 354 in the 10/412,699 US patent application
  misc_feature: The sequence is a functional homolog of SEQ ID NO 823 in the 11/479,226 US patent application
  misc_feature: The sequence is a functional homolog of SEQ ID NO 930 in the 11/435,388 US patent application
  misc_feature: The sequence is a functional homolog of SEQ ID NO 1794 in the 10/412,699 US patent application
  misc_feature: The sequence is a functional homolog of SEQ ID NO 2032 in the 10/374,780 US patent application
  misc_feature: The sequence is a functional homolog of SEQ ID NO 380 in the 10/412,699 US patent application
  misc_feature: The sequence is a functional homolog of SEQ ID NO 534 in the 10/225,066 US patent application
  misc_feature: The sequence is a functional homolog of SEQ ID NO 936 in the 11/435,388 US patent application
  misc_feature: The sequence is a functional homolog of SEQ ID NO 1878 in the 10/412,699 US patent application
  misc_feature: The sequence is a functional homolog of SEQ ID NO 2138 in the 10/374,780 US patent application
  misc_feature: The sequence is a functional homolog of SEQ ID NO 372 in the 10/225,066 US patent application
  misc_feature: The sequence is a functional homolog of SEQ ID NO 878 in the 11/435,388 US patent application
  misc_feature: The sequence is a functional homolog of SEQ ID NO 1494 in the 10/374,780 US patent application
  misc_feature: The sequence is a functional homolog of SEQ ID NO 1564 in the 10/412,699 US patent application
  misc_feature: The sequence is a functional homolog of SEQ ID NO 242 in the 10/374,780 US patent application
  misc_feature: The sequence is a functional homolog of SEQ ID NO 764 in the 10/412,699 US patent application
  misc_feature: The sequence is a functional homolog of SEQ ID NO 826 in the 10/225,066 US patent application
  misc_feature: The sequence is a functional homolog of SEQ ID NO 950 in the 11/435,388 US patent application
  misc_feature: The sequence is a functional homolog of SEQ ID NO 96 in the 11/375,241 US patent application
  misc_feature: The sequence is a functional homolog of SEQ ID NO 1498 in the 10/374,780 US patent application
  misc_feature: The sequence is a functional homolog of SEQ ID NO 1568 in the 10/412,699 US patent application
  misc_feature: The sequence is a functional homolog of SEQ ID NO 114 in the 10/666,642 US patent application
  misc_feature: The sequence is a functional homolog of SEQ ID NO 2362 in the 10/374,780 US patent application
  misc_feature: The sequence is a functional homolog of SEQ ID NO 376 in the 10/412,699 US patent application
  misc_feature: The sequence is a functional homolog of SEQ ID NO 608 in the 10/225,066 US patent application
  misc_feature: The sequence is a functional homolog of SEQ ID NO 848 in the 11/435,388 US patent application
  misc_feature: The sequence is a functional homolog of SEQ ID NO 871 in the 11/479,226 US patent application
  misc_feature: Useful for making plants with modulated biomass
  misc_feature: Useful for making plants with modulated flowering time
  misc_feature: The sequence is a functional homolog of SEQ ID NO 1798 in the 10/412,699 US patent application
  misc_feature: The sequence is a functional homolog of SEQ ID NO 2044 in the 10/374,780 US patent application
  misc_feature: The sequence is a functional homolog of SEQ ID NO 408 in the 10/412,699 US patent application
  misc_feature: The sequence is a functional homolog of SEQ ID NO 48 in the 10/286,264 US patent application
  misc_feature: The sequence is a functional homolog of SEQ ID NO 938 in the 11/435,388 US patent application
  misc_feature: The sequence is a functional homolog of SEQ ID NO 957 in the 11/479,226 US patent application
  misc_feature: The sequence is a functional homolog of SEQ ID NO 1786 in the 10/412,699 US patent application
  misc_feature: The sequence is a functional homolog of SEQ ID NO 2024 in the 10/374,780 US patent application
  misc_feature: The sequence is a functional homolog of SEQ ID NO 352 in the 10/412,699 US patent application
  misc_feature: The sequence is a functional homolog of SEQ ID NO 819 in the 11/479,226 US patent application
  misc_feature: The sequence is a functional homolog of SEQ ID NO 928 in the 11/435,388 US patent application
  misc_feature: The sequence is a functional homolog of SEQ ID NO 1493 in the 10/374,780 US patent application
  misc_feature: The sequence is a functional homolog of SEQ ID NO 1563 in the 10/412,699 US patent application
  misc_feature: The sequence is a functional homolog of SEQ ID NO 1495 in the 10/374,780 US patent application
  misc_feature: The sequence is a functional homolog of SEQ ID NO 1565 in the 10/412,699 US patent application
  misc_feature: The sequence is a functional homolog of SEQ ID NO 1497 in the 10/374,780 US patent application
  misc_feature: The sequence is a functional homolog of SEQ ID NO 1567 in the 10/412,699 US patent application
MRSFGPPQHSIHTDMNSMQPSQVTNFGALAQSAGFRIEDLANLNTSTLFNLKTNTINNNPLQFGSYGKPISPSHINTTTTATAAVRIDPQSLEQQTGAQQNLVALPTGNIENWGESAMADSPMIDTSTDPDTDERNQMFEQGLVAGPTASDSSDKSRDKLDQKTLRRLAQNREAARKSRLRKKAYIQNLESSRLKLTQLEQELQRARQQGIFISTSGDQPQSANGNGALAFDMEYARWLEEHNKHVNELRAAVNAHAGDNDLRGIVDSIMAHYDEIFRLKGVAAKADVFHVLSGMWKTPAERCFMWLGGFRSSELLKLLAGQLEPLTDQQLVGISNLQQSSQQAEDALSQGMEALQQSLAETLASGSLGPAGSSGNVANYMGQMAMAMGKLGTLENFLRQADNLRLQTLQQMQRILTTRQSARALLAISDYFSRLRALSSLWLARPRE

SEQ ID NO: 21980 - DNA, 702 bp, Panicum virgatum
  misc_feature: Ceres CLONE 1819131
  misc_feature: Encodes the peptide sequence at SEQ ID NO. 21981
ttattaatggaagtgagaaggtgggaattgttggcagaacaggtgctggtaaatctagcatgcttaatgctttgttccgtatcgtggagcttgaacgagggaggatattgattgatgattgtgacacttccaagtttggaatttgggacctgcgcaaagttctaggaataataccacaagcaccagttctattttcaggttctgttcgatttaatctggacccttttaatgagcacaatgatgcggatctctgggaggctctggaaagggctcatctaaaggatgttatcaggaggaatgccttaggactagatgctgaggtttctgaagctggtgaaaattttagtgttggacaaaggcaactgttgagcttagctcgtgcgttgctgagaagagcaaagatacttgttcttgatgaggcgacagcagcagttgatgtacggactgatgctcttattcagaaaaccatccgtgaagaattcaagagttgcacaatgctcataattgcccaccgtttgaacactgtcattgactgtgataggttacttattctaagtgctgggcaggttttggaatttgactcacctgagaatcttctgagcaatgaggaaagtgctttctccaagatggtgcagagtacaggacctagcaacgcagaatacctcaagagtcttgtatttggaagtggggaggagagatcac

SEQ ID NO: 21981 - protein, 233 aa, Panicum virgatum
  misc_feature: Ceres CLONE 1819131
  misc_feature (4)..(187): Pfam Name: ABC_tran Pfam Description: ABC transporter
  misc_feature: SWISSPROT Homolog: EC 3.6.3.44 Xenobiotic-transporting ATPase
INGSEKVGIVGRTGAGKSSMLNALFRIVELERGRILIDDCDTSKFGIWDLRKVLGIIPQAPVLFSGSVRFNLDPFNEHNDADLWEALERAHLKDVIRRNALGLDAEVSEAGENFSVGQRQLLSLARALLRRAKILVLDEATAAVDVRTDALIQKTIREEFKSCTMLIIAHRLNTVIDCDRLLILSAGQVLEFDSPENLLSNEESAFSKMVQSTGPSNAEYLKSLVFGSGEERS

SEQ ID NO: 21982 - DNA, 677 bp, Panicum virgatum
  misc_feature: Ceres CLONE 1819139
  misc_feature: Encodes the peptide sequence at SEQ ID NO. 21983
acgaacccgtttcgagctcgcgcgattacgcgattcgcagggtcctttattgcaaaaccacggcaccgcctccccgtcgccatctccgctcccgtgaacccgtcgcgtcccggcttccccctcaccgccccgccgtgcacagttgcacgagcggagctcgccgtcgcctcccccgccgagaggcccgaggcctgatccccacgccgagagcagtggtgctgctaggagattagcgatggcgaggtggcgcccggcggcgctgctggtagtggcgctggcggcggtcctggcggcggcgcggcgggcggacgcgctgtcggtgaccgtgaccgacaccgagtgcatccacgagttcgtgccctacgagggcgacaccgtgtccgggaacttcgtcgtcgtcgaccacgacatcttctggagctccgaccaccccggcatcgacctcacggtaacttcaccaggtggcaacactgtacatacgttgaaggggaaatctggtgataaatttgagtttaaagctccaaggggtggcatgtacaagttttgcttccataacccatatggggcacctgaaactgtttctttctacattcatgttgggcacatacccaatgaacacaatctggcaaaagatgagcacttggaccctattaacgttaaaattgcggagctgaagg

SEQ ID NO: 21983 - protein, 147 aa, Panicum virgatum
  misc_feature: Ceres CLONE 1819139
  misc_feature (55)..(121): Pfam Name: EMP24_GP25L Pfam Description: emp24/gp25L/p24 family/GOLD
MARWRPAALLVVALAAVLAAARRADALSVTVTDTECIHEFVPYEGDTVSGNFVVVDHDIFWSSDHPGIDLTVTSPGGNTVHTLKGKSGDKFEFKAPRGGMYKFCFHNPYGAPETVSFYIHVGHIPNEHNLAKDEHLDPINVKIAELK

SEQ ID NO: 21984 - DNA, 958 bp, Panicum virgatum
  misc_feature: Ceres CLONE 1819140
  misc_feature: Encodes the peptide sequence at SEQ ID NO. 21985
gagccacactcagtcgtcgcttctcaattccactgctgaatcggatcgagctagctaggtcactcttttttgagagaggagcgtaaggatcgatggcggcctcctgcttgaaggtcaataatggagctgcactggcagcggtaacggtgatcttcctcgccgtcgtgctcccttcttcccacgcgtcgacgatggtcgacgagccagcggctaactacaagcccgcggctccagcgcccccgccgcagcctgcgtcgtcttacaccccgccgccgccggtaccggtccagccggtggtcgtcgtccacggcgtcatctactgcaagtcgtgcaagctcaggggctacaacagcggcatgggcgcatcccctctccccaacgcgacggtgagcctggtgtgctacggcgacgaggagagcgggtaccgggtgctgaaccagacgagcacggcggcggacaggaacggctacttcatcgtgatggtgtacgacgtggacatgttcgacaggcacacctgccggctgtacctgcgggcgtcgccgacgccgctctgcgccgcgccctccgtcccgtccaaccccaagctcgggctcaccctggtgcgggaccgcgcggccacggcgccccggggcgcgcgcggcgtctaccacgccaggaccgcgctcatgtacgcgccgggcgccggcggcaggtgcccgccgccctactgacgccaggagctcaagagatgtcgtcgtcgtcggaggcaagaataagctgaggtccatggtcgttgtcacttagtgtgtcgtccgtttgggtggtcggtggtgcatggctcgatggagtgtttgttgactactgtactactacgttgcaatgcattgtgtggttcggtcgtcgtctcgtctgtgtaacctactatttctgaatcggtcccctgtccctcgaatgaaggaatcccggcacccgtttaatt

SEQ ID NO: 21985 - protein, 205 aa, Panicum virgatum
  misc_feature: Ceres CLONE 1819140
  misc_feature (71)..(203): Pfam Name: Pollen_Ole_e_I Pfam Description: Pollen proteins Ole e I family
MAASCLKVNNGAALAAVTVIFLAVVLPSSHASTMVDEPAANYKPAAPAPPPQPASSYTPPPPVPVQPVVVVHGVIYCKSCKLRGYNSGMGASPLPNATVSLVCYGDEESGYRVLNQTSTAADRNGYFIVMVYDVDMFDRHTCRLYLRASPTPLCAAPSVPSNPKLGLTLVRDRAATAPRGARGVYHARTALMYAPGAGGRCPPPY

SEQ ID NO: 21986 - DNA, 1081 bp, Panicum virgatum
  misc_feature: Ceres CLONE 1819159
  misc_feature: Encodes the peptide sequence at SEQ ID NO. 21987
cccaaacccccgccgccgctgccaagcacatcgcacccggcgcgatttccccggcgagagcccaccccccatcccacccaaccatggcggaccgcggaggcgagagaggcggagagcgcggcggcgagcgtggcggcttcggccgcgggttcgggcgcggcgggcgcggcgaccgcggcgggcgcaggggcggccggcgcggcgggcgccagcaggaggaggagaagtgggtgcccgtgaccaagctcgggcgcctcgtcaaggagggcaggatcaagcagatggaggagatctacctccactcgctccccgtcaaggagcaccagatcgtggaggccctcctccccgggctcaaggacgaggtcatgaagatcacgccggtgcagaagcagacgcgcgccggccagcgcacgcgcttcaaggccttcgtcgtcgtcggcgacggcaacggccacgtcgggctcggggtcaagtgcgccaaggaggtggccaccgccatccgcggcgccatcatcctcgccaagctgtcagtcgtgcccgtcaggaggggctactgggggaacaagatcggccagccgcacaccgtgccgtgcaaggtcaccggcaagtgcggctccgtcaccgtgcgcatggtgccggcgcccagggggtccgggatcgtcgccgcccgcgtgcccaagaaggtgctccagttcgctggcattgaggatgtgttcacctcctcccgcggctccaccaagacgctcggtaactttgtcaaggccacctttgattgtctcatgaagacctatggcttccttactcctgagttctgggatgagactaagtttgcgaagaccccattccaggagttcaccgatctcttggccaagccaacaaagggacttgtgatcgaggctccagtggagactgtagaagcttaaacctgttggaagttcagagcaaagtttccttgtagtagaaactggtttcctatctacttttgtgtgggttattatgtattactgtctcggatatctcagttttgaattgtaaaccttaaggtatgcacttaaatatccagatggtctgttcttgtttt

SEQ ID NO: 21987 - protein, 279 aa, Panicum virgatum
  misc_feature: Ceres CLONE 1819159
  misc_feature (89)..(155): Pfam Name: Ribosomal_S5 Pfam Description: Ribosomal protein S5, N-terminal domain
  misc_feature (172)..(245): Pfam Name: Ribosomal_S5_C Pfam Description: Ribosomal protein S5, C-terminal domain
MADRGGERGGERGGERGGFGRGFGRGGRGDRGGRRGGRRGGRQQEEEKWVPVTKLGRLVKEGRIKQMEEIYLHSLPVKEHQIVEALLPGLKDEVMKITPVQKQTRAGQRTRFKAFVVVGDGNGHVGLGVKCAKEVATAIRGAIILAKLSVVPVRRGYWGNKIGQPHTVPCKVTGKCGSVTVRMVPAPRGSGIVAARVPKKVLQFAGIEDVFTSSRGSTKTLGNFVKATFDCLMKTYGFLTPEFWDETKFAKTPFQEFTDLLAKPTKGLVIEAPVETVEA

SEQ ID NO: 21988 - DNA, 725 bp, Panicum virgatum
  misc_feature: Ceres CLONE 1819173
  misc_feature: Encodes the peptide sequence at SEQ ID NO. 21989
attgcatcgcatctcctctcgctctctgttgtgtgactgattgccaagaacgctctctgcttgcttgtgttccagcctctgaatctcgtgaggatgtcgtgctgcggaggcaactgcgggtgcggctccggctgcaagtgcggctccggctgcggagggtgcaagatgtacccggacatgactgagcagggcaccaccaccaccagccagactgtcatcatgggcgttgcaccaaccaacaaggggtatgttcatccatccatccatcccatctgtaccgtgtacttttcagcttcctccgccgagatcattttggcgaggtggtgatctgaattctgatccaccacccttgcgtttgccaataatagccagcaatttttatggtgccgagttgttattagctgtactatttttacggttttcttttgtgtgtttctctggtactcctactaaattatcggttgtgtagaaagtagaacaaacttctgtctgcatagtgctagactgctagtgcagaactcagtcaccatcagcaacgagaagggaggcactaagccactaagctacgacaaaaatcagtttgtgcccagcatgaaccagaacaatcttctgcttcttttccccgcgccaagggaaggaaaaatccaacaagaaatgatgtcttctttacttgtccactaactgaaaagttcgggacggcatacgtagctgctggtagcgaacag

SEQ ID NO: 21989 - protein, 77 aa, Panicum virgatum
  misc_feature: Ceres CLONE 1819173
  misc_feature (1)..(61): Pfam Name: Metallothio_2 Pfam Description: Metallothionein
MSCCGGNCGCGSGCKCGSGCGGCKMYPDMTEQGTTTTSQTVIMGVAPTNKGYVHPSIHPICTVYFSASSAEIILARW

SEQ ID NO: 21990 - DNA, 714 bp, Panicum virgatum
  misc_feature: Ceres CLONE 1819180
  misc_feature: Encodes the peptide sequence at SEQ ID NO. 21991
aaattcctcgacggatcgatcttgatttctcgccgccgtccgcgcatctctgccaccgccgccgccacctgcctgtttgggaggttgccaggccgcgcgcccatggccgtcaccgtgtgcgtcaccggcgccggcggcttcatcgggtcttggatcgtcaagctcctcctcgaccgcgggtacgccgtccggggcacctcccgccgcgcagatgaccccaagaacgcgcacctctgggcgctcgacggcgcggcggagcgcctcacgatgctgcaggtggacctgctcgaccgggccagcctccgcgccgccttcgacggctgcgacggcgtcatccacaccgcctcgccgatgcacgacaaccccgaggagatcatcgagccaattatcgccgggacgcggaacgtcgttgaggccgcggccgacgccggcgtgcggcgcctggtgatctcctccaccatcggcaccatgtacatgaacccgcaccgcgaccccgacgcgcccctggaggagtggagctggagcgacctcgagcactgcaagaagaccgcgaactggtactgctacgccaagacgatcgcggagcagagcgcgtggcaggcggcgcgggcgcggggcctggacctggcggtggtcatcccggtggtggtgctcggcgaactgatgcagccaagcatgaacaccagcaccctgcacatactcaagtacctcacc

SEQ ID NO: 21991 - protein, 203 aa, Panicum virgatum
  misc_feature: Ceres CLONE 1819180
  misc_feature (5)..(203): Pfam Name: Epimerase Pfam Description: NAD dependent epimerase/dehydratase family
  misc_feature: SWISSPROT Homolog: EC 1.1.1.219 Dihydrokaempferol 4-reductase
  misc_feature: Useful for making plants with altered carbohydrate content
  misc_feature: Useful for making plants with altered cell wall content and/or composition
  misc_feature: Useful for making plants with altered lignin content
MAVTVCVTGAGGFIGSWIVKLLLDRGYAVRGTSRRADDPKNAHLWALDGAAERLTMLQVDLLDRASLRAAFDGCDGVIHTASPMHDNPEEIIEPIIAGTRNVVEAAADAGVRRLVISSTIGTMYMNPHRDPDAPLEEWSWSDLEHCKKTANWYCYAKTIAEQSAWQAARARGLDLAVVIPVVVLGELMQPSMNTSTLHILKYL

SEQ ID NO: 21992 - DNA, 1347 bp, Panicum virgatum
  misc_feature: Ceres CLONE 1819213
  misc_feature: Encodes the peptide sequence at SEQ ID NO. 21993
aagttccggaaaccacatccgaaccccaatcctcctcccgaattctctccatcgccatggctctctcctccatcttcctccccctccccctgcccaagctactctcctcctccagatcccaccgcttgctccccgtccgggcgtcctccgacgcgcccgccgcctccgcttccttcgatctgcgccgctactggaccaccctgatcgccgacgtcgagtccgagctcgacgccgcgatgcccatgcgccccccggagagcatccacgctgccatgcgctacgcggtcctcccgggcgccggcaaggaggggcccgccaagcgggccccccccgtgctgtgcgtggccgcctgcgagctcctcggcgcgccgcgctcggccgcgctcccggccgcggcggccctcgagatgctccacgcggcgtcgctcgtgcacgacgacctgccctgcttcgacgccgcgcccacgcgacgcgggcgcccctccacgcacgccgccttcggcaccgacatggccgtcctcgcgggcgacgcgctcttcccgctcgcctacacccacatcatcgcgcacaccccgtcgccggacccggtgccccacgccgtcctcctccgcgtcatggcggagcttgcgcgcgccgtcggatccaccggcatggcggcgggccagttcctcgatctggccggcgccaccgcactcggcgaggccgaggtcatgcaggtcctgacgaagaagttcggcgagatggccgagtgctccgcggcctgcggcgccatgctcggcggggccgggcccgacgaggaggccgcgctgcggcgctacggccgcaccatcggcgtcctgtacgagctcgtcgacgacctccggagcgcgtcggggaacggcaagatgaggagcaacgccagcgtcctgcgcgcgctgggcatggaccgcgcgctcggcatcgtggaggagctcaaggcgcaggccaagacggaggccgacaggttcgcggacaagtacggcgaccgggtgctgcccctgtacagcttcgtggactacgcggtggagagagggtttgagctccaggatgcagcggcagcgccatgaagagtgcgcgatcgcagttggtactgaacattggagcaagtgacctgtacatggttcttgagaatgggtgagaagctccatttgccaaaattatagtccctctgctatagatgcttagacgcttgaattcgtaatttggctagataatcatccgtagagttctcacccctgatacagatgttcagaacttcgaacttggggttgatgtctcggttgaagttttgtagtacgttggtaaaagaaaaaaagtgtccattggccc

SEQ ID NO: 21993 - protein, 342 aa, Panicum virgatum
  misc_feature: Ceres CLONE 1819213
  misc_feature (69)..(329): Pfam Name: polyprenyl_synt Pfam Description: Polyprenyl synthetase
  misc_feature: SWISSPROT Homolog: EC 2.5.1.29 Farnesyltranstransferase
MALSSIFLPLPLPKLLSSSRSHRLLPVRASSDAPAASASFDLRRYWTTLIADVESELDAAMPMRPPESIHAAMRYAVLPGAGKEGPAKRAPPVLCVAACELLGAPRSAALPAAAALEMLHAASLVHDDLPCFDAAPTRRGRPSTHAAFGTDMAVLAGDALFPLAYTHIIAHTPSPDPVPHAVLLRVMAELARAVGSTGMAAGQFLDLAGATALGEAEVMQVLTKKFGEMAECSAACGAMLGGAGPDEEAALRRYGRTIGVLYELVDDLRSASGNGKMRSNASVLRALGMDRALGIVEELKAQAKTEADRFADKYGDRVLPLYSFVDYAVERGFELQDAAAAP

SEQ ID NO: 21994 - DNA, 723 bp, Panicum virgatum
  misc_feature: Ceres CLONE 1819220
  misc_feature: Encodes the peptide sequence at SEQ ID NO. 21995
acacacaagcgccagctacagcaatatatagcatggtatagatgtgtgttgcagctgctggctgctgctaataattcttactcctagctcctcatcgtcagacgacctctcatcatctccttcgattcctcctctcctcatatgtgcagagatcatatatagccagctgcagataggcaagtaaagcttgcttgtgtctcctccagcaggttcatgcagatcagaatcagatcacagtgctagggatatagacaagtttgcaggagaaaagatctctagatagatacatacatagctagggagtagggatcgatccatcgaaggtataggccagctgctggcatgggcctgagggacatcgagctgacgctcccgccggggttccggttctaccccagcgacgaggagctggtgtgccactacctgcacagcaaggtggccaacgagcggatcgccggcgccggcggggccatggtggaggtggatctgcacacccacgagccctgggagcttcctgacgttgcgaagctgagcacgaacgagtggtacttcttcagcttccgcgaccgcaagtacgcgacggggctgcgcaccaaccgcgccaccaagtccggctactggaaagccaccggcaaggaccgcgtcatccacaaccccaaggccgccggccgcgccgtcgtcggcatgcgcaagaccctcgttttctaccgcggccgcgccccc

SEQ ID NO: 21995 - protein, 126 aa, Panicum virgatum
  misc_feature: Ceres CLONE 1819220
  misc_feature (10)..(126): Pfam Name: NAM Pfam Description: No apical meristem (NAM) protein
  misc_feature: The sequence is a functional homolog of SEQ ID NO 1197 in the 10/412,699 US patent application
  misc_feature: The sequence is a functional homolog of SEQ ID NO 866 in the 10/374,780 US patent application
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: The sequence is a functional homolog of SEQ ID NO 1198 in the 10/412,699 US patent application
  misc_feature: The sequence is a functional homolog of SEQ ID NO 867 in the 10/374,780 US patent application
  misc_feature: The sequence is a functional homolog of SEQ ID NO 100 in the 10/374,780 US patent application
  misc_feature: The sequence is a functional homolog of SEQ ID NO 318 in the 10/412,699 US patent application
  misc_feature: The sequence is a functional homolog of SEQ ID NO 749 in the 11/479,226 US patent application
  misc_feature: The sequence is a functional homolog of SEQ ID NO 884 in the 10/225,066 US patent application
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: Useful for making plants with altered terpenoid content
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: Useful for making plants with modulated light quality sensitivity
  misc_feature: Useful for making plants with altered lignin content
  misc_feature: The sequence is a functional homolog of SEQ ID NO 492 in the 11/435,388 US patent application
  misc_feature: The sequence is a functional homolog of SEQ ID NO 741 in the 11/479,226 US patent application
  misc_feature: The sequence is a functional homolog of SEQ ID NO 476 in the 10/666,642 US patent application
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: The sequence is a functional homolog of SEQ ID NO 106 in the 10/225,068 US patent application
  misc_feature: The sequence is a functional homolog of SEQ ID NO 2348 in the 10/374,780 US patent application
  misc_feature: The sequence is a functional homolog of SEQ ID NO 340 in the 10/412,699 US patent application
  misc_feature: The sequence is a functional homolog of SEQ ID NO 778 in the 11/479,226 US patent application
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: Useful for biocontainment applications
  misc_feature: Useful for making plants with altered cell wall content and/or composition
  misc_feature: The sequence is a functional homolog of SEQ ID NO 2416 in the 10/374,780 US patent application
  misc_feature: The sequence is a functional homolog of SEQ ID NO 914 in the 10/225,066 US patent application
  misc_feature: Useful for making plants with altered carbohydrate content
  misc_feature: The sequence is a functional homolog of SEQ ID NO 853 in the 10/374,780 US patent application
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: The sequence is a functional homolog of SEQ ID NO 851 in the 10/374,780 US patent application
  misc_feature: Useful for making plants with modulated biomass
  misc_feature: The sequence is a functional homolog of SEQ ID NO 854 in the 10/374,780 US patent application
  misc_feature: The sequence is a functional homolog of SEQ ID NO 1270 in the 10/374,780 US patent application
  misc_feature: The sequence is a functional homolog of SEQ ID NO 1423 in the 10/412,699 US patent application
  misc_feature: The sequence is a functional homolog of SEQ ID NO 898 in the 10/666,642 US patent application
  misc_feature: The sequence is a functional homolog of SEQ ID NO 891 in the 10/374,780 US patent application
  misc_feature: The sequence is a functional homolog of SEQ ID NO 344 in the 10/666,642 US patent application
  misc_feature: The sequence is a functional homolog of SEQ ID NO 162 in the 10/225,068 US patent application
  misc_feature: The sequence is a functional homolog of SEQ ID NO 2414 in the 10/374,780 US patent application
  misc_feature: The sequence is a functional homolog of SEQ ID NO 428 in the 11/435,388 US patent application
  misc_feature: The sequence is a functional homolog of SEQ ID NO 508 in the 10/412,699 US patent application
  misc_feature: The sequence is a functional homolog of SEQ ID NO 728 in the 10/225,066 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 160 in the 10/666,642 US patent application
  misc_feature: The sequence is a functional homolog of SEQ ID NO 634 in the 10/412,699 US patent application
  misc_feature: The sequence is a functional homolog of SEQ ID NO 638 in the 11/435,388 US patent application
  misc_feature: The sequence is a functional homolog of SEQ ID NO 194 in the 10/374,780 US patent application
  misc_feature: The sequence is a functional homolog of SEQ ID NO 898 in the 10/225,066 US patent application
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 612 in the 11/435,388 US patent application
  misc_feature: The sequence is a functional homolog of SEQ ID NO 2590 in the 10/374,780 US patent application
  misc_feature: The sequence is a functional homolog of SEQ ID NO 286 in the 10/225,066 US patent application
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Useful for making plants with modulated water use efficiency
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 890 in the 10/374,780 US patent application
  misc_feature: Useful for making plants with modulated oxidative stress sensitivity
  misc_feature: The sequence is a functional homolog of SEQ ID NO 1365 in the 11/479,226 US patent application
  misc_feature: The sequence is a functional homolog of SEQ ID NO 2474 in the 10/374,780 US patent application
  misc_feature: The sequence is a functional homolog of SEQ ID NO 744 in the 10/225,066 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 1012 in the 11/435,388 US patent application
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: The sequence is a functional homolog of SEQ ID NO 2472 in the 10/374,780 US patent application
  misc_feature: The sequence is a functional homolog of SEQ ID NO 520 in the 11/435,388 US patent application
  misc_feature: The sequence is a functional homolog of SEQ ID NO 974 in the 10/225,066 US patent application
  misc_feature: The sequence is a functional homolog of SEQ ID NO 854 in the 11/435,388 US patent application
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: Useful for making plants with altered alkaloid content
  misc_feature: Useful for making plants with modulated light quality response
  misc_feature: The sequence is a functional homolog of SEQ ID NO 142 in the 10/286,264 US patent application
  misc_feature: The sequence is a functional homolog of SEQ ID NO 324 in the 10/412,699 US patent application
  misc_feature: The sequence is a functional homolog of SEQ ID NO 756 in the 11/479,226 US patent application
  misc_feature: The sequence is a functional homolog of SEQ ID NO 1816 in the 11/479,226 US patent application
  misc_feature: The sequence is a functional homolog of SEQ ID NO 2112 in the 10/374,780 US patent application
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
MGLRDIELTLPPGFRFYPSDEELVCHYLHSKVANERIAGAGGAMVEVDLHTHEPWELPDVAKLSTNEWYFFSFRDRKYATGLRTNRATKSGYWKATGKDRVIHNPKAAGRAVVGMRKTLVFYRGRA

SEQ ID NO: 21996 - DNA, 972 bp, Panicum virgatum
  misc_feature: Ceres CLONE 1819225
  misc_feature: Encodes the peptide sequence at SEQ ID NO. 21997
atccgaaagccaaagcgagtctcaccagtcaaagaacgagttctagtagctttgctgatctgttctgctgtttttagtttggaaagcctttagttccggcgatcatggagcacggcgagcacaaggaggagcacgagaccggggagaagaagaagggcctcaaggagaagatcaaggagaagctacccggccacaaggaccacgccgagggcgaccaccacacggccgtgccggccccggcgcccgcgcccgtgggaacgcacgcttacaaggaggacgagcacaagccgtacgtgccggccccggctcccccgcccgcggtggagacgcacgtccaccaccacgaccacgccgtcgtcgtccagaaggtcgaggacgactccccaccggcgccggaggaggagaagaagggcctccttgacaagatcaaggagaagctccccggcggccacaagaagccggaggacgccgccgccgccgcgcccgctgtccacgcgccagcgccggcgccgcacgcagaggacgtgagcagcccggacggcaaggagaagaagggcctgctgggcaagatcatggacaagatacccggctacaagggctccggcgaggaggaccacaaggccgccgccggcgagcacaagaccagctcttcttaagatggcccgcgcgtcgtgaccttgatcggaagcgtttgtttgccgtgcgtttggttctgctttgctttattttgtttcaagatgggattgcgcggtcaaggtccggtgtgttgaggcccggccagtactggtagcgagagtattgctggcttgctgcttgtgttcgctctagttcgggctttagtttggttccgagtcggggactggaagttgttgggtttgttgaattattatcagcagttgcgtcggtattgtaattcggctgggctacctggggattatgccttaacatttatatctttggtttctgcctagc

SEQ ID NO: 21997 - protein, 183 aa, Panicum virgatum
  misc_feature: Ceres CLONE 1819225
  misc_feature (17)..(178): Pfam Name: Dehydrin Pfam Description: Dehydrin
MEHGEHKEEHETGEKKKGLKEKIKEKLPGHKDHAEGDHHTAVPAPAPAPVGTHAYKEDEHKPYVPAPAPPPAVETHVHHHDHAVVVQKVEDDSPPAPEEEKKGLLDKIKEKLPGGHKKPEDAAAAAPAVHAPAPAPHAEDVSSPDGKEKKGLLGKIMDKIPGYKGSGEEDHKAAAGEHKTSSS

SEQ ID NO: 21998 - DNA, 656 bp, Panicum virgatum
  misc_feature: Ceres CLONE 1819240-R
  misc_feature: Encodes the peptide sequence at SEQ ID NO. 21999
cagggaaagtacctccagaagatcattgaagagcagcagcgcttaactggcgtgaaatctgaaactcctgctgcaggtgcttctgtcacagtatctagtgatcaattccttgactctgagcggactgagccctcgactcctgcgccgacgtctgagtctccaactcaagttggcccttccaatagggacagtggagaacgaactgaagcaaccaagagcacctgtcgtggtgattccctctcccgtcatgagccactgacccctgattccaactgccagaatggctcacctccggctagtccaaaccacgagagggcagcaaagaggcaacgaggcagtggtagtgaattcttagatgccgagactgatttttcccttccacgcaacatcttcgagtcaagctcgggctctgagttccagccgtattcaatgtcctactcaggcaattagcttctgatgctcccgacatcgttggtagcttgttgagcacgatgcgcatgatctgatccatgtctgtaggtctgggtagaatgatgctatctcaaggattgtattgttggtagacaaagttgtaggggtttcagtgattgtttagatgatatacatgccatctataagttcctaggtttgtaacatgtatgtcccatctgtagttc

SEQ ID NO: 21999 - protein, 149 aa, Panicum virgatum
  misc_feature: Ceres CLONE 1819240-R
  misc_feature: Useful for making plants with altered lignin content
  misc_feature: Useful for making plants with altered terpenoid content
QGKYLQKIIEEQQRLTGVKSETPAAGASVTVSSDQFLDSERTEPSTPAPTSESPTQVGPSNRDSGERTEATKSTCRGDSLSRHEPLTPDSNCQNGSPPASPNHERAAKRQRGSGSEFLDAETDFSLPRNIFESSSGSEFQPYSMSYSGN

SEQ ID NO: 22000 - DNA, 286 bp, Panicum virgatum
  misc_feature: Ceres CLONE 1819240
atggattcgcgaacaaactcattcccccgtctccactggagacccccttcttcctcctctcgcctttcctcctgcggctcctcccccaaatccgcctctcccctgcctcgattccacccccacctcgctgtcggctgcatccccgccggcgacgcacgggccccgcacctagcgaggaggccccagacctgattccctcgtcgagaggagtcgccgtcccctcctggctctgccggcggtgccgggctgccgcggtccggaggggggggggggagggggggggggg

SEQ ID NO: 22001 - DNA, 1139 bp, Panicum virgatum
  misc_feature: Ceres CLONE 1819254
  misc_feature: Encodes the peptide sequence at SEQ ID NO. 22002
gcgcctcctcgtttcgccttcagcagccagtgagttgcttcgttgggaaggcaagagggacctgcagccgcgagccggcgatggcccgatgggcggcattgctgctgcttctgcttgccgcgtcggcggcggggaggaaggagaaggccggcgagaaggtgcggcaaggggtgggagtgcagcggcagccggttctgctgcaacgagaccatcagcgactacttcaaggcgtaccagttcgaggagctcttcgcccaccgcaacgatgcccaggcccacgcccccggcttctgggactaccaggccttcatcaccgccgccgccctcttcgagcctagcgggttcggcaccaccggaggcaagcagatggggatgaaggaggtcgccgctttcctcggccatgtcggcgccaagacgtcatgtggatacggtgaagcacctggtggtgaaacggcttgggggctttgctataaccatgaattgagccccagtcagagctactgtgatgatagcaatgaattgtacccttgtgttgaaggagttgagtactatggcagaggcgctattcctgtttactggaaccacaactatggtatcattggcaatggtatcaagcaggatctgttgaatcacccagagctattggaacagaatgccaccctagcatttgaagcagctgtctggaggtggatgactccaatgaagcggaagcagccatctgcccatgatgtgtttgttggtaactggaaacccaccaagaacgacacattgtccaagaggtatcctggctttggtgctaccatgaacatcctgtatggtgatgatatctgtggtcaagggtccactgataagatgaacaccattatatctcattaccaacattatctcgacttgatgggagttggccgtcagcactctggagataacttggattgtggtgaccaggtggctttcaatccatcatcagagagttccgacttctaagaaactgttttaaaaatctgtgtgactgggccgcgggcccactaactgggttccccaagctatagtgatcatgtctgtgaaacaacagttgtttgccctacggcatatgtacttgacgataattaaaatccagtcatgatttacctgtactgtag

SEQ ID NO: 22002 - protein, 205 aa, Panicum virgatum
  misc_feature: Ceres CLONE 1819254
  misc_feature (1)..(190): Pfam Name: Glyco_hydro_19 Pfam Description: Chitinase class I
  misc_feature: SWISSPROT Homolog: EC 3.2.1.14 Chitinase
  misc_feature: Useful for making plants with modulated water use efficiency
  misc_feature: Useful for making plants with altered cell wall content and/or composition
MGMKEVAAFLGHVGAKTSCGYGEAPGGETAWGLCYNHELSPSQSYCDDSNELYPCVEGVEYYGRGAIPVYWNHNYGIIGNGIKQDLLNHPELLEQNATLAFEAAVWRWMTPMKRKQPSAHDVFVGNWKPTKNDTLSKRYPGFGATMNILYGDDICGQGSTDKMNTIISHYQHYLDLMGVGRQHSGDNLDCGDQVAFNPSSESSDF

SEQ ID NO: 22003 - DNA, 382 bp, Panicum virgatum
  misc_feature: Ceres CLONE 1819259
  misc_feature: Encodes the peptide sequence at SEQ ID NO. 22004
aaaccattcccctcccccttctagatggagagatagagaagaaaagataagctcagctcagctcgcaagcaagaggtggagatgcggagcccacgaggaggagggcgcgcccatgagcacgtcgacctgatcccgggcatccccgacgacgtctccgtcgactgcctggcgcgcgtgccccacgcgtcccaccgcgcgctgcgccgtgtctgccgcggctggcggagcgccgccgccgcggcggccttcggcgcggctcgagccgccgcgggtgagaatgatgacctcacctactcgcgcgactcaccggaacccgcgggcctccaccgacgccggcgatggatggaccattgactgcggtgcgccgcccaccgcgtccgcc

SEQ ID NO: 22004 - protein, 90 aa, Panicum virgatum
  misc_feature: Ceres CLONE 1819259
  misc_feature (15)..(62): Pfam Name: F-box Pfam Description: F-box domain
MRSPRGGGRAHEHVDLIPGIPDDVSVDCLARVPHASHRALRRVCRGWRSAAAAAAFGAARAAAGENDDLTYSRDSPEPAGLHRRRRWMDH

SEQ ID NO: 22005 - DNA, 672 bp, Panicum virgatum
  misc_feature: Ceres CLONE 1819262
  misc_feature: Encodes the peptide sequence at SEQ ID NO. 22006
attcacatgtgattggacttgggcctgggcgtcctagcgatagccaaatcgttcgttcgccgctccggcgaagtctgcacgtcctcgttcatctcgccgcccgccgcctcgtcggtcctcttcaacggcggcttcggcggcgaggaggatcagggtcatatccgcagccactcgctccaccggcaccagcctctgcttagcccccaactgagtgctcgcgtgagggggtgagaattgagatccatctggatccagtcggccgtcaatggaagcggcggcgggcggcaagcgcgcgtacagcatcatcgtgcccacctacaacgagcgcctcaacgtcgccctcatcgtgtacctcatcttcaagcacctcccagatgtgaactttgagatcattatcgtggatgatggtagtccagatggaactcaagatattgtaaaacaattgcaggaagtgtatggtgaagatcgtgtcttactgcgagctaggccaaggaagctaggacttggtactgcatatttacatggattaaagcatgcctcgggggagtttgttgttatcatggatgcggacctatctcaccatccaaagtatttgccaagctttattaggaagcaaaaagaaactggtgctgatgttgtaactggcacacgttatgttaagaatggtggtgt

SEQ ID NO: 22006 - protein, 135 aa, Panicum virgatum
  misc_feature: Ceres CLONE 1819262
  misc_feature: SWISSPROT Homolog: EC 2.4.1.83 Dolichyl-phosphate beta-D-mannosyltransferase
MEAAAGGKRAYSIIVPTYNERLNVALIVYLIFKHLPDVNFEIIIVDDGSPDGTQDIVKQLQEVYGEDRVLLRARPRKLGLGTAYLHGLKHASGEFVVIMDADLSHHPKYLPSFIRKQKETGADVVTGTRYVKNGG

SEQ ID NO: 22007 - DNA, 666 bp, Panicum virgatum
  misc_feature: Ceres CLONE 1819266
  misc_feature: Encodes the peptide sequence at SEQ ID NO. 22008
gcccataccatttgcaaagcccgctgcgactgcggcgccaatggccgaccgcgtctacccggccgccaagcccaacccgcccccggcggccgcggccgccaacggcggcgcaccggcgtcgttcccggcgcccaaatcgcagacgtaccagcggcccatctaccggccgcaggcccccgcgaagcgccggcgatcctgccggtgcagcctctgctgctgcttctgctgggcgctgctggcggtgatcctcctggcgctcgccgccgccgcggcgggcggcgccttctacctcctgtaccgcccgcagcgcccgtcctttaccgtctcctctgtgcgcctggcgtcgctgaacctcacctcctccgccaccgcgccggtgctcaccgacgccatcacgctgaccgtcaccgcccgcaaccccaacaagaagatcgcctacctctacggcgacttcaccctgtcggcggccacgtccgccaacgcgctcccgctgggcagcgcgacggtgcccgggttcgcgcacgcggccggcaacaccacggtgctgaccgccaccatcgcctccagcgcggcggcggtggacccgagcgcgagcggcgacgtgaagaagtcgggcgggttcggcgtggtcctggacgcggacacgagcgcgggcgcccgcgtggg

SEQ ID NO: 22008 - protein, 208 aa, Panicum virgatum
  misc_feature: Ceres CLONE 1819266
  misc_feature (83)..(208): Pfam Name: Hin1 Pfam Description: Harpin-induced protein 1 (Hin1)
MADRVYPAAKPNPPPAAAAANGGAPASFPAPKSQTYQRPIYRPQAPAKRRRSCRCSLCCCFCWALLAVILLALAAAAAGGAFYLLYRPQRPSFTVSSVRLASLNLTSSATAPVLTDAITLTVTARNPNKKIAYLYGDFTLSAATSANALPLGSATVPGFAHAAGNTTVLTATIASSAAAVDPSASGDVKKSGGFGVVLDADTSAGARV

SEQ ID NO: 22009 - DNA, 1314 bp, Panicum virgatum
  misc_feature: Ceres CLONE 1819280
  misc_feature: Encodes the peptide sequence at SEQ ID NO. 22010
gcaaagccctcgtccttatccccaacccacaccggcagctccccatcccatccgtccccatctgagctgagctccccgtcggcgtaggtccccactgcctgacctcccctcgccgtcgcgagaccgagcagccagtagccgcaggagtaggtgctccctgctccgtgtcccgccttccaatacccgaaagggacgccgcctcccctcttcgcacggcacgcgaggtgttcgacggagagccgagccgcacaggaggaggaggtgggagccggcggcccgcccatgtcgagcggcgcggacggatcggcgcccggcccggccctcgacccgacgccgggcccggagctgaaccgtgagccgcccgtgctgcaggctccggagccggcaccgcagcaggagatggcggcgttgcagatggaggcgccggcgccgcagcaggaggcggtggcgttgcagatggagacgccggggccggcgccgcagcaggaggtggtggcgttgcagatggaggcgctggcgccggcgccgcagcaggaggtggtggcgctgcagacggaggcgccgatgccggcggttaccatcgtgatctcgcggccaggggacgagcttcatgcgcccgatgcaaagggcgtctccccagcgtcctccccgcaggccggtggcggcaaggccacggccgcctccgtgtcggtgaccgctgcggtggccgcgaaggaggccgagctggcgaggtccgacagcttcgacgactacgagcaatgcagagtttgtcagcagaagacagaagaacctctggtagatcttggatgcagatgtcgtggagatcttgctaaagcacatcgcacatgcattaatgtttggtttcgtactagaggatcaaacaaatgtgagatatgccagcaagtggctgtcaatatcccccctccagaaacgcaagcaagtggatggtttagcccactttgggtcgcgtttgcaattctgattggtggtctcttattggacgtgctgatatctgtttcccttggtgtctccgcacttcctgtcaacataataattggtgtgcttatcgttctcggcttgggcaccgcccttcgcctagctctggagtgctgtcaggaatggggctcgaggaggaatgtgagcaacatgccaaggatggagaacataccgcctactgggtaccatcctgcagtcgtataattctgaggtttgtaaatagcgtagaaacatctaagctcgtgctggcttttggattcacctcgtgattaacttaatctcacacgattgctgctcgtcaaagtcgagctcagattc

SEQ ID NO: 22010 - protein, 305 aa, Panicum virgatum
  misc_feature: Ceres CLONE 1819280
  misc_feature (160)..(205): Pfam Name: zf-C3HC4 Pfam Description: Zinc finger, C3HC4 type (RING finger)
MSSGADGSAPGPALDPTPGPELNREPPVLQAPEPAPQQEMAALQMEAPAPQQEAVALQMETPGPAPQQEVVALQMEALAPAPQQEVVALQTEAPMPAVTIVISRPGDELHAPDAKGVSPASSPQAGGGKATAASVSVTAAVAAKEAELARSDSFDDYEQCRVCQQKTEEPLVDLGCRCRGDLAKAHRTCINVWFRTRGSNKCEICQQVAVNIPPPETQASGWFSPLWVAFAILIGGLLLDVLISVSLGVSALPVNIIIGVLIVLGLGTALRLALECCQEWGSRRNVSNMPRMENIPPTGYHPAVV

SEQ ID NO: 22011 - DNA, 820 bp, Panicum virgatum
  misc_feature: Ceres CLONE 1819294
  misc_feature: Encodes the peptide sequence at SEQ ID NO. 22012
caatcatccgcccccaatccccaaaagcacccacccctctcgcggacgcgcgagatcccacgcgcaccaccatcccccggcggattccctccttccgcggtggtggtggcctccggtggaggctggcgcgggcgagcgagcgagcgatggacgcggcggcgaagaagatgacgcggggcatgtcgcggcagctctcgtcgggggcggcgcggctatggcgccagctgtcgctggaccagcacaccccgcggcgcggcgggccgggcgcgggggccgggccgacgcggttcgcgatcgcgaggcagtcgtcgctcgacccgacgccgcggggcgggccggaccggtcgtcggcgcaccagcagctcgcggtgccggagaacctggacgccacgatgcgcctgctcttcgcggcgtgccagggggacgccgccggggtggaggagctgctcaggggcggggtggacgtcgacagcatcgacctcgacggccgcacggcgctgcacatcgccgcctgcgagggccagggggaggtcgtgcggctgttgctcgactggaagaccaacatcaacgcccgcgaccgatggggaagcacggtgcgtcaactgtaccggcacggcggcacttcattaatgaactgctagctctctctgctcctcttacgcgaacgcgatcgttctagttgtggtgtattgttcacttctctgaaccggagcctatgcatacatagacctttcgctgcactacttcagttcatactggaagtacggctacagagcaatgctagatcaatgcaacgcgaactgaacgaactttatggttt

SEQ ID NO: 22012 - protein, 164 aa, Panicum virgatum
  misc_feature: Ceres CLONE 1819294
  misc_feature (113)..(145): Pfam Name: Ank Pfam Description: Ankyrin repeat
  misc_feature: SWISSPROT Homolog: EC 3.5.1.2 Glutaminase
MDAAAKKMTRGMSRQLSSGAARLWRQLSLDQHTPRRGGPGAGAGPTRFAIARQSSLDPTPRGGPDRSSAHQQLAVPENLDATMRLLFAACQGDAAGVEELLRGGVDVDSIDLDGRTALHIAACEGQGEVVRLLLDWKTNINARDRWGSTVRQLYRHGGTSLMNC

SEQ ID NO: 22013 - DNA, 577 bp, Panicum virgatum
  misc_feature: Ceres CLONE 1819360
  misc_feature: Encodes the peptide sequence at SEQ ID NO. 22014
ggcggtctctctcccttgactcgtcagcttccaccttcctggcttcccctctctggctcccccctccccctccccttcggcctttcccatgtgggcggcctcgagctctgcttagatcacagctgtgctcgttggttgggtgatccgccccttgtcggctcggctcctttcagctccgagctcggggacagggaggcaccttcagaaatggattttttcacggaatatggtgagggcagcaggtacaacataaaagaggtcatagggaaagggagctatggtgtggtttgctctgccctggacacccatactggcgaaaaggttgctataaagaagataaatgacatcttcgagcatgtgtctgatgcgacaaggatactccgtgagatccagttgcttacactactgcgacatccagatattgtggaaatcaaacatattctacctccaccatcaaggagagaattcagggatatatatgtagtttttgaactcatggagcctgatttgcaccaagttataaaggctaatgatgacctgaccccagagcaccatcagttcttcttgtatcagttgc

SEQ ID NO: 22014 - protein, 123 aa, Panicum virgatum
  misc_feature: Ceres CLONE 1819360
  misc_feature: SWISSPROT Homolog: EC 2.7.11.24 Mitogen-activated protein kinase
  misc_feature: Useful for making plants with altered cell wall content and/or composition
MDFFTEYGEGSRYNIKEVIGKGSYGVVCSALDTHTGEKVAIKKINDIFEHVSDATRILREIQLLTLLRHPDIVEIKHILPPPSRREFRDIYVVFELMEPDLHQVIKANDDLTPEHHQFFLYQL

SEQ ID NO: 22015 - DNA, 696 bp, Panicum virgatum
  misc_feature: Ceres CLONE 1819374
  misc_feature: Encodes the peptide sequence at SEQ ID NO. 22016
aagataagagcagacttctctgcaaatgtcacagctaacacaatcacaatacaaatgccagtgccctcctacacaatgagagcaagttttgagttacaagctggagcagttgggcaaacaacagattttaaggagggatccaggagacttgagtggaatctaaagaagattgttggtggttctgagcacacccttcgtgcaaagctgacattttcccaggagtcgcatggaaatatcacaaaggaagctggtccggtgaacatgaatttcactatacctatgtacaatgcgtcaaagttgcaggtcaggtatcttcagatagcgaagaaatcaaagacatacaatccatacagatgggtgcgatatgtaacacaagctaactcctacgtagctcgtctatgaggaacccgtgtttgtacacttgtttctggtccattttttggtgtattatttgaggtttatcttggacagagtggcacccacacccctactgctcttcctccgccttcacccacctctcttcctcagctcctccccctccccacggccgtagcagccatggcgaccgccacctcctcctcgtcttcccggcgcagctccgaaccaagacaccacctcctctagccctcctccagccgctgccaaggatcacgtagccgtacataagttcggagagggtagtgtgcaagtgtatag

SEQ ID NO: 22016 - protein, 133 aa, Panicum virgatum
  misc_feature: Ceres CLONE 1819374
  misc_feature (1)..(133): Pfam Name: Adap_comp_sub Pfam Description: Adaptor complexes medium subunit family
KIRADFSANVTANTITIQMPVPSYTMRASFELQAGAVGQTTDFKEGSRRLEWNLKKIVGGSEHTLRAKLTFSQESHGNITKEAGPVNMNFTIPMYNASKLQVRYLQIAKKSKTYNPYRWVRYVTQANSYVARL

SEQ ID NO: 22017 - DNA, 1765 bp, Panicum virgatum
  misc_feature: Ceres CLONE 1819389
  misc_feature: Encodes the peptide sequence at SEQ ID NO. 22018
ctgtctctctcagatccctctctcctcttcttctcccttccgtccccaaatcgtcgcggggagcctaccgatccctcgcccgcctcccgtcgcgcgcgccaggtggacccgggggcggtgcttgccctgccgccgcgatggatcgcgccgagctcaccaccgagcaggttctcaagcgggacattccatgggagcattacatgtcaactaagcttatttctgggacatgccttcagcttttacggcgctatgaccagaaaccagagagccagcgtgctcctttgcttgaggaggatgggccagcatatgttcgagtttttctgaatatactacggagtatctctaaggaaaagactgtggaatatgtgcttgccctcattgatgagatgcttgcaacaaatcctaaacgcgcaacactgttctatgaccaatctctgtctggtgaagatatttatgagcctttcttaagattgctctggaaaggcaactggtttgtacaagaaaaaagttgtaagatattgactgatatagtaagtgcacggcctaagcatcagaatggcatgcttccaaatggagactcttcaaattcgaagagcaagcttacttcaacacatgatgtgttgagaggtttggttgattggatctgttctcagctgaggaatcctacccacccgagctgttctgttcctactgctatccactgcctctccactctgctaagagaagcatatgttaggacattatttgttcaagcggatggtatcaagctgctcattcctttaatatccccagcttcaacacaacagtcaattcagctcctttatgaaacttgcctctgcatctggcttttatccttttatgatgcagcagttgattatttgtccactacaagggttatgccaagacttgtagaggttgtcaaagtctctactaaagagaaggtagtcagagttgttgtcatgtccttccgtaatttgctggccaagggtgcatttgctgcccagatgatcgatcttggattgccacagatagtacaaaacttgaaagctcaagcatggactgatgaggatctactagatgctttgaatcaactagaggtgggactcaaagacaacctcaagaagttgcgctcatttgataagtacaaacagcaagttcttctcggtcaccttgactggtctccaatgcacaaagatccaagtttctggcgtgagaacattaacaatttcgaagaaaatgatttccagattctacgtgtcctgatgacaattatcgacacatcaagtgacaccactgctcttgccgtggcctgctacgacctctcacagttccttcagtaccacccatctggccgaattgtggtggcagacctcaaggccaaggaccgagttatgaagctcatgaaccacgagaatgctgaagtgaggaaaaacgcactgctatgtgtgcagaggctattccttggtgcaaagtatgccagcttcctgcaggcttgaggtagaccgtaccgagtttttgtatttagatccagagaacccccactggccatttgtcagaatggccgaaccatgattgaaagaccctgaaaattcttgtccagtataccctattgttattcgatttccagaaccgatgtataataaataatcagagccatgccctcttcgatgtaataaagtgtccatgggcttgttgattctttcgttcttctgaacagatttctatgaagtgaaaagacatgatttatgtaaatgttaacttcagc

SEQ ID NO: 22018 - protein, 452 aa, Panicum virgatum
  misc_feature: Ceres CLONE 1819389
  misc_feature (1)..(407): Pfam Name: V-ATPase_H Pfam Description: V-ATPase subunit H
  misc_feature: SWISSPROT Homolog: EC 3.6.3.14 H(+)-transporting two-sector ATPase
MDRAELTTEQVLKRDIPWEHYMSTKLISGTCLQLLRRYDQKPESQRAPLLEEDGPAYVRVFLNILRSISKEKTVEYVLALIDEMLATNPKRATLFYDQSLSGEDIYEPFLRLLWKGNWFVQEKSCKILTDIVSARPKHQNGMLPNGDSSNSKSKLTSTHDVLRGLVDWICSQLRNPTHPSCSVPTAIHCLSTLLREAYVRTLFVQADGIKLLIPLISPASTQQSIQLLYETCLCIWLLSFYDAAVDYLSTTRVMPRLVEVVKVSTKEKVVRVVVMSFRNLLAKGAFAAQMIDLGLPQIVQNLKAQAWTDEDLLDALNQLEVGLKDNLKKLRSFDKYKQQVLLGHLDWSPMHKDPSFWRENINNFEENDFQILRVLMTIIDTSSDTTALAVACYDLSQFLQYHPSGRIVVADLKAKDRVMKLMNHENAEVRKNALLCVQRLFLGAKYASFLQA

SEQ ID NO: 22019 - DNA, 2236 bp, Panicum virgatum
  misc_feature: Ceres CLONE 1819403
  misc_feature: Encodes the peptide sequence at SEQ ID NO. 22020
accagccttcctcctctcgctccgttcctcttcgcctgccgattgacgaggaatttctagagcgccgtaccggcgtacgactccttcccgagccccgacccgccgctcgccggaattgggaggcagccttgccttgccttgcgccgcggcgagaggcgcggctaaggagctagggaggggtgatgtacccggtggccacgggcccgccgccggcgcggctgccggcggcgtcgcgggtggacaaggccacgagccacctgctgcagggccccgactgggccgtcaacctcgaaatctgcgacacgctcaacgccgaccgctggcaaaccaaggatgtggtaaaagcagtgaagaagcgattgcagcataaggacccaaaagttcaattcctaactttgacgttgttggagacaatgatgaagaactgtggtgaaaatgttcattttgaagttgttgatcaacatattttacaggagatggttaaaattgtccagaagaggcatgatatgcaagtgagggataaggcattattacttttagattcatggcaagaggcatttggtggacctggaggcaaatatccgcagtattactggtcatacattgaactcaagaggtcaggagtaatgttcccacgacgtcctgtggatgctcctccaatatttactccacccgcaatacatcaagcatatggttcacctagatatccttctggaagttcaaatgagagaatgacatccgatgttgaaacattgagtttcgagggcttgaataatattagaaatgcaacagaactgctgcgtgatatggtgaatgctttgaaccccgctgatcgcatggcagttaaagatgagattattacagatcttgtaaatcaatgtcgttcaaatcaacaaaagctcatgcaatttgtcagttccacaggggatgaggaactgctaaagcaaggcctagaaattaatgatggcttacagagtgtacttgcaaaacatgatgctattgcttctggttcaccattaccggttgaaacaccaagtagagaagagttacgcacagaggatcaaaaccaacagccatctacaccagcaattccacatgataataaggttcaagttgaagaggatgaagaggatgagtttgctcagatcgcaagaagaaaaaacaaatctgtgataagcagtgatgaggcatcgtccagtgctggtgatcaggcccttatagctgttgatccagcactttctgaagtctcttcggttgcaagcaatgcactggttcctgttgattcaacttctgtcagtagcacaaggaccaaagagcaggatatgattgaccttctcagcctcaccttgtacagtcctcctgaaccatctacggattcttcaacacagagccaaaatggggctcaaccgagtgtctcatcaaatggaccagaagtaccgtcaaactatcagcctgctgtggcaaatggggcaaattatcctgccaataaccaggctattccaacaacccagggatatcttccatacaacaactatgttgcaccttgggcccaaactggaccagtctctcagccaggagcatatcagactcaaccccagcaatatgtgtccagctatccagcaccaccatgggttatgcctgcaaatgccaactcaaccaatcctttccagcctgcgacataccaaatgccaaaccctcccgttgcttctgtttcccctgcagctacctatccagctccgtcgaagccgtatgctgctccgccaatgcaacatgttccgtctccaaaccccaagccgatgcatagttacaactcttttgtttctcaaacatacaatggtccaagcatggcatcagatgctcggatgaatgggaatcaacggccaaaagaaactccagcgacagcagccagaccgtattacatgccagacaatttgtttggtgatttgatcgacgtgaagagttttggcgcaggaagcaagatcaataggtcgaccagcatgccaagtcctaagggtggtggccagcctatgataggtagaaataaataggcctccgcagttcaaatttgagatgatcatattgattagtcgctactgtcgtttggcttgatgtaaatcactgtatcggccagtcagttagtattggttactttggtaaatttcgtggttgcggcgtgcgtatttttactagagatggtagagcgtcattgctactgatgatcaatgacattctcacg

SEQ ID NO: 22020 - protein, 621 aa, Panicum virgatum
  misc_feature: Ceres CLONE 1819403
  misc_feature (13)..(147): Pfam Name: VHS Pfam Description: VHS domain
  misc_feature (186)..(283): Pfam Name: GAT Pfam Description: GAT domain
MYPVATGPPPARLPAASRVDKATSHLLQGPDWAVNLEICDTLNADRWQTKDVVKAVKKRLQHKDPKVQFLTLTLLETMMKNCGENVHFEVVDQHILQEMVKIVQKRHDMQVRDKALLLLDSWQEAFGGPGGKYPQYYWSYIELKRSGVMFPRRPVDAPPIFTPPAIHQAYGSPRYPSGSSNERMTSDVETLSFEGLNNIRNATELLRDMVNALNPADRMAVKDEIITDLVNQCRSNQQKLMQFVSSTGDEELLKQGLEINDGLQSVLAKHDAIASGSPLPVETPSREELRTEDQNQQPSTPAIPHDNKVQVEEDEEDEFAQIARRKNKSVISSDEASSSAGDQALIAVDPALSEVSSVASNALVPVDSTSVSSTRTKEQDMIDLLSLTLYSPPEPSTDSSTQSQNGAQPSVSSNGPEVPSNYQPAVANGANYPANNQAIPTTQGYLPYNNYVAPWAQTGPVSQPGAYQTQPQQYVSSYPAPPWVMPANANSTNPFQPATYQMPNPPVASVSPAATYPAPSKPYAAPPMQHVPSPNPKPMHSYNSFVSQTYNGPSMASDARMNGNQRPKETPATAARPYYMPDNLFGDLIDVKSFGAGSKINRSTSMPSPKGGGQPMIGRNK

SEQ ID NO: 22021 - DNA, 1603 bp, Panicum virgatum
  misc_feature: Ceres CLONE 1819410
  misc_feature: Encodes the peptide sequence at SEQ ID NO. 22022
gctggagaggagtacacgcctcattacgcccatccacgtgcgcgccccgccccatcacgaagcttttcctcggcggcgtcgccatctcaccggcggcggaggcgatggcgagctcgtcggtggcggcggacatggagctcgaccgccccaacctggaggactacctcccgcccgactcgctcccgcaggaggcgccccggaatctccatctgcgcgatctgctggacatctcgccggtgctcaccgaggcggcgggcgccatcgtcgatgactcgttcacacgttgctttaagtcgaattctccagaaccatggaattggaacatatatttgttccccttatggtgcttgggtgtagtgataagatatggaatactctttccactgaggtccctaacgcttgcaataggatggttagcattttttgctgccttttttcctgtccatttcctattgaaagggcaagacaagttgagaagtaaaattgagaggaagctggttgaaatgatgtgcagcgtttttgttgcttcatggactggagtgatcaagtatcatggaccacggccaagcacacgacctcatcaggtatttgttgcaaaccatacatcaatgattgattttattattctggagcaaatgacagcatttgctgtcatcatgcagaagcatcctggatgggttggatttattcagaagactatcttggaaagtgtgggttgcatctagtttaatcgtaatgatctcagggatcgtgaagttactgcacggaagttacgcgatcatgttcaacaaccagacaacaaccctctcttgatttttccggaaggaacttgtgtcaacaaccagtacacggtcatgttcaagaagggtgcctttgaacttggctgcgctgtctgtccaataactatcaaatacaataagatatttgttgatgccttttggaacagtaagaagcaatcttttacaatgcatttggtccggctgatgacttcatgggctgttgtgtgtgatgtttggtacttgcctcctcaatacctgagggagggagagacttcaattgcatttgctgagagagtaagagacatgatagctgctagagctggtcttaagaaggttccgtgggatggctatctgaaacacaaccgtcctagtcccaaacacactgaagagaaacaacgcatatttgccgattctgtcttgatgagactagaggagaaatgaagacacgtggagcggtacaagtgcacttgattagggatcgatttaccattcagctaccttgtaattcggttgggttccagaaacaaaaaatgtgagtctgggacacgtcaagtgaccagctcagttttgttgtaaattttgttagtagttcgatagaattaatagtatgtacttctcaggaaaggaatgctcgcatgtgttttggatgttcacttgatggtctgtgttaggggctgacgcctaagcatggtgctctattgagatgccgtgttggtattaatgagttgtgaccgtatcatggtttaaattcatgtgattatatattatgtatatggattagtttgatttgatatcaagaagcgcggatgcagaacatctaattt

SEQ ID NO: 22022 - protein, 206 aa, Panicum virgatum
  misc_feature: Ceres CLONE 1819410
  misc_feature: SWISSPROT Homolog: EC 2.3.1.51 1-acylglycerol-3-phosphate O-acyltransferase
  misc_feature: The sequence is a functional homolog of SEQ ID NO 26 in US patent 7235714
MASSSVAADMELDRPNLEDYLPPDSLPQEAPRNLHLRDLLDISPVLTEAAGAIVDDSFTRCFKSNSPEPWNWNIYLFPLWCLGVVIRYGILFPLRSLTLAIGWLAFFAAFFPVHFLLKGQDKLRSKIERKLVEMMCSVFVASWTGVIKYHGPRPSTRPHQVFVANHTSMIDFIILEQMTAFAVIMQKHPGWVGFIQKTILESVGCI

SEQ ID NO: 22023 - DNA, 693 bp, Panicum virgatum
  misc_feature: Ceres CLONE 1819415
  misc_feature: Encodes the peptide sequence at SEQ ID NO. 22024
gatcgaagcggcgcgcttctccccgtccctcgccgccgccgccttcctcgcccgccggccccctcccgcgctgttccccttctccctccgccgcaggatccctctcctccacgtccttgccggctcgtcaggcggggacgggcgcgtcgtcgcgctctcctcgtctgagctccgcaaacgccggggcctctcctcgtcgtccggagccgcggacccggcctctgacggggatgagaagctccgctcgctccgacgcctcttcgcgcgcccagacgttgccatcgacgcctacatcgtcccctcgcaggacgcccaccagagcgaattcattgcagaatgcttcatgaggcgtacatacctgactgggttcactggcagtgctggtacagctgtggttacaaaagataaagctgctctctggactgatggccgatattttcttcaggctgagaaggaattgacccatgaatggacacttatgcgcagtggaaatcatggcgttccaactactagtgagtggttgaatgatgttttaccatctggttgccgagttggtattgacccgtttcttttctcttttgatgctgccgaagaattaaaagattcaatctcaaataaaaaccatgagctggttttggttcgtggcatgaatctagttgatgaaatatggggagatgcaaggccagagccccc

SEQ ID NO: 22024 - protein, 230 aa, Panicum virgatum
  misc_feature: Ceres CLONE 1819415
  misc_feature (79)..(219): Pfam Name: Creatinase_N Pfam Description: Creatinase/Prolidase N-terminal domain
IEAARFSPSLAAAAFLARRPPPALFPFSLRRRIPLLHVLAGSSGGDGRVVALSSSELRKRRGLSSSSGAADPASDGDEKLRSLRRLFARPDVAIDAYIVPSQDAHQSEFIAECFMRRTYLTGFTGSAGTAVVTKDKAALWTDGRYFLQAEKELTHEWTLMRSGNHGVPTTSEWLNDVLPSGCRVGIDPFLFSFDAAEELKDSISNKNHELVLVRGMNLVDEIWGDARPEP

SEQ ID NO: 22025 - DNA, 512 bp, Panicum virgatum
  misc_feature: Ceres CLONE 1819432
  misc_feature: Encodes the peptide sequence at SEQ ID NO. 22026
gcagccaagcgccacgctccaccagtccaccggaccaaccagccgcgcgcggtgatcagctagtgcggtggtgttgctttccgctccgtgggcgcggaccggcatccagcggggaggatgaagaaggtgtcggtggccgctgcggcgggcgcggcgctgctgctgctgttgctgctggcggcggcggcgacggaggggagcgagctcgagctggactactacccccagacctgccgcgggtgggagaacgtggtcaagtaccacgtccccgaggccatccgggccaaccgcgccagcggcgccgccctcgaccgcctcatcttcctccactgcttcctacggcgatgcgacgcgtcggtgctgctcgatccgacgccggcgaacccacacacggataccacagcgcccatccgcatcgggctggcggcgttcgatgtgatccacgacatccaggcagtgctggacgagcggcgccccggcactgtgtcgtgctcggacatcgtggtgttcgc

SEQ ID NO: 22026 - protein, 131 aa, Panicum virgatum
  misc_feature: Ceres CLONE 1819432
  misc_feature: SWISSPROT Homolog: EC 1.11.1.7 Peroxidase
MKKVSVAAAAGAALLLLLLLAAAATEGSELELDYYPQTCRGWENVVKYHVPEAIRANRASGAALDRLIFLHCFLRRCDASVLLDPTPANPHTDTTAPIRIGLAAFDVIHDIQAVLDERRPGTVSCSDIVVF

SEQ ID NO: 22027 - DNA, 1266 bp, Panicum virgatum
  misc_feature: Ceres CLONE 1819434
  misc_feature: Encodes the peptide sequence at SEQ ID NO. 22028
acacacatattctctcctctctcctcccccaactactccctctctctctctctctctctctctctctctctctctctctctacatccacagagcacaaaattgaagcagctagagagcacatgcacgcaggccataggtaaacttttgcaagaaaccatttgcttgtattatctcccagcagaagatctagacgacaacaacagaaactctgtatggagcaagaagaggtcggtctagccctgggcctctccctgggctccggccaccaccagctcaaggagcaaccctcgccgtcgtcgcactcgtgcacgctgctggagccgtcgttgtcgctccgcctcccagccaaagacagcccggcggcacgggtgaggattgctgccgtgaagagggagctgcggatggaggaggacgacgaggccaccgacagggcgctttactcggtggcgtcgtcggcactggtggcgccggacgacgatgaagggtgcaacagtcggaagaaactgaggctaaccaaggagcaatcggcgctgctggaggaccgcttcaaggagcacagcaccctcaacccgaagcaaaaggctgctttggcaaagcaactgaacctcaygycaaggcragtggaggtgtggttccaaaacagaagagccagaacgaagttgaagcagacagaggtggactgtgagcttctcaagcgctgctgcgagacattaaccgaggagaaccgccgcctccaccgtgagctccagcagctccgcaccctcaaccacccccacaccgccgcctttttcatgcccgccgccactctctccatctgcccctcttgtgagcgcctctccggagcacctgcctccacctctaccaatggtgcagacaggactaaggatagtggccctggtgatatgcctcgactagagatagcatataattaatatcctcctccgctcaccttgaattccacagctttgttttttttcacaagataatgaattatattactagcgtgtgaggaggatggagcacctcacatgctactaggaaaaagaaatgtcttgtttgatgttgttggtgtagctatagctttagtagttgttactgaagaatttccttttattaattgtcagtcagggaagtatcatcattagatgatgatgacatgacaccacagacgcatcccgccagtttatttggatgtggattcatgtatatatatgcctatgatgtatctgtttcaccaattcaataatatatattgatttgtttcg

SEQ ID NO: 22028 - protein, 239 aa, Panicum virgatum
  misc_feature: Ceres CLONE 1819434
  misc_feature (151)..(195): Pfam Name: HALZ Pfam Description: Homeobox associated leucine zipper
  misc_feature (96)..(150): Pfam Name: Homeobox Pfam Description: Homeobox domain
  misc_feature: The sequence is a functional homolog of SEQ ID NO 2326 in the 10/374,780 US patent application
  misc_feature: The sequence is a functional homolog of SEQ ID NO 252 in the 10/412,699 US patent application
  misc_feature: The sequence is a functional homolog of SEQ ID NO 546 in the 11/479,226 US patent application
  misc_feature: The sequence is a functional homolog of SEQ ID NO 8 in the 10/225,068 US patent application
  misc_feature: The sequence is a functional homolog of SEQ ID NO 568 in the 11/479,226 US patent application
  misc_feature: The sequence is a functional homolog of SEQ ID NO 2328 in the 10/374,780 US patent application
  misc_feature: The sequence is a functional homolog of SEQ ID NO 524 in the 10/225,066 US patent application
  misc_feature: The sequence is a functional homolog of SEQ ID NO 553 in the 11/479,226 US patent application
  misc_feature: The sequence is a functional homolog of SEQ ID NO 254 in the 10/412,699 US patent application
  misc_feature: The sequence is a functional homolog of SEQ ID NO 550 in the 11/479,226 US patent application
  misc_feature: Useful for making plants with altered lignin content
  misc_feature: Useful for making plants with modulated biomass
  misc_feature: Useful for biocontainment applications
  misc_feature: Useful for making plants with modulated flowering time
  misc_feature: The sequence is a functional homolog of SEQ ID NO 542 in the 11/479,226 US patent application
  misc_feature: Useful for making plants with altered alkaloid content
  misc_feature: The sequence is a functional homolog of SEQ ID NO 10 in the 10/225,066 US patent application
  misc_feature: The sequence is a functional homolog of SEQ ID NO 136 in the 11/375,241 US patent application
  misc_feature: The sequence is a functional homolog of SEQ ID NO 1873 in the 11/479,226 US patent application
  misc_feature: The sequence is a functional homolog of SEQ ID NO 304 in the 10/374,780 US patent application
  misc_feature: The sequence is a functional homolog of SEQ ID NO 838 in the 10/225,066 US patent application
  misc_feature: The sequence is a functional homolog of SEQ ID NO 1674 in the 10/374,780 US patent application
  misc_feature (133)..(133): Xaa is any aa, unknown, or other
  misc_feature (134)..(134): Xaa is any aa, unknown, or other
  misc_feature (136)..(136): Xaa is any aa, unknown, or other
MEQEEVGLALGLSLGSGHHQLKEQPSPSSHSCTLLEPSLSLRLPAKDSPAARVRIAAVKRELRMEEDDEATDRALYSVASSALVAPDDDEGCNSRKKLRLTKEQSALLEDRFKEHSTLNPKQKAALAKQLNLXXRXVEVWFQNRRARTKLKQTEVDCELLKRCCETLTEENRRLHRELQQLRTLNHPHTAAFFMPAATLSICPSCERLSGAPASTSTNGADRTKDSGPGDMPRLEIAYN

SEQ ID NO: 22029 - DNA, 1226 bp, Panicum virgatum
  misc_feature: Ceres CLONE 1819453
  misc_feature: Encodes the peptide sequence at SEQ ID NO. 22030
atcacataacagcacgccaaaaccactctagcctgcagtacgactgccactgaaccacgatcaccgcctcccactaccagcaccagctagtcctcgccaatttcaccctgaaaaatcagaaatggcatcgcctcatggtagcgttcgcgttcggcacggcatgagccacgtcgcgctcgtgctgatctccgtgctgctcctcagctcggcacgtctctccgcgggcgccagcaggaggctgctggagctgtacaagccgccggccagcgcgcggctcacctaccacaacggcgccgtgctgcagggcagcatcccggtgtccatcgtctggtacggccggttcacgccggcgcagaagtccgtggtcaccgacttcctccagtccctcaccgccgcctcgcaggcgcccaccccgtccgtctcgcagtggtggaacaacgtcaaccagctctacctgtccaaggcgccgcggaggggcagcggtagcgcgcaggtggtactcgccggccaggtctccgacgaggcgtgctcgctggggaagcgcctcacgctggcgcagctcccgcggctggcggcgcgggccgggcccaagaagggcggcatcgcgctggtgctcaccgcgcaggacgtggccgtggaggggttctgcatgagccgctgcggcctgcacggctccgacgccagggccgggacagcctacgcctgggtaggcaactccgccacgcagtgccccggccagtgcgcgtggccgttccaccagcccccgtacgggccccagacgccggcgctcgtgccgcccagcggcgacgtcggcatggacggcatggtgatcaacatcgccagcatggtcgcgggcacggtgaccaacccgttccgggacgggttctaccagggcgacaaggacgcgccgctggaggccgccaccgcttgcaccggggtctacggcagcggcgcgtaccccgggttcgccggcaacctggcggtggatcgcgcgacgggggcgagttacaacgccaatggcgcgcgtggaaggaagtacctgcttcctgcgctgttcgaccctgaaacatccacgtgttcaactttggtgtaacgcctaagtaaacaatcctgacagaaacgtgtagtagcaccgtacatatgcgagtgactggaagtgtatactgtagtaagggttaaatttttgtttcatatgaacaataaaaagaatccacttttgcagtatc

SEQ ID NO: 22030 - protein, 323 aa, Panicum virgatum
  misc_feature: Ceres CLONE 1819453
  misc_feature (52)..(323): Pfam Name: Phi_1 Pfam Description: Phosphate-induced protein 1 conserved region
MASPHGSVRVRHGMSHVALVLISVLLLSSARLSAGASRRLLELYKPPASARLTYHNGAVLQGSIPVSIVWYGRFTPAQKSVVTDFLQSLTAASQAPTPSVSQWWNNVNQLYLSKAPRRGSGSAQVVLAGQVSDEACSLGKRLTLAQLPRLAARAGPKKGGIALVLTAQDVAVEGFCMSRCGLHGSDARAGTAYAWVGNSATQCPGQCAWPFHQPPYGPQTPALVPPSGDVGMDGMVINIASMVAGTVTNPFRDGFYQGDKDAPLEAATACTGVYGSGAYPGFAGNLAVDRATGASYNANGARGRKYLLPALFDPETSTCSTLV

SEQ ID NO: 22031 - DNA, 1438 bp, Panicum virgatum
  misc_feature: Ceres CLONE 1819461
  misc_feature: Encodes the peptide sequence at SEQ ID NO. 22032
agtactagccctgcgccgcagcaatggtggtggcttcccccgccgcataaatcccaccactcccgcttctcggcgtgttctcctcggctgggcttccatcccctccaatcgcgcgggcgcggcgccgccgtggacatggcgaccggggagtgggagctgcgggaggaggacgactacgagtacgagttcgagttcgacctcgagaacccgttcaccagccccgccgacgagccgatcgccagcctcctcgacgccgagggccaccacgcgccctccgtctccgctgcggcctccgccgcccgccgcgacgccgccggattcatctccaaggtgcggttcggcggggagctcgccgtgcacccgcgcgtcgcgtacctcgcgctcaactacgtggatcgcttcctctccaagcgcgaattgccctacgagctgcagccgtgggcgccgcgactgctcgccgtcagctgtctctccctcgccgccaagatgcagcgcgtcgcagccgtctccatcgccgacatccagagggatgacgagttcatgttcgacgaggcgtccgtgcggcgcatggagcgcatggtgctgggcgcgctggagtggcgcacgcgctccgtcacgccgctcgctttcctcggcttcttcctctccgcgtgctacccggcgccccatcaccggacacaggtcgctgccgtcaaagcgcgcgccgtcgacctcctggtccgcgcccagcccgaggtcaagatggcggagttctcgccctccgtatcggccgcggccgcgctgctcgccgctgccggggaggtcgccgccgcgaacctccaggcgttccaagccgtcgtcgccgcctgcccctttgtaaatagcgacaagctgcgagagtgcggtgaggtgctggcggcggtgcgcggcgtcggcccggtgcgcggcgcggcgagcgcggacacgccggtgacggtgctcggtcactaccgcagcgccagctccgcgtccgagagcgactggaccgtcggatcggcggccaacggcggcggtggcgaggcgaagaagcgctgcatgggcccaccgtcgcattgggggtaggcggctgaccgagtcaagtggggggcttgtcagtttgtcacagctggatgaaggagttggaaatttactcgtgccctgcccctttcccaattttttttaccctttttcttttcaattcttttcttctactttaatcctctcgaggtaaagcggtggggatggatagaattcgcggtggtggtgcctgtcatttagtagctcctttttgctagtttgtcttttttagggggagcctagttatggtaatttttgcggcagtactccagaaggtgatgatggtggatgaacatattgggctgggagggggcgaaatgatgtgagatgccagaaaataaaaccaaaaggcatgttgctggtc

SEQ ID NO: 22032 - protein, 314 aa, Panicum virgatum
  misc_feature: Ceres CLONE 1819461
  misc_feature (32)..(158): Pfam Name: Cyclin_N Pfam Description: Cyclin, N-terminal domain
MATGEWELREEDDYEYEFEFDLENPFTSPADEPIASLLDAEGHHAPSVSAAASAARRDAAGFISKVRFGGELAVHPRVAYLALNYVDRFLSKRELPYELQPWAPRLLAVSCLSLAAKMQRVAAVSIADIQRDDEFMFDEASVRRMERMVLGALEWRTRSVTPLAFLGFFLSACYPAPHHRTQVAAVKARAVDLLVRAQPEVKMAEFSPSVSAAAALLAAAGEVAAANLQAFQAVVAACPFVNSDKLRECGEVLAAVRGVGPVRGAASADTPVTVLGHYRSASSASESDWTVGSAANGGGGEAKKRCMGPPSHWG

SEQ ID NO: 22033 - DNA, 1465 bp, Panicum virgatum
  misc_feature: Ceres CLONE 1819475
  misc_feature: Encodes the peptide sequence at SEQ ID NO. 22034
aaatcgcatctgttggccgtctcccgtcttccccaacctagcagccaaaccctaggtagggcacgatgctgggcggcctgtacggcgacctcccgccgccgtcgtcggccggcgacgacgacaaggcctcctcggcctccttctggtccagcgccaccaagatggcgccgcccaccctccgcaagccgtcaaccaccttcgccccgcccccctcgctcctccgcaaccagcacctgcgcccgcccaaggccgcctccgcatccgcctcagcggctcccgccacggctgcccccgtcgtggccgccgagcccgcccccgcgccgtccttccagccggcgttcgtggccgtccagtccaccgtgctggaggagtacgaccccgccaggcccaacgactacgaggactaccgcaaggacaagctccggcgggccaaggaggccgagctgagcaaggagctcgagcgccgccgccgcgaggagcaggagcgggagagggagcgcgagcagcgggagagggaggcccgcgagcgcgaggagagggactaccagtccagggcatcctccctcaacatatccggcgaggaggcgtggaagcggagggcggcgatgagcggtggcaccggagctgctgctgcgcagaggaccccctcgtccccgccgcacggggatgggtttgccatcgggagctcatcttccgctgggttgggcctgggcgccggcggacagatgactgctgcccagcggatgatggcgaagatggggtggaaggaaggtcaagggcttggcaagcaagagcaggggatcactgctcctcttgtggccaagaagactgataggaggggaggggttattgttgatgagagcagttcgaagccaccagaaaagaagccgaaatccgtcaactttgatgggccaccgacacgagttctgctgctccgcaacatggttggtcctggtgaggttgatgacgagctggaagatgaggtggcatctgagtgtgccaagtttgggacagtgactcgtgtgctgatatttgagatcacacagacagacttcccagctgaggaggctgtgaggatattcatacagtttgagcgagcagaagaagcaacaaaggcgatgattgatctgcaagggcggttctttggtgggcgtgtggtgcaggcatccttctttgacgaggaaaggtttgggaggaacgaacttgctcctatgccaggggaagtaccaggcttctttgattaaagaaaggaagtgctgatgcggtattagatcagaggctcacaattctttcttccccccaagacggatggagcataaagttggatagttgtagttttgctgtagctagtacagagatgtacgcgaactatttttgatacaagctgttgcgttttttgtgtgtcatcggctactgaactacccgtgtgtttatacatgacctttttgatagctttctcgtgctt

SEQ ID NO: 22034 - protein, 392 aa, Panicum virgatum
  misc_feature: Ceres CLONE 1819475
  misc_feature (220)..(264): Pfam Name: G-patch Pfam Description: G-patch domain
MLGGLYGDLPPPSSAGDDDKASSASFWSSATKMAPPTLRKPSTTFAPPPSLLRNQHLRPPKAASASASAAPATAAPVVAAEPAPAPSFQPAFVAVQSTVLEEYDPARPNDYEDYRKDKLRRAKEAELSKELERRRREEQEREREREQREREAREREERDYQSRASSLNISGEEAWKRRAAMSGGTGAAAAQRTPSSPPHGDGFAIGSSSSAGLGLGAGGQMTAAQRMMAKMGWKEGQGLGKQEQGITAPLVAKKTDRRGGVIVDESSSKPPEKKPKSVNFDGPPTRVLLLRNMVGPGEVDDELEDEVASECAKFGTVTRVLIFEITQTDFPAEEAVRIFIQFERAEEATKAMIDLQGRFFGGRVVQASFFDEERFGRNELAPMPGEVPGFFD

SEQ ID NO: 22035 - DNA, 1013 bp, Panicum virgatum
  misc_feature: Ceres CLONE 1819478
  misc_feature: Encodes the peptide sequence at SEQ ID NO. 22036
ctcccaagcttcgagcgaacagccgagaaaaaggaagcggagtagcggacgggagaccaggagtcaaggaccagggagataatcgaggcctcgaatcggtcgacgcgacgagatgtcttcgccagccgagtactacaattcacttccaccaataagcaaggcatatgggacattgtgtttctttaccaccgtcctgtttcatctccatatactgaacccagaatttattggcttatattacccctttgtattcaagaaatttgagatatggaggttatttacaaatttcttttttctgggcccgttttccatcaactttggtattcgtcttctgatgatagcaaggtatggtgtgcagttggaaaagggtgcgttcgaaaagcggactgcagatttcttgtggatgatgatatttggtgccatctcactactggtactgtcagctattcccctatttaagctttcattcttgggaatacctatggtcagcatgcttctgtatgtctggagccgagagtatccaaattctcagataaatatgtacggcctcgtccaattgaggtctttttatcttccatgggctatgcttggattggatgtgatatttggctcaccattactgcctggctttatgggtatcatagttggacatctatactacttccttgcagttttgcacccgctagccactggaaagaattatctgaagactccgaaatgggtgcacagcatcgttgctcgatacaaaataggtgtgcaggcaaactctccggtccgaccagcagccaacggtggtaccggtgccttcagaggaagaagctatagactcaatcaatagattgaccaggatagctcatcttataatgtgatgctgttgggactgcaatgtagagcagagctcacagctcaggacatacaagtttaagggttgctctcttaggggctctagaaaaatctgggcttgttacacttacacggaatggcgaatctttcgagtgctgatttagttcctg

SEQ ID NO: 22036 - protein, 241 aa, Panicum virgatum
  misc_feature: Ceres CLONE 1819478
  misc_feature (11)..(202): Pfam Name: DER1 Pfam Description: Der1-like family
MSSPAEYYNSLPPISKAYGTLCFFTTVLFHLHILNPEFIGLYYPFVFKKFEIWRLFTNFFFLGPFSINFGIRLLMIARYGVQLEKGAFEKRTADFLWMMIFGAISLLVLSAIPLFKLSFLGIPMVSMLLYVWSREYPNSQINMYGLVQLRSFYLPWAMLGLDVIFGSPLLPGFMGIIVGHLYYFLAVLHPLATGKNYLKTPKWVHSIVARYKIGVQANSPVRPAANGGTGAFRGRSYRLNQ

SEQ ID NO: 22037 - DNA, 612 bp, Panicum virgatum
  misc_feature: Ceres CLONE 1819488
  misc_feature: Encodes the peptide sequence at SEQ ID NO. 22038
tgccgacgccgcgatgccgatctgcacgccgtcgtcggactcctcggcctcgtcggcctccggcggccgcgcgtggatagtccacgggctggcgctcggcgtggcggcggcggcgccgtccccgctcagctccctcgacttcctgccgagcgggttccgcagccgcgcggtggggatcatacccgcgcgcttcgcctcctcgcgcttcgagggcaagccgctcgcgcacatcctcggcaagcccatgatccagagaacatgggaaagagttatgttagcttcttccttggaccacgttgttgtggcaacagatgatgagagaattgcagattgttgtcgaggatttggagctgatgttataatgacatcagaatcatgcagaaatggatctgagcgctgctgtgaggcacttgaaaagcttgggaaacgttatgatattgttgtcaatattcaaggagatgagcctcttatcgaaccagagataatagatggtgtcgttatggcattgcagcgagctcctgatgcagtgttcagcacagctgttacttcactgaaacctgaagatgcatctgatacgaatcgagttaagtgtgttgaggataatcagggcta

SEQ ID NO: 22038 - protein, 199 aa, Panicum virgatum
  misc_feature: Ceres CLONE 1819488
  misc_feature (53)..(199): Pfam Name: CTP_transf_3 Pfam Description: Cytidylyltransferase
  misc_feature: SWISSPROT Homolog: EC 2.7.7.38 3-deoxy-manno-octulosonate cytidylyltransferase
MPICTPSSDSSASSASGGRAWIVHGLALGVAAAAPSPLSSLDFLPSGFRSRAVGIIPARFASSRFEGKPLAHILGKPMIQRTWERVMLASSLDHVVVATDDERIADCCRGFGADVIMTSESCRNGSERCCEALEKLGKRYDIVVNIQGDEPLIEPEIIDGVVMALQRAPDAVFSTAVTSLKPEDASDTNRVKCVEDNQG

SEQ ID NO: 22039 - DNA, 1808 bp, Panicum virgatum
  misc_feature: Ceres CLONE 1819491
  misc_feature: Encodes the peptide sequence at SEQ ID NO. 22040
acttccgttttcacgatccttgcgtcgcggctccgatccaccgcagcaccgcaccgcaccgcaccgccgcgagcacatcgggtgccggtgcggcaggcgagatccgaggacgcccccctcccccgcacccctcccgaatggccgccgccggccgcagatagagagagagaggcgcgggcggcgcgtgcagatccagatccggcgggcaggcgtggacgagatcgcccccaccgccatggcgggcgcggtgtccgcgctcttcctgctggacatcaagggccgcgtcctcgtctggcgcgactaccgcggcgacgtctccgcgctccaggccgagcgcttcttcaccaagctcctcgacaaggaggacgacgcggaagtgcactcgccggtggtctacgacgacgccggcgtcacgtacatgttcatccagcacagcaacgtcttcctcctcaccgccgcccgccagaattgcaacgcggccagcattctcctcttccttcaccgcgtcgttgatgtgttcaagcactactttgaggagttggaggaggagtcgctcagagataactttgtcgtcgtgtatgagttgcttgatgagatgatggattttgggtacccgcaatacacggaagcaaagatcttgagcgagttcatcaagacagatgcgtacaggatggaggtctcgcagaggccacccatggctgtgacaaatgctgtgtcatggagaagtgaggggatccggtacaagaagaacgaagtcttcttggatgtggtggagagtgttaacattctagttaacagcaatgggcagattgtgagatcagatgtcgttggggcactgaagatgagaacatatttgagtggaatgccagagtgcaaacttggcttaaatgatagggttcttttggaggctcaaggccgagcaactaaaggaaaagcaatagaccttgatgatatcaaatttcatcagtgtgtacgtttggctagatttgagaatgatagaactatatctttcgtacctcctgatgggtcttttgatctaatgacgtacaggcttagcactcaggtgaaacctcttatctgggtagaagcacaaattgaaaagcattctagaagccgtgtagaactcatggtgaaggcaaggagtcagttcaaggaaaggagcacagcaacaaatgttgaaattgaagtgcctgttccttcagatgccacaaacccaaatataagaacttcaatgggttctgctgcgtatgcccctgagagagatgcaatggtctggaaagtaaaatcatttcctggtggcaaggaatacatgtgcagagcggaatttagtcttcctagcataacagcggaagaaggggcccaagaaaagaaggcgccaatacgagtgaaatttgagataccatatttcaccgtatcaggcattcaggttcggtatctgaagataattgaaaagagtggttaccaggcacttccctgggttagatacattacaatggccggcgaatatgagctgagacttatatgagctactctcttttctggctgctggaagacattgatgataccgcaagaccctgaagacacatatttgccctatatcctgccatcagttggcattgaatgtagcatggaagttttctccttaaatgccatacaaggtccccccccccccctctgtggtttgttgttcatcttgttaggcacaccttaccatggttactgtaagttacccatcaagtatagctttggaaaaaggaaactttcacttttcagttcacttgtattattattgatttatttttgtgggt

SEQ ID NO: 22040 - protein, 429 aa, Panicum virgatum
  misc_feature: Ceres CLONE 1819491
  misc_feature (160)..(428): Pfam Name: Adap_comp_sub Pfam Description: Adaptor complexes medium subunit family
MAGAVSALFLLDIKGRVLVWRDYRGDVSALQAERFFTKLLDKEDDAEVHSPVVYDDAGVTYMFIQHSNVFLLTAARQNCNAASILLFLHRVVDVFKHYFEELEEESLRDNFVVVYELLDEMMDFGYPQYTEAKILSEFIKTDAYRMEVSQRPPMAVTNAVSWRSEGIRYKKNEVFLDVVESVNILVNSNGQIVRSDVVGALKMRTYLSGMPECKLGLNDRVLLEAQGRATKGKAIDLDDIKFHQCVRLARFENDRTISFVPPDGSFDLMTYRLSTQVKPLIWVEAQIEKHSRSRVELMVKARSQFKERSTATNVEIEVPVPSDATNPNIRTSMGSAAYAPERDAMVWKVKSFPGGKEYMCRAEFSLPSITAEEGAQEKKAPIRVKFEIPYFTVSGIQVRYLKIIEKSGYQALPWVRYITMAGEYELRLI

SEQ ID NO: 22041 - DNA, 1138 bp, Panicum virgatum
  misc_feature: Ceres CLONE 1819493
  misc_feature: Encodes the peptide sequence at SEQ ID NO. 22042
acctaaccttacaccaacgcacaagcgctcgctctctcacacgcaccgtgggaagaatccagtagagggcgtggaaggggagagccatgaagatgtcgagcggcagccacgtgatcggagtgcccgtcaccgccaaggcgtacgccatcgaggaggcggcgagggacgggccgccggcggcagcggcggctaagaaggacggcgatcgcctcgcggtctcgctgacgcacccgagcccctacacgcctttcggcatcaagcacggcagcaagggccaggtgatccactgggtgaacaagctgggaagacgagctcagagcttcagggaccatgtgacactggggccgaagctctcggagacggtgaaggggaagctgagcctgggcgcgaggatcctgcaggccggcggcttggagcgcgcgttccggcacgcgttcccggccgagaggggcgagcggctggtgaaggcccaccagtgctacctctacaccaccggcggccccatcgccgggatgctcttcgtctccacccgcaggatcgccttccgcagcgaccgctccctggccgtcacctccccagccggcgacgtcgtggcccgggtcccctacaaggtggtggtccccctgcggcggatcaagcgggtgaggcccagcgagagcgccgacaagccggagcacaagtacatccaggtggccacggtggacggcttcgagttctggttcatgggcttcgtcagctaccagagatgctgcaagtacatggtgcacctgatggacatctccggcgacctgtgacgtggccggcgcggcgccggcgcgggcgggggtcgaggcgtgtccggccggccggtcgccgtggatcggaggttccgtgcgccctgtcagtagtaaggcagtcgaagtgatgaagtttgagggctaccgtgcacgcgcagcaacgtcttgttgttggaacgttggtagcctcgagctgctccaccactttttttttatgggggcacgttccttccgcttgcgattcggattggtaggcaattgtgtggtcgcccaagttctgttaactagtgctgtaggattgatgatgcttggaccaaggaacttggtttcgccaaatgaatatatatttgaatgattctcgg

SEQ ID NO: 22042 - protein, 235 aa, Panicum virgatum
  misc_feature: Ceres CLONE 1819493
  misc_feature (111)..(190): Pfam Name: GRAM Pfam Description: GRAM domain
MKMSSGSHVIGVPVTAKAYAIEEAARDGPPAAAAAKKDGDRLAVSLTHPSPYTPFGIKHGSKGQVIHWVNKLGRRAQSFRDHVTLGPKLSETVKGKLSLGARILQAGGLERAFRHAFPAERGERLVKAHQCYLYTTGGPIAGMLFVSTRRIAFRSDRSLAVTSPAGDVVARVPYKVVVPLRRIKRVRPSESADKPEHKYIQVATVDGFEFWFMGFVSYQRCCKYMVHLMDISGDL

SEQ ID NO: 22043 - DNA, 703 bp, Panicum virgatum
  misc_feature: Ceres CLONE 1819495
  misc_feature: Encodes the peptide sequence at SEQ ID NO. 22044
aaaatcctcaggcagctcgtccccaatcgcagtcgcagcgcggctcttgcctcttgtaggttgtagccatagcgaaagagagagcgccatggccaaggctcacatcctcgtgctgccggtgccggcccagggccacgtcaccccgctcatggagctctcccaccgcttggtcgaccacggcttcgaggtcacgttcgtcaacaccgaagcgcatcacgcgcgggtcgtcggcgcgctgcaggcggcgggcggcacggcggcgctggccggcatccacctggcatccatctcggacgggtcggacgataacgacgacagcggcaagatcttcgactcctactcccggcacatgccggggcacctggagcggctcatcgccggaatggaggcggccggcaggcccaaggtgaagtggcttgtgtgcgacgtgttcatgtggtggctcttggacgttgccaaaaagttgggcatccgcgtggccgcattctggccgctgccggcggcttgcttagccatttgtctcaagatccccaagttgacagaggatgggctcctcaacaacaagggttggccagagcgtgatgagacgttccagcttgcccccgggattccaccgctgcacacgtcgcagctgccgtggatgcatctcggaccggtcgtcttcgagatgcacatccggaccggcatgctcaccgcccacgcc

SEQ ID NO: 22044 - protein, 204 aa, Panicum virgatum
  misc_feature: Ceres CLONE 1819495
  misc_feature: SWISSPROT Homolog: EC 2.4.1.218 Hydroquinone glucosyltransferase
  misc_feature: Useful for making plants with altered carbohydrate content
MAKAHILVLPVPAQGHVTPLMELSHRLVDHGFEVTFVNTEAHHARVVGALQAAGGTAALAGIHLASISDGSDDNDDSGKIFDSYSRHMPGHLERLIAGMEAAGRPKVKWLVCDVFMWWLLDVAKKLGIRVAAFWPLPAACLAICLKIPKLTEDGLLNNKGWPERDETFQLAPGIPPLHTSQLPWMHLGPVVFEMHIRTGMLTAH

SEQ ID NO: 22045 - DNA, 714 bp, Panicum virgatum
  misc_feature: Ceres CLONE 1819502
  misc_feature: Encodes the peptide sequence at SEQ ID NO. 22046
agagcccagcgacgagaacggacaaactgcggcggaccgacccggaggcaggccagggcccgatcctcccctctccccgccggtcgccgccatcgtccccgggcgcgctagccccgtcgacgccggcgggcagcttgagatatgggttgctcgtcctccgtgccagctagaagtacaggagggctgaacactgtcaacaacgatacctcttctgccactgattcaaaggacttgcgtgctaagttggtattactgggagactcaggtgttgggaaaagctgcatcgttcttcgctttgttcgtggtcagtttgatcctacttccaaggtaactattggtgcatcttttttatcacaaacattggcattggaagactcaacaatagtgaaatttgaaatttgggatactgctggccaagagaggtatgctgccttggcaccactttactacagaggagctgctgctgcaattgttgtttatgatataactagtccggaatcatttaacaaagcacagtactgggtaaaggaacttcagaagcatggtagtcctggtattgtaatggttttggttggcaataaggctgacctgcatgagaatcgaagtgtatcttcacaggatgcacaggagtacgcagagaagaacaatatgtttttttatcgagacgtcagcaaagacagcagataatataaaccaactatttgaggaaattgc

SEQ ID NO: 22046 - protein, 181 aa, Panicum virgatum
  misc_feature: Ceres CLONE 1819502
  misc_feature (34)..(178): Pfam Name: Ras Pfam Description: Ras family
  misc_feature (34)..(149): Pfam Name: Miro Pfam Description: Miro-like protein
MGCSSSVPARSTGGLNTVNNDTSSATDSKDLRAKLVLLGDSGVGKSCIVLRFVRGQFDPTSKVTIGASFLSQTLALEDSTIVKFEIWDTAGQERYAALAPLYYRGAAAAIVVYDITSPESFNKAQYWVKELQKHGSPGIVMVLVGNKADLHENRSVSSQDAQEYAEKNNMFFYRDVSKDSR

SEQ ID NO: 22047 - DNA, 1388 bp, Panicum virgatum
  misc_feature: Ceres CLONE 1819504
  misc_feature: Encodes the peptide sequence at SEQ ID NO. 22048
caccagcagccaccagcacctcctttttctcattcgagctcacccacgcagcacctgctgctccttcgatgctgccccgcagccactggtcagcccgagctaagccttccagaccacgcaacgccgccgccggacccgcacaccacgcctggccgcaagcctcccgtgcacgagcctctgcaggccgttgttggtctgctctgcttggatcttgaggtcgcccctgcctgtgctcctcagcgcgccgccgctcgccgcttctgctgcagcttgccgctggctgctcccgcacgctccctgcgcgccgccgggaaaggcctgctcactggggatccgtgccgccggccggctcctcctcctgcagatccgccgcgccgctcgtgcgcaagatgcgcgccctctggcccgcctgcacactgctgctccacgccgccgagccacaccaccgctgctgctccggctcctgctcgccggccgacgtcacgccggcgaagccaccaccatcgccaccatcgcattgaactcagccctgataccatgtggagtttgggaaaacaactcaggagatttttttctcctggtgccttttctttattcttaacctttttacactttagctctgcatatatacatatattacatacacacaccaacagtattaatgttactgaaaaagaaaattgaacgacactgctacaggagatcgcagaggaccccaacgttgagcccccggagctgagcgtggacaggctgctgatgaggcagcaggtccgcaacttcctggggatcctgaaccccagggaaaaggagatcatggagcaccgcttcggaatccacgatggggagcccaagacacttcatgtgatcggcgacatgtacgggctgtcaaaggagcggatccggcaggtgcagaacaaagcactggacaagctgaaaaagagcgtatcggcacagggttttgacgtttactttgatttgctaaggtgaaggaagaggccaataaaacttggtttcgattccattgctcatgttgatacccccaaaaaaaaatacaaagggattttcgcagctagacagacttgtatacgtccccaaattaaagccagtgaatgaccatgtaaaggaagcaaaaacaatgcagtatctcttgtgctgcctgtactcatgtcaagtgtccgatggatgcaatgcaagaaccggcaccaagtgtattgtattattggaagctggtggactggaagtggggcatgcaaatgctgggcttgctagtccatgatagctccaactcatcccctgatcagacatcattacagagtaggattcctattacttgtttgactgacacttgtttttctgatgacatgaggtctcttaggattccttttccc

SEQ ID NO: 22048 - protein, 76 aa, Panicum virgatum
  misc_feature: Ceres CLONE 1819504
  misc_feature (8)..(61): Pfam Name: Sigma70_r4 Pfam Description: Sigma-70, region 4
MRQQVRNFLGILNPREKEIMEHRFGIHDGEPKTLHVIGDMYGLSKERIRQVQNKALDKLKKSVSAQGFDVYFDLLR

SEQ ID NO: 22049 - DNA, 725 bp, Panicum virgatum
  misc_feature: Ceres CLONE 1819508
  misc_feature: Encodes the peptide sequence at SEQ ID NO. 22050
gaaccgtcaatggacgcgacgcgccgcaagtttcctccctataaaaccaccccgattccccaccccgacttttcctcatcacgaatccgaagaatccccacgagcagaagagaaaacccagagaaaccaagcgaaaaatccaatcttttcctcgattcagcccccgattccgcggcgagaagagccatggccgagtccgccaacaacgacgccccggccgccaccaacaaccagcccactacggaggaggtgacgattgagagggcggcgacccaggaggaggaggagaggctgcggtacctcgagttcgtgcagcaggcggcggcgcaggcgctggtgctggccgccgcggcgtacgcgtacgccaagcagggcgcggggccgctccgccccggtgtcgaccacgtcgagggcaccgtcaagaccgtcgtggggcccgtctacgaccgcttccatgccgtcccgctcgacctcctcaagttcctcgaccgcaaggttggtgagtccgttgaggaaattgaccgccgcgtccctccagtggtaaaggaagcccccaccctcgcccgctctgctgccaaggaggtccgtcaagccggtctggtgggcacagccactggcctcgcaaagtcggccatcgcccgtgcagagcccaaggccagggagctctacacccgctacgagcctgtggctgagcgcggcgcagctgaggcctgggtggccctgac

SEQ ID NO: 22050 - protein, 179 aa, Panicum virgatum
  misc_feature: Ceres CLONE 1819508
  misc_feature (27)..(179): Pfam Name: REF Pfam Description: Rubber elongation factor protein (REF)
MAESANNDAPAATNNQPTTEEVTIERAATQEEEERLRYLEFVQQAAAQALVLAAAAYAYAKQGAGPLRPGVDHVEGTVKTVVGPVYDRFHAVPLDLLKFLDRKVGESVEEIDRRVPPVVKEAPTLARSAAKEVRQAGLVGTATGLAKSAIARAEPKARELYTRYEPVAERGAAEAWVAL

SEQ ID NO: 22051 - DNA, 1051 bp, Panicum virgatum
  misc_feature: Ceres CLONE 1819515
  misc_feature: Encodes the peptide sequence at SEQ ID NO. 22052
gccgaggccgccgcctcctcgccgactagggttcccgtgacgccgccgcttgcatcctcgggagagcaaaatgcctcgatacgatgaccgctatgattacgatgatcgatacgaccactatggtcgacatggtggtaacaccaagttgtacgtgggtcagatttctcctcatactcagatacatgatcttgaggaccttttcagcaaatatgggagactgcggaaagtggatctgaagagggactttggctttgttgagtttagtgatcctcgggatgccgatgacgcaaggtatgatcttgatggccgaaaatttgatgggagttgtatcgttgttgagtttgcaagaggggtcccgtgtggtccaggaggtgtccgccaatatggcagaggacctcctggccgctgctataactgtgggatggatgggcactgggttcgtgattgcaaagctagtgactggcgggataggtgctaccgctgtggagaaatgggccatctagaaagaaactgccagaacagtccaaaggatctgaagcgagacagacgctactcaaggtctccatctcctcgccatggaaagggccaagggagaagcagaagctactcaaggtctccgtctcctcgtcatgcaaggggccgaagctggacttacagtaggtcgccaccgccaaggagggattacaacactggtggggaagagttgccgtcaaaaagcgcccattacagccccaaccccaggaggaacctcccaccaagggaacaagctgaacgcaatggctcatatcatggtgggagccccagaagaggtgaagctcgtgagaagcgccagtgacccggaacttgagactctggggttgtgaattctcaaaactctccaatttggatgactatgctgaggcattgtctgaagaatcttagcttttgtgtagattggattgtgaattctcagagaagctcgcctgaatgctgctagttttgccgaggcgtcatatctgaaggatcttgaccggttatggttctctgttaagaatcttgcctgcaattattt

SEQ ID NO: 22052 - protein, 254 aa, Panicum virgatum
  misc_feature: Ceres CLONE 1819515
  misc_feature (26)..(89): Pfam Name: RRM_1 Pfam Description: RNA recognition motif. (a.k.a. RRM, RBD, or RNP domain)
  misc_feature (133)..(150): Pfam Name: zf-CCHC Pfam Description: Zinc knuckle
  misc_feature (111)..(128): Pfam Name: zf-CCHC Pfam Description: Zinc knuckle
  misc_feature: SWISSPROT Homolog: EC 5.2.1.8 Peptidylprolyl isomerase
MPRYDDRYDYDDRYDHYGRHGGNTKLYVGQISPHTQIHDLEDLFSKYGRLRKVDLKRDFGFVEFSDPRDADDARYDLDGRKFDGSCIVVEFARGVPCGPGGVRQYGRGPPGRCYNCGMDGHWVRDCKASDWRDRCYRCGEMGHLERNCQNSPKDLKRDRRYSRSPSPRHGKGQGRSRSYSRSPSPRHARGRSWTYSRSPPPRRDYNTGGEELPSKSAHYSPNPRRNLPPREQAERNGSYHGGSPRRGEAREKRQ

SEQ ID NO: 22053 - DNA, 1311 bp, Panicum virgatum
  misc_feature: Ceres CLONE 1819519
  misc_feature: Encodes the peptide sequence at SEQ ID NO. 22054
actccggtgggcgcgctcccaccgccgcggcggctcaaaacccgcccgcctccgcctcctgccactccagtcgagacgacgcggggactcctctccggacgtggcttgctggtcgggtgccaccgtattagcgggcagttcgtcgtgagaggaacacaccaggctagaggggatgttctccctgttctatggcctatggaagtatgtgtttaccaaggacgagttccgtgttcttattcttggtgtcgataaggccggcaagacggggggaggacttccacctgatcgtgtcgttcccactgttggacttaacattggccgcattgaagatgcaaatgcaaaacttgttttctgggatctgggtggtcaggttggcctacgtgcaatctgggagaaatactatgaagaggctcatgccataatgtatgttattgatgctgctactgcatcatcatttgaagatgccaaatctgctctgggtaagataattctttttccttttagttatgaactactggtttattgctgatgcactacctattctggtaagggtgaagaggactcattgtaaagaacctaaactaaatttcttactccagagaaggttattcgccatgagcatctgagaggagcaccgctcttgattgttgcaaacaagcaggatttacctggggtcatcaatgatgaagaattggctaagtttctgaatcttaaagagctggatgagaggccatatatgtttcaggctgtatccgcctatgatgggagggggatcaaatctggcatagactggctggtggaacaaatggaaaaatgtaaacgtacagaaacactgcgggctcgtgctggtgtagctggacaaatttagaatattcgtatgcagctgtcatcaaatgattttgttaaagaacaaagcatttgaggtgaaggcttctattgtattgcataagcagttgtttgcagcctatcataattacaaggatcatcgttccaagctgcctagagtgatgcaagaaatatttggtgctcaactccttatgatgttgatggcgagggtgattttgtttggtctttaacgagttggcattcttcacatttttctgtacctaaagatcgtgagcatactgcatacatgtttgtgtattgctttcgtattaggctagcatcagtatagaggatcaaatgagccatgaactttatgttcactgtaaatgagaaaactggaaacgatgattaacgtaggaattccatgtcattcgtgtggaaataatttcagtgcatagctttgaaattcgaatttacagtaaattc

SEQ ID NO: 22054 - protein, 118 aa, Panicum virgatum
  misc_feature: Ceres CLONE 1819519
  misc_feature (1)..(118): Pfam Name: Arf Pfam Description: ADP-ribosylation factor family
MFSLFYGLWKYVFTKDEFRVLILGVDKAGKTGGGLPPDRVVPTVGLNIGRIEDANAKLVFWDLGGQVGLRAIWEKYYEEAHAIMYVIDAATASSFEDAKSALGKIILFPFSYELLVYC

SEQ ID NO: 22055 - DNA, 592 bp, Panicum virgatum
  misc_feature: Ceres CLONE 1819528
  misc_feature: Encodes the peptide sequence at SEQ ID NO. 22056
aacatagcttcattaattccctggctggctggattccaactctttattccgcagaaaacgcacgtggcacatactgtatagagatatgccaagcatgcccgccgtctcagccgccaccggagcggcgcctccgccgaccaaggtcgtcgtcgaggacatctacggcttcctgcgcgtcctcgacgacggcaccgtgctccggtcggcggcggagccagcgttctgcccgaccaccttccccgacagccacccgtcggtgcagtggaaggaggccgtgtacgacaaggccaagaacctccgcgtccgcatgtataggccggccgccgcgcccgcggggaagctgccggtgctcgtccacttccacggcggcgggttctgcctcgggtcgtgcacgtgggccaacgtgcacgcgttctgcctccgcctcaccgcgaaggccggcgccgtagtgctctccgcggggtaccgcctcgccccggagaaccgccgccccgcggacggcgacgacggcgccggggcgcagagctgccgcatctagaagaccgccgacctggcccctgctgaagcctgggtcggccacctcggcaatctc

SEQ ID NO: 22056 - protein, 147 aa, Panicum virgatum
  misc_feature: Ceres CLONE 1819528
  misc_feature: SWISSPROT Homolog: EC 3.1.1.3 Triacylglycerol lipase
MPAVSAATGAAPPPTKVVVEDIYGFLRVLDDGTVLRSAAEPAFCPTTFPDSHPSVQWKEAVYDKAKNLRVRMYRPAAAPAGKLPVLVHFHGGGFCLGSCTWANVHAFCLRLTAKAGAVVLSAGYRLAPENRRPADGDDGAGAQSCRI

SEQ ID NO: 22057 - DNA, 586 bp, Panicum virgatum
  misc_feature: Ceres CLONE 1819528-R
  misc_feature: Encodes the peptide sequence at SEQ ID NO. 22058
gtgctcctgaacctggacctgttcgaccgattctggcggctgtcgctgccggccggcgccaccagggaccacccggcggcgaacccattcgggccggacagccccggcctggccgcggcggacctccggccggtcctcgtggtggccggcggcctcgacatgatgcgcgaccgcgccgtcgactacgccgagcggctcgcggcgatgggcaagccggtggagctcgccgagttcgccggcgagccgcacggcttctacacgctggacccggggtccgaggccaccggcgagctgatcggcctcgtgcgccggttcgtacgcagctgctgcgccgcggcgccgaaaggttagctcggtgcatgcacgtgccacgtaagccagcatcaaggttcgtgcgtgcatgatgcatgcatagtattttgcggagttcagctgtatgcttgtgtagtgtagttcggttgatgccgcgtgtcagcttattacgaggggagctcaaatcggcagggtagtcggtcacaagtgtttgtgttgtgtttgtgctgctgtgaggtgccatccctatgaatgaaaaaaaaaagatcaggtg

SEQ ID NO: 22058 - protein, 116 aa, Panicum virgatum
  misc_feature: Ceres CLONE 1819528-R
  misc_feature: SWISSPROT Homolog: EC 3.1.1.79 Hormone-sensitive lipase
VLLNLDLFDRFWRLSLPAGATRDHPAANPFGPDSPGLAAADLRPVLVVAGGLDMMRDRAVDYAERLAAMGKPVELAEFAGEPHGFYTLDPGSEATGELIGLVRRFVRSCCAAAPKG

SEQ ID NO: 22059 - DNA, 1030 bp, Panicum virgatum
  misc_feature: Ceres CLONE 1819560
  misc_feature: Encodes the peptide sequence at SEQ ID NO. 22060
gacctccccgaccccagccagctcgccccagtctggcagtctcctcctcctccagctcccccatccgacgccgatccccaatcacccatggatcccaagcccgacgccaacgcgcccgcggcctcggcgccggcggagcacgcggcgtacccgcgcctgtccccggaggagatggcgccgccgccgccgcccgtcgtgccgccggccggcgccaacccctacgtgctctccgccccgtcgcccaacccgcccgccaagagcgctacgaacaatctgatggagatgttcggtatggtggggaagaagttcaacgaggccgcgcgcaagaccgagggcatcgccggcgacgtctggcagcacctcaaaactggatctagcatgacggatactgcaatggggaggattgctcagatatcaaaggtcatatctgagggtggttacgacaagatatttcgtcagactttcgagtgcttgcctgatgagaagctcaagaaagtgtatgtgtgctacctatcgacatctcatgggccgatcatgggcgtcctgtatctctcgactgtcaagattgcatttggtagtgacagccctgtgaaatatgtaactgaggacaacaaaaccgagtcatccttttacaaggttgttttacccattccccacttgagatcagttaaccccacggcaagtccacaaaaccctgcagagaggtatattcaggttgtctctgttgataaccatgagttctggttcatgggtttcgtgaactacgatagtgctgtgaagaatctccaggaggctgttcgtggtgttcatggcgcctgaagatcgcccgggtatttaaacacttgtctatgtggtatgccgtatgccccctgtaaggctgtaaatgtgtttatgcatggtgcttgtatagttgtgaatctcgtgttgagatgtgtgccattggacatcattatgcagtgcatgcatccatgtatctgtagcatgttgatactgctggagaagtgtctgcaaatacggaatgaagttgatt

SEQ ID NO: 22060 - protein, 243 aa, Panicum virgatum
  misc_feature: Ceres CLONE 1819560
  misc_feature (120)..(198): Pfam Name: GRAM Pfam Description: GRAM domain
MDPKPDANAPAASAPAEHAAYPRLSPEEMAPPPPPVVPPAGANPYVLSAPSPNPPAKSATNNLMEMFGMVGKKFNEAARKTEGIAGDVWQHLKTGSSMTDTAMGRIAQISKVISEGGYDKIFRQTFECLPDEKLKKVYVCYLSTSHGPIMGVLYLSTVKIAFGSDSPVKYVTEDNKTESSFYKVVLPIPHLRSVNPTASPQNPAERYIQVVSVDNHEFWFMGFVNYDSAVKNLQEAVRGVHGA

SEQ ID NO: 22061 - DNA, 667 bp, Panicum virgatum
  misc_feature: Ceres CLONE 1819571
  misc_feature: Encodes the peptide sequence at SEQ ID NO. 22062
ctacgattggctagatatttcttggctgaagaattactacaattttggttttgaccactatgagatgtctcggaggaaagtaggcttttcaggtttaattgatctgctgctggggcacactggcccatttgccagcggagattggattttacctgatctcacaatacagggatctataaaacttaactctagactgaggacctttcccaatacattttacttcagttatgctacaaagaaaacaagaaagctatttggaattacagtgccttcaagtgttcttggagtccaccccatgctctttctcagagtccttcagatgtgtatgtggcggcaccctcaaaatgcacctctgccttacaaaggatacagggatgaagattgggaagacaatgatggggctttgaacacaatctctatgactcacccacgcattcctatagagcatccacaccgttttgtcgtggatgattctgactgccatcctttgcaacctgggatatggtattacaagattattgaagctgaccacattctatttattgtgaaccgggaaagagctggcgtgcagttcgatttgctgtatgatggcattttccagcgatgcagaaagcatgcatttaggaagagcccacctactgtaccaaacgaaacgagtcaatagcag

SEQ ID NO: 22062 - protein, 220 aa, Panicum virgatum
  misc_feature: Ceres CLONE 1819571
  misc_feature: Useful for making plants with modulated cold sensitivity
YDWLDISWLKNYYNFGFDHYEMSRRKVGFSGLIDLLLGHTGPFASGDWILPDLTIQGSIKLNSRLRTFPNTFYFSYATKKTRKLFGITVPSSVLGVHPMLFLRVLQMCMWRHPQNAPLPYKGYRDEDWEDNDGALNTISMTHPRIPIEHPHRFVVDDSDCHPLQPGIWYYKIIEADHILFIVNRERAGVQFDLLYDGIFQRCRKHAFRKSPPTVPNETSQ

SEQ ID NO: 22063 - DNA, 1329 bp, Panicum virgatum
  misc_feature: Ceres CLONE 1819588
  misc_feature: Encodes the peptide sequence at SEQ ID NO. 22064
aaaggagagcctcagagcagcaggaaggactctgccagatcgagccttcttcttctccctctcatccaagaacagcatcaaacaagaaaccagagagctagaatagagcaagatgacctgagactaagcaaaacgcacgcacgcacgcacgtagaggacgcgcgggaaggacttgcactccggctcatgggtctcctggaccagctgtgggacgacacggttgccgggccgcgcccggactccggcctcggcaagctccgcaagtacgcctccttctcgccctcttcctcttcagtgtccgcggccgcggccgcgccgccgcctgcggagggggcggccgtcgccgtgccgccacccggcgtgacgcgcagcatcagcatgctccgcccctcggcgctgtccgtcgtcacgtcgccgcgcagcgagtccagctctgcgccgtcgtcgccggccagcggcgccccggactcgcccttcggcgcaggtgaccggcctcagtagccaccacccttttccccttcgctaagctactttctttggtgtttcatttccttggggcactcgcacaaaaaaaaaccctgattttttacggttccatgcatcgcgcctggattttgtagatctatcgggatctatgctgcttagacgttggatcttaaataaatttgtagataatttttttttcgaaaagaaaatttgtagaaaatggaagtacagtttcacatgactgagctagcatgcgtggcatctcctctgctggtgcagcgacgacgcccaagggagagggctggaagaagctgcgccggaaaggcaggatggccgccgccgacggcgccgacgcccccggcacgccgaggagccccactgtctacgactgggtggtgatcagctcgctggacccgtgaacgactgcgcaaggaaaccatcagcacagctagccaactgaagatggtttctgtgttttgtatacgttaaaattacccccgtatatcttcttgtaaatccccgtgtgagatgctgctgttttctgtaagctctgctagtacgcttagctcctcagcaggtcatgcgtgcccaagccttgaacttgaagtgacaacaggcaacgcaagctctgatgacctgacgggcccgcacgtcggtgacccaaccgtaagcggtaggggcagtaccgcagaggagtcctgtccatgtagcgcagtcctgtggtacctatactgttgaagagagctgtatgagcagggttaaccatttcgttttccggtcaaatcccggtgtttaccggaaacgaaatttcgttccgaaatttcggtaaatttcggcgaattt

SEQ ID NO: 22064 - protein, 104 aa, Panicum virgatum
  misc_feature: Ceres CLONE 1819588
  misc_feature (7)..(104): Pfam Name: Auxin_repressed Pfam Description: Dormancy/auxin associated protein
MGLLDQLWDDTVAGPRPDSGLGKLRKYASFSPSSSSVSAAAAAPPPAEGAAVAVPPPGVTRSISMLRPSALSVVTSPRSESSSAPSSPASGAPDSPFGAGDRPQ

SEQ ID NO: 22065 - DNA, 738 bp, Panicum virgatum
  misc_feature: Ceres CLONE 1819592
  misc_feature: Encodes the peptide sequence at SEQ ID NO. 22066
gtgcagcaggggctcacgccagtcgccactgtatctctctcgttgagccgccaatccgttcgtcgtgcaggagacggaggcgcagccgcgcagggggagcatcgcaggtctcctgtcagtttcccagtggttccttcgctgttcgtgtcgcccctgccgccttccagtctcctcgtcgccggaaggcgggcgctcccggcgcacaccgacgcgttccccctctgcgttctcttctcccgttcacccctgccttttcgtcttctattcaccccgagcaccagcgccgccctccgccaggtgcccagatcgagcacccaccaggctcataggactaggtctttttatgttacaaagctgcaatgaaggatgctcagagcacgacagagttgcagtcatcagcacaaggtactaatgaagtgcagagtcaacaaccaaatgcaatggccactgatgctcctgcaggagattctggttccttgtcagtaagaagtaatgacaataaggtctcccgtgaagacattgaacttgtacagaatttgatagaacgctgtctacagctatacatgaacaaaggagaggttgttaggactctatctactcgtgcaagaatagaacctggcttcactaccttagtatggcagaaactcgaagaagagaactctgagttctttagggcttactatatacggttgaaattgaaaagacagatcatctttgttcatcatttatttgcacacc

SEQ ID NO: 22066 - protein, 126 aa, Panicum virgatum
  misc_feature: Ceres CLONE 1819592
  misc_feature: Useful for making plants with modulated water use efficiency
  misc_feature: Useful for making plants with modulated drought sensitivity
MKDAQSTTELQSSAQGTNEVQSQQPNAMATDAPAGDSGSLSVRSNDNKVSREDIELVQNLIERCLQLYMNKGEVVRTLSTRARIEPGFTTLVWQKLEEENSEFFRAYYIRLKLKRQIIFVHHLFAH

SEQ ID NO: 22067 - DNA, 665 bp, Panicum virgatum
  misc_feature: Ceres CLONE 1819594
  misc_feature: Encodes the peptide sequence at SEQ ID NO. 22068
agaagagggcaagcgaccggcctgcccccaacccccccgctaaaccccccctctccagtctccaccttttcgccagccgcctgctcgaaagcaaccgcggaggggaagaagctggtgcgcaggagaagaaacggcggcggcggcgtgtaggctgctgcaggccggagagggcaagcttttggcagcgggggtggttttggaatgcagcagcagcagcaacagcaccacctgatgcagatgaaccagggaatgattgggggctacgcatcccctaccgctgtcaccaccgatcacatccagcagtacctggatgagaacaagcagctgatccttgccatcctagagaaccagaacagtgggaaggtggaagaatgcgaacggcaccaagctaagctccagcacaacctcatgtacctggccgccattgccgatagtcagccaccacagtcggcaccgctgtcacagtacccgtccaacctgatgatgcagccgggcccgcggttcatgccgccgcagtcggggcagattatgagccagcagtcgctgatggcggcgcggtcctccatgatgtacgcgcacccgtccctgtcgccgcttcagcagcagcaggcggcgcacggtcagcttggcatggccccaggcggcggcggcacgaccagcgggtt

SEQ ID NO: 22068 - protein, 154 aa, Panicum virgatum
  misc_feature: Ceres CLONE 1819594
  misc_feature (15)..(87): Pfam Name: SSXT Pfam Description: SSXT protein (N-terminal region)
MQQQQQQHHLMQMNQGMIGGYASPTAVTTDHIQQYLDENKQLILAILENQNSGKVEECERHQAKLQHNLMYLAAIADSQPPQSAPLSQYPSNLMMQPGPRFMPPQSGQIMSQQSLMAARSSMMYAHPSLSPLQQQQAAHGQLGMAPGGGGTTSG

SEQ ID NO: 22069 - DNA, 1350 bp, Panicum virgatum
  misc_feature: Ceres CLONE 1819616
  misc_feature: Encodes the peptide sequence at SEQ ID NO. 22070
atcgcccgctgctctcctcttcgtcctcctcatcctcctctctcatctgttcactcccggccctgtcctcctgcgcccatcccagcgtaccacccgaggagggagatggccggaggcggcgacaactcccagacgaacggagctcgcgaccagagggccatggaggaggggaggaaggacgagttcgccggcgaccggggctgcgccgccgccatctccattcccttcgttcagaagatcatcgcagagatctttggcacctacttcctcatgttcgcggggtgcggcgcggtgaccatcaacgcgagcaagaacggcgccatcacgttcccgggggtggccatcgtgtgggggctggcggtgatggtgatggtgtacgccgtcggccacatctccggcgcgcacctcaaccccgccgtcaccctggcgttcgccacctgcggccgcttcccgtggcggcagctgccggcgtacgtgctggcgcagatgctgggctccacgctcgccgccggcacgctgcgcctcatgttcggcggccgccacgagcacttcccggggacgctcccgaccggctccgacgtgcagtcgctcgtcatcgagatcatcaccaccttctacctcatgttcgtcatctccggcgtcgccaccgacaacagagccatcggggagctggcagggctggccgtgggcgcaaccatcctgctcaacgtgctcattgccgggcccgtgtccggcgcgtcgatgaaccctgctcggagcgtgggcccggcgctggtgagcgggcagtaccgctccatctgggtttacctggtgggcccggtggcgggggccgtggcgggggcctgggcctacaacctgatccgcttcaccaacaagcccctccgcgagctcaccaagagcacctccttcctccggagcatgagcaggatgaactccgccgtctgatcgctaatcaaccgcgagcccaccagtcagagctgatgtggcaggccatcatccttacgtggggcggcctgggggcatttcagtaatctagcacctattcacctgtgagagtatatatactactatatacttcatccgttccaaaatgtaggtcgttttggctttttttgattcatagtgtttattatgcatctagatataacatatgtctaggtacatagcaaaatatatgaatctaaaaaaatcaaaatgacctgtattttgaaacggagggagtatatgtgtgtgactgtgtgtgtggaggacatgggggatgaagggttggataatcagatggtgatggatgtggcagtgtccatgtacgcctgtttcgataactcgaattaatcagtgttggtcagactc

SEQ ID NO: 22070 - protein, 279 aa, Panicum virgatum; identical to SEQ ID NO: 19146
  misc_feature: Ceres CLONE 1819616
  misc_feature (35)..(249): Pfam Name: MIP Pfam Description: Major intrinsic protein

SEQ ID NO: 22071 - DNA, 732 bp, Panicum virgatum
  misc_feature: Ceres CLONE 1819617
  misc_feature: Encodes the peptide sequence at SEQ ID NO. 22072
atctcgatcgaacagcagctacagctgcagaagaagaagaaggggtgtgtcctatcctcctaccagagcaatggcggtgcgtaacggaggtggagccttgggcgcggcggcgttcctggcggccgtggccgcgctgctgggcgccgccggggtggcggcggcggcggcgagcaagttcgacgacgtggtgcagccgagctgggccaacgaccacatggtgtacgacggcgacctcctcaagctccgcctcgacgccaactcgggcggcgggttcgtgtcccggagcaagttcctctacggcaaggccagcgccgacctcaagctcgtgccgggggactccgccggcgtagtcaccgctttttatttgtcgtcggccagggacaagcacaacgagttcgacttcgagttcctgggcaacgtgaccggcgagccgtacctggtgcagacgaacctgtacatcgacggcgtgggcaaccgggagcagcgcatcgacctgtggttcgaccccaccgccgacttccacacctacgccgtgctctggaaccccagccaggtggtgttcatggtggacgacacccccatccgcgtctacgagaaccgccagaacgccaccgcccgccggggccaccaccgccacgccaacggcagcgccggctcgtcgccgttcccgggcccccagccgatggccgtgtacagctccatctggaacgcggacgactgggcgacgcaggg

SEQ ID NO: 22072 - protein, 220 aa, Panicum virgatum
  misc_feature: Ceres CLONE 1819617
  misc_feature (36)..(220): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
  misc_feature: Useful for making plants with altered cell wall content and/or composition
  misc_feature: Useful for making plants with altered carbohydrate content
MAVRNGGGALGAAAFLAAVAALLGAAGVAAAAASKFDDVVQPSWANDHMVYDGDLLKLRLDANSGGGFVSRSKFLYGKASADLKLVPGDSAGVVTAFYLSSARDKHNEFDFEFLGNVTGEPYLVQTNLYIDGVGNREQRIDLWFDPTADFHTYAVLWNPSQVVFMVDDTPIRVYENRQNATARRGHHRHANGSAGSSPFPGPQPMAVYSSIWNADDWATQ

SEQ ID NO: 22073 - DNA, 522 bp, Panicum virgatum
  misc_feature: Ceres CLONE 1819620
  misc_feature: Encodes the peptide sequence at SEQ ID NO. 22074
acagctgagtccgatcgatcgatcgatccgtgccccccccgctcggcaatcatggagttcccgcaccaccaccaccacagccaccgccgcgacggcgatgacgacgagcgccggggcccgccgcccccggtctacagcgggtacggccagcggacccctagggccgcccgcccgcggaccagccctactgccgggccccgcccccctgcgctcaccgtgcgctcggggacgcctacggccgcgacgaatatgcctctagctacatctgaccctagaagggcgtgggatatacacatcatggggaggcagctgtgctcccacgagctgggggtgaagcgcgggccgtggacagctgaggaggagcggaagctcatcatcttcatcctgagcaaccgacattgctgctggcgggcgccgccgaaactggcccgcctgttgcgatgccgcaagagctgccgcctgcgctggaccaactacctccgcccggacctcaagcccggcctcctcaccgacgccgaggag

SEQ ID NO: 22074 - protein, 74 aa, Panicum virgatum
  misc_feature: Ceres CLONE 1819620
  misc_feature (14)..(61): Pfam Name: Myb_DNA-binding Pfam Description: Myb-like DNA-binding domain
  misc_feature: Useful for making plants with altered carbohydrate content
  misc_feature: The sequence is a functional homolog of SEQ ID NO 1863 in the 10/374,780 US patent application
  misc_feature: The sequence is a functional homolog of SEQ ID NO 1094 in the 10/225,066 US patent application
  misc_feature: The sequence is a functional homolog of SEQ ID NO 386 in the 10/374,780 US patent application
  misc_feature: Useful for making plants with altered cell wall content and/or composition
  misc_feature: Useful for making plants with altered alkaloid content
  misc_feature: Useful for making plants with modulated nitrogen use efficiency
  misc_feature: The sequence is a functional homolog of SEQ ID NO 442 in the 10/412,699 US patent application
  misc_feature: The sequence is a functional homolog of SEQ ID NO 836 in the 10/412,699 US patent application
  misc_feature: The sequence is a functional homolog of SEQ ID NO 569 in the 10/374,780 US patent application
  misc_feature: The sequence is a functional homolog of SEQ ID NO 156 in the 10/412,699 US patent application
  misc_feature: The sequence is a functional homolog of SEQ ID NO 164 in the 10/412,699 US patent application
  misc_feature: The sequence is a functional homolog of SEQ ID NO 1754 in the 10/412,699 US patent application
  misc_feature: The sequence is a functional homolog of SEQ ID NO 1978 in the 10/374,780 US patent application
  misc_feature: The sequence is a functional homolog of SEQ ID NO 353 in the 11/479,226 US patent application
  misc_feature: The sequence is a functional homolog of SEQ ID NO 369 in the 11/479,226 US patent application
  misc_feature: The sequence is a functional homolog of SEQ ID NO 40 in the 10/374,780 US patent application
  misc_feature: The sequence is a functional homolog of SEQ ID NO 776 in the 10/225,066 US patent application
  misc_feature: The sequence is a functional homolog of SEQ ID NO 1118 in the 10/225,066 US patent application
  misc_feature: The sequence is a functional homolog of SEQ ID NO 1396 in the 11/479,226 US patent application
  misc_feature: The sequence is a functional homolog of SEQ ID NO 2488 in the 10/374,780 US patent application
  misc_feature: The sequence is a functional homolog of SEQ ID NO 658 in the 10/412,699 US patent application
  misc_feature: The sequence is a functional homolog of SEQ ID NO 116 in the 10/412,699 US patent application
  misc_feature: The sequence is a functional homolog of SEQ ID NO 280 in the 11/479,226 US patent application
  misc_feature: The sequence is a functional homolog of SEQ ID NO 824 in the 10/412,699 US patent application
  misc_feature: The sequence is a functional homolog of SEQ ID NO 1052 in the 11/479,226 US patent application
  misc_feature: The sequence is a functional homolog of SEQ ID NO 456 in the 10/412,699 US patent application
  misc_feature: The sequence is a functional homolog of SEQ ID NO 2564 in the 10/374,780 US patent application
  misc_feature: The sequence is a functional homolog of SEQ ID NO 276 in the 10/225,066 US patent application
  misc_feature: The sequence is a functional homolog of SEQ ID NO 818 in the 10/412,699 US patent application
  misc_feature: The sequence is a functional homolog of SEQ ID NO 1011 in the 11/479,226 US patent application
  misc_feature: The sequence is a functional homolog of SEQ ID NO 434 in the 10/412,699 US patent application
  misc_feature: The sequence is a functional homolog of SEQ ID NO 296 in the 11/479,226 US patent application
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: The sequence is a functional homolog of SEQ ID NO 822 in the 10/412,699 US patent application
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: Useful for making plants with altered lignin content
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: The sequence is a functional homolog of SEQ ID NO 2572 in the 10/374,780 US patent application
  misc_feature: The sequence is a functional homolog of SEQ ID NO 636 in the 10/225,066 US patent application
  misc_feature: The sequence is a functional homolog of SEQ ID NO 838 in the 10/412,699 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: The sequence is a functional homolog of SEQ ID NO 134 in the 10/412,699 US patent application
  misc_feature: The sequence is a functional homolog of SEQ ID NO 321 in the 11/479,226 US patent application
  misc_feature: The sequence is a functional homolog of SEQ ID NO 1004 in the 11/435,388 US patent application
  misc_feature: The sequence is a functional homolog of SEQ ID NO 1901 in the 11/479,226 US patent application
  misc_feature: The sequence is a functional homolog of SEQ ID NO 310 in the 10/374,780 US patent application
  misc_feature: The sequence is a functional homolog of SEQ ID NO 842 in the 10/225,066 US patent application
  misc_feature: The sequence is a functional homolog of SEQ ID NO 1010 in the 11/435,388 US patent application
  misc_feature: The sequence is a functional homolog of SEQ ID NO 1680 in the 11/479,226 US patent application
  misc_feature: The sequence is a functional homolog of SEQ ID NO 202 in the 10/666,642 US patent application
  misc_feature: The sequence is a functional homolog of SEQ ID NO 852 in the 10/412,699 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 1002 in the 11/435,388 US patent application
  misc_feature: The sequence is a functional homolog of SEQ ID NO 794 in the 11/435,388 US patent application
  misc_feature: The sequence is a functional homolog of SEQ ID NO 1074 in the 10/412,699 US patent application
  misc_feature: The sequence is a functional homolog of SEQ ID NO 590 in the 10/374,780 US patent application
  misc_feature: The sequence is a functional homolog of SEQ ID NO 726 in the 11/435,388 US patent application
  misc_feature: The sequence is a functional homolog of SEQ ID NO 58 in the 10/666,642 US patent application
  misc_feature: The sequence is a functional homolog of SEQ ID NO 148 in the 10/412,699 US patent application
  misc_feature: The sequence is a functional homolog of SEQ ID NO 2266 in the 10/374,780 US patent application
  misc_feature: The sequence is a functional homolog of SEQ ID NO 341 in the 11/479,226 US patent application
  misc_feature: The sequence is a functional homolog of SEQ ID NO 58 in the 11/375,241 US patent application
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: The sequence is a functional homolog of SEQ ID NO 136 in the 10/412,699 US patent application
  misc_feature: The sequence is a functional homolog of SEQ ID NO 325 in the 11/479,226 US patent application
  misc_feature: The sequence is a functional homolog of SEQ ID NO 1684 in the 11/479,226 US patent application
  misc_feature: The sequence is a functional homolog of SEQ ID NO 2582 in the 10/374,780 US patent application
  misc_feature: The sequence is a functional homolog of SEQ ID NO 30 in the 11/375,241 US patent application
  misc_feature: The sequence is a functional homolog of SEQ ID NO 854 in the 10/412,699 US patent application
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: The sequence is a functional homolog of SEQ ID NO 593 in the 10/374,780 US patent application
  misc_feature: The sequence is a functional homolog of SEQ ID NO 782 in the 11/435,388 US patent application
  misc_feature: The sequence is a functional homolog of SEQ ID NO 1073 in the 10/374,780 US patent application
  misc_feature: The sequence is a functional homolog of SEQ ID NO 122 in the 10/412,699 US patent application
  misc_feature: The sequence is a functional homolog of SEQ ID NO 126 in the 11/375,241 US patent application
  misc_feature: The sequence is a functional homolog of SEQ ID NO 148 in the 10/286,264 US patent application
  misc_feature: The sequence is a functional homolog of SEQ ID NO 34 in the 10/374,780 US patent application
  misc_feature: The sequence is a functional homolog of SEQ ID NO 438 in the 10/225,066 US patent application
  misc_feature: The sequence is a functional homolog of SEQ ID NO 168 in the 10/412,699 US patent application
  misc_feature: The sequence is a functional homolog of SEQ ID NO 377 in the 11/479,226 US patent application
  misc_feature: Useful for biocontainment applications
  misc_feature: The sequence is a functional homolog of SEQ ID NO 263 in the 11/479,226 US patent application
  misc_feature: The sequence is a functional homolog of SEQ ID NO 478 in the 11/435,388 US patent application
  misc_feature: The sequence is a functional homolog of SEQ ID NO 54 in the 10/666,642 US patent application
  misc_feature: The sequence is a functional homolog of SEQ ID NO 1917 in the 10/374,780 US patent application
  misc_feature: The sequence is a functional homolog of SEQ ID NO 592 in the 10/374,780 US patent application
  misc_feature: The sequence is a functional homolog of SEQ ID NO 786 in the 11/435,388 US patent application
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: The sequence is a functional homolog of SEQ ID NO 796 in the 11/435,388 US patent application
  misc_feature: Useful for making plants with modulated low light sensitivity
  misc_feature: The sequence is a functional homolog of SEQ ID NO 792 in the 11/435,388 US patent application
  misc_feature: The sequence is a functional homolog of SEQ ID NO 788 in the 11/435,388 US patent application
  misc_feature: The sequence is a functional homolog of SEQ ID NO 110 in the 10/412,699 US patent application
  misc_feature: The sequence is a functional homolog of SEQ ID NO 259 in the 11/479,226 US patent application
  misc_feature: The sequence is a functional homolog of SEQ ID NO 1041 in the 11/479,226 US patent application
  misc_feature: The sequence is a functional homolog of SEQ ID NO 112 in the 10/225,066 US patent application
  misc_feature: The sequence is a functional homolog of SEQ ID NO 20 in the 11/375,241 US patent application
  misc_feature: The sequence is a functional homolog of SEQ ID NO 2052 in the 10/374,780 US patent application
  misc_feature: The sequence is a functional homolog of SEQ ID NO 450 in the 10/412,699 US patent application
  misc_feature: Useful for making plants with modulated biomass
  misc_feature: The sequence is a functional homolog of SEQ ID NO 1072 in the 10/412,699 US patent application
  misc_feature: The sequence is a functional homolog of SEQ ID NO 1073 in the 10/412,699 US patent application
  misc_feature: The sequence is a functional homolog of SEQ ID NO 588 in the 10/374,780 US patent application
  misc_feature: The sequence is a functional homolog of SEQ ID NO 589 in the 10/374,780 US patent application
  misc_feature: The sequence is a functional homolog of SEQ ID NO 730 in the 11/435,388 US patent application
  misc_feature: The sequence is a functional homolog of SEQ ID NO 184 in the 10/412,699 US patent application
  misc_feature: The sequence is a functional homolog of SEQ ID NO 397 in the 11/479,226 US patent application
  misc_feature: The sequence is a functional homolog of SEQ ID NO 46 in the 10/374,780 US patent application
  misc_feature: The sequence is a functional homolog of SEQ ID NO 590 in the 11/435,388 US patent application
  misc_feature: The sequence is a functional homolog of SEQ ID NO 6 in the 10/225,068 US patent application
  misc_feature: The sequence is a functional homolog of SEQ ID NO 594 in the 10/374,780 US patent application
  misc_feature: The sequence is a functional homolog of SEQ ID NO 784 in the 11/435,388 US patent application
  misc_feature: The sequence is a functional homolog of SEQ ID NO 1071 in the 10/412,699 US patent application
  misc_feature: The sequence is a functional homolog of SEQ ID NO 587 in the 10/374,780 US patent application
  misc_feature: The sequence is a functional homolog of SEQ ID NO 728 in the 11/435,388 US patent application
  misc_feature: The sequence is a functional homolog of SEQ ID NO 1681 in the 10/374,780 US patent application
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 790 in the 11/435,388 US patent application
  misc_feature: The sequence is a functional homolog of SEQ ID NO 743 in the 10/666,642 US patent application
  misc_feature: The sequence is a functional homolog of SEQ ID NO 1031 in the 11/479,226 US patent application
  misc_feature: The sequence is a functional homolog of SEQ ID NO 1804 in the 10/412,699 US patent application
  misc_feature: The sequence is a functional homolog of SEQ ID NO 2050 in the 10/374,780 US patent application
  misc_feature: The sequence is a functional homolog of SEQ ID NO 444 in the 10/412,699 US patent application
  misc_feature: The sequence is a functional homolog of SEQ ID NO 598 in the 10/225,066 US patent application
  misc_feature: The sequence is a functional homolog of SEQ ID NO 620 in the 11/435,388 US patent application
  misc_feature: Useful for making plants with altered terpenoid content
  misc_feature: The sequence is a functional homolog of SEQ ID NO 112 in the 11/375,241 US patent application
  misc_feature: The sequence is a functional homolog of SEQ ID NO 2398 in the 10/374,780 US patent application
  misc_feature: The sequence is a functional homolog of SEQ ID NO 466 in the 10/412,699 US patent application
  misc_feature: The sequence is a functional homolog of SEQ ID NO 580 in the 10/225,066 US patent application
  misc_feature: The sequence is a functional homolog of SEQ ID NO 2394 in the 10/374,780 US patent application
  misc_feature: The sequence is a functional homolog of SEQ ID NO 544 in the 10/225,066 US patent application
  misc_feature: The sequence is a functional homolog of SEQ ID NO 999 in the 11/479,226 US patent application
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 1411 in the 11/479,226 US patent application
  misc_feature: The sequence is a functional homolog of SEQ ID NO 2492 in the 10/374,780 US patent application
  misc_feature: The sequence is a functional homolog of SEQ ID NO 52 in the 10/225,066 US patent application
  misc_feature: The sequence is a functional homolog of SEQ ID NO 2574 in the 10/374,780 US patent application
  misc_feature: The sequence is a functional homolog of SEQ ID NO 278 in the 10/225,066 US patent application
  misc_feature: The sequence is a functional homolog of SEQ ID NO 116 in the 11/375,241 US patent application
  misc_feature: The sequence is a functional homolog of SEQ ID NO 1648 in the 11/479,226 US patent application
  misc_feature: The sequence is a functional homolog of SEQ ID NO 2566 in the 10/374,780 US patent application
  misc_feature: The sequence is a functional homolog of SEQ ID NO 632 in the 10/225,066 US patent application
  misc_feature: The sequence is a functional homolog of SEQ ID NO 650 in the 11/435,388 US patent application
  misc_feature: The sequence is a functional homolog of SEQ ID NO 826 in the 10/412,699 US patent application
  misc_feature: The sequence is a functional homolog of SEQ ID NO 1033 in the 10/412,699 US patent application
  misc_feature: The sequence is a functional homolog of SEQ ID NO 540 in the 10/374,780 US patent application
  misc_feature: The sequence is a functional homolog of SEQ ID NO 232 in the 10/225,066 US patent application
  misc_feature: The sequence is a functional homolog of SEQ ID NO 264 in the 10/374,780 US patent application
  misc_feature: The sequence is a functional homolog of SEQ ID NO 534 in the 11/435,388 US patent application
  misc_feature: The sequence is a functional homolog of SEQ ID NO 2178 in the 10/374,780 US patent application
  misc_feature: The sequence is a functional homolog of SEQ ID NO 504 in the 10/666,642 US patent application
  misc_feature: The sequence is a functional homolog of SEQ ID NO 896 in the 11/435,388 US patent application
  misc_feature: The sequence is a functional homolog of SEQ ID NO 126 in the 10/412,699 US patent application
  misc_feature: The sequence is a functional homolog of SEQ ID NO 156 in the 10/225,068 US patent application
  misc_feature: The sequence is a functional homolog of SEQ ID NO 262 in the 10/374,780 US patent application
  misc_feature: The sequence is a functional homolog of SEQ ID NO 282 in the 10/225,066 US patent application
  misc_feature: The sequence is a functional homolog of SEQ ID NO 160 in the 10/412,699 US patent application
  misc_feature: The sequence is a functional homolog of SEQ ID NO 214 in the 10/225,068 US patent application
  misc_feature: The sequence is a functional homolog of SEQ ID NO 2270 in the 10/374,780 US patent application
  misc_feature: The sequence is a functional homolog of SEQ ID NO 361 in the 11/479,226 US patent application
  misc_feature: The sequence is a functional homolog of SEQ ID NO 462 in the 10/225,066 US patent application
  misc_feature: The sequence is a functional homolog of SEQ ID NO 482 in the 11/435,388 US patent application
MGRQLCSHELGVKRGPWTAEEERKLIIFILSNRHCCWRAPPKLARLLRCRKSCRLRWTNYLRPDLKPGLLTDAE

SEQ ID NO: 22075 - DNA, 1139 bp, Panicum virgatum
  misc_feature: Ceres CLONE 1819623
  misc_feature: Encodes the peptide sequence at SEQ ID NO. 22076
gaataccacaccccgggcgagcaggcgaggtcgtctcagtggaccggaaccggaagcgagtcgcgcccgatggcggcgctgctgctgagccgggcgcggtggctcctggtggagcacccggcggtggcgtccttccgctggcagccgggccgcacgctcggcgcgaccccgtccttcgcggccgccgtcacctgcggctacctcgccgcggtgctcgtcctccaccgcctcgtccttccgcgcctcccgccgctcccgccgcgggcgctgcgcttggcctccgcggcccacaacacggtcctcctcgcgctctccgccaccatggccgccgggtgcgcgctgtccacggcggccacggcgccgccgccgcggtgggcgtggccgttctgcttccccccgggcggcgccacggaggcgtcgggccccgtcttcttctgggcgcacgtcttctacctctccaaggtgtacgagctcggcgacacgctgctcatcctgctcggccgccgcccgctcacgctgctccacgtctaccaccacgccgtcgtcatcgccatgtgctacctctggctcgccacgcgccagtccctgatgcccatcgcgctcgtcatcaacgccggcgtgcacgtcgtcatgtactcgtactacctctgctgcagcgtcgggctgcgctggcccaggcggctgaagcgcgccgtcacggagctgcagatcgtgcagttcctcttcagcttcgcggcctccgtggtcatgctgtggctccacttcaccgccggcggctgcgaggggatggccgggtgggtgttcaacgccgtcttcaacgcgtcgctgctcgcgctcttcctcgacttccatggcgccgcctacaaagccgcaaaggggaacaagggcaaagcagaatgacgcggccagcagcgaattagctgaccaccaattacctgtgagattttactgtttttagacttgttttttctatatatttcaaaaagggcaaagtagtgtattgaaatcttggatcatgtaacatttctgatttcaattttgttttgcttttccatcctgaacaatcatgttgcaacaacctttatgtgataattggtgtagatgaattatccaagtatctcgaaaaaaaaacctgaagc

SEQ ID NO: 22076 - protein, 276 aa, Panicum virgatum
  misc_feature: Ceres CLONE 1819623
  misc_feature (3)..(276): Pfam Name: ELO Pfam Description: GNS1/SUR4 family
MAALLLSRARWLLVEHPAVASFRWQPGRTLGATPSFAAAVTCGYLAAVLVLHRLVLPRLPPLPPRALRLASAAHNTVLLALSATMAAGCALSTAATAPPPRWAWPFCFPPGGATEASGPVFFWAHVFYLSKVYELGDTLLILLGRRPLTLLHVYHHAVVIAMCYLWLATRQSLMPIALVINAGVHVVMYSYYLCCSVGLRWPRRLKRAVTELQIVQFLFSFAASVVMLWLHFTAGGCEGMAGWVFNAVFNASLLALFLDFHGAAYKAAKGNKGKAE

SEQ ID NO: 22077 - DNA, 1331 bp, Panicum virgatum
  misc_feature: Ceres CLONE 1819628
  misc_feature: Encodes the peptide sequence at SEQ ID NO. 22078
gtcgtcgtcgtccctacacgttcgtctcccgaggagagagagcgcgcgcggcgagcttaggatgacgtggtgcaatggcttcaacgacgtgcgcgccgccgtggagatcagcctgtccccaaccgccgccgccgcgggcaagaaggccgccgcgtcgctcgccgtcctcgtcaagatgtgcccatcgtgcggccaccgcgcgcactacgaacaggagacaacatcgatccaggacttgccgggcctgccggccggcgtcaagttcgacccgacggaccaggagcttctggagcacttggagggcaaggcgaggccggactcccggaagctccaccccctcgtcgacgagtttatccccaccatcgagggcgagaacggcatctgctacacgcaccccgagaggctccccggcgtgagcaaggacgggctcgtccggcacttcttccaccggccgtccaaggcgtacacgacggggacgagaaagcgccggaaggtgcacagcggcgacggggacgacggcggaggcggcgagacgcggtggcacaagacgggcaagacgcggccggtgctgtcccacggcaggccccgcgggtacaagaagatcctggtgctctacaccaactacggcaagcagcgcaagcccgagaagaccaactgggtgatgcaccagtaccacctcggctccgacgaggaggagcgcgacggcgagctcgtcgtctccaaggtcttcttccagacgcagcccaggcagtgcggctccacggcggcggccaagggggccgtcgccgccgccaacgtcgtcacgagcagcaacgcgcttgccggccatcaccagggtggtagcgttctcagggaggcaaacggtgtcgatcagttctacaatccaggaacaatgatggggtaccagggggtcccaaacaacagggcacctcctgtccctggtgcttctcacttcatgcctagcttcgcagtgcatgcagggagggctacctttggcccttgaatcaagaattcaggacaaaggtttatacaagacctattcaattcaattcacaggttaattaaatagggatttaggagcaggtcatgccgtcagggcatttgtccctggcctggaaaactacctacctcacacgcgaagaaacatatcgtgtcctttgcactctaacttgacgttcatttacgaactacaaaaattgttttcttttaagattcctttctattagataggtcatatgttcaacatcatatgctgttgttccatcgtagtacttgaatactcgaatcataaacatgtaaggggaaaaaaaagccatgctgctccaagattg

SEQ ID NO: 22078 - protein, 313 aa, Panicum virgatum
  misc_feature: Ceres CLONE 1819628
  misc_feature (62)..(207): Pfam Name: NAM Pfam Description: No apical meristem (NAM) protein
  misc_feature: Useful for making plants with altered carbohydrate content
  misc_feature: The sequence is a functional homolog of SEQ ID NO 210 in the 10/666,642 US patent application
  misc_feature: The sequence is a functional homolog of SEQ ID NO 562 in the 11/435,388 US patent application
  misc_feature: The sequence is a functional homolog of SEQ ID NO 542 in the 10/666,642 US patent application
  misc_feature: The sequence is a functional homolog of SEQ ID NO 1710 in the 10/374,780 US patent application
  misc_feature: The sequence is a functional homolog of SEQ ID NO 318 in the 10/374,780 US patent application
  misc_feature: The sequence is a functional homolog of SEQ ID NO 848 in the 10/225,066 US patent application
  misc_feature: The sequence is a functional homolog of SEQ ID NO 1713 in the 10/374,780 US patent application
MTWCNGFNDVRAAVEISLSPTAAAAGKKAAASLAVLVKMCPSCGHRAHYEQETTSIQDLPGLPAGVKFDPTDQELLEHLEGKARPDSRKLHPLVDEFIPTIEGENGICYTHPERLPGVSKDGLVRHFFHRPSKAYTTGTRKRRKVHSGDGDDGGGGETRWHKTGKTRPVLSHGRPRGYKKILVLYTNYGKQRKPEKTNWVMHQYHLGSDEEERDGELVVSKVFFQTQPRQCGSTAAAKGAVAAANVVTSSNALAGHHQGGSVLREANGVDQFYNPGTMMGYQGVPNNRAPPVPGASHFMPSFAVHAGRATFGP

SEQ ID NO: 22079 - DNA, 1684 bp, Panicum virgatum
  misc_feature: Ceres CLONE 1819644
  misc_feature: Encodes the peptide sequence at SEQ ID NO. 22080
atttctgctggaagaagaaaaaaaagggggtggggattggaggggatcgagggttgaagccttggcgaggagggtgccctagcccacgtgccggcagcaatggcggggtggtgcgaggaggcggtggcgctgctgcggcgccccgcggtggcggagatggcggtggacgtgctgctctgcgcggtgccgatctgggcggccgtcatgatcgggctcgtcgtgggctggtcctggcgcccgcgctggacggggctgctcttcctcggcctccgcagccgcctccgcctcctctgggtgccgccggggctcggcgcgcggaggctctggctcgcctgcaccgcgctctccgcgtgctccgtcgcgcccaggctcctctccgccttccgacgctgccgggggaagcaccaggacaaggtctcccccgaggaccacgccggggacgacggaggctgcgccgacggcaggacaatatttgagggcgagcatgatactgttactgagaaggacctagaacatctgcttcaacttttagataacaaggagagtggggatacagcgtggcagaatttgatggagcgcacaacctccaacatgacctacaaggcctggcggcgtgagcctgaggagggacctattatgtattgcagccgcactatttttgaggatgctactcctgaactggttagagatttcttctgggatggtgattttcgtcttaagtgggatcccatgcttgcatattcaaagacattggatgagttccctcagaatggaaccatgattgtccactggataaaaaagttcccgttcttttgcagtgaccgtgaatacatcttcggagggcacatatgggaatctgggaagacatactattgtgttacaaagggtgttccttatctttctttgccaaagaaggaaaaaccaaggcgtgtggagctgtacttctcaagctggcgaattagatctgttcaatcgcctaaacaacctggacagcaatccgcatgtgaagtaactttggttcactatgaggacatgggcataccaaaagatgttgccagggttgctgttcggcatggcatgtggggtgctgtaaagaagctgcagtctgggttcagagcataccagcagatgagagcagaaaacgccctgtcacacagtgccatcatggctcaagtgaccaccaaggtatccattgctggctcaaatggtcctctggaccaagaactttctgctgctgataaaatcagcgatggcgatgcgaactctagggcagtccaacatggtttcgactggagatgggtggtggttggaggtgctgtggctgcggtttgcgtgctcaacactggatttgttgggaaggtcctcctactaggggcagcaagacggcaggcaaagaagtgaggtgaggggcaccttccggcgtctgcagaagacggcaggccctaaccagtagctgcaaccttgcagtcgacaaatgattaagaaataggatgggtttcaacaggaggcagataagagggatgcacgatttttgatcgtgcgttttatgaggtagagcacgggtgtgctaccataagaggcgccgcggtgccgagaacctgtagctaatgtatctgaagttataagaggctttcttgctaccgtactgcatgctttcagccttctacattcgcatttattcttg

SEQ ID NO: 22080 - protein, 433 aa, Panicum virgatum
  misc_feature: Ceres CLONE 1819644
  misc_feature (134)..(344): Pfam Name: START Pfam Description: START domain
MAGWCEEAVALLRRPAVAEMAVDVLLCAVPIWAAVMIGLVVGWSWRPRWTGLLFLGLRSRLRLLWVPPGLGARRLWLACTALSACSVAPRLLSAFRRCRGKHQDKVSPEDHAGDDGGCADGRTIFEGEHDTVTEKDLEHLLQLLDNKESGDTAWQNLMERTTSNMTYKAWRREPEEGPIMYCSRTIFEDATPELVRDFFWDGDFRLKWDPMLAYSKTLDEFPQNGTMIVHWIKKFPFFCSDREYIFGGHIWESGKTYYCVTKGVPYLSLPKKEKPRRVELYFSSWRIRSVQSPKQPGQQSACEVTLVHYEDMGIPKDVARVAVRHGMWGAVKKLQSGFRAYQQMRAENALSHSAIMAQVTTKVSIAGSNGPLDQELSAADKISDGDANSRAVQHGFDWRWVVVGGAVAAVCVLNTGFVGKVLLLGAARRQAKK

SEQ ID NO: 22081 - DNA, 725 bp, Panicum virgatum
  misc_feature: Ceres CLONE 1819661
  misc_feature: Encodes the peptide sequence at SEQ ID NO. 22082
cgccgagcaaggagcagccacgaaccgagaccccatcgccattcgccaccaagatcaattcgagctagacaagatcacaagacatggagtacgacgagcaggagtcgccggaggccgccgccggggaggagtacgccacggtcatgtccgcgccgcccaagcgccccgcggggcggaccaagttccgggagacccgccacccggtgtaccgcggcgtgcggcggcgcggccccgcggggcgctgggtctgcgaggtccgggagcccaacaagaagtcccgcatctggctcggcaccttcgccaccgccgaggccgccgcgcgcgcgcacgacgtcgccgcgctcgcgctccggggccgcgcggcctgcctcaacttcgccgactcggcgcgcctgctccgcgtcgacccggccacgctcgccacgcccgaggacatccgccgcgccgccatcgagctcgccgaggcctccgcgcagcaggacgccgcggcggcggtcgcctcctcgtcgtccgcggccgacgcggcggcaccgatggcgatgcaccaccagcaggacgccgcgccctacgactacgcggcaatgtacggcaacatggacttcgaccaaccgtactactacgacggtatgggctgcggcgccgttgggggcaacgactggcaggccggctggcatgtgaacgcggacgacgacggcgccggcgcccgcggctgcggcagcgacatg

SEQ ID NO: 22082 - protein, 213 aa, Panicum virgatum
  misc_feature: Ceres CLONE 1819661
  misc_feature (40)..(92): Pfam Name: AP2 Pfam Description: AP2 domain
  misc_feature: The sequence is a functional homolog of SEQ ID NO 1224 in the 10/374,780 US patent application
  misc_feature: The sequence is a functional homolog of SEQ ID NO 1413 in the 10/412,699 US patent application
  misc_feature: The sequence is a functional homolog of SEQ ID NO 710 in the 11/435,388 US patent application
  misc_feature: The sequence is a functional homolog of SEQ ID NO 1229 in the 10/374,780 US patent application
  misc_feature: The sequence is a functional homolog of SEQ ID NO 1245 in the 10/374,780 US patent application
  misc_feature: The sequence is a functional homolog of SEQ ID NO 4 in US patent 7317141
  misc_feature: The sequence is a functional homolog of SEQ ID NO 750 in the 11/435,388 US patent application
  misc_feature: The sequence is a functional homolog of SEQ ID NO 1232 in the 10/374,780 US patent application
  misc_feature: The sequence is a functional homolog of SEQ ID NO 718 in the 11/435,388 US patent application
  misc_feature: The sequence is a functional homolog of SEQ ID NO 1223 in the 10/374,780 US patent application
  misc_feature: The sequence is a functional homolog of SEQ ID NO 1412 in the 10/412,699 US patent application
  misc_feature: The sequence is a functional homolog of SEQ ID NO 716 in the 11/435,388 US patent application
  misc_feature: Useful for making plants with modulated water use efficiency
  misc_feature: The sequence is a functional homolog of SEQ ID NO 1227 in the 10/374,780 US patent application
  misc_feature: The sequence is a functional homolog of SEQ ID NO 706 in the 11/435,388 US patent application
  misc_feature: The sequence is a functional homolog of SEQ ID NO 2 in US patent 7253000
  misc_feature: The sequence is a functional homolog of SEQ ID NO 1246 in the 10/374,780 US patent application
  misc_feature: The sequence is a functional homolog of SEQ ID NO 748 in the 11/435,388 US patent application
  misc_feature: The sequence is a functional homolog of SEQ ID NO 1248 in the 10/374,780 US patent application
  misc_feature: The sequence is a functional homolog of SEQ ID NO 1230 in the 10/374,780 US patent application
  misc_feature: The sequence is a functional homolog of SEQ ID NO 724 in the 11/435,388 US patent application
  misc_feature: The sequence is a functional homolog of SEQ ID NO 1226 in the 10/374,780 US patent application
  misc_feature: Useful for making plants with altered terpenoid content
  misc_feature: Useful for making plants with modulated flowering time
  misc_feature: The sequence is a functional homolog of SEQ ID NO 2 in US patent 7138277
  misc_feature: The sequence is a functional homolog of SEQ ID NO 1244 in the 10/374,780 US patent application
  misc_feature: The sequence is a functional homolog of SEQ ID NO 744 in the 11/435,388 US patent application
MEYDEQESPEAAAGEEYATVMSAPPKRPAGRTKFRETRHPVYRGVRRRGPAGRWVCEVREPNKKSRIWLGTFATAEAAARAHDVAALALRGRAACLNFADSARLLRVDPATLATPEDIRRAAIELAEASAQQDAAAAVASSSSAADAAAPMAMHHQQDAAPYDYAAMYGNMDFDQPYYYDGMGCGAVGGNDWQAGWHVNADDDGAGARGCGSD

SEQ ID NO: 22083 - DNA, 702 bp, Panicum virgatum
  misc_feature: Ceres CLONE 1819665
  misc_feature: Encodes the peptide sequence at SEQ ID NO. 22084
gccccgtttcccctctggccctctctgtctctcctcccttggtcttccactcttcctttcctggcggcgacgactgggcaagcggcggcgccattcgtcacgtcttcacccggttctttgccggcgacgagcatccaccagacaagggagcttccaagttcctagatagacctgttaacctgcacgagtagcagatggcgaggataaagcccaagcaactgctcattcaaagcaaaacgaagaaggctccgtctcgaatcagttactcaactatcatcacatggaacctgattgtcgtcttggttgtgctatccctctatgccacttacaggcattggcatcaaaggtcagcccaagacattgaaatggatcttcgtcaagctgagcttgctgtgagaccagatgattcaaaaatgacaagtagaccaggatatgcagtaatgaacactggcaaaggcccaattactatagaaatatacaaagatgcttctgctgatgttgtggatagattcatcaacttatgcaagagtaatcacttcaaaggaatgccattccgccacatcataaaaaattttgtgattcaaggtggtgatttcgattttgatggagctgcccaagaatggataacaaaagctaaagccagtgggaagaatgatctcagtccagagcacgaggcatttatgattgggactgctaagaatc

SEQ ID NO: 22084 - protein, 169 aa, Panicum virgatum
  misc_feature: Ceres CLONE 1819665
  misc_feature: SWISSPROT Homolog: EC 5.2.1.8 Peptidylprolyl isomerase
MARIKPKQLLIQSKTKKAPSRISYSTIITWNLIVVLVVLSLYATYRHWHQRSAQDIEMDLRQAELAVRPDDSKMTSRPGYAVMNTGKGPITIEIYKDASADVVDRFINLCKSNHFKGMPFRHIIKNFVIQGGDFDFDGAAQEWITKAKASGKNDLSPEHEAFMIGTAKN

SEQ ID NO: 22085 - DNA, 1448 bp, Panicum virgatum
  misc_feature: Ceres CLONE 1819685
  misc_feature: Encodes the peptide sequence at SEQ ID NO. 22086
gcgaccccaggtcagacgggatcacccgctgagtttaagcatataaataagcggaggagaagaaactatgttcttcatctggtataacaccagaggcaggaaagcttcgagaaggaagacgcggcgatggagaacggcggcggcggcggcagaggggacgtccccgaggacgccaacgagcattgccccggaacgcagtcggaggatgcggggaaggcggatgcctgcgccggatgccccaaccagcagatttgcgccactgcccccaagggccctgatccagatgtggttgctattgttgagcggctggctacggtgaagcacaagatactagttctgtctggaaagggaggtgttggaaagagcacgttctcagctcagctctcatttgccctagctgaaatggagcatcaggtcggccttcttgacatagatatctgtggccctagcatcccaaaaatgttagggctggagggtcaggatattcatcaaagcaaccttggctggtccccggtctatgtcgagtcaaaccttggtgttatgtcaattggtttcatgctgcctaacccagatgatgctgtcatatggaggggtccccgtaagaatggactgataaagcagttcttaaaggatgttgactggggggagatcgactatcttgtagtggatgcacctccaggaacctctgatgaacacatctcgattgtgcagtacctccaggccacaggaatcgatggtgcaataattgtcacgactccgcagcaggtctctctaatcgacgtgaggaaggagataaatttctgcaagaaggtcggtgttccggtgttgggtgttgtggagaacatgagtggcctgaggcagccactttcagatctcagattcgtgaagtcaggtgagtcaggcgagacagacgctacggagtgggtgctgaactatatcagggagaaagcgcccgagctcctatctgttgtggcgtgcagcgaggtgtttgacagcagcaagggtggcgcagagaagatgtgcatcgaaatgggggtccctttcctcggtaaggtgcccatggatcctcaactgtgcaaggcggcagaggaagggagatcgtgctttgctgatcagaagtgcagcgccagtgctccggctcttcagagcattgtgaagaagttaatcaagactgagtgagaaaatagtgttggcccgctggggattgggtggatgtgacaatgccagagttcatgctatgtatgttgctgtgttacacgctgaatttgttttattgctggtattggatccagtaagtttttgttcatgaattatcagtgggggcacaaaattatgaaactactgcagattctgagtgaagtatgttttgggctgctgcctgaatgatgcttgctttacatgctttgtactgtgtaccttaactgaatgagcaaatggatggtattagc

SEQ ID NO: 22086 - protein, 350 aa, Panicum virgatum
  misc_feature: Ceres CLONE 1819685
  misc_feature (68)..(283): Pfam Name: CbiA Pfam Description: CobQ/CobB/MinD/ParA nucleotide binding domain
  misc_feature: SWISSPROT Homolog: EC 2.7.10.2 Non-specific protein-tyrosine kinase
MENGGGGGRGDVPEDANEHCPGTQSEDAGKADACAGCPNQQICATAPKGPDPDVVAIVERLATVKHKILVLSGKGGVGKSTFSAQLSFALAEMEHQVGLLDIDICGPSIPKMLGLEGQDIHQSNLGWSPVYVESNLGVMSIGFMLPNPDDAVIWRGPRKNGLIKQFLKDVDWGEIDYLVVDAPPGTSDEHISIVQYLQATGIDGAIIVTTPQQVSLIDVRKEINFCKKVGVPVLGVVENMSGLRQPLSDLRFVKSGESGETDATEWVLNYIREKAPELLSVVACSEVFDSSKGGAEKMCIEMGVPFLGKVPMDPQLCKAAEEGRSCFADQKCSASAPALQSIVKKLIKTE

SEQ ID NO: 22087 - DNA, 667 bp, Panicum virgatum
  misc_feature: Ceres CLONE 1819690
  misc_feature: Encodes the peptide sequence at SEQ ID NO. 22088
atatttcaaacagaagaagtttgctgaagcaattgagtgctactccagaagtattgggttgtctcctacagcagttgcttatgcaaatagagctatggcatatcttaaactaagaagattcaaggaggcagaggacgattgcactgaagctctgaatctggatgatcgatatattaaagcatactcacggcgaattacagcacggaaagaacttgggaagcttaaggaagcaatggatgatgctgaatttgccatcagtcttgagccaaacaatccaaagctaaggaagcagtattctgacataaaagctttgcacatggagaaattggctaaaacaacccaggagccagctaagcatgcagtttctggatttgataaacctgctgataaaaaggaaatcacttctcatccgccgactatctcccagaaggacagtttcatggaagttgattcacctattagagctgcagtggatatcagagagagtgctggtggcaggtctaaaggagggtctggagtaatcatcaatgagaatggcatgcagtcttgggatgccaatcagaagcctgggccagaagcttcaattcaagagcttgcatcgcgagctgcttcacggtatatggccagcactgtaaaaagcgtcaagataccgaagacagcttatgac

SEQ ID NO: 22088 - protein, 221 aa, Panicum virgatum
  misc_feature: Ceres CLONE 1819690
  misc_feature (24)..(57): Pfam Name: TPR_1 Pfam Description: Tetratricopeptide repeat
  misc_feature (58)..(91): Pfam Name: TPR_1 Pfam Description: Tetratricopeptide repeat
  misc_feature: SWISSPROT Homolog: EC 3.1.3.16 Phosphoprotein phosphatase
YFKQKKFAEAIECYSRSIGLSPTAVAYANRAMAYLKLRRFKEAEDDCTEALNLDDRYIKAYSRRITARKELGKLKEAMDDAEFAISLEPNNPKLRKQYSDIKALHMEKLAKTTQEPAKHAVSGFDKPADKKEITSHPPTISQKDSFMEVDSPIRAAVDIRESAGGRSKGGSGVIINENGMQSWDANQKPGPEASIQELASRAASRYMASTVKSVKIPKTAY

SEQ ID NO: 22089 - DNA, 683 bp, Panicum virgatum
  misc_feature: Ceres CLONE 1819696
  misc_feature: Encodes the peptide sequence at SEQ ID NO. 22090
atcagttgtcttcctttgataaataggcaaaccatcaccccccaccagctccttgcttgccctctcttgcctccttttctgctcttggtgttcttggtgagacagagggagaggcagagtttgttcagtaggagttgtgcactatgggtaattgctggtttaaggggaattcatactttaacagggtttcctccaatgcaaccaaatcaggctgaggttatatttcttgagcagctctcccacccaaatttagtgaagttgatcggttattgttgtgaagacgaccacagggttcttgtttacgagttcatgcccctgggaagtgtggagtctcatctgttttcaagggtgatgatgccacttccatggtcgaccagaatgaaaattgcgcttggcgctgcaaagggacttgcttttctgcatgaagcagagaagcctgtcatctatcgggactttaagacatcgaacatattgctagatgaggaatataatgcgaaactatccgattttgggcttgcaaaagatggaccagtcggcgacaagtcccatgtttcaactcgtattatgggtacttacggttatgcagcgccagagtacatcatgacagggcatctcacggcgatgagcgatgtctacagctacggtgttgtcctcctggagctcctcacgggccggaagtcgct

SEQ ID NO: 22090 - protein, 227 aa, Panicum virgatum
  misc_feature: Ceres CLONE 1819696
  misc_feature (50)..(227): Pfam Name: Pkinase_Tyr Pfam Description: Protein tyrosine kinase
  misc_feature: SWISSPROT Homolog: EC 2.7.11.1 Non-specific serine/threonine protein kinase
ISCLPLINRQTITPHQLLACPLLPPFLLLVFLVRQRERQSLFSRSCALWVIAGLRGIHTLTGFPPMQPNQAEVIFLEQLSHPNLVKLIGYCCEDDHRVLVYEFMPLGSVESHLFSRVMMPLPWSTRMKIALGAAKGLAFLHEAEKPVIYRDFKTSNILLDEEYNAKLSDFGLAKDGPVGDKSHVSTRIMGTYGYAAPEYIMTGHLTAMSDVYSYGVVLLELLTGRKS

SEQ ID NO: 22091 - DNA, 709 bp, Panicum virgatum
  misc_feature: Ceres CLONE 1819697
  misc_feature: Encodes the peptide sequence at SEQ ID NO. 22092
aggccagccgtctgcaaaacccaaacggccaaacctgaggtggagatcgcacgcggggcaccccatctctcgtaccgccgtttgttccgctcgcgctcgccaccaccaccacccacatcccaatctctcgccgccgcaccggcagcgtcagggtcttcgccgtcgcctccacgccctccaccgtctccaccaaggttgaggttaagaagtcatttgctcctccaagggaggtacatgtccaggttacacattcaatgccaccccagaagattgaaatattcaagtctcttgatgactgggctagagataacatcttgactcatctcaagccagtcgagaagtgttggcagccacaggatttcctccctgacccagcatctgaaggatttcatgatgaagttaaggagctcagagaacgtgccaaggaaatccctgatgattacttagtttgtttggtcggagacatgattactgaggaagctcttccaacataccagactatgcttaacaccctcgatggtgtcagggatgagacaggtgcaagccccaccgcctgggcagtttggacaagggcatggactgatgaggagaaccggcatggtgacctcctaaacaaatatctgtacctcactgggagggtggatatgaggcaaattgagaagacaattcagtatcttattggctccggaatggatccaaggactgagaa

SEQ ID NO: 22092 - protein, 151 aa, Panicum virgatum
  misc_feature: Ceres CLONE 1819697
  misc_feature (2)..(151): Pfam Name: FA_desaturase_2 Pfam Description: Fatty acid desaturase
  misc_feature: SWISSPROT Homolog: EC 1.14.19.2 Acyl-[acyl-carrier-protein] desaturase
MPPQKIEIFKSLDDWARDNILTHLKPVEKCWQPQDFLPDPASEGFHDEVKELRERAKEIPDDYLVCLVGDMITEEALPTYQTMLNTLDGVRDETGASPTAWAVWTRAWTDEENRHGDLLNKYLYLTGRVDMRQIEKTIQYLIGSGMDPRTE

SEQ ID NO: 22093 - DNA, 1060 bp, Panicum virgatum
  misc_feature: Ceres CLONE 1819703
  misc_feature: Encodes the peptide sequence at SEQ ID NO. 22094
cacctgcttgattgaaacgccctctccccaagcccctgtcgttcgatctcccgatcccgccaccggaggcgatggcggcggcgccggcggtaaggtttccggtctccggcctcgtgcggctgctgggcttggccgccgcggcgggcatcctcttctgggccgtccactaccgcggcggcatggctctgtccaccgacgaggagagcaagctcccgattttcaacgttcaccctgtgctgatgctgattggtttggtaaccttgaacggtgaagctcttttggcctataaaaccgtgccaggaaccaaaaaattgaaaaagctagtgcaccttgccctgcagttccttgccatgtttttgtgtttaattggtctctgggctgtctggaagttccacgatgaaagaaaaatcgatcacttatatacacttcactcatggttgggactcacttgcatcatcttcttcagcttgcagtgggctactggattttggaccttttggtatcctggtggatcaagaagtggccgcgcatctctccttccctggcatgtcttctttggtatattcatctatgctcttgctatcgccacaagtgtgagtggactcctagagaagtcaatatttatgcagagtgccaaaatgattgggcgcttctccacagaagccatgtttatgaactcgctggggatgctgctagtggtactgggcgcccttgttattcttgcaattgttagtcctggacctggtaagattgacacataccgaggctcttcagagtaagccgaagtggttacagttcagtttcctgcaattttagccagtcactgagcattgtatgtacatgtcgttgaagccagaattgtgatttcggtcctctgatatggatagtcagtgctgaggataacctcgttcctgtaacaaggttcacttcattccagtagcatatttgtggatcaagctgactgaaattacatcccagatttttctgtagaccaagactcccatatactttggttttatacattggaatatgggatataataagtagagctttgttttgg

SEQ ID NO: 22094 - protein, 235 aa, Panicum virgatum
  misc_feature: Ceres CLONE 1819703
  misc_feature (11)..(231): Pfam Name: Cytochrom_B561 Pfam Description: Cytochrome b561
MAAAPAVRFPVSGLVRLLGLAAAAGILFWAVHYRGGMALSTDEESKLPIFNVHPVLMLIGLVTLNGEALLAYKTVPGTKKLKKLVHLALQFLAMFLCLIGLWAVWKFHDERKIDHLYTLHSWLGLTCIIFFSLQWATGFWTFWYPGGSRSGRASLLPWHVFFGIFIYALAIATSVSGLLEKSIFMQSAKMIGRFSTEAMFMNSLGMLLVVLGALVILAIVSPGPGKIDTYRGSSE

SEQ ID NO: 22095 - DNA, 1381 bp, Panicum virgatum
  misc_feature: Ceres CLONE 1819711
  misc_feature: Encodes the peptide sequence at SEQ ID NO. 22096
acacagcgcgagtccaccccagaggcccattcctgcacagagccgccgaatcgggaccaatcccgtcgatccttctggccgccgccgccgccgccgccgcggggctctccagaggcgtcctccgattcggccggggccggggggaactggggacacatggggctcggggcggcggcggggcggctcctgccggaggtggactgggagcgcgaggcctacccggcgtacgacgacttcctcgcgctcccggccttcgtcctcttcttccccaccgtccgcttcttcctcgaccgcttcgtcttcgagagggttgcaaggaggcttatacttgggaagggacatcaccagagatctaatgatgaaacagaagaaaccaggaagaagataagaaaattcaaggaatcggcgtggaaatgtgtttatttcctatctggagagcttttatctctgtcggtcacatataatgaaccttggttcaccaataccagatatttttgggtaggacctggagaacagatttggcctgatcaaaagataaaattgaaacttaaggcggtgtacatgtatgctgctggattctacacatattccatatttgcacttatgttttgggaaacaaggcgttcggactttggcgtgtcgatgtcacatcatgttgctactgttatcctgatcgttctatcttatgtgttcagatttgctagagttggctctatagtattggcaattcatgatgcaagtgacgttttcttggaagtagggaagatgtccaagtacagccattgtgattggcttgccaatgtttcatttcttctttttgttgtttcatgggttcttctccggctcacatattttccattctggattctgagaagtacaagctacgaggtcttgttgactttggataaaaagaagcacagttttgatggtcccatatactattacgtgttcaactcccttttattttcactgcttgttctccacatatattggtgggttttaatatatcggatgcttgtgaggcaaatcatgacaaggaatgttggagatgatgttcgatctgactctgaaggagaagacgagcacgaagattgattggcaccaccatcttgtcttctctattgcaacgatgctagaagcatcgactccagtgcccagtgccccgagctttgcattcttttcctggatttcaagatatgtgcagattatgggaggacgagcattgttcctcacgagatacatcagcgccgagctgcgacttgttctgcctcggccgcacatatgtgttgtaccatgtatgcatgatagtaatacattatgctccagtgcgttaattaggagcagctggatatccaagacaagcattctttcgggggtaaac

SEQ ID NO: 22096 - protein, 312 aa, Panicum virgatum
  misc_feature: Ceres CLONE 1819711
  misc_feature (98)..(309): Pfam Name: LAG1 Pfam Description: Longevity-assurance protein (LAG1)
  misc_feature: SWISSPROT Homolog: EC 2.3.1.24 Sphingosine N-acyltransferase
MGLGAAAGRLLPEVDWEREAYPAYDDFLALPAFVLFFPTVRFFLDRFVFERVARRLILGKGHHQRSNDETEETRKKIRKFKESAWKCVYFLSGELLSLSVTYNEPWFTNTRYFWVGPGEQIWPDQKIKLKLKAVYMYAAGFYTYSIFALMFWETRRSDFGVSMSHHVATVILIVLSYVFRFARVGSIVLAIHDASDVFLEVGKMSKYSHCDWLANVSFLLFVVSWVLLRLTYFPFWILRSTSYEVLLTLDKKKHSFDGPIYYYVFNSLLFSLLVLHIYWWVLIYRMLVRQIMTRNVGDDVRSDSEGEDEHED

SEQ ID NO: 22097 - DNA, 712 bp, Panicum virgatum
  misc_feature: Ceres CLONE 1819713
  misc_feature: Encodes the peptide sequence at SEQ ID NO. 22098
gcagatcgatcgagcaccccaaacttgcacacaatcaccatcagttctagtagacaggacatatcgacatcgacgatgagctccgtggacgccaccggcggcgagaagaagacgtcgtggccggaggtggtgggcctgccggcggaggaggccaagaagatcatcctcaaggacatgcccgacgccgacgtcgtcgtcctgcccgccggctcgccggtgaccatggactggaggtccaaccgcgtccgcgtcttcgtcgacaccgtcgctcagaccccgacggtgggctgaatgataaacgtaccgcctgcatgctggatcaaagctgctagctagcgcctacacccttgatgttccttcctgattgcccttactggtttagcttttagctagtacactagaaaagggaagatctagagatcaaataattgaagctcatcaaatagtatggggaatggagctagctgctgtctagaataaaactgatggaatgcatgaataaacaatgtattactgcagtacttcacattatgtgtccgtattcagggggctaacaatgtatatattcttatgtttgcagagaagcgccttgggcttcaaccagcatgcactgctgcctgaagggcaaacaatctagttgtacagctaacagttgctaggtttgcgctcacgttttttctctactaaaaaccttataaaacggccctttttg

SEQ ID NO: 22098 - protein, 71 aa, Panicum virgatum; identical to SEQ ID NO: 19463
  misc_feature: Ceres CLONE 1819713
  misc_feature (12)..(71): Pfam Name: potato_inhibit Pfam Description: Potato inhibitor I family

SEQ ID NO: 22099 - DNA, 725 bp, Panicum virgatum
  misc_feature: Ceres CLONE 1819725
  misc_feature: Encodes the peptide sequence at SEQ ID NO. 22100
tcttggttttgctagagagaaaaaaaacaaaaaaaaagtttgtttcttcagatctgctgtagtcgatggctgccgctatagatcagtccggggaggagctgatgagagcactcgagccttttatccgggatgcctctgctcctcacgaatccagtccgcttctccagcaccaccaccctctgagccccacttcgcccttctccttccaccacgccgccgcctacggcgggtacccgttcgccggggccgagggggcgggccagctgagcccggcccagatgcactacatccaggcccgcctccacctgcagcagcgccaggcgcagtcctccgtcctgggcccgcgggcccagcccatgaaggtctcgtcggcggccccggccccgccgcggccgcagaagctgtaccgcggcgtgcggcagcggcactggggcaagtgggtggcggagatccgcctcccgcgcaaccgcacccgcctctggctcggcaccttcgacaccgccgaggaggcggcgctcgcctacgaccaggccgcctaccgcctccgcggcgacgcggcgcgcctcaacttccccgacaacgccgcctcccgcggcccgctccacgcctccgtcgacgccaagctccagcagctctgccagagcatcgccgcatccaagaagggcgccaagaaatccgcccccgccgcccccgccgccgccatgtcctcctcctccgcccccacc

SEQ ID NO: 22100 - protein, 219 aa, Panicum virgatum
  misc_feature: Ceres CLONE 1819725
  misc_feature (112)..(163): Pfam Name: AP2 Pfam Description: AP2 domain
  misc_feature: The sequence is a functional homolog of SEQ ID NO 1290 in the 10/374,780 US patent application
  misc_feature: The sequence is a functional homolog of SEQ ID NO 1436 in the 10/412,699 US patent application
  misc_feature: The sequence is a functional homolog of SEQ ID NO 1288 in the 10/374,780 US patent application
  misc_feature: The sequence is a functional homolog of SEQ ID NO 1434 in the 10/412,699 US patent application
MAAAIDQSGEELMRALEPFIRDASAPHESSPLLQHHHPLSPTSPFSFHHAAAYGGYPFAGAEGAGQLSPAQMHYIQARLHLQQRQAQSSVLGPRAQPMKVSSAAPAPPRPQKLYRGVRQRHWGKWVAEIRLPRNRTRLWLGTFDTAEEAALAYDQAAYRLRGDAARLNFPDNAASRGPLHASVDAKLQQLCQSIAASKKGAKKSAPAAPAAAMSSSSAP

SEQ ID NO: 22101 - DNA, 1626 bp, Panicum virgatum
  misc_feature: Ceres CLONE 1819731
  misc_feature: Encodes the peptide sequence at SEQ ID NO. 22102
gaaatcccttcaatgttcaaaacccctcaccccatccgccgccgctactcgactgtccactgcacgcgcggcgaccgacgggcgagagagcaggcgacggccggcggcggggagcaggacgcgatcctcaccggcgcctctacatctgtggggtgagagcaaagcagcaaaatgaacggccacctaaactttgaggaaggctggaaagtcctggaacagggtatcgtaagatgctcaaagattttggagtgcactagtacaaggcctactgtggctgagtacatgaattactatgattgttcttacaggatggctgtgcagaaacaggactattgtcgggaaatgtacaatggtttcaagacaacgcttgcagattgtgtccgtgcaatggttctgccacatctcatgcacaagaaaaatgactgcttttttagagagcttctgaaaatgtggtcaaactatggcatcatggttagatgtgtaactggcttctttagctatttggaccgctgctatgtggagcagtacaaactaccatcactaagcgatgctgctgctacttctttctttggtccagtcttttcgtacttcggtgatgaagtgagaactgctcttcttactatgatccgtcaagaacgtgatggaaataacatggattcaggctttctggatgttatgcatggcatatgtcgttctgaagtcaaaacattaatgcaaaatgctgttcttcaagacacatatgactattactccatgagaagttctgaatggattgtgcactactctctaccagattatctagctaaggttcaggaaagtatggaaaaggaaaccaatagaatggcttactatctgaatatttcaagtgatgagagctttgacctctgtttacaggctgttaatgctccattgatggaaacttacgacagttacgcaagtgagaaacaaattggtggtcagcttttgcttcaaacatacaagactgttgaggaggaactgcttgacaggtgcggtagcttgacgcttggtggtcgttcaggcagcaattctctcgattgagtggggtagaaaggcaacttttcctaacatccatcatgacccagcttacatacagtagatcttttagaacatggcctgcatggcccgctcaaggctacccagctcccagtctagagcttgacttgtctagcagatttcgccgctgatctgaatggtgagatttcggttgagatttctacatatgctatccgtggttcccaggatctagggatcggagctcaactaagagttacagctcgctcaccttaccatgcacgtcattctgcaaaaccaacgcagttgggaatgcacatgatggtagattcttgtgatgaggatgctttgtttctctgactatcatctactgttaacttgtttgagacttgggatgccagcagggtaaatggcgtgtgtgcttttgcgtgcctgtttccatccccttgattgagaaggcttgtctagtttggcttttcgatgaattgtgttgatatcgctttatttcttttgctggggcagctgtgctgttggtaactcggtattgcattctgatattactgttctattgtacagccagtttcattgcgatgc

SEQ ID NO: 22102 - protein, 295 aa, Panicum virgatum
  misc_feature: Ceres CLONE 1819731
  misc_feature (11)..(295): Pfam Name: Cullin Pfam Description: Cullin family
MNGHLNFEEGWKVLEQGIVRCSKILECTSTRPTVAEYMNYYDCSYRMAVQKQDYCREMYNGFKTTLADCVRAMVLPHLMHKKNDCFFRELLKMWSNYGIMVRCVTGFFSYLDRCYVEQYKLPSLSDAAATSFFGPVFSYFGDEVRTALLTMIRQERDGNNMDSGFLDVMHGICRSEVKTLMQNAVLQDTYDYYSMRSSEWIVHYSLPDYLAKVQESMEKETNRMAYYLNISSDESFDLCLQAVNAPLMETYDSYASEKQIGGQLLLQTYKTVEEELLDRCGSLTLGGRSGSNSLD

SEQ ID NO: 22103 - DNA, 1435 bp, Panicum virgatum
  misc_feature: Ceres CLONE 1819735
  misc_feature: Encodes the peptide sequence at SEQ ID NO. 22104
aaattccgaagttccccaaaaagcctaaattccgaaggctggtaggcgaccaacagaggcccccttgccgtgctctgctctactcatggcagaccatcgcctgggaagacgcgggggagaaattctggagatctaaaccccggcacgcagccaggggaaccgggagctacaggtcgccatcaaatccacttcttgccgcttcaggaattggggaattcttcttccagtcgcaccttgatttcttgtgtcgagtgacatttgtggagctggaggacagagcttagcggcggtgccggcgaagatgagcagcggagacggtgctaacagcaggagggctgcctcagatgggatgaggaagctcagagagttgctgcacaagagcgacaaccgcatatgtgctgactgcagtgcacctgatcccaaatgggcatccgctaatattggagtattcatatgcctaaaatgctctggtgttcacagaagccttgggacacatgtttcaaaggttctgtcagtcactctagatcaatggactgatgatgaaattaactcaatgatagaagttggtggaaactcttacgcaaatgctatatatgaagtatttcttccagagggctatcacaaaccgcatccagattctacccaggaagagagagctgatttcatcaggtccaagtatgagtctcaagaatttctgaagccaagtctaaggatagtttctagtaatagctctttggaggttacctactctcgaaaacatatggacagcaatgcttcacattctgcaagtttcaacagtgaggctggcatggttgagtttattggaatactaaaagttaaagtaataagagggactaaattagctgtaagagacctgataagtagtgacccctatgttgtactgactctagggcagcagaaagcaaagacatcagtgattaaacgtaacctaaatcctgtttggaatgaagaacttaagctgtcagttcctcagcaatatggacctctcaagcttcaagtgtttgactatgacatgctatcgaaggacgacaaaatgggcgaggctgagattgacctgcagccgatgatcagtgcagcgactgcgttcggtgatgctgacctgctcgcggacatgcagatcggcaagtggctcaagtccccggacaatgcgcttgccagggacagccccgtgaatgtcgtcaatggtaaggtgaagcaggaggtctcgttgaagctacagaacgtggagtccggggaggtggatctggagctggagtggatacctctcaatcagtagaactagaacattcagtgctttgcgtgacctatcataaccataagaataaattaatgtgcttggaagtcatggcaaacagttaaacaatgaccgttggtataaaaactggtacaatatagttacaactgattccagctt

SEQ ID NO: 22104 - protein, 331 aa, Panicum virgatum
  misc_feature: Ceres CLONE 1819735
  misc_feature (18)..(139): Pfam Name: ArfGap Pfam Description: Putative GTPase activating protein for Arf
  misc_feature (177)..(256): Pfam Name: C2 Pfam Description: C2 domain
  misc_feature: SWISSPROT Homolog: EC 3.1.1.4 Phospholipase A(2)
MSSGDGANSRRAASDGMRKLRELLHKSDNRICADCSAPDPKWASANIGVFICLKCSGVHRSLGTHVSKVLSVTLDQWTDDEINSMIEVGGNSYANAIYEVFLPEGYHKPHPDSTQEERADFIRSKYESQEFLKPSLRIVSSNSSLEVTYSRKHMDSNASHSASFNSEAGMVEFIGILKVKVIRGTKLAVRDLISSDPYVVLTLGQQKAKTSVIKRNLNPVWNEELKLSVPQQYGPLKLQVFDYDMLSKDDKMGEAEIDLQPMISAATAFGDADLLADMQIGKWLKSPDNALARDSPVNVVNGKVKQEVSLKLQNVESGEVDLELEWIPLNQ

SEQ ID NO: 22105 - DNA, 983 bp, Panicum virgatum
  misc_feature: Ceres CLONE 1819738
  misc_feature: Encodes the peptide sequence at SEQ ID NO. 22106
ttaataaatatattaaatagaacaatatataagcaaacaacttaccttatattatatatacttgcaagctgtatatgctggtatggctagattatcgtatacatatgcaatcatgcatacatgatgcaggaattcgtgttggccggtagcagcagggacagaagcgacagcaaggggaagcttaggcatgtgggcgggccaaacatattcagtggattcactgatgacgagctgcttgccgaatcccttggcatcgacaaacgcctggccggaagccttcgtggtgaagatggccgagccggcggcaccatagtccacgcgccgcagattcgccttcctccaattgggccagctgatgggaagaacaaggacgacccgatgtgcaggatcatgaacaggaaggtgataatgaacttggaagaccctgctgctgccggcgtccacgacgacccgcgttatcagaacgtcacacgtctcaccgcccgcaacttccccatcctcgagtccctgcgattgagtcccgagagaggaactgtaagccagaacgcaattgttgcaccacactacaacataaactctcaagatgtggtgctgctgacccggggaagcgtccgagtgcaggttgttgataacgacggggtggcggtgttcgacggcgagcttcgtcaggggcagctgcttgtcataccacagtactacgtcgtcctacgcaaagcaggggcagatggttacgaatacatcttgttcaggaccaacgccaaccctctgataatcaacatggcagggccgggatccgtcctgctggccttgccggtcgatgtcatcgcagtttcctacaatgtctccacgacagatgccaagaagattaagaacagtgggagcaacgaggaacccatatgaactcgactgatatgattgcaacaatatatcagccaagtatgtacgtctagctatatgccaaagcgataggcgatattgcgatg

SEQ ID NO: 22106 - protein, 259 aa, Panicum virgatum
  misc_feature: Ceres CLONE 1819738
  misc_feature (105)..(247): Pfam Name: Cupin_1 Pfam Description: Cupin
MMQEFVLAGSSRDRSDSKGKLRHVGGPNIFSGFTDDELLAESLGIDKRLAGSLRGEDGRAGGTIVHAPQIRLPPIGPADGKNKDDPMCRIMNRKVIMNLEDPAAAGVHDDPRYQNVTRLTARNFPILESLRLSPERGTVSQNAIVAPHYNINSQDVVLLTRGSVRVQVVDNDGVAVFDGELRQGQLLVIPQYYVVLRKAGADGYEYILFRTNANPLIINMAGPGSVLLALPVDVIAVSYNVSTTDAKKIKNSGSNEEPI

SEQ ID NO: 22107 - DNA, 1718 bp, Panicum virgatum
  misc_feature: Ceres CLONE 1819745
  misc_feature: Encodes the peptide sequence at SEQ ID NO. 22108
ggcaggcatcgatcatctgagacgtactgagagatcgagatgaaacagtgatcagtgctagctcaagctcatcgatcgagcagcagccggccacatggcgggcatggacaagtggaccgggttggggtcggcgctggccagcttcctcttcctctggtccgtggtgcagagccacctcccggtggccttccgccaccgcctctccacctgggccaacaagctcgcctccttgttcaacccctacctccacgtcaccatctccgagtatggcgccaagcgcttcagccgcagcgacctgttcctcgccgtcgaggcctacctctccgacgcctgcgcccgccacgcgcgccgcctcaaggccgagctcggcaaggacagcaagaacctccaggtctccgtcgacgacaacgacgaggtcaccgacaccttcaacggcgtcacgatctggtggtacgccgccaagaagctccagacgtcccaggtcatcagcttctaccccggccaggacgagcgccgcttctaccaggtcgtcttccaccggcgccaccgcgacctcgtcgtcggctcctacctgccccacgtccttgaggagggccgcgccgtcaccgtccggaaccggcagcgccgcctcttcaccaacaaccccagcagcggctggaacccctaccgcagcggcaagggcgtctggagccacgtcccgttcgagcacccggccaccttcgacacgctcgccatggaccccgccgacaaggaggccatcgtcgacgacctcgaggcgttccgggacgccaaggactactacgccaaggtcggcaaggcgtggaagcgcgggtacctgctgtacggccccccgggcaccggcaagtccactatgatcgccgccatggccaacttccttgactacgacgtctacgacctcgagctcacgtcggtgaagaacaacaccgagctgcgcaagctcttcatcgagaccaccggcaagtccatcatcgtcatcgaggacatcgactgctccatcgacctcaccggcaagcgcaaggataagaaggcggcggagaagaagtcatcggaggacgaggctgacggcaagcccaagctgccgacggacgccgacaaggacgacggcaccaaggtcacgctctcggggctgctcaacttcatcgacggcctctggtcggcgtgcggcggcgagcgcatcatcatcttcaccaccaaccacaaggacaagctggacccggcgctgatccggcgaggcaggatggataagcacatcgagatgtcctactgcagcttcgaggccttcaaggtgctcgccaacaactacctggacatcaccgagcacgagctcttcggcgagattcggcgcctgctcgaggagaccgacatgtcgccggcggacgtggccgagaacctgatgcccatgtccaagaagaagaagagggacaacaacgcgtgcctggcggggctagtggaggctctgaagaaggccaaggaggaggcggcggaggcggaggttaaggccaaggcggaggcggaggccaaggaagccaaggaaaaggaggaggcagaggcgaagaaaggccaagcagaagaccaaggggacaaggacaaaacgtcggagggaaagatgagcaacggagagatcatcaatggatcggagcaggtgaaaaataatgacaacaactaataataaggtaataatgagcttgcttattggt

SEQ ID NO: 22108 - protein, 530 aa, Panicum virgatum
  misc_feature: Ceres CLONE 1819745
  misc_feature (246)..(449): Pfam Name: AAA Pfam Description: ATPase family associated with various cellular activities (AAA)
  misc_feature: SWISSPROT Homolog: EC 3.6.4.6 Vesicle-fusing ATPase
MAGMDKWTGLGSALASFLFLWSVVQSHLPVAFRHRLSTWANKLASLFNPYLHVTISEYGAKRFSRSDLFLAVEAYLSDACARHARRLKAELGKDSKNLQVSVDDNDEVTDTFNGVTIWWYAAKKLQTSQVISFYPGQDERRFYQVVFHRRHRDLVVGSYLPHVLEEGRAVTVRNRQRRLFTNNPSSGWNPYRSGKGVWSHVPFEHPATFDTLAMDPADKEAIVDDLEAFRDAKDYYAKVGKAWKRGYLLYGPPGTGKSTMIAAMANFLDYDVYDLELTSVKNNTELRKLFIETTGKSIIVIEDIDCSIDLTGKRKDKKAAEKKSSEDEADGKPKLPTDADKDDGTKVTLSGLLNFIDGLWSACGGERIIIFTTNHKDKLDPALIRRGRMDKHIEMSYCSFEAFKVLANNYLDITEHELFGEIRRLLEETDMSPADVAENLMPMSKKKKRDNNACLAGLVEALKKAKEEAAEAEVKAKAEAEAKEAKEKEEAEAKKGQAEDQGDKDKTSEGKMSNGEIINGSEQVKNNDNN

SEQ ID NO: 22109 - DNA, 721 bp, Panicum virgatum
  misc_feature: Ceres CLONE 1819757
  misc_feature: Encodes the peptide sequence at SEQ ID NO. 22110
ctgatctgactggcttgcgttcgctctccctcgatctcggccatggcggaggacgccaccagcagccacccctctcgctacgtcaagctcgccaaggaccaggacgcccccgccgaggacatcctccccggcgagctcaaccagccagtccacgtcccccagctcgaaggccggaggtgcagcgagtgcggccaggtcctgcccgagagctacgagccgcccgccgacgagccctggactaccggaatcttcggatgcaccgacgaccccgaaacctgccgaactggactgttttgtccttgcgtgctgtttggacgcaacgtggaggcacttagagaggacatcccctggacaactccttgcgtctgccatgctgtgtttgttgaaggagggatcacgctggcaattctgacagccatatttcatggtgtggatccaaggacatcgtttctgatcggagaaggtttggtgtttagttggtggttatgtgctacctatactggcattttccgtcaagaacttcagaggaaataccatctcaagaactctccgtgtgacccatgcatggtccactgctgcttgcactggtgtgcaaactgccaggagcatcgcgagaggcggggtcggcttgcagataacagcgcggtgcccatgacagttgtgaacccacctccagtacaagagatgagcatgtcagagaaccgtggtcctgtggccgccc

SEQ ID NO: 22110 - protein, 226 aa, Panicum virgatum
  misc_feature: Ceres CLONE 1819757
  misc_feature (65)..(192): Pfam Name: PLAC8 Pfam Description: PLAC8 family
MAEDATSSHPSRYVKLAKDQDAPAEDILPGELNQPVHVPQLEGRRCSECGQVLPESYEPPADEPWTTGIFGCTDDPETCRTGLFCPCVLFGRNVEALREDIPWTTPCVCHAVFVEGGITLAILTAIFHGVDPRTSFLIGEGLVFSWWLCATYTGIFRQELQRKYHLKNSPCDPCMVHCCLHWCANCQEHRERRGRLADNSAVPMTVVNPPPVQEMSMSENRGPVAA

SEQ ID NO: 22111 - DNA, 1592 bp, Panicum virgatum
  misc_feature: Ceres CLONE 1819805
  misc_feature: Encodes the peptide sequence at SEQ ID NO. 22112
tcgaaccccaaacctacccgacaccaaatctccaccggagtctgatggacggtgccgtacccaggaaacgcgaagctaaccacggcggcgacggcgaggccagcgcgccggacctgatcagccgcctcccggactgcatcctcggcaccatcgtctccctcctacgcactgaggatggcgcccgcaccgccgtcctctcccgccactggcgccctgtctggcgctccgcgccgctcaacctcgacgacgacctcaatatctattgcgacgacgacctccgcgtccaggtcgtctcccagatcctcgatgctcacgggggccccacccaccggctcgccttcagatctctccccctcgactccaacgcctccatctacgacgcctggttccgacggccgcagcaccgtgcgctccaggagcttgtcctccatttccccctcgtctccagctaccacgagctgcccgcctccgccctccgcttcgcctcgtcgctccgcgtgctcgacatcagatgctgtaccttgccggccgccggctggggcccgcctgccttcccctgccttacccacctttctctccgcgaagtcggcgtcagcgaagacttcctccaagggatgatttctggtagcccgaggatcgaggttatggtgctcggctccaatttcggtcaccgccggctgcgcctctgcctgcctaggcttaggtccctggccgtgtcggtcaggtggattagaaggagggaggaacggatcgagctggatgatctcgtggttgagggtgctccatgtctggaacgattgctgctcagtcatgtgacctatggcccatcggtgagaatcacaggcgcaaccaagctcaacatgttgggctaccttggaactggctttccaactattcaggtcggcgaatcaatctttaaggccatggttcctgtcaagttggcggataatttgttcggtgtgaggatattggcactagctatgcctgaaccaaatttgaagcttgccatagactacttaagatgttttcctttcttagagaagcttcacatcgagttttcaaacggatggagttgggaaggtcccgggctctatgatccgcttaatcccattgaatgtcttgaccgcagtctcaagaccattgagctgcaaccatacgaaggacttaattcacatatcgaattcgccaaattcttcatcaagagggcaaagatccttgagctcatgaagtttggtaggtgcccatggtgtgcaacaaaatggatcgaagatcagcacaggaagcttgatgtagagaacaaagcttctaaacgtgctcagttttcgtttgagcaagagggtgacttctcgacattctggttggatgaggccctatctgaagaagtctgcttctaaggtgggtgatttcttgtgggcaagctttcaggttctatcctggaagtggttgtcagaaatgctcatttcattgttaatgagacgctcttttactgaactctaggggtggctatctatattgtggaagatatataagccatccatctttaaaccccactacggtccaattagcttatacaaatgttcaacatttttctt

SEQ ID NO: 22112 - protein, 449 aa, Panicum virgatum
  misc_feature: Ceres CLONE 1819805
  misc_feature (348)..(398): Pfam Name: FBD Pfam Description: FBD
MDGAVPRKREANHGGDGEASAPDLISRLPDCILGTIVSLLRTEDGARTAVLSRHWRPVWRSAPLNLDDDLNIYCDDDLRVQVVSQILDAHGGPTHRLAFRSLPLDSNASIYDAWFRRPQHRALQELVLHFPLVSSYHELPASALRFASSLRVLDIRCCTLPAAGWGPPAFPCLTHLSLREVGVSEDFLQGMISGSPRIEVMVLGSNFGHRRLRLCLPRLRSLAVSVRWIRRREERIELDDLVVEGAPCLERLLLSHVTYGPSVRITGATKLNMLGYLGTGFPTIQVGESIFKAMVPVKLADNLFGVRILALAMPEPNLKLAIDYLRCFPFLEKLHIEFSNGWSWEGPGLYDPLNPIECLDRSLKTIELQPYEGLNSHIEFAKFFIKRAKILELMKFGRCPWCATKWIEDQHRKLDVENKASKRAQFSFEQEGDFSTFWLDEALSEEVCF

SEQ ID NO: 22113 - DNA, 662 bp, Panicum virgatum
  misc_feature: Ceres CLONE 1819811
  misc_feature: Encodes the peptide sequence at SEQ ID NO. 22114
gttttgttggttccgtctagggttttagcccctgccgccgcaacctcccgtcccctgcccctgccgccgcaaccgcctcctccccctagcgaatcccgtgcccccgcgacccgccgggcgacgagcgtctgcgccggcggccgagatggaccggtaccagagggtggagcggccacggaccgagtcggcgaccatcgaggagaacgagatccgcatcaccgcgcagggcctcatccgcaactatgtctcctacgccacctccctcctccaggagcggagaattaaagagattgttttgaaagccatgggacaggcaatcagtaagtctgttgctgttgcagaaattatcaagaaaagaatccctggtttacatcaagataccaatatcagttctgtcagcatcactgatgtctgggaacctatagaagaaggccttcacccgctggagatgactcggcatgtttcaatgatttcaattaccttatctcctggagagctggataagaacacccctgggtaccaagctcctgcttatgtcgaacagcacaggcaaccgcagcacctccagcaggcaccgccgccgcagcgccaacctcaccgagcacaaggccaataccagcagcttgagtatgaagactcctatgcacggggtcgaggcagag

SEQ ID NO: 22114 - protein, 172 aa, Panicum virgatum
  misc_feature: Ceres CLONE 1819811
  misc_feature (18)..(88): Pfam Name: Alba Pfam Description: Alba
  misc_feature: SWISSPROT Homolog: EC 3.1.26.5 Ribonuclease P
MDRYQRVERPRTESATIEENEIRITAQGLIRNYVSYATSLLQERRIKEIVLKAMGQAISKSVAVAEIIKKRIPGLHQDTNISSVSITDVWEPIEEGLHPLEMTRHVSMISITLSPGELDKNTPGYQAPAYVEQHRQPQHLQQAPPPQRQPHRAQGQYQQLEYEDSYARGRGR

SEQ ID NO: 22115 - DNA, 690 bp, Panicum virgatum
  misc_feature: Ceres CLONE 1819813
  misc_feature: Encodes the peptide sequence at SEQ ID NO. 22116
cacttcagaaactcaccttggatgatctttttaaggccacaaatggcttccacaatgatagcctaatagggtctggtggttttggggatgtctacaaggcccagctcaaggatggaaatgtcgttgcaatcaagaagcttatacatgtgagcggccagggtgaccgggagtttactgcagaaatggagactattggcaagatcaaacaccgcaaccttgttccgctccttggctactgcaaggttggtgaggagcggctgttggtgtatgaatacatgaagtatggcagcttggaagatgtgttgcatgaccgcaaaaagatcggaattaagctgagttgggcagcaaggcgaaagattgccataggtgctgcaaggggattggcattcctccatcacaactgcaccccgcacatcatccacagagacatgaagtcgagcaacgttcttattgatgagaacttggagacaaaggtatcagatttcggcatggcaaggacagtgaatgtggtggacacacacctgagtgtgtccacccttgctggtactccgggttatgtaccaccggagtactatcagagcttcagatgcaccaccaagggtgacgtgtacagctatggtgttgtgttgctcgagcttctcacagggaaaccgcctacggactcaacagattttggcgaggacaacaatc

SEQ ID NO: 22116 - protein, 229 aa, Panicum virgatum
  misc_feature: Ceres CLONE 1819813
  misc_feature (16)..(224): Pfam Name: Pkinase Pfam Description: Protein kinase domain
  misc_feature: SWISSPROT Homolog: EC 2.7.11.1 Non-specific serine/threonine protein kinase
  misc_feature: The sequence is a functional homolog of SEQ ID NO 2 in US patent 7135625
  misc_feature: Useful for making plants with altered carbohydrate content
LQKLTLDDLFKATNGFHNDSLIGSGGFGDVYKAQLKDGNVVAIKKLIHVSGQGDREFTAEMETIGKIKHRNLVPLLGYCKVGEERLLVYEYMKYGSLEDVLHDRKKIGIKLSWAARRKIAIGAARGLAFLHHNCTPHIIHRDMKSSNVLIDENLETKVSDFGMARTVNVVDTHLSVSTLAGTPGYVPPEYYQSFRCTTKGDVYSYGVVLLELLTGKPPTDSTDFGEDNN

SEQ ID NO: 22117 - DNA, 1449 bp, Panicum virgatum
  misc_feature: Ceres CLONE 1819841
  misc_feature: Encodes the peptide sequence at SEQ ID NO. 22118
aaactcgcctgagctgaagcttcctgcgccgcgccaccagatctcgccgccgcgtcaccgtccatgccgccgcggcgctcgcgccacttcctacgagtcctcttcctcctccttgtttctcttgcaggcgcgggcgtggcccacggtggcgcgggggaggatgccgcctgcgccgcggcgaaccgcaccgacgcggcgacgctccggccggaccgcctcacggtgctcctgagcggctactcggagcgtcgcctcccgctgctccgcgccatcgcgggggcctacgccgcgcacccgctggtcctctccgtggtcgtgctctggtgcaacccctccacgccgggccgcgtcctcctccgcggcggcgggttcccgccccgcgtcacggtccgccgcgccgcctccgcctccctcaactcccgcttcctcccgcgcccctccgacatccgcaccgcggccgtcgccgtggccgacgacgacgtgctgcccgacgctgcggccctctccttcgcgttcgccgcctggcagcagcagcagcagcagccagcggcggcggccggccccctcgtcggcttcttcccgcggtcgcaccacctcgacctcgcccgcgggaggtgggcgtacacggcggcgcagccggggcggtactccatggtgctcaccaagttcatggtcctcggggccgacctcctctacaggtactcgtgctcgccggagctcgcggcggcgcgcgccgtggttgaccgcgagcgcaactgcgaggacatcctcatgaacttcgtcgccgccgaggagtccggcgcggggcccgtgctcgtggaggccggcggcatccgggactggggcgacccgaggaacgacgtgaacgtcggtggcgcgggcgaggacggcggcgggatgaaggatgtcgggctgagcgccacaggcgggttggggcactgggagaagagaggggcgtgcatcaccgagttccaccgcctgctggggagaatgccgctgcgttacagctacgggaaggtggtggaggccgccgccggcgagcaggggctctgcagcaaaggcggacgcctcgtccggtgcgaccagcaggagtagctgaaggtctgtgattttcttcgcggtggtgtcaagttcaaatccatgtggccgttgaatcagattgctgaagggtggttgaagagttgaagaaccgtggctgtgacagactggaaatcagcttcatcatccctgctgataaatccatgaaggaagatggcgcttgtaatccctgctgacataaccgatagcttgttttcctgtcaatttggcgtgtggtgtatgtagttagcaccgtattcgattcagttcttgctctaaattttggttgttaacaagattgctcattgtcagtgcttcttgttagctcttctgcagaactgcaaacaaagttcaggtactgcaatgctttgc

SEQ ID NO: 22118 - protein, 343 aa, Panicum virgatum
  misc_feature: Ceres CLONE 1819841
  misc_feature (52)..(326): Pfam Name: EXTL2 Pfam Description: EXTL2, alpha-1,4-N-acetylhexosaminyltransferase
  misc_feature: SWISSPROT Homolog: EC 2.4.1.223 Glucuronyl-galactosyl-proteoglycan 4-alpha-N-acetylglucosaminyltransferase
MPPRRSRHFLRVLFLLLVSLAGAGVAHGGAGEDAACAAANRTDAATLRPDRLTVLLSGYSERRLPLLRAIAGAYAAHPLVLSVVVLWCNPSTPGRVLLRGGGFPPRVTVRRAASASLNSRFLPRPSDIRTAAVAVADDDVLPDAAALSFAFAAWQQQQQQPAAAAGPLVGFFPRSHHLDLARGRWAYTAAQPGRYSMVLTKFMVLGADLLYRYSCSPELAAARAVVDRERNCEDILMNFVAAEESGAGPVLVEAGGIRDWGDPRNDVNVGGAGEDGGGMKDVGLSATGGLGHWEKRGACITEFHRLLGRMPLRYSYGKVVEAAAGEQGLCSKGGRLVRCDQQE

SEQ ID NO: 22119 - DNA, 705 bp, Panicum virgatum
  misc_feature: Ceres CLONE 1819864
  misc_feature: Encodes the peptide sequence at SEQ ID NO. 22120
aacatagcttcattaattccctggctggctggcttccaactctttattccgcagaaaacgcacgtgccacatactgtatagagatatgccaagcatgcccgccgtctcagccgccacgggagcggcgcctccgccgaccaaggtcgtcgtcgaggacatctacggcttcctgcgcgtcctcgacgacggcaccgtgctccggtcggcggcggagccagcgttctgcccgaccaccttccccgacagccacccgtcggtgcagtggaaggaggccgtgtacgacaaggccaagaacctccgcgtccgcatgtacaggccggccgccgcgcccgcggggaagctgccggtgctcgttcacttccacggcggcgggttctgcctcgggtcgtgcacgtgggccaacgtgcacgcgttctgcctccgcctcgccgcggaggccggcgccgtcgtgctctccgcggggtaccgcctcgccccggagcaccgcctccccgcggcggtcgacgacggcgccgggttcctgcgctggctccgcgagcagtccgcgaaccccgccgccgcggacgcctggctcgccgaggccgccgacttcgggcgcgtgttcatcaccggcgactcggcgggcggcaccatagcgcaccacctcgccgcgcgcgccggcttggccgccgcggtcaccaagcgcggcgagcccggcccccggcc

SEQ ID NO: 22120 - protein, 203 aa, Panicum virgatum
  misc_feature: Ceres CLONE 1819864
  misc_feature (86)..(201): Pfam Name: Abhydrolase_3 Pfam Description: alpha/beta hydrolase fold
  misc_feature: SWISSPROT Homolog: EC 3.1.1.3 Triacylglycerol lipase
MPAVSAATGAAPPPTKVVVEDIYGFLRVLDDGTVLRSAAEPAFCPTTFPDSHPSVQWKEAVYDKAKNLRVRMYRPAAAPAGKLPVLVHFHGGGFCLGSCTWANVHAFCLRLAAEAGAVVLSAGYRLAPEHRLPAAVDDGAGFLRWLREQSANPAAADAWLAEAADFGRVFITGDSAGGTIAHHLAARAGLAAAVTKRGEPGPR

SEQ ID NO: 22121 - DNA, 1221 bp, Panicum virgatum
  misc_feature: Ceres CLONE 1819866
  misc_feature: Encodes the peptide sequence at SEQ ID NO. 22122
gaaacataaacatcgaaaatccgggcggcggcagattcgactgtcgcagccgccactgccgacaatatggcggcggcggcggcggcggcgttatcgcagctggacgacgagatcgtccacggcatggccatcggcgcggtgttcactgattacgccgggaagataaactgcctcgacttccaccgcaaggaggatctcctcgtcacctccagcgaggacgactccatacgactctacaacatcaccaccgcgacgttgctaaagactacatatcataggcaacatggtgctgaccgtgtctgttttactcatcatccaagttctatcttatgctcaccaagatacaatctagagtctgcagagtcactccattatttgtcattgtatgacaaccgttgcttaagatacttcaaagggcacaaagacagggttgtctcattatgtatgtcacccgtcaatgatagctttatgtcaggatcacttgatcacagtgtcagaatttgggatcttcgtgtaaatgcttgtcagggcatactaagacttcgaggcaggccttctgttgcatatgatcagcaaggacttgtttttgctgtagcaatggaaggtggagctattaagttatttgattcccgatcatatgataagggtccatttgatactttcttggttggcggagatacagctgaagtttctgacatcaaatttagcaatgacggcaagtctatgcttttgacaaccactaacaaccatatctatgttctggatgcatatggaggggataagaagtgtggctttagtttagaaccatctcccaatgtaacaaatgaagctgctttcactccagatggccagtatgtaatttcaggatctggtgatggaaccctgcacgcttggaacatcaatacagtacaagagattgcttgttggaacagtcatattggtcctatcacagctttgaagtgggcccctcgtcgagcaatgtttgcaactgcatccactgccctaactttctggattcccagccaatcgaattaggtttaggtgcctggaaaaaagggggaataaaaaagggggaatttcagatatgctaacttagcaaatatatcttgatctctggtgtaaaaggcaggcatcatgtatgaaatgtcacttgttttattacagtatgctgaaacaatgacatagttccaagcagatacttgttgtaatattgttaacgcg

SEQ ID NO: 22122 - protein, 322 aa, Panicum virgatum
  misc_feature: Ceres CLONE 1819866
  misc_feature (109)..(147): Pfam Name: WD40 Pfam Description: WD domain, G-beta repeat
  misc_feature (239)..(277): Pfam Name: WD40 Pfam Description: WD domain, G-beta repeat
  misc_feature: SWISSPROT Homolog: EC 2.7.11.7 [Myosin heavy-chain] kinase
MAAAAAAALSQLDDEIVHGMAIGAVFTDYAGKINCLDFHRKEDLLVTSSEDDSIRLYNITTATLLKTTYHRQHGADRVCFTHHPSSILCSPRYNLESAESLHYLSLYDNRCLRYFKGHKDRVVSLCMSPVNDSFMSGSLDHSVRIWDLRVNACQGILRLRGRPSVAYDQQGLVFAVAMEGGAIKLFDSRSYDKGPFDTFLVGGDTAEVSDIKFSNDGKSMLLTTTNNHIYVLDAYGGDKKCGFSLEPSPNVTNEAAFTPDGQYVISGSGDGTLHAWNINTVQEIACWNSHIGPITALKWAPRRAMFATASTALTFWIPSQSN

SEQ ID NO: 22123 - DNA, 2033 bp, Panicum virgatum
  misc_feature: Ceres CLONE 1819871
  misc_feature: Encodes the peptide sequence at SEQ ID NO. 22124
aaacggctccgctgctgctgctgctccgttcccatccccactcgcccaaatccaccaccccccacgtctctcctgcctcctcccaagtcccattccatccccgtgtagatttcaaatccgcgtcaggccaggggcagctcgaggcccggtctccgccgccgcccgcagctcccgatcccccgagatctgcccccgccgccgcccgagggaccgccgaccatggaggccatagaggagctgtccgagctctccgagtcgatgcgccaggcggcgtcgctcctcgccgacgacgacccctccgacgacgccgcgccgcgccgccccaccacgttcctcaacgccgtcgcccttggcaacgtcggagcaggcaagtcggccgtgctgaacagcctcatcggccacccggtcctgccgacaggggagaacggggcaacgcgggcgccgatagtgctggacctgcagagggagccgggtctcagcagcaagtccatcgtgctccagatcgacagcaagtcgcagcaggtgtccgcaagtgccctccggcattcactgcaggacagactcagcaagggggcatctggtggatcagggaggggccgcgctgatgagatttacctcaagctgcggacaagtacagctcccccattaaagctgattgatttacctgggatagaccagcgagctgttgatgattccatgatcaatgagtacgctgggcacaatgatgcaatactgcttgttgtgatacctgcaatgcaagctgctgatgtcgcatcatctcgagctctaaggctggccaaggatattgattcagatgggacgagaactgtgggtgttataagcaaagttgatcaagcaaatggagatgcaaaaactatagcatgtgttcaggccctactgtcaaacaaaggcccaaaaaaccttccagacattgaatgggttgctctaataggacaatcggttgcaattgcgtcagcgcaatcagttgggtctgaaaactcgctagaaacagcttggcgagctgaagctgaaagcctgaaaaacatcttaactagtgctcctcagaataagctgggcagacttgctttggttgacaccattgctaagcagatacgtaaaagaatgaaagtgcggcttcctaaccttttgagtggccttcagggtaaatctcagatggtgcaagatgaactagcaagactcggagagtctatggtacaaagtcccgaaggaaccagggcagttgctttggagctgtgccgggaatttgaagataaatttcttgctcatataacatctggtgagggatctggttggaaaattgttgcaagttttgaaggcaagtttccagatagaattaaacagctaccattggacaggcattttgatctcaacaatgtcaaaaggattgtcttggaagccgatggttatcaaccatatttgatatctccagagaaaggactgagatccttaataaaaatagtactggaaatggcaaaggagccatcacgactatgtgttgaagaggttcatcatgtattgttagatatagtcaatgcttccgcaaatgccacaccaggacttggaagatatcctccattcaagcgcgaggttgttgcaatagcatcgaatgcactcgagagcttcaaaaatgactccaagaagatggttgtagcacttgttgatatggagcgtgcctttgttcctcctcaacattttatccgcttagtacaaagaagaatggaaaggcagcgtcgtgaggatgagttaaaaaatcgatcttctaagaaaacacaagaggctgaacagtcaacgtcaaagagggcctccagtccacaaacagactctgagcaaggtggtggcagcttaaaatcaatgaaagacaaatctggtcagcaagataaagacgcaaaagaggtatcgaatttgcaggttgctggtcctgctggtgaaattactgcaggttacctcttaaagaaaagcgcaaaaactaatggctggagcaaaaggtggtttgttcttaatgagaagagtgg

SEQ ID NO: 22124 - protein, 604 aa, Panicum virgatum
  misc_feature: Ceres CLONE 1819871
  misc_feature (41)..(210): Pfam Name: Dynamin_N Pfam Description: Dynamin family
  misc_feature (254)..(516): Pfam Name: Dynamin_M Pfam Description: Dynamin central region
  misc_feature: SWISSPROT Homolog: EC 3.6.5.5 Dynamin GTPase
MEAIEELSELSESMRQAASLLADDDPSDDAAPRRPTTFLNAVALGNVGAGKSAVLNSLIGHPVLPTGENGATRAPIVLDLQREPGLSSKSIVLQIDSKSQQVSASALRHSLQDRLSKGASGGSGRGRADEIYLKLRTSTAPPLKLIDLPGIDQRAVDDSMINEYAGHNDAILLVVIPAMQAADVASSRALRLAKDIDSDGTRTVGVISKVDQANGDAKTIACVQALLSNKGPKNLPDIEWVALIGQSVAIASAQSVGSENSLETAWRAEAESLKNILTSAPQNKLGRLALVDTIAKQIRKRMKVRLPNLLSGLQGKSQMVQDELARLGESMVQSPEGTRAVALELCREFEDKFLAHITSGEGSGWKIVASFEGKFPDRIKQLPLDRHFDLNNVKRIVLEADGYQPYLISPEKGLRSLIKIVLEMAKEPSRLCVEEVHHVLLDIVNASANATPGLGRYPPFKREVVAIASNALESFKNDSKKMVVALVDMERAFVPPQHFIRLVQRRMERQRREDELKNRSSKKTQEAEQSTSKRASSPQTDSEQGGGSLKSMKDKSGQQDKDAKEVSNLQVAGPAGEITAGYLLKKSAKTNGWSKRWFVLNEKS

SEQ ID NO: 22125 - DNA, 672 bp, Panicum virgatum
  misc_feature: Ceres CLONE 1819893
  misc_feature: Encodes the peptide sequence at SEQ ID NO. 22126
actacactgccgagtgctcgcttcccggcacggctgcctccgatcccctgcgagtctgcgacctccacctgcagccaaggagcaagccgccccgccgccgcaggtcccccgcgccaagctcggcacccaggggctggaggtgtcgaagctggggttcgggtgcatggggctcacgggctcctacaacgccccgctcggcgacgaggccgtcgccgccgtcgtcgagcatgccttccgccgcggggtcaccttcttcgacacctccgacgcgtacgggccccacaccaacgagaccctcctgggcagggcgctggggcggctgccgcgggggcaggtgcaggtggccaccaagttcgggatcgggcagggcgcggccggcggcctgaccgtgtgcggcgagcctgagtacgtgcgcgcctgctgcgaggccagcctgcgccgcctcggcgtcagctacatcgacctctactaccagcaccgcgtcgacatcaccgtccccatcgaggacacggtcgctctctgcagccagtctgctccaattctgctttgccttcttcgatcaaattggtgctcttggcgtggttgctcatgtgagctcttgtgccgaaacctctgcagattggtgagctcaagaagctggtggaggaggggaaggtcaagtacatcgggctg

SEQ ID NO: 22126 - protein, 223 aa, Panicum virgatum
  misc_feature: Ceres CLONE 1819893
  misc_feature: SWISSPROT Homolog: EC 1.1.1.65 Pyridoxine 4-dehydrogenase
LHCRVLASRHGCLRSPASLRPPPAAKEQAAPPPQVPRAKLGTQGLEVSKLGFGCMGLTGSYNAPLGDEAVAAVVEHAFRRGVTFFDTSDAYGPHTNETLLGRALGRLPRGQVQVATKFGIGQGAAGGLTVCGEPEYVRACCEASLRRLGVSYIDLYYQHRVDITVPIEDTVALCSQSAPILLCLLRSNWCSWRGCSCELLCRNLCRLVSSRSWWRRGRSSTSG

SEQ ID NO: 22127 - DNA, 723 bp, Panicum virgatum
  misc_feature: Ceres CLONE 1819905
  misc_feature: Encodes the peptide sequence at SEQ ID NO. 22128
gacaggacagcgcgatcgtcatccgccacccaggctcaactgctcgcggcgaggcagcacccgtcccctctctcccgtcctcctgcgcgctctccctcctcgctgacgcgcgcacacgtccaagcctccaaggggaccaaccaatcgcgcgcggctctggttgggaaatgggtctcctggaccagctctgggacgagacggtggccggcccgcgcccggagtccggcctcggcaggctccgcaagtacgcctccttctccccctcgtcgtcgtcctcgctggcccccgccgcggcgcccgcggtgacgcgcagcttcaccgtcgggggccgcccggcgtcgctatccgtcgaccagtcgccgcacggggagtcgtacagctcctccgtcccgtcctccccggccagcgggccggactccccgttcgccgcaggttcgtctccagcctcacgcgccaccctttcttgggggctaaaaagcggttcttttttaggatcgatccctgcagtactgtgcaggattccacaattggggatcggatctccgatgaaatgggaggggaaaaacggatgacttttttttcttgccccttttgccgtttcattcatgccacagatctaccactggtatagttggtaaagcacagcaagaatctggtcatgcataacacactgaaaagtttctgtttttatttttcaatctatgaatagcaaactatttgtgg

SEQ ID NO: 22128 - protein, 134 aa, Panicum virgatum
  misc_feature: Ceres CLONE 1819905
  misc_feature (7)..(112): Pfam Name: Auxin_repressed Pfam Description: Dormancy/auxin associated protein
MGLLDQLWDETVAGPRPESGLGRLRKYASFSPSSSSSLAPAAAPAVTRSFTVGGRPASLSVDQSPHGESYSSSVPSSPASGPDSPFAAGSSPASRATLSWGLKSGSFLGSIPAVLCRIPQLGIGSPMKWEGKNG

SEQ ID NO: 22129 - DNA, 709 bp, Panicum virgatum
  misc_feature: Ceres CLONE 1819913
  misc_feature: Encodes the peptide sequence at SEQ ID NO. 22130
ggcccgctggaggttcgtgaacgccgacgagtgcctgatgacgaggatgcaggagatgtccctggactaccacttcacggtggagcaggaggtgagctcctccgtctgcgccttcttcggcttcaacggaaccgctggtgtgtggcgcatttccgcgattaatgaggccggagggtggaaggacaggaccacggtggaggacatggaccttgcaattcgggcgagcctcaagggctggaagtttgtctacctcggtgatgttcaggtgaaaagtgagctgccgagcaccttcaaggctttccggttccagcagcacaggtggtcctgcgggcccgcaaacctgttcaggaaaatgcttatggagattgtgacaaataagaaagtgacgatctggaagaagatccatgtcatctacaactttttcttgatacgcaagatcgtggcgcatattataacattttcattctactgccttgtcatcccagcaacaatcttcgtcccagaggtgcgcataccgaagtggggctgtgtctacattccctcggccatcacccttctcaattctgttggcactcccaggtcttttcacttgcttttcttctgggttgcctttgagaacgtaatgtccctgcacagaacaaaagccactttgataggattgttagaggctggcagggccaatgaatgggttgtgacagcgaagcttggc

SEQ ID NO: 22130 - protein, 235 aa, Panicum virgatum
  misc_feature: Ceres CLONE 1819913
  misc_feature: Useful for making plants with altered carbohydrate content
  misc_feature: Useful for making plants with altered cell wall content and/or composition
ARWRFVNADECLMTRMQEMSLDYHFTVEQEVSSSVCAFFGFNGTAGVWRISAINEAGGWKDRTTVEDMDLAIRASLKGWKFVYLGDVQVKSELPSTFKAFRFQQHRWSCGPANLFRKMLMEIVTNKKVTIWKKIHVIYNFFLIRKIVAHIITFSFYCLVIPATIFVPEVRIPKWGCVYIPSAITLLNSVGTPRSFHLLFFWVAFENVMSLHRTKATLIGLLEAGRANEWVVTAKL

SEQ ID NO: 22131 - DNA, 731 bp, Panicum virgatum
  misc_feature: Ceres CLONE 1819928
  misc_feature: Encodes the peptide sequence at SEQ ID NO. 22132
tggatcaactggtgaagtgatccttgggaagcagccacttgccccaccagccctcagtggtgatttggaaaccttcatgtcctgggtagatgaagttaggcaactgaaggttatggccaatgcggatactcctgaggatgcactggcagcaagaaacaatggggcgcaaggaattggactatgccggacagagcacatgttcttcgcttcggatgagaggatcaaggctgtgaggcagatgattatggctcctacacttgaactgaggcagaatgcactagatcgtctcttgccttatcagaggtctgattttgaaggcattttccgtgctatggatgggcttccggtgacaattcggctactggaccccccacttcatgagtttcttcctgaagggaatgttgaggacattgtgagtgaattatgcgctgaaactggagccgatcaggaggaagcccttgcaagaatagaaaaactatcagaagtaaatccaatgcttggtttccgtgggtgcaggcttggtatatcgtatcctgaattaacagaaatgcaagctcgtgccatctttgaagctgctatagcgatgaccaaccaaggtgttcaagtttttccagagataatggttcctcttgttggaacacctcaggaactggggaatcaagtgacccttatccgtcaaactgctaacaatgttttcactgctatgggtaaaaccattgagtacaaaattg

SEQ ID NO: 22132 - protein, 243 aa, Panicum virgatum
  misc_feature: Ceres CLONE 1819928
  misc_feature (16)..(241): Pfam Name: PEP-utilizers_C Pfam Description: PEP-utilising enzyme, TIM barrel domain
  misc_feature: SWISSPROT Homolog: EC 2.7.9.1 Pyruvate, phosphate dikinase
GSTGEVILGKQPLAPPALSGDLETFMSWVDEVRQLKVMANADTPEDALAARNNGAQGIGLCRTEHMFFASDERIKAVRQMIMAPTLELRQNALDRLLPYQRSDFEGIFRAMDGLPVTIRLLDPPLHEFLPEGNVEDIVSELCAETGADQEEALARIEKLSEVNPMLGFRGCRLGISYPELTEMQARAIFEAAIAMTNQGVQVFPEIMVPLVGTPQELGNQVTLIRQTANNVFTAMGKTIEYKI

SEQ ID NO: 22133 - DNA, 951 bp, Panicum virgatum
  misc_feature: Ceres CLONE 1819933
  misc_feature: Encodes the peptide sequence at SEQ ID NO. 22134
aaaaagggggacgaatccaatccaatccaagccggagcgcgagcggggagagagctcagggaaggcaaaccgttccggcccaatccagtcggatcggatcgccgagtcgcagcgagggaaggaacgcggcgaggtttaggcagggtttgtctcctcccgtgcgattcagctctcgccgtgggaggaggaggaggacgaggggtcgccggcggtggggcgcgccgatgcggaagttccaggactccgtcaaggccctcgaggccgacatcgagcacgccaatgcgctggcgtcggagttcctgcgggactacgacgggtccttcatccagatgcggatggcgtacagcgccgtcgcgcatttcctcgtgcagtggaccgactgcaagctcgccggcgcgctcggcctcctcaaggtcatgctctacaaggtgtacgcggacggtgcgtcggcgcttcccgactgggagagggaggccagcatcagggagttctacggcgtcatattcccgtcgctgctgcagctgccgagcgggatcaccgagctggacgacaggaagcagaggcggctctgcctgaagaaattcaggagcagggacgaggagctctcggaggtggacacggagagggagctcgagtgcggcatctgcctcgaggtcaaccgcaaggtcgtgctgcccgactgcgcccacacgctctgcatgcggtgcttcgaggattggaacgccaaatccaagtcctgcccgttctgccgcgcctgcctggaggaggtgaagccgggcagcctgtggatgtacaccgacgacagcgacgttgtggatatggataccttgacaagggagaacattaggcggctcttcatgtacataaataagctgccccttgtagtcctacatgtagttgacctcgacatttaccagtaccgtatcaagtaaatttaactgctccttgttc

SEQ ID NO: 22134 - protein, 235 aa, Panicum virgatum
  misc_feature: Ceres CLONE 1819933
  misc_feature: Useful for making plants with altered lignin content
MRKFQDSVKALEADIEHANALASEFLRDYDGSFIQMRMAYSAVAHFLVQWTDCKLAGALGLLKVMLYKVYADGASALPDWEREASIREFYGVIFPSLLQLPSGITELDDRKQRRLCLKKFRSRDEELSEVDTERELECGICLEVNRKVVLPDCAHTLCMRCFEDWNAKSKSCPFCRACLEEVKPGSLWMYTDDSDVVDMDTLTRENIRRLFMYINKLPLVVLHVVDLDIYQYRIK

SEQ ID NO: 22135 - DNA, 1313 bp, Panicum virgatum
  misc_feature: Ceres CLONE 1819939
  misc_feature: Encodes the peptide sequence at SEQ ID NO. 22136
caagctcggtggatctagagcagcacaatgaccaccaccggcgccgggaaggacgacgtcgagggcctgaagcaggcaatggcggccggcgcgggcatcgccgacctcatcccttcgctgcccctcgagacgaggtgccagccgttcctcctccgtcagctcggcggcttctggctgcccgagatgttccttcccggggtcgccgccgcgcacgcgcgcttcaagcccaggcccgacgacgtcttcctcgccagcttccccaagtccggcacgacctggctcaaggcactcaccttcgctacgctcaaccgggcccaccacccgccgtccgaccctgaccacccactccggctccaaagcccccacgactgcgtcagcttcttcgagcttcccttggccctcgctgcggccagcagcaacggcggcggcggaggggacagggaggaggaggaagaagcgttcgcggcgctcccttcgccgcgcgtgctcgccacccacctgccctaccacctcctgccggagcgcatcaccgcggagagctccggctgccgcgtcgtctacgtctgccgggactccaaggacgcgttcgtatccgcgtgggtgttcaccaagaagacagcggccgcaaaggccgccgccggcgaggccccaccgccgccgccgtacccgctcgagtcagcgttcgagctgttctgcgacggccgcagcgtcggcggcccgcagtggctgcacgtgctcgggtactgggaggcgagcctgcggcggccggacagggtgctcttccttcagtacgaggacatgctccgggacccggtgagcagcgtgaggaagcttgccgagttcttgcgctgcccgttctccggcgaggaggaggcggcgggcgcggtgggcgccgtcgtggagctctgcagcctgggcagcctccaggggtccaaggggaaccggagcggcaagacgaaggatatgagcatcgacaacgggctgttcttccggaagggcgaggcgggggactggcgcaaccacctgtcgccggagatggcggcgcggctggaccagatcgtcggcgaggcgctgcaagggtcggggctcacgttgggtggcgtcgccggcgccgcgcgcgacgacgacgacgactctgcgtgagccgccggcacgtttggcgacatgcagatgcaaatgcaggtgacgctggaactggtattcactcgcgtgattcctgagcgttttgctgagtaaatgggggtgctatgcgcacctccaaggctcagaaccagaataagtttactcaacatgcatgtatgtgcgagcgactt

SEQ ID NO: 22136 - protein, 371 aa, Panicum virgatum
  misc_feature: Ceres CLONE 1819939
  misc_feature (69)..(353): Pfam Name: Sulfotransfer_1 Pfam Description: Sulfotransferase domain
  misc_feature: SWISSPROT Homolog: EC 2.8.2.3 Amine sulfotransferase
MTTTGAGKDDVEGLKQAMAAGAGIADLIPSLPLETRCQPFLLRQLGGFWLPEMFLPGVAAAHARFKPRPDDVFLASFPKSGTTWLKALTFATLNRAHHPPSDPDHPLRLQSPHDCVSFFELPLALAAASSNGGGGGDREEEEEAFAALPSPRVLATHLPYHLLPERITAESSGCRVVYVCRDSKDAFVSAWVFTKKTAAAKAAAGEAPPPPPYPLESAFELFCDGRSVGGPQWLHVLGYWEASLRRPDRVLFLQYEDMLRDPVSSVRKLAEFLRCPFSGEEEAAGAVGAVVELCSLGSLQGSKGNRSGKTKDMSIDNGLFFRKGEAGDWRNHLSPEMAARLDQIVGEALQGSGLTLGGVAGAARDDDDDSA

SEQ ID NO: 22137 - DNA, 701 bp, Panicum virgatum
  misc_feature: Ceres CLONE 1819940
  misc_feature: Encodes the peptide sequence at SEQ ID NO. 22138
gcctcacttcgccgcttcagttgcaattgccaagtcgcaacaatctacggcacctaccgcgcgcagcgtcaaccagcccgagccccccaccccccaagcaccgagcggcgcgatggcgacggagctgacggcggcgctgctgcgggcgtacgacggcaccgacccctccaagccgatctacgtctccgtccgcggcaaggtctacgacgtcacctcgggccgcagcttctacggccctggcggcgcctacgccatcttcgccggccgcgaggccagccgcgccctcgccaagatgtccaaggaagaggccgacctctccggcctcaccgagaaggagctcggcgtcctcgctgactgggagaccaagttccaggccaagtaccccgtcgtcgcccgcctcgtcgacgcctgaactcggaatctgaagtcaaaaccccccaatcagcggcgaccaccaccacctcggcaagtatcagtgtaactctgttttggtgtattgttcttagatgtatcttcttgtttgctttgtatgtttgctcgatgattgctccgagtagaaggatcgtcgtttgaagattgaagatcgagatttccaggtgagcaaaagatgaagagcagtaagagttgcttatcattggataaaggcaagtgaccctaaccatacttctatctatgctttatttacaagagtactatgattt

SEQ ID NO: 22138 - protein, 99 aa, Panicum virgatum
  misc_feature: Ceres CLONE 1819940
  misc_feature (4)..(97): Pfam Name: Cyt-b5 Pfam Description: Cytochrome b5-like Heme/Steroid binding domain
  misc_feature: Useful for making plants with modulated nitrogen use efficiency
MATELTAALLRAYDGTDPSKPIYVSVRGKVYDVTSGRSFYGPGGAYAIFAGREASRALAKMSKEEADLSGLTEKELGVLADWETKFQAKYPVVARLVDA

SEQ ID NO: 22139 - DNA, 1575 bp, Panicum virgatum
  misc_feature: Ceres CLONE 1819954
  misc_feature: Encodes the peptide sequence at SEQ ID NO. 22140
atacctgagcctgaagtttctgaacctttccctgcaacctcatgccctcccattaatccttcaaggctccctcccactcccactgaaagagccaccaattaaccctgtgctgacttgtcccagtgacgtgaacccatcgccggcgatcggccaagatcggcggcgagcagggtgccgggtcatcgattcgatcgtctccgagttcgcagccttggagaagggcagcatgcaagaggggcacggcgagaccgtcaactacagggtgttcgccggcacgtggaacgtcggcggcaaggcgccgccggatgatcttgacctggaggattggctggacaccaaggccggctcccacgacatctacgttctcgggttccaggagatggtgccgctgaatgtgaggagcgtgctcggccccaagcagagatcggcggccatgaattggcagcggcttatcggggacgcactgaacggcgggaggaggagcgtgatggatggagaagacgcggcgatggatcacggacagggcgcgttcaggtgcgtcatgagcaagcagatggtcggcatcttcgtctccgtgtggacgaggagcggcctccgccggcacgtccgccaccccggcgtctccgccgtcggcgccggcgtcctcggccggctcggcaacaagggcgcggtgtcggtccggttcttgctgcacggcacgagcttctgcttcgtctgctgccacctggcctccggcggcggcgacggcgacgcgctacgccggaacgccgacgcggcgtacatcctcgcgaggacgagcttcctcaactccggcggcgcgccggcgccggcaccggaggagctgcccaggaagattcttgaccatgatcgggtggtgttgctcggcgacctcaactaccggatcgccatggacgacgccgaggcgcggcagctggtgagggccaggaaatggagcatgctgctggagaacgacgagctgctgctcgagctcgccgagggccggcggttcgacggctggcgcgagggccacgtcaccttcgccccgacctacaagtaccaccgcaactccgaccagttctgctggtgcgccgacggcggcgccgccgccggccgcggcaagcagcaccgcgcgccggcatggtgcgaccggatcctttggcgagggaaggggatgaggcagatccggtacgagtggtgcggtggctacaggctctccgatcaccggccggtgagggccgtgttccacgctgtgtgtgaggtggtggaaaccaaagcatgttaactaagctgcaggcttctgtcctctgaaacagttaacaaacgagatgctgtaaattttacagaaattcgacaacagcttggtttcctgcatccgttttcaaaaatagggcctcgatgatttacctgaggatgaaaggctcttgttttcgcctttgtatctgcaggtgaaaattcatgtaaatttcctgttcttttcccctgctgaagaaatggaatccggggatcattgtccagtcgattcatgtaccattaggatgcaaccttttatggattgaatcgatgatattttttctt

SEQ ID NO: 22140 - protein, 351 aa, Panicum virgatum
  misc_feature: Ceres CLONE 1819954
  misc_feature (13)..(339): Pfam Name: Exo_endo_phos Pfam Description: Endonuclease/Exonuclease/phosphatase family
  misc_feature: SWISSPROT Homolog: EC 3.1.3.56 Inositol-polyphosphate 5-phosphatase
MQEGHGETVNYRVFAGTWNVGGKAPPDDLDLEDWLDTKAGSHDIYVLGFQEMVPLNVRSVLGPKQRSAAMNWQRLIGDALNGGRRSVMDGEDAAMDHGQGAFRCVMSKQMVGIFVSVWTRSGLRRHVRHPGVSAVGAGVLGRLGNKGAVSVRFLLHGTSFCFVCCHLASGGGDGDALRRNADAAYILARTSFLNSGGAPAPAPEELPRKILDHDRVVLLGDLNYRIAMDDAEARQLVRARKWSMLLENDELLLELAEGRRFDGWREGHVTFAPTYKYHRNSDQFCWCADGGAAAGRGKQHRAPAWCDRILWRGKGMRQIRYEWCGGYRLSDHRPVRAVFHAVCEVVETKAC

SEQ ID NO: 22141 - DNA, 1316 bp, Panicum virgatum
  misc_feature: Ceres CLONE 1819964
  misc_feature: Encodes the peptide sequence at SEQ ID NO. 22142
gcgtgctaggagggggccgagaccatccgccgcggcggtcgcttcctctccccgccggctcctccacccgccgcctccaagtccactggttccgccacaccgccgctcctctctctatctgcggtttcttcgtttgctgggccacacttattgcaccaagcatatcaacttatcttccacaggcatggaggggtgcatttgtgctgtcttttgtatggttccttcacaggtggaaaaccaacttcattgctaaagctatgaccaacccagatgccccaagtgtggaccgcgacagaatatcagcatttgataaggtttcttcattgggactgattggactaggagtaatgggtcttgctgaagcttgtggtgtagctgttcagtcaatattaactgttggtggtgtgggaggtgttgctactgcttttgctgctagagatgtccttggtaatattctcagtgggttctccttgcaattttctaagccattctcagttaacgactacataaaggcggggccaatagaaggcaaggtgatcgaaataggactcacttctacttcattgatcaatccagaaaagctccctgtcatagtaccaaactctttgttctccagtcagatgatagtaaacagatcacgagctgattggcgagctagtgtgacaaagattcctataagaattgaggatattgagaaggttccgtctgtatcagaggagataagggttatgttaaggtccaatccaaatgtgtccaatagtgatgttccttattgctatctctcaagattggaaagttcatatggagagctcaccattggatgcaacctaaaaaacatgagaaaagatgagtggctatctgctgaacaagatattcttttgggagctgctaggattatcaagtcgcatggcattgaacttggaagcactatgcagtgctgttaattcactcctctgggacttaaagttgggtatattccgttagcctacagaactgtggaactgcgtactgacctacttggcggtggcgcctgaagttttgcttacggggcattggcaaaaacgtccgtgtgctatgtctttggaccatctgacacctcttatcaccgatagatattttgttactatcgttatctctggaacctaggtatggtaattgacccgtttctgtgtggtgtgggtgttgtccactgggcgtgggtgagcggattgttggctccattttggtgaaaatgtccggtttcaacctcgaaacgtacgggtttgtcaagctgtaacctgacaatcatctcgaatgaatagcgttcgacattgtcc

SEQ ID NO: 22142 - protein, 313 aa, Panicum virgatum
  misc_feature: Ceres CLONE 1819964
  misc_feature (103)..(307): Pfam Name: MS_channel Pfam Description: Mechanosensitive ion channel
VLGGGRDHPPRRSLPLPAGSSTRRLQVHWFRHTAAPLSICGFFVCWATLIAPSISTYLPQAWRGAFVLSFVWFLHRWKTNFIAKAMTNPDAPSVDRDRISAFDKVSSLGLIGLGVMGLAEACGVAVQSILTVGGVGGVATAFAARDVLGNILSGFSLQFSKPFSVNDYIKAGPIEGKVIEIGLTSTSLINPEKLPVIVPNSLFSSQMIVNRSRADWRASVTKIPIRIEDIEKVPSVSEEIRVMLRSNPNVSNSDVPYCYLSRLESSYGELTIGCNLKNMRKDEWLSAEQDILLGAARIIKSHGIELGSTMQCC

SEQ ID NO: 22143 - DNA, 640 bp, Panicum virgatum
  misc_feature: Ceres CLONE 1819967
  misc_feature: Encodes the peptide sequence at SEQ ID NO. 22144
aaagaccccctctccattgaggcgatccgtgatcgagttcctcttgtgttggtgtccacagaatcgcagtgtagcgtgagagctagagaggtttcgatatggcttccaggatggcactcctgtgccttcttggcttgctggtagcgtcacctgccattgctgactccggcatctactaccggcttgctcttatgtggcccggagcgtactgcccgcagaccgacgccgggtgctgcaagccgaccaccggcgtgtccccggcgagggacttctacctctccggcttcaccgtctacaacccgacgaccgaccctccggtgaccggctgcaacacctccgctcctttcgaccctaacaagattaccggcgtccacggcctgtacctctactggagcagcatcaagtgccccagcaacgacggccggatcaactggaacaacgcctgcaagaactccggcgcctgctccggcctccaggagaaagactacttcgaggccgccctctccttcctcagccggatctacccgctggtccgcctcaaggcccagcacatcgagccggacttcgggctgtacgcgcgtgaatgcgatcaggaatgtgttcaaggccggcatcgacgcggcgtcggtggtccagtgca

SEQ ID NO: 22144 - protein, 180 aa, Panicum virgatum
  misc_feature: Ceres CLONE 1819967
  misc_feature: SWISSPROT Homolog: EC 3.1.27.1 Ribonuclease T(2)
MASRMALLCLLGLLVASPAIADSGIYYRLALMWPGAYCPQTDAGCCKPTTGVSPARDFYLSGFTVYNPTTDPPVTGCNTSAPFDPNKITGVHGLYLYWSSIKCPSNDGRINWNNACKNSGACSGLQEKDYFEAALSFLSRIYPLVRLKAQHIEPDFGLYARECDQECVQGRHRRGVGGPV

SEQ ID NO: 22145 - DNA, 700 bp, Panicum virgatum
  misc_feature: Ceres CLONE 1819970
  misc_feature: Encodes the peptide sequence at SEQ ID NO. 22146
gattccacccatcgtctccttcaccactcttgcagtctcgctcggagataagaagaggctctaccaaaccaaagcccccctccgcccaaaaacccctctcgagctcctacccccatccgtggagaccgccaccgcccccgccccctcttcctcctctgtgaccgcccctctcctccgccagaaccccaacacccaccccccccccatatccctgcctctcctcgagaacaagaggtgtttttgcgccgagaccgccgccgtctcggggggcgtggggggagagggggctgcccagcggtgcgagatttggtctatcggggaagatttgatggtgcagatgtccccctacttcccgggggagtacgcggcggggcaagaacgtgggccgtcccctgtggagatggagcggctccagagcgtcctcacccatcttttccaacataagattatcgggtgcggtggccgtgtagaagaagatatggataatatcattggtgcacatgtgctctatcgtgaccccctccacccctctagagatatcattatgtatgtgaattcaccaagagggtcagagacatctggtgtgtatatatgagatactgtgaagcatatcgcgtctgatgtctcctgtgtgtgtatcatattatgtgcgagtatgagatcttctctacttagcgctgagactaggagagagctatac

SEQ ID NO: 22146 - protein, 197 aa, Panicum virgatum
  misc_feature: Ceres CLONE 1819970
  misc_feature: SWISSPROT Homolog: EC 3.4.21.92 Endopeptidase Clp
IPPIVSFTTLAVSLGDKKRLYQTKAPLRPKTPLELLPPSVETATAPAPSSSSVTAPLLRQNPNTHPPPISLPLLENKRCFCAETAAVSGGVGGEGAAQRCEIWSIGEDLMVQMSPYFPGEYAAGQERGPSPVEMERLQSVLTHLFQHKIIGCGGRVEEDMDNIIGAHVLYRDPLHPSRDIIMYVNSPRGSETSGVYI

SEQ ID NO: 22147 - DNA, 713 bp, Panicum virgatum
  misc_feature: Ceres CLONE 1819979
  misc_feature: Encodes the peptide sequence at SEQ ID NO. 22148
atccaccatccatcccgatccgttctgctcccctccgtgtcaacagcgacgccgcgaaccctccctttgcctccgccttctgctttccacttccacgtccccgtctcgatcggcccgcccgcccgcccgctccacgcgccgccgcgcggaatccgcagacccgccctcgccctgccctcccccacaccgcctcgccctctcccctgacccgccgtccttcccctccccagttccccagccagatcggagctgcggggtcgtccacgcgggtgctgcgtttcgtcagttttctgtaagcatcatcggtacatcaagtttgttgttattctagaagaggaaatatgcaggcatcaagagctaggcttttcaaggagtacaaggaggtgcagcgagagaaatcagctgaccctgatattcagttgatatgtgatgattcaaacatattcaagtggactgctctcatcaagggaccctcggagactccttatgaaggtggtatcttccagcttgcctttgctattccagagcaataccctctgctacctccccaagttcgcttcctgactaatattttccatccaaatgttcatttcaagactggtgaaatttgcttggatatcttgaagaatgcatggagccctgcatggacactccaatcagtttgtagagccataattgcactgatggctccatccgagccagacagcccactt

SEQ ID NO: 22148 - protein, 123 aa, Panicum virgatum
  misc_feature: Ceres CLONE 1819979
  misc_feature (7)..(123): Pfam Name: UQ_con Pfam Description: Ubiquitin-conjugating enzyme
  misc_feature: SWISSPROT Homolog: EC 6.3.2.19 Ubiquitin--protein ligase
MQASRARLFKEYKEVQREKSADPDIQLICDDSNIFKWTALIKGPSETPYEGGIFQLAFAIPEQYPLLPPQVRFLTNIFHPNVHFKTGEICLDILKNAWSPAWTLQSVCRAIIALMAPSEPDSP

SEQ ID NO: 22149 - DNA, 1211 bp, Panicum virgatum
  misc_feature: Ceres CLONE 1819982
  misc_feature: Encodes the peptide sequence at SEQ ID NO. 22150
aaaagagaggggaacaggagaagcaaagcacaagcacacagacggccgccgcagccgcagcaacgacacacacaaccttccaactccgtcgagcgacaccgcccgccgcagatccgtgctcgccactagggttcaggcgagatggacgtggtgaaggcggcgcagctgtcggggcggacgctggagaaggtggtggtgcaccccctggtgctgctcagcatcgtcgaccactacaaccgcgtcgcccgcgacacccgcaaacgcgtcgtcggcgtcctcctcgggacctcctctcgcggctccgtcgacgtcaccaactcctacgccgtgccgttcgaggaggatgacaaggatcctaggatctggttccttgaccacaattaccatgagtcgatgttctccatgttcaagaggattaacgccaaggagcatgttgttggttggtacagcactggtccaaaattgagggagaacgacttggatgtccatgcgttgttcaacagttatgttcctaatcctgtcctggtgattatcgatgtgcaacccaaggagttggggatacccactaaagcgtactacgctgtggaagaggttaaagagaatgctactcagaaaagtcagaaggtgtttgttcatgtttcttcagaaattgctgctcatgaagttgaggaaattggagttgagcaccttctaagggatgtaaaggacacgacaataagcacacttgcaacagaggtcactagcaagcttgcagccttgaaaggactggatgcaaggctcagggagatccgaagctatttggacctagtaattgaagggaagctcccactgaatcatgagattctgtatcatttgcaggatgtatttaatttgcttccaaatctgaacgtaaatgagctgatcaaagcctttgcagtgaaaacaaatgacatgatgttggtgatatacctgtcttccctgatcaggagtgtcattgcactccacaacttgatcaacaacaagatgctaaacaaggagcacgagaaggctgaggattcaaaaccaaccgctattccgactgctgctgggagctaaatggccaagaaaagggatgaaacgtgtggcatcttagcacggttgcgcttgaaccaattgtcttgaccttgaatggacattttgatgtttatttcatgtatgatgaggtcaatggcaagagaaaccagttacattgc

SEQ ID NO: 22150 - protein, 310 aa, Panicum virgatum
  misc_feature: Ceres CLONE 1819982
  misc_feature (12)..(125): Pfam Name: Mov34 Pfam Description: Mov34/MPN/PAD-1 family
MDVVKAAQLSGRTLEKVVVHPLVLLSIVDHYNRVARDTRKRVVGVLLGTSSRGSVDVTNSYAVPFEEDDKDPRIWFLDHNYHESMFSMFKRINAKEHVVGWYSTGPKLRENDLDVHALFNSYVPNPVLVIIDVQPKELGIPTKAYYAVEEVKENATQKSQKVFVHVSSEIAAHEVEEIGVEHLLRDVKDTTISTLATEVTSKLAALKGLDARLREIRSYLDLVIEGKLPLNHEILYHLQDVFNLLPNLNVNELIKAFAVKTNDMMLVIYLSSLIRSVIALHNLINNKMLNKEHEKAEDSKPTAIPTAAGS

SEQ ID NO: 22151 - DNA, 1760 bp, Panicum virgatum
  misc_feature: Ceres CLONE 1819985
  misc_feature: Encodes the peptide sequence at SEQ ID NO. 22152
gtgccacgccgctgccgtcaacgccgccgcgacgccatggggaagcgatccggcggcaggaagctgccgttcttcaccagatcctcttcagcgtcgtcctcctccaagcggaatcgctccgcgcgccgcctccctaaccttcccaagcaggacaacgcggcgagggctcttctcgcatcccccgccgacgcctcaccttccgcgaccccggccgccgccgcgtcgaggccgaccgcgcagccaccccctcccatctccgtttctgcgggcgccggcggtgtcgtgtcgggtaaggtcggcaagaagaagggcggcgcgcgtctgtggatgcggctggaccggtggggtacctccgagatcgtcgagctcgacaaggcctccatcatccggcgcgccggtctgcccccgcgggacctccgcatcctcggccctgtcttctcccactcctcgagcatcctcgctagggagaaagcgatggtcatcaacctcgaattcatcagggcgatcgttactgccgaggaggtcctcctgctggaccctctcgcgcacgaggtgctccctttcgttgaccaattgaggcaacatctccctctgaagagcctggtgggtgggaatggtgaatgtgccccggatggcaacggggaaaagcaggacggctcacctggaggtcagctgccctgtcttaatgaggcgactggggcagagcacgagcttccattcgagttccaggtgctagaggttgcgctcgagattgtgtgctcgtcgctggacttaagcgtggccgaccttgagaggcatgctactccggtgcttgacgagctgaccaagaatgtgagcacgaggaaccttgagagagtgcggagcctcaagagtcttcttacccgtttacttgcccgtgtgcagaaggtgagggatgaaatagaacatcttctagatgataatgaagacatggaacatctgtatctaacaaggaagcaagtacaaaaccagcaggttgagactataatgtcatctgctacttccaacagcattgttcccgccggaacaggtgtggccaggctgaactctagctttcggcgtagtgtgagcattgctaccagcatgcatttggataatgatgtggaagatctagagatgttgcttgaggcctacttcatgcagctggatggaattcgcaacagaattttatcggttcgggaatatattgatgacacagaagattatgtcaacattcaactcgacaaccagcggaatgaactcattcagctccagcttacactgaccattgcatcctttgggatagctaccaacacatacatagcaggggctttcgcaatgaacatcccgtccagtctgtatagcactgacggcagcctcttttggccatttgtcgggggcacctcatcgggctgcttcgtaatcttcatcgtcttgttagggtacgcctggtggaagaagttgctgggtccttgaacatgaagtgaaggaaagccatgggagagagtcttgtcatggttgcagaaaggaaggaggcacttctaggttagaggagaacaacggtatagcaagaataccgtacataacatctcatgagtagtcaataagatgagcgcactgtaatttctcaccggcacaaactacaagatgagatgatgtaataatcagtatgctgccatcttaatattagtggatgtagcacttgctggcgattaaaaaaatgttgcgatgaaattatagatccgcaaatgcttgttttatgc

SEQ ID NO: 22152 - protein, 478 aa, Panicum virgatum
  misc_feature: Ceres CLONE 1819985
  misc_feature (92)..(476): Pfam Name: CorA Pfam Description: CorA-like Mg2+ transporter protein
MGKRSGGRKLPFFTRSSSASSSSKRNRSARRLPNLPKQDNAARALLASPADASPSATPAAAASRPTAQPPPPISVSAGAGGVVSGKVGKKKGGARLWMRLDRWGTSEIVELDKASIIRRAGLPPRDLRILGPVFSHSSSILAREKAMVINLEFIRAIVTAEEVLLLDPLAHEVLPFVDQLRQHLPLKSLVGGNGECAPDGNGEKQDGSPGGQLPCLNEATGAEHELPFEFQVLEVALEIVCSSLDLSVADLERHATPVLDELTKNVSTRNLERVRSLKSLLTRLLARVQKVRDEIEHLLDDNEDMEHLYLTRKQVQNQQVETIMSSATSNSIVPAGTGVARLNSSFRRSVSIATSMHLDNDVEDLEMLLEAYFMQLDGIRNRILSVREYIDDTEDYVNIQLDNQRNELIQLQLTLTIASFGIATNTYIAGAFAMNIPSSLYSTDGSLFWPFVGGTSSGCFVIFIVLLGYAWWKKLLGP

SEQ ID NO: 22153 - DNA, 422 bp, Panicum virgatum
  misc_feature: Ceres CLONE 1820004
  misc_feature: Encodes the peptide sequence at SEQ ID NO. 22154
acggattcgattcgcttcggcttcgattgggattttgtgtcctggtttgatcggtgccgcgcttgaagctgcttggtttgggattccactcggggatttcaggggaacaaaacagtggagaccgccgggaaggtgatcaactgcagagccgcggatggcatgttcacgccgggaagccgctgtccatccaggaggtggacgtggcccccccgctgggcatggaggtgcgcgtcaacatcctctacacctcgctctgccgcgaagacgtctacttctgggaggccaatgggcacactcccgtgttccctcccatattcggtcatgatgctggacgtatcatacacagtgttggacatggtgtgactgacctggcccctggtgaccatgtccttcctgtgttcactggggagtgcaaggactgt

SEQ ID NO: 22154 - protein, 67 aa, Panicum virgatum
  misc_feature: Ceres CLONE 1820004
  misc_feature: SWISSPROT Homolog: EC 1.1.1.1 Alcohol dehydrogenase
MEVRVNILYTSLCREDVYFWEANGHTPVFPPIFGHDAGRIIHSVGHGVTDLAPGDHVLPVFTGECKD

SEQ ID NO: 22155 - DNA, 588 bp, Panicum virgatum
  misc_feature: Ceres CLONE 1820012
  misc_feature: Encodes the peptide sequence at SEQ ID NO. 22156
gacgccggcggcgctcgtccattggttccgtcggccgccgctcccgccggggccggggtcgggggcgcctccgtcgcggacgacccccgggacgcgtgggtggtgcgggagctcctgcgctcgatggggctcggccagggcgagtacgagccccgcgtcgtgcaccagttcctggacctggcctaccgctacgtcggcgacgtgctcggggacgcccacgtctacgccgaccacgccgggaaggcccagatcgacgccaacaacatccgcctcgccatccaggccaaagtcaatttctccttctcgcagccgccgccgcgcgaggttctccttgagctggcacgcaaccggaacataatcccgctgcctaagtcgatcgctcctcctggttcaattcccctgccaccagagcatgacacactgttggctcagaattaccaactcctgccaccattgaagccgccatctcaagttgaggagacagaggatgacaacgaacaaaccaaccctagtccaaccccacaccctggaaattccaatccaaactactcccagggatcagaggggtaatgagcaacaacacacttc

SEQ ID NO: 22156 - protein, 189 aa, Panicum virgatum
  misc_feature: Ceres CLONE 1820012
  misc_feature (19)..(149): Pfam Name: TFIID-31kDa Pfam Description: Transcription initiation factor IID, 31kD subunit
DAGGARPLVPSAAAPAGAGVGGASVADDPRDAWVVRELLRSMGLGQGEYEPRVVHQFLDLAYRYVGDVLGDAHVYADHAGKAQIDANNIRLAIQAKVNFSFSQPPPREVLLELARNRNIIPLPKSIAPPGSIPLPPEHDTLLAQNYQLLPPLKPPSQVEETEDDNEQTNPSPTPHPGNSNPNYSQGSEG

SEQ ID NO: 22157 - DNA, 1071 bp, Panicum virgatum
  misc_feature: Ceres CLONE 1820024
  misc_feature: Encodes the peptide sequence at SEQ ID NO. 22158
agatgcatccatccggtcagtccagctccagcagaaacagacaccaacagctgattggggaccatgtggacggagagcccgctggtccgcgacgccggcgccgccgtgctcaccggattcgccgtggcagtcgtgctccgcttctgggaggaggtcgccaaccgtgcgctgctggaacagaaactttgcaggaaactggtgcacataactgttggattagtgtatctcctcatgtggcctttgttcagttcagatgatgtctttgccccatttcttgctccgcttattatcgaaatcaacatcataaaggtgacagtaattgggctcggtgttgttaaagatgagggcgtggttaactcgatgaccaggcatggggactacagggaactactcaagggccccctgtattatgcgtgtgctataactctgacaacaatagtcttctggaggacatcccccatctcaaccgccgtgatctgcaatttgtgtgcgggcgatggtgttgctgacatagctgggagacgattcggacaagtgaagctccctcacaaccctgggaaatcgtatgctggcagcattgcgatgttcatggccggtttctacgcatcagtgctgtacatgtgctacttgaacattttcggatttgttgacaagagctgggctatggttggtgcctttggtgtcatatcccttgctgcagcagttgtggagtcgctgcccatcagcacacgccttgacgacaacctgacggttcctcttgtatctgtgctcgtcggtgccctcgttttctagtacttcattggagccaaatacctgtgctgcatgagcagcgaggacagcagcggcatcatttcagcaatctctgagatggtgtttgcaggcagcagcagcagcaagtagccgcagcccagaagcagagtgcatagagagaggagtgctgcttgattgaatccccctgatgcgtgtcatgtcggtatctgattcttcgtgacagtggtctttgtgtaagcaaacattcttgtggcttgaaaatgattaataagaaagaagaaaaagaaggaaattgaatag

SEQ ID NO: 22158 - protein, 242 aa, Panicum virgatum
  misc_feature: Ceres CLONE 1820024
  misc_feature (41)..(240): Pfam Name: CTP_transf_1 Pfam Description: Cytidylyltransferase family
  misc_feature: Useful for making plants with modulated nitrogen use efficiency
MWTESPLVRDAGAAVLTGFAVAVVLRFWEEVANRALLEQKLCRKLVHITVGLVYLLMWPLFSSDDVFAPFLAPLIIEINIIKVTVIGLGVVKDEGVVNSMTRHGDYRELLKGPLYYACAITLTTIVFWRTSPISTAVICNLCAGDGVADIAGRRFGQVKLPHNPGKSYAGSIAMFMAGFYASVLYMCYLNIFGFVDKSWAMVGAFGVISLAAAVVESLPISTRLDDNLTVPLVSVLVGALVF

SEQ ID NO: 22159 - DNA, 1219 bp, Panicum virgatum
  misc_feature: Ceres CLONE 1820044
  misc_feature: Encodes the peptide sequence at SEQ ID NO. 22160
gtgacatcccgccgcatagcatacccaccccctacagcgcgcggccggcccgacttcccacccccttcccgccgttaaacacctccccgtcaccgccgtccgccgtcgccggcgaagatgatgtccggcggtgggtactcctccctcgacgaccccaaggcctcaggatccgtcccggcggcgacggggccagatccgccggccatcaggttcgcggaatccaacctccagaccttcccgccgcccgacgccaggggcaagatctccggcgcctaccgcctgcccaccgacgccgacgataccttctcgtccaaggctggaggaggcggtgccggtggcggcggcagaggaggcggcgccggatcggacgacgccgcgcagggcggatggttccggatattctccgtggcggcgtacaagccctacttcgatgtcgacacctccgacgtcgtcgagaggatctgggagtccgtcttccccttccgcggcacattcaccgagaagacctccgagaaccccgatctgtatgggccgttctggacatgcaccaccctaattttcgttgctgcatctattgccacctttgtcacctacctatcacacaaatggcacaagaaggagtggaattatgacattaatttggttacctggtctgctggcttattctatggctatgtgacgtttgttccccttctgttatatgttattcttaagtacttctcagcacctgctggtcttgtgcaattgtggtgcctctatggatactccctgttcatcttcattccagcatcgcttctgtcaattgtgccaatagaaatattcagatgggtgattgctggtgtcgctggattcatgtctgctacctttgttgctgtaaatctccgtgcccacattgtaaattctggcgagcgatggttcttgatcgtcgcagggatattcttgttgcagttggggcttgctgtcttactgaaactctatttcttcacaataactgtatagggttattacatcaatgcttgtattagtcaggaatacacacaaattttctatgtcgaatcgcttccacattcattgaacattgatgtaatttgccaagtatacatctttcttaaacgaaacttgggcagcttctgaaatcgtattagagcagctaaacatgtactcataggaggtcaagagtctgttctggagcctattctgtgttccactgcatggtatg

SEQ ID NO: 22160 - protein, 293 aa, Panicum virgatum
  misc_feature: Ceres CLONE 1820044
  misc_feature (104)..(269): Pfam Name: Yip1 Pfam Description: Yip1 domain
MMSGGGYSSLDDPKASGSVPAATGPDPPAIRFAESNLQTFPPPDARGKISGAYRLPTDADDTFSSKAGGGGAGGGGRGGGAGSDDAAQGGWFRIFSVAAYKPYFDVDTSDVVERIWESVFPFRGTFTEKTSENPDLYGPFWTCTTLIFVAASIATFVTYLSHKWHKKEWNYDINLVTWSAGLFYGYVTFVPLLLYVILKYFSAPAGLVQLWCLYGYSLFIFIPASLLSIVPIEIFRWVIAGVAGFMSATFVAVNLRAHIVNSGERWFLIVAGIFLLQLGLAVLLKLYFFTITV

SEQ ID NO: 22161 - DNA, 1186 bp, Panicum virgatum
  misc_feature: Ceres CLONE 1820047
  misc_feature: Encodes the peptide sequence at SEQ ID NO. 22162
aaagaaagggagctcgtgccagtgtgccacacccgcacccgccctcgcccgcagttcacatcagccgccgccaccgccgccgccgcagcagcagcacagcgacgtcgccgccgtccccccgccgccgcgccggttcccttccagccgccggggaccatgtcgagcggcctggacatgtccctggacgacttcatcaagcagtccaaatcccggcccaagtccaaccctgcctcctcgtcggggcccgcgcgccgcgcgccgccgcccgcccgcgcggcgccctacccgccggccgcccccaaggcccaccgcgccgccgccgactcgccctacggggtctactccgagcacatcgccgccatggccgcggtcgcgccgccgcagccggccaccgcgaggtcgctcgagacggggacgaagctgcacatctccaaccttgacgccggcgtcaccgtcgaggatgtccaggaactcttctcggaggtcggtgagctcaaacgttattcaatgaactatgacaaagatgggacatccaagggaactgcggaagttgtctttgcaaggaaggtggatgctttggatgccatcaagagatacaatggtgttctacttgatgggaagccaatgaacatagagctcattggaaacaatgccgaaccacctcccatgccaccactaatacacaaccgtcctttgcagaactataatgatatccatagcagcgtgcctcaaaaccaaagaggtgttctgcaaagagcacctcaaagcaatggtcgtggtggaggcagtagtcagaacagtggcggtcgcggacaggggaaaggccgagggcaggaccagaaccgcacgcccctatctgcagcagatcttgatgctgaactggacaattaccatgcatcggcagtgaaagagaaatgatgctctggcgtcctgcttattgtactggtgggaaggtgatgaggttgcggctttgttttagaagtttgaggttgttactattctagctatagtgttttgtactagatatttcttcgcatagttatagaaccattcagatatcttgtttatgcactacgatggtgtggaccataattgatccagttaatgctacatccaggatgcaagttatgctaatttgcagccctgtaggcacggttgagaacaaatgcaaaccaacagtttcgtc

SEQ ID NO: 22162 - protein, 253 aa, Panicum virgatum
  misc_feature: Ceres CLONE 1820047
  misc_feature (89)..(159): Pfam Name: RRM_1 Pfam Description: RNA recognition motif. (a.k.a. RRM, RBD, or RNP domain)
MSSGLDMSLDDFIKQSKSRPKSNPASSSGPARRAPPPARAAPYPPAAPKAHRAAADSPYGVYSEHIAAMAAVAPPQPATARSLETGTKLHISNLDAGVTVEDVQELFSEVGELKRYSMNYDKDGTSKGTAEVVFARKVDALDAIKRYNGVLLDGKPMNIELIGNNAEPPPMPPLIHNRPLQNYNDIHSSVPQNQRGVLQRAPQSNGRGGGSSQNSGGRGQGKGRGQDQNRTPLSAADLDAELDNYHASAVKEK

SEQ ID NO: 22163 - DNA, 575 bp, Panicum virgatum
  misc_feature: Ceres CLONE 1820063
  misc_feature: Encodes the peptide sequence at SEQ ID NO. 22164
atcatcacctcccttcgtcgccggcgccgccgacacgtcccgaaccccttgactgcttgatcttggtttaagagagaggattcgaggagtgatgtggaccgaggaggctgccgctgcggtgaccgacgtccccacgaccgaggtcgagtccgaggcgccggccgccgacgaggcggaggcgatgcccgccaaggcctgcaacgccgcgcccaacgacaagaaggccccgccggagaagaaggggcccaaagagaagactcccaccccggccaggaaccccgccgcccacccgccgtacgccgagatgatctcggaggcgattgcggcgctcaaggagaggaccggggccagctcggtggccatctgcaagtacgtggacgaaaagtacggcgggcagctgccgacccacttccgcgagctgctggccgggcagctcacgacgctcgccgccgctgggaagctgacccgcgtctcgaactcgctctagctgccggccgccgccgacgccgagtccagcgcctccaagcccgccgccgcggccaagtccaagccaggcaaggtctcctagcccgccg

SEQ ID NO: 22164 - protein, 131 aa, Panicum virgatum
  misc_feature: Ceres CLONE 1820063
  misc_feature (65)..(130): Pfam Name: Linker_histone Pfam Description: linker histone H1 and H5 family
MWTEEAAAAVTDVPTTEVESEAPAADEAEAMPAKACNAAPNDKKAPPEKKGPKEKTPTPARNPAAHPPYAEMISEAIAALKERTGASSVAICKYVDEKYGGQLPTHFRELLAGQLTTLAAAGKLTRVSNSL

SEQ ID NO: 22165 - DNA, 718 bp, Panicum virgatum
  misc_feature: Ceres CLONE 1820078
  misc_feature: Encodes the peptide sequence at SEQ ID NO. 22166
gcttgctccgcccacccgcattcccttccctcccgtcgcctcgccgcctccgcacgcgcaccgcaacgcgacgcaccgggaaccgccgctacctccgcccacccatcctctgcgcgcgagaggaaggaagggtcttcttcttggtgggaaggagggagatggcgatcgaccacgagtccccgttcaaggagctccgcctcaagaaccgcaggatcatgggaggcggcggccccgagccggaggaggaggccgcctcggcggcgtaccgggaccagtggccgcgctggctgcagccgctgctctccgcgcgcttcttcgcgcactgcaagacgcacagcgactcgcaccgcagcggcgagtgcaacatgttctgcctcgactgctccgccgccgcgggcgccggcgccggcgccgccgcgggcgcgctctgctccctctgcctcgcgcacgcccaccgcgaccaccacaccatccagatccgccgctcctcgtaccacgacgtcatccgggtctccgacatccagcgcttcatggacatcgccggcgtgcagacctacgtcatcaacagcgcccgagtcgtcttcctcaacgagcggccccagcagcagaagcccggctgcggcggcaaggccgcctccgcctccgccaacctctgcgaggtctgcgcccgcagcctcctcgacaacttccgctttctgctcctcggggtgcaaggtcg

SEQ ID NO: 22166 - protein, 186 aa, Panicum virgatum
  misc_feature: Ceres CLONE 1820078
  misc_feature (56)..(184): Pfam Name: PLATZ Pfam Description: PLATZ transcription factor
  misc_feature: The sequence is a functional homolog of SEQ ID NO 664 in the 10/666,642 US patent application
  misc_feature: The sequence is a functional homolog of SEQ ID NO 668 in the 10/666,642 US patent application
MAIDHESPFKELRLKNRRIMGGGGPEPEEEAASAAYRDQWPRWLQPLLSARFFAHCKTHSDSHRSGECNMFCLDCSAAAGAGAGAAAGALCSLCLAHAHRDHHTIQIRRSSYHDVIRVSDIQRFMDIAGVQTYVINSARVVFLNERPQQQKPGCGGKAASASANLCEVCARSLLDNFRFLLLGVQG

SEQ ID NO: 22167 - DNA, 263 bp, Panicum virgatum
  misc_feature: Ceres CLONE 1820083
  misc_feature: Encodes the peptide sequence at SEQ ID NO. 22168
atatccatcttcaattctccatccatcaagtgaagttcagcgcaaatcaccccgatgccggcgcgccggcgtgcagccaggcggagccgacgacgcgcatcgtggggccggaggggcggtgcgtggacgtgccctacaactggtactaccgcgggaaccaggtgcagctgtggccgtgcaagtccaacggcgacgcgaaccagctctggaccttccggcgcgacggctccgtccggtccggcggcatgtgcctggccgccgcc

SEQ ID NO: 22168 - protein, 86 aa, Panicum virgatum
  misc_feature: Ceres CLONE 1820083
  misc_feature: SWISSPROT Homolog: EC 3.2.2.22 rRNA N-glycosylase
IHLQFSIHQVKFSANHPDAGAPACSQAEPTTRIVGPEGRCVDVPYNWYYRGNQVQLWPCKSNGDANQLWTFRRDGSVRSGGMCLAA

SEQ ID NO: 22169 - DNA, 455 bp, Panicum virgatum
  misc_feature: Ceres CLONE 1820096
  misc_feature: Encodes the peptide sequence at SEQ ID NO. 22170
aaacccttcccctcccccttctagatggagagatagagaagaaaagataagctccgctcagctcgcaagcaagaggtggagatgcggagcccacgaggaggagggcgcgcccatgagcacgtcgacctgatcccgggcatccccgacgacgtcgccgtcgactgcctggcgcgcgtgccccacgcgtcccaccgcgcgctgcgccgtgtctgccgcggctggcggagcgccgccgccgcgccggccttcgccgcggcgcgcgcccccgcgggcgccgccgaggcccccacctccatgctgcaggtcgggaccccccccgccgccgccgaccccgacgacagcgggcccaaggactgcggcgcgccgcccagcgcgcccgcctacggcgccgctgtctacgacgtgactccaggccagtggctccgggagccccccccgccccccgcgccgtccgc

SEQ ID NO: 22170 - protein, 124 aa, Panicum virgatum
  misc_feature: Ceres CLONE 1820096
  misc_feature (15)..(62): Pfam Name: F-box Pfam Description: F-box domain
MRSPRGGGRAHEHVDLIPGIPDDVAVDCLARVPHASHRALRRVCRGWRSAAAAPAFAAARAPAGAAEAPTSMLQVGTPPAAADPDDSGPKDCGAPPSAPAYGAAVYDVTPGQWLREPPPPPAPS

SEQ ID NO: 22171 - DNA, 1622 bp, Panicum virgatum
  misc_feature: Ceres CLONE 1820097
  misc_feature: Encodes the peptide sequence at SEQ ID NO. 22172
aaatccgaaatgctagcgtctgagtgactgtgacctagatcccccctcccgtccccacactcgatggagctgggcggcggcggcgagagcgccaccaagcgcgcgaggctctcctccgacgatgccgccgccgccgcaggcgaggaccggctcagcgcgctccccagcgacgtcctcgtcctcatcctcctcaagctcagcacccgcgccgccgcccggaccagcgtcctctcccgctcctggcgccgggtctgggcgctcctcccgacgctcagcttcgacgaaaccgccgacccaggccagctgcgcgacgcgctcgacggccacgaggtgtccgtccgcagcctcctcgtcggggccgacggcgccgccgccgagtccctaggggtctggctccccgccgccgcgcgccgcgtctccggcgacctgtccctttacagctacgctcgggtcgaggaggatgaggacgacgagacccctcaaagtggcatctttgtgctcccctgcttcgagaaggccacctccatcacgctcttcttgagcttccacggcctcgccgtgcctcgcgctggcgtcttcgcccggctcgccgagctccacctgcaccgcgtctggtttcacggcccgggcgagctgggcgacgccgtgtccactccgaggtgcccgtgcctgcagaggctcaccgtcgacgatgcccggggcctggccgatctcaatctcgccatacgttcggagactctgctggaggtggagctcaggaacctgtgcaccttgtctcggctcaccgtggcggcgccggcactcaaggagttagctgtggtgctttgttttggcaagaatcgaccggtcgccaacatctctgcccctcggctgacgaatcttgactggggtgatgaatatgatcccagctctgtccactttggcaagatggaacatctccggtcgctgagcactaactcttatcttgtttatgcaaactatgccttcatacacaatcacttttggttaagtctcttgcagcgctttgaggggatccagactctttccctaatgctcatgtatctgcggagaactatcaatacatgatggaagacttgacagtgctccctgacattacatttttgcgcgtgatggtagttgcaaatggacatgcctttcaggccagcgcattccatgttctcagattgtgtacgggtataagaaggttgattctgcaatttggcttagagccagcagactggggaaccgaggaactcttgttgaatcaccttgaagaagtagaaatcattgggtggagaggatctgaacatgaagttgcttttatgaaacgacttttcaattgggggacaaggcttaaagagatgacagtaaatttctattttaaaacctctgaaatcaaggcaaaggagttgcaccaaatatttcagagtttctctaggccaggaatatgcacgaaattttacctatatcagaagcataggaaggtgttatatgcacctgactactagcacaccaaattgtcactgtaggccattctttgtggtttatgttttcttgttatgaaccgtactgtatgagatcatcaaaatgctagaagatcttaaaggaaaaggttgaggtcc

SEQ ID NO: 22172 - protein, 340 aa, Panicum virgatum
  misc_feature: Ceres CLONE 1820097
  misc_feature (28)..(75): Pfam Name: F-box Pfam Description: F-box domain
MELGGGGESATKRARLSSDDAAAAAGEDRLSALPSDVLVLILLKLSTRAAARTSVLSRSWRRVWALLPTLSFDETADPGQLRDALDGHEVSVRSLLVGADGAAAESLGVWLPAAARRVSGDLSLYSYARVEEDEDDETPQSGIFVLPCFEKATSITLFLSFHGLAVPRAGVFARLAELHLHRVWFHGPGELGDAVSTPRCPCLQRLTVDDARGLADLNLAIRSETLLEVELRNLCTLSRLTVAAPALKELAVVLCFGKNRPVANISAPRLTNLDWGDEYDPSSVHFGKMEHLRSLSTNSYLVYANYAFIHNHFWLSLLQRFEGIQTLSLMLMYLRRTINT

SEQ ID NO: 22173 - DNA, 715 bp, Panicum virgatum
  misc_feature: Ceres CLONE 1820112
  misc_feature: Encodes the peptide sequence at SEQ ID NO. 22174
tggcgattatactgcgcttgtttgccttcgcttcagcagcatctgcggagcggcggcggctactcgcctgctcccccagggggaaagggcaccggcgacggcggccggcgaggagctggaccctcgagcccggatgcctcctcccgagctacagctagagcaagatcactaatgtctgatccacctacaactgatgctggtgatgaactggagagctactcgtccttgggtttgacagtaccatactcacagaaagacaatgctaaatttccaaaggttcttttgcttctgtcagcatatcttgacaagatagttaaggagaatgaagagttacttgattccagtaaaataaaggagtcaaccactatctttcatggtcagagggtgccagaacttagcataaaactctatgcagaacgcatcttcaagtatgcacagtgcagcccatcttgctttgtgttgggactcatctacatggagagatatctacagcaaccaaacatttacatgacatcatttagtgttcatcgcttgctgattacaagtgttgttgttgctgccaaattcatagatgattcgtttttcaacaatgcatactacggaagagttggagggattagcacaagagagatgaacatgcttgaattggatttgttgttcagtctggatttcagacttaaagtcaatttagagactttcagaagctactgcttgc

SEQ ID NO: 22174 - protein, 181 aa, Panicum virgatum
  misc_feature: Ceres CLONE 1820112
  misc_feature (34)..(169): Pfam Name: Cyclin Pfam Description: Cyclin
MSDPPTTDAGDELESYSSLGLTVPYSQKDNAKFPKVLLLLSAYLDKIVKENEELLDSSKIKESTTIFHGQRVPELSIKLYAERIFKYAQCSPSCFVLGLIYMERYLQQPNIYMTSFSVHRLLITSVVVAAKFIDDSFFNNAYYGRVGGISTREMNMLELDLLFSLDFRLKVNLETFRSYCL

SEQ ID NO: 22175 - DNA, 356 bp, Panicum virgatum
  misc_feature: Ceres CLONE 1820130
  misc_feature: Encodes the peptide sequence at SEQ ID NO. 22176
atcatccatacatacaagttctctgacacaacctgcagcctcctagctagaataaagcatcctcctgaagaagtgaagaggtagccagacatggcctcctccaagttgtttcttcactttgttcttctcgccttgatcgcttgtggggccgtggcttccgatcccagtcctctccaggacttttgtgttgctgacaaagactcacctggtacgtaacatcgaagcgaacacatgatcacattctgatatcttataacaaattaagccagagattattagctttctaacacatacatgtatgttgtttcattgatgaagaacgggtcaatgggataccatgcaaggatatgaaggat

SEQ ID NO: 22176 - protein, 41 aa, Panicum virgatum
  misc_feature: Ceres CLONE 1820130
  misc_feature: SWISSPROT Homolog: EC 1.2.3.4 Oxalate oxidase
MASSKLFLHFVLLALIACGAVASDPSPLQDFCVADKDSPGT

SEQ ID NO: 22177 - DNA, 1135 bp, Panicum virgatum
  misc_feature: Ceres CLONE 1820138
  misc_feature: Encodes the peptide sequence at SEQ ID NO. 22178
ggcaggccgcggctcgcacgcgtcctccaaccagaccgggccaggtcaggcacggagccgctcgccgcctccggggctccggcctccgccacggcggttaccggcgatgaacggcgggctccctggattccacaatgcgccggcatcgagggccgtggtcgtcgcctccgcgctcttctccgtccccttcggcttccgcggccgcttcctcgacctcggcctttcctaccagaatgtttaccaaagtttgagtatatggaggcttatcacctcgttgtttgctttctcgtcgacccctgagctgatatttggagccgcgctgctgtactacttccgggtgttcgaaaggcaaataggttctaacaagtatgctgtcttcatcatattctcaaccatggtctctgtcctgcttcagatccttgctttaggttacctgaaagatccttctataaatcctctgacgtcaggaccctatggcctcatttttgcatcttatgtgccattctttgacattccggtctcaatgaggttccgcatatttggactgagcttaagtgataagtcatttgtatatttggctggactccagcttctttgctcatctggaagacgttctgttgtacctggagtttctggcatactagctggccttttgtatcgcctgaatacatttggcatccgcaggttgaagttcccagagtttgtagcatcactcttcacgcgtgtatcgtggccgttttctagaaatccttatcaagggttgccgactacagaaaatgatgcaaacatttcttctcaccaggctgcgcacacagctacccaagaccctgcagagtcctctattgccgctctcgtgtccattggcttcgatcgtaactctgcagttcaggcacttgtattgacaaactatgacgttaatttggcctcgaacattctgcttgaaacacaagccctgcagcaatgataccttgtagtcaaaatatagacgcactgtacattaatggatgtgaagtgtttcattcattcttatgtaccagattttatctcagaatttattgacacaaacaagccattgtacaacacagaactagaggaacgaagcacaatgaatacatgagctctctatttgcttgct

SEQ ID NO: 22178 - protein, 285 aa, Panicum virgatum
  misc_feature: Ceres CLONE 1820138
  misc_feature (241)..(277): Pfam Name: UBA Pfam Description: UBA/TS-N domain
MNGGLPGFHNAPASRAVVVASALFSVPFGFRGRFLDLGLSYQNVYQSLSIWRLITSLFAFSSTPELIFGAALLYYFRVFERQIGSNKYAVFIIFSTMVSVLLQILALGYLKDPSINPLTSGPYGLIFASYVPFFDIPVSMRFRIFGLSLSDKSFVYLAGLQLLCSSGRRSVVPGVSGILAGLLYRLNTFGIRRLKFPEFVASLFTRVSWPFSRNPYQGLPTTENDANISSHQAAHTATQDPAESSIAALVSIGFDRNSAVQALVLTNYDVNLASNILLETQALQQ

SEQ ID NO: 22179 - DNA, 464 bp, Panicum virgatum
  misc_feature: Ceres CLONE 1820141
  misc_feature: Encodes the peptide sequence at SEQ ID NO. 22180
acaacaacccgcacaacatctcatctgaggaaaaggggagtctgaccatcggattgatcagaagtgagctgaagccttggccgtggatccaagcatcgcggcggcacgatgccgaggccgcagcgcgccggaacgaggatgcagcctaagccttcttccgcgcctctccgccgctccgttaccgctaccgcgtcgccgccagcgtggccgacttcctcgcccgcctctccgcggggagcggcggtgcgggcggtcccgccgaaggcgacagggagatctgtatcagcgaccggcggcacttcggtgcccctggagcagcgctgcctgcgctacatcgacaacttcacctccggtccgctggtggcggccgctatcgaatattctcacaaggaaggctatgcctgtcttcttcatctgtcgacgcggaacctcgccattttattgttgattttttccagagattt

SEQ ID NO: 22180 - protein, 118 aa, Panicum virgatum
  misc_feature: Ceres CLONE 1820141
  misc_feature: SWISSPROT Homolog: EC 6.3.2.5 Phosphopantothenate--cysteine ligase
MPRPQRAGTRMQPKPSSAPLRRSVTATASPPAWPTSSPASPRGAAVRAVPPKATGRSVSATGGTSVPLEQRCLRYIDNFTSGPLVAAAIEYSHKEGYACLLHLSTRNLAILLLIFSRD

SEQ ID NO: 22181 - DNA, 1069 bp, Panicum virgatum
  misc_feature: Ceres CLONE 1820161
  misc_feature: Encodes the peptide sequence at SEQ ID NO. 22182
acgcaacaacgaccaccaaggcagcccgttcgccgctccgcccgccagccgccgtcaccggcagcgagcatgcaccacgatcccaaccccttcgatgagggcgccgacgacaaccccttctcgaatggaggaggaggaggtgcaggagcgcgtggtggaggcggcaagtcgcagttcgggttccggccggcggagcccgtcgggttcggcggcggcaggggcgacgcgaccgtcgacatccccctcgacaccatgaacgattcgaagggcaaagcgaaggagctgtcgcagtgggaatcagatctcaggaggcgagaggcggatatcaggaggagggaggaagctctcaagagtgctggggtgcccatggaggacaagaactggccgccattcttcccaatcatccaccacgacatttccaatgagataccagcaaacgctcagaagttgcagtatcttgcgttcgcgagctggcttggcatagtgctttgtctcttctggaattttattgctgtcattgtctgttggatcagagggggagattccaagctatttttcctggctacaatctatggtatgcttggcatccctttgtcctacttgatgtggtataggcctctctaccgagcaatgagaactgacagtgctttcagctttggatggtttttcctatgttacctgctccacattggcttttgcatatttgctgccattgctcctccaattatattccgtggaaagtcattaacgggtatactggctgcaattgacaccttctctgatcatgcgatagttgggatcttttactttgtcggatttgccttgttttgcttggagacacttgtgagcatatgggttcttcagaaagtatacatgtacttcagagggcacaagtaggccattgaaggatttactaccaataccatctgattgtgctgcggttctgtgcatacacataagtacatgtccattgttgtatgttatgacaatgtatattttttcaactttgaagttgaggggtataccattatatagtagtgtcgtttctgactgatttatttttttaccc

SEQ ID NO: 22182 - protein, 275 aa, Panicum virgatum
  misc_feature: Ceres CLONE 1820161
  misc_feature (101)..(275): Pfam Name: SCAMP Pfam Description: SCAMP family
  misc_feature: Useful for biocontainment applications
MHHDPNPFDEGADDNPFSNGGGGGAGARGGGGKSQFGFRPAEPVGFGGGRGDATVDIPLDTMNDSKGKAKELSQWESDLRRREADIRRREEALKSAGVPMEDKNWPPFFPIIHHDISNEIPANAQKLQYLAFASWLGIVLCLFWNFIAVIVCWIRGGDSKLFFLATIYGMLGIPLSYLMWYRPLYRAMRTDSAFSFGWFFLCYLLHIGFCIFAAIAPPIIFRGKSLTGILAAIDTFSDHAIVGIFYFVGFALFCLETLVSIWVLQKVYMYFRGHK

SEQ ID NO: 22183 - DNA, 1808 bp, Panicum virgatum
  misc_feature: Ceres CLONE 1820172
  misc_feature: Encodes the peptide sequence at SEQ ID NO. 22184
ctctctctctctctctctctctccgtgttcttatcagcagcagctcgctcgccacgttccgatcctgtaccagctgccgagacgagcgcgaggccccgaggtccaaaagagctcaagctcctccccgacgcatgcgcggatcgatcgatccagcccgagctacgggaggcggcggcggcagatcgacggccggcagctgactaaggtggatccccggaggcatggcaagaggcccctacccgccgacgaggaggaagaggagccgccgcccccgccgccgccgaagcacgagcagctggatgtcgaggagcagtaccaccacgtctccccccagctgctaggagcgacctttagcggcggcggcggagggtcgtcgtcgtcccccgccggcgtcggcgccgcgggctcgtcgccggaggcgtacgcgcagtactactactcggcgcgcgccgaccacgacgccaccgccgtggcctccgcgctagcgcacgtcatccgcgcctcccccgaccagctcccgccgcaggccttctacgccgccgccgccgccacgggccaccagctgggagaccaccggcaagcagcgccgccgcaccatcccggcggccacgccgccgccgccgaggaggagcaagccgcaggccggaggcggcactaccgaggggtgcggcagcggccatgggggaagtgggcggcggagatccgggaccccaacaaggcagcgcgggtgtggctgggcaccttcgacacggcggaggacgccgccatcgcctacgacgaggcggcgctccggttcaagggcaccaaggccaagctcaacttcccggagcgcgtccaaggccgcaccgacctgggcttcctcgtcacccgcggcatcccggaccggcaccaccaacaccaaggcgcggtgacgctggcagcaaggccgccgccgccgcaccggcagcaccagcaccagaccgtggtgccgtacccggacctcatgcagtacgcgcagctgctgcaggccggcggccggggcggcggcggaggcggcggcgaccgcgccgaggcggccgccgcggcccagcaggcggcgcaggcgcagctcatgatgatggcccgcggcggcsgcggcggcgtsaacctgscgttcggcgccgcgtcgtcgccgttctccccctcgccctcgtcggcgccgcagatcctggacttctccacgcagcagctcatccggcccggsccgccgtcgccggccgccgcgatgtcgtcgtcgggcgctgctccgtccacgccgtcgtccacgaccacggcgtcgtcgcccggtggcggcagtgcatggccgtacggtggggagcaccacaggaataaaaaagacgcgtgatcgagctggcatatgctcatatgcgtgcatgcaagttgcaagcacttgcaatgcgagaggatcagatcagagaccaagtagctgcatatggaggaatatgcatgcaatatggggtaagtggcagtggtgatttaattttgctggaagcatataaaagcattttttggccattgttctcttgtctctttctttcttttcttttcgcgatgcatgatcttcttttcttcatttcttggaggatcctcagtttagagagctagctagctagctgctagagcttgctgctaccttccttgtttaatttactgctctgttgctcatcatctctttaattggttcaagtgtaaactaattaattgtgcgaactaatccaaaagcaagaagagaggaataataatctcattgatgcaatatacaggagcttttttctctccaatcaaaaaac

SEQ ID NO: 22184 - protein, 453 aa, Panicum virgatum
  misc_feature: Ceres CLONE 1820172
  misc_feature (217)..(268): Pfam Name: AP2 Pfam Description: AP2 domain
  misc_feature: Useful for making plants with altered lignin content
  misc_feature (371)..(371): Xaa is any aa, unknown, or other
  misc_feature (377)..(377): Xaa is any aa, unknown, or other
SLSLSLSPCSYQQQLARHVPILYQLPRRARGPEVQKSSSSSPTHARIDRSSPSYGRRRRQIDGRQLTKVDPRRHGKRPLPADEEEEEPPPPPPPKHEQLDVEEQYHHVSPQLLGATFSGGGGGSSSSPAGVGAAGSSPEAYAQYYYSARADHDATAVASALAHVIRASPDQLPPQAFYAAAAATGHQLGDHRQAAPPHHPGGHAAAAEEEQAAGRRRHYRGVRQRPWGKWAAEIRDPNKAARVWLGTFDTAEDAAIAYDEAALRFKGTKAKLNFPERVQGRTDLGFLVTRGIPDRHHQHQGAVTLAARPPPPHRQHQHQTVVPYPDLMQYAQLLQAGGRGGGGGGGDRAEAAAAAQQAAQAQLMMMARGGXGGVNLXFGAASSPFSPSPSSAPQILDFSTQQLIRPGPPSPAAAMSSSGAAPSTPSSTTTASSPGGGSAWPYGGEHHRNKKDA

SEQ ID NO: 22185 - DNA, 1534 bp, Panicum virgatum
  misc_feature: Ceres CLONE 1820202
  misc_feature: Encodes the peptide sequence at SEQ ID NO. 22186
accttcagtcctcagctactataaccagatcactcaccaagtggaatccaggagggtgccatttctggcggccatgagctcgtctggcctggcacggacgctgaagtccctgtgcatcaccggggacctgtccaaggccgtgcgcctcctgtggcagagccccttgtgccccggcgcgaggacctacgagcttctgctgcaagagtgcgtgcaccggagggacgcgaggctcggcaagcggatccacgcccgcatggtcgccaccgggttccgctgcggcgagtacatcaccaccaagctgctcatcttctatgccaagatcggggacctcggatgcgcgcagaagctgttcgacggaatgctgcagcggagcatcgtcgcgtggaacgccatgatctcgggctgcgcgcgcggcggcgcggaggcgcaggagcgggcggtggagctgttcggcgcgatgcgagcggaggggctggcgccggaccagttcacgttcgcgtccgtgctgtgcgcgtgcgcgaggctggccgcgctggagcccggccgccgcgtgcacgccgtcgcggtcaagtcggacgtgggcgggaacgtgttcgccaacagcgcgctcgtggacatgtacctcaagtgcagcagccccgaggacgcgcgccgggcgttcgcggcggcgccggagcggaacgtcaccatgtggacggcggtcatctccgggcacggccagcaggggcgcgccgccgaggcgctggcgctgttcgaccggatggcggcggacgggttccggcccaacggcgtgacgctcctcgccgtgctctcggcgtgcgcgcacgccgggctcgtcgacgaggggctgaggcggttcgcgtccatgtcgtcggactacgggctcgcgccgaggggcccgcactacgcggcagtggtcgacatgctcgccagggtcggcagaatacaggaggcctacgagctcgtcgagaacctgccggactgccaggagcactccgtggtctggggcgcgctgctgggcgcctgcaggaagcacggtggcgacgtggccctcgtcgagctcgcctcgcggcggttcttccggctgcagcccgggaacgccggcaagtacgtggtcctggcgaacacgtacgccgcccgcgagatgtgggacagcgtggccggcgcgcacgaggcgatgcgggcgctcggggtgaagaaggaccgcgcctggagcgccgtcgaagtgcagggcaagaggcacactttccttgccggagactcgtaccacgacgaatactcggcgatctataaggtctgcactgcattggccttcgctgtctccgagcaagcaacagatggagccagacgctgctgattgatgcgcatcgacctgcgtggttattgctgcaattcagaatggagaaacatcctgcacagagatggtatcttcttcttgtgtgatctgaatgccaaattgttggctgcgcagtgcgcagttttggtgcaaacagttccagggctcaggttaaaattgcagatgctcaggtttgct

SEQ ID NO: 22186 - protein, 427 aa, Panicum virgatum
  misc_feature: Ceres CLONE 1820202
  misc_feature (205)..(239): Pfam Name: PPR Pfam Description: PPR repeat
MSSSGLARTLKSLCITGDLSKAVRLLWQSPLCPGARTYELLLQECVHRRDARLGKRIHARMVATGFRCGEYITTKLLIFYAKIGDLGCAQKLFDGMLQRSIVAWNAMISGCARGGAEAQERAVELFGAMRAEGLAPDQFTFASVLCACARLAALEPGRRVHAVAVKSDVGGNVFANSALVDMYLKCSSPEDARRAFAAAPERNVTMWTAVISGHGQQGRAAEALALFDRMAADGFRPNGVTLLAVLSACAHAGLVDEGLRRFASMSSDYGLAPRGPHYAAVVDMLARVGRIQEAYELVENLPDCQEHSVVWGALLGACRKHGGDVALVELASRRFFRLQPGNAGKYVVLANTYAAREMWDSVAGAHEAMRALGVKKDRAWSAVEVQGKRHTFLAGDSYHDEYSAIYKVCTALAFAVSEQATDGARRC

SEQ ID NO: 22187 - DNA, 730 bp, Panicum virgatum
  misc_feature: Ceres CLONE 1820231
  misc_feature: Encodes the peptide sequence at SEQ ID NO. 22188
agcgaatcccaagaaacgatcttgatcccgatccgccaggagactagccggacacccagccagagccagagcagcggcgcgatccaggagacagccagccagccgccatgaacaacctgttctcgagctcgtggaagcgcggcggcggcggggacggagacatcgagtccggcggcgtggagctgtccgcgccgccgggtgccgcggcgggcgcgagcctggacaagttcttcgaggacgtggagtccatcaaggacgagctccgcggcctggagcgcatccagcgctccctccacgacgccaacgaggggggcaagtcgctgcacgacgcggcggccgtgcgcgagctccggtcccggatggacgccgacgtcgccgcggcgatcaagaaggccaaggtggtgaagctccggctcgagtccctggaccgcgccaacgccgccaaccggtcggtgcccgggtgcggcccggggtcgtccaccgaccgcacgcgcacgtccgtggtggccgggctccgcaagaagctccgggactcgatggaggccttctcctccctccggtcccgcatcgcggccgagtaccgcgacacggtggcgcggcgctacttcacggtgacgggggcgcagccggacgaggcgacgctggacgcgctggcggagtccggcgagggggagcggatcctgcagcgcgcggtggcggagcaggggcgcggggaggtgctgggcgtggt

SEQ ID NO: 22188 - protein, 207 aa, Panicum virgatum
  misc_feature: Ceres CLONE 1820231
  misc_feature (37)..(144): Pfam Name: Syntaxin Pfam Description: Syntaxin
MNNLFSSSWKRGGGGDGDIESGGVELSAPPGAAAGASLDKFFEDVESIKDELRGLERIQRSLHDANEGGKSLHDAAAVRELRSRMDADVAAAIKKAKVVKLRLESLDRANAANRSVPGCGPGSSTDRTRTSVVAGLRKKLRDSMEAFSSLRSRIAAEYRDTVARRYFTVTGAQPDEATLDALAESGEGERILQRAVAEQGRGEVLGV

SEQ ID NO: 22189 - DNA, 722 bp, Panicum virgatum
  misc_feature: Ceres CLONE 1820235
  misc_feature: Encodes the peptide sequence at SEQ ID NO. 22190
accagcaggcaaggcatacacagattctgtctcgaggtgactgtcgtcctcttggcggcggcggcagcagcagcagaatcgaccgaccatgaggagtgtagggttagggagaagctagcagttcttattccagtctagctcctcttgcactgccccctgacagagtgacgacactgatagataacctggtagatcatcaggcggcggcaatgggcttccaggagcacgggctagccttccaggtgatcaccgacggcggtggcggcgcaaccgcagcgccgtggtgggcggctgctgctgctcctcaggggtttgccgccaagtttccgatcatcagctcaggcgattctgaccctccgcaagacctcaaataccatgagcctttggcagcagccatggccgcctacccggagttgcacaagtaccatggccctttcgatctggcccttgggcagtccatggtgtggagcaacaatgccgatgccggtcagcgtcagagctttggcctgtactctccatatggagctcaaactatgcacggcagggtgctcctgccgccggcgatcgccgccgaggagccggtctacgtgaacgccaagcagttcaaaggcatcctccggcggcgcctggcccgtgccagggcggcgagggacctcagggcctccaggaaccgcaagccatacctccacgagtcgcggcacctgcacgcgctccgccgcgcg

SEQ ID NO: 22190 - protein, 170 aa, Panicum virgatum
  misc_feature: Ceres CLONE 1820235
  misc_feature (122)..(170): Pfam Name: CBFB_NFYA Pfam Description: CCAAT-binding transcription factor (CBF-B/NF-YA) subunit B
MGFQEHGLAFQVITDGGGGATAAPWWAAAAAPQGFAAKFPIISSGDSDPPQDLKYHEPLAAAMAAYPELHKYHGPFDLALGQSMVWSNNADAGQRQSFGLYSPYGAQTMHGRVLLPPAIAAEEPVYVNAKQFKGILRRRLARARAARDLRASRNRKPYLHESRHLHALRR

SEQ ID NO: 22191 - DNA, 713 bp, Panicum virgatum
  misc_feature: Ceres CLONE 1820255
  misc_feature: Encodes the peptide sequence at SEQ ID NO. 22192
gagcttctccgcgcactgcatctccctccctgccgccgccgccgccgccgccgcacgcagccgcatcggccatgggggcgtacaagtacgtgtcggagctatggaggaggaagcagtccgatgtgatgcgcttcgtgcagcgcgtccgctgctgggagtacaggcagcagccggcgatcgtccgcctcaccaggcccacccgcccggacaaggcccgccgcctcggcttcaaggccaagcagggctatgttgtttaccgtgtccgtgtgaggcgtggtggcagaaagaggcccgtgcccaagggtattgtctatggcaagccaaagcaccagggtatcacccaactcaagttccagaggaacaagaggtctgttgctgaggagagggctgggcgtaagcttggtggactgagggttctcaactcctactgggtgaatgaggatagtacctacaaatactttgaggtcatccttgttgatgttgcccacactgccatccgcaacgaccccaggatcaactggctgtgcaaggatgtgcacaagcaccgcgagctccgtggcctcacctcggctggcaagaagtaccgtggcctgcgcggcaagggccacacccaccacaagaacaggccatccaggagagccacctggaagcgcaaccagaccctctccctccgccgctaccgttgagctctgtgcctggatacaggaacccat

SEQ ID NO: 22192 - protein, 204 aa, Panicum virgatum; identical to SEQ ID NO: 12677
  misc_feature: Ceres CLONE 1820255
  misc_feature (2)..(193): Pfam Name: Ribosomal_L15e Pfam Description: Ribosomal L15

SEQ ID NO: 22193 - DNA, 708 bp, Panicum virgatum
  misc_feature: Ceres CLONE 1820275
  misc_feature: Encodes the peptide sequence at SEQ ID NO. 22194
atcaatccgccccatgcccacatccgtcgccacccacgcatccctcctcctcaaagccgcagccgccaagcccttcttctccccccgcgcggcggcccggatcccgccgccttcgccccaccctcctccccccgcccccgccgccgggcgcctcccgccggccacggcgacgacggccgccgctgccggcgccagccgctggttccggtggcagtcggcgcgggggctgtgcgccgcgccgcattccggcggtggggccggcggcgaggggatgggatctgatgcgggggtgggcgccaggaggagggcggtgaacgggccggccaaggagctgccggcggtgaacgggatgtccaaggaggacccgcagcctcccaggctgctcactctgcccaccgtgctcaccattggccgcgtcgctgccgtgccgctcctgattagcactttctacatggatggtccgtgggcagctacggccacaactggcatcttccttgctgctgcagtcactgattggctagatggttatcttgctagaaagatgcagctaggaacaccttttggtgcatttcttgatcctgtagctgacaagcttatggcagctgcaacattagttttgctgtgcaccaaaactatggaaacttcaatactcagggatgggccatggcttctaacagttccttccattgctatcatcgggagagagat

SEQ ID NO: 22194 - protein, 231 aa, Panicum virgatum
  misc_feature: Ceres CLONE 1820275
  misc_feature: SWISSPROT Homolog: EC 2.7.8.5 CDP-diacylglycerol--glycerol-3-phosphate 3-phosphatidyltransferase
MPTSVATHASLLLKAAAAKPFFSPRAAARIPPPSPHPPPPAPAAGRLPPATATTAAAAGASRWFRWQSARGLCAAPHSGGGAGGEGMGSDAGVGARRRAVNGPAKELPAVNGMSKEDPQPPRLLTLPTVLTIGRVAAVPLLISTFYMDGPWAATATTGIFLAAAVTDWLDGYLARKMQLGTPFGAFLDPVADKLMAAATLVLLCTKTMETSILRDGPWLLTVPSIAIIGRE

SEQ ID NO: 22195 - DNA, 1494 bp, Panicum virgatum
  misc_feature: Ceres CLONE 1820278
  misc_feature: Encodes the peptide sequence at SEQ ID NO. 22196
aagccgaaatcgcaacaccctagcccgctgctccgtctgattcccctcctccctcctccctcgctcgccgctcctctccgcggcgtctgcggctttccctctccgctccaaggagcggtaaggcctaccgccgcgccgaccgccgaccgccaccgccagccatgtcttctcaggtcgacagccgcaaccaatccgctgggaagcgcgcgcgcaccgacggcagccggcgtgaggatgactgggtttgccccagctgcaagaatgtcaacttcgctttccgcaccacttgcaacatgcgcaactgcaaccagtccaggccagcggatcacacgaaggccatgcaaaagcctatgcagactccgccccactacaccacgtcagggggttacatgggcccagggacacctccatcgatgtaccttggtgggggtgctcccccgtatgggacctccatgtttaatggacctgcaatgccgccgcgctatggcattcctcagttccctgggagttcggcgtatccatatggatatggtggtcgcataccgatggggagcccctacgggccgatgcaaatggccgggccacctccatattctggtggatctatgatgggagcaggtggaatgtatggaatgcccatggacagatatggcttaattcctcctagtcctggttcaatgggcacaagggctggctcatattctgatgaaggttcccagaagaagcctgcaggatctgggcgtgataatgattgggagtgtccaaattgccacaacatcaacttcgcctttcgcacagtctgtaatatgagaaagtgcaacacaccaagacctgaaaaccagggatctaagccagatggttcaagaggctcaaaaccaaagatgccagagggcagttggaagtgcgagcagtgcaataacataaactatccattcagaacaaaatgcaatcgtcctcaatgtggagcagagaagccactgcagacaaacaatacaaatgattcagcaacagatcaggacaatcagtttttgtcatgtaacattacgaagcttttatcaaagctgcgacttcttcatgaatctcaagacaacagtgagcagacacagacggatcttcctggtgatgtggctggagcaccaatgagttctcacgtgttccggatggcagcactcagtgtgttgcagaacagtcttgcaaactaatttgctaccgtttcatattgtgaaatgaaggtgagaaatttgcacctcgtggatatgcttctgtagtgagcgtctggcagcgctataggaagttcgagatggtaagcatttgtgatgttcagggggcagtatcttgatgtagccatttcagtttctgtttggagtgccttgtttcctttttatccttttctttatttattctttatgcctaagtttgagcacgccactattgttccgtactcctgatgtaagttcatcacgtttctaaaatgtaccggagataatttccccc

SEQ ID NO: 22196 - protein, 346 aa, Panicum virgatum
  misc_feature: Ceres CLONE 1820278
  misc_feature (242)..(273): Pfam Name: zf-RanBP Pfam Description: Zn-finger in Ran binding protein and others
  misc_feature (194)..(225): Pfam Name: zf-RanBP Pfam Description: Zn-finger in Ran binding protein and others
MSSQVDSRNQSAGKRARTDGSRREDDWVCPSCKNVNFAFRTTCNMRNCNQSRPADHTKAMQKPMQTPPHYTTSGGYMGPGTPPSMYLGGGAPPYGTSMFNGPAMPPRYGIPQFPGSSAYPYGYGGRIPMGSPYGPMQMAGPPPYSGGSMMGAGGMYGMPMDRYGLIPPSPGSMGTRAGSYSDEGSQKKPAGSGRDNDWECPNCHNINFAFRTVCNMRKCNTPRPENQGSKPDGSRGSKPKMPEGSWKCEQCNNINYPFRTKCNRPQCGAEKPLQTNNTNDSATDQDNQFLSCNITKLLSKLRLLHESQDNSEQTQTDLPGDVAGAPMSSHVFRMAALSVLQNSLAN

SEQ ID NO: 22197 - DNA, 565 bp, Panicum virgatum
  misc_feature: Ceres CLONE 1820290
  misc_feature: Encodes the peptide sequence at SEQ ID NO. 22198
agcgaggcgagcagagcatagttaagcatcggaggccgacgccgccggcgagttgcggcattgggctgcggacgtcaactggcatctgcgctccacgtcgccgagcgcggcccctccaccgggtccgcggtcctcctcatccacggcttcccggacctgtggctctcctggtgcctccagatggccgcgcccgccgcccgcggcttccgcgcgctggccccccacctccgcggctaccgccattcctccgtccccgccgaccccgccgcctactccatcttccacatcgtccgcgacctggtcgccctcctcgaccacctccgcctcccaaaggtgttcgtggtagggcacgattggggtgcgcatgtggcgtggcacctctgcctgttcctgcaggaccgggtgcgcgcctccgtcatcctgggtattccctactttccccgcggccctcgcccgatggccgagtcgttagcaaagctctgcgatggcttctacatcaatcagtttcagagagcccggaagagccgaaagggcttttggtcgctctgacgttgcatctgcgctt

SEQ ID NO: 22198 - protein, 122 aa, Panicum virgatum
  misc_feature: Ceres CLONE 1820290
  misc_feature: SWISSPROT Homolog: EC 3.3.2.10 Soluble epoxide hydrolase
MAAPAARGFRALAPHLRGYRHSSVPADPAAYSIFHIVRDLVALLDHLRLPKVFVVGHDWGAHVAWHLCLFLQDRVRASVILGIPYFPRGPRPMAESLAKLCDGFYINQFQRARKSRKGFWSL

SEQ ID NO: 22199 - DNA, 1590 bp, Panicum virgatum
  misc_feature: Ceres CLONE 1820302
  misc_feature: Encodes the peptide sequence at SEQ ID NO. 22200
attgaacgcttcacacctcacccacaagagaacaacccagcacgcctctccgagtactcatcgtccacctcctgaccttctagctaattccgcttgttccgatggcgctgctggcgcggagggcgcggagggcagtcgccaaggcggcgccgctcggcggcggcggcggcggcggcgtggagctggcgatcccggcgcacttccggtgcccgatctcgctggacctgatgcgggaccccgtcacggggccgacggggatcacgtacgaccgggagagcatcgaggcgtggctggacacgggccgcgccacctgccccgtcacgcacgcgccgctccgccacgaggacctcgtccccaaccacgccatccggcgggtcatccaggactggtgcgtcgccaaccgctcccgcggagtcgagcggatccccacgcccaagatccctgtcacgcccgtccaggcatccgagctcctcttcgacctcgccggggccgcgcgacgccgcgacgccgccgcgcggtgcgccgaggtggtcgccaagataaaggccctcgcgagggacagcgagcggaacaggcgctgcttcgcgtccatcggcacgggccgcgcgctcgccgccgcgttccagacgctcgctgccgctgacgccgcgccggcggggcgcgtccccgaggacatcctggcggcattggtctgcatgatgccgctggacgaggaggccgccgggacattgggctcgccgagctcgctggggtctctggtcgccattgcggagaacgggagcttggcgggaaggatgaacgccgtgctcgcgatcaaggagatcgtctcgtgcgacggagcgttcgtggatttgagcgagaaggtggacgcaatcgtagactcgctggtcaagatcatcaaggctcccatctgtccgctggctaccaaggccgccatggtcgccacctaccacctggcgcggtccgacgagcgcgttgcggctcgcctggccaccgccgggctcgtcccggtgctcatcgaggccctcgtcgaagccgacaagagcgtgtccgagaaggcgctggggcttgtcgacgcggtgctcacgtcggaggaaggccgcgcgagcgcgcgggcgcacgcgctcaccatgcccgttctggtcaagaagatgttccgcgtgtccgacctggccaccgagctagccgtgtcggcgatgtggcgccttggcaaggcgccctgcgctggagaagaggacgaggcggtggtgcggtgcctggtcgatgcgctgcgggttggcgccttccagaagctgctcctgctcttgcaggtcggctgcagggacgcaaccaaggagaaggccaccgaactgctcaagatgctcaacaagcacaagggcgtaggcgaatgcgtcgacgctggggatttccgaggactcaataggctgtcggcttaaatcaaaggggggactatgatgtaaaaaagggtactgtaaaatagagagatgcaacctgtaagtagatagggatagttgcaattttgttggacatgtttccatgatatttcggcagtttaggttcaactgaaaacatagatcttttttttccttt

SEQ ID NO: 22200 - protein, 444 aa, Panicum virgatum
  misc_feature: Ceres CLONE 1820302
  misc_feature (29)..(103): Pfam Name: U-box Pfam Description: U-box domain
MALLARRARRAVAKAAPLGGGGGGGVELAIPAHFRCPISLDLMRDPVTGPTGITYDRESIEAWLDTGRATCPVTHAPLRHEDLVPNHAIRRVIQDWCVANRSRGVERIPTPKIPVTPVQASELLFDLAGAARRRDAAARCAEVVAKIKALARDSERNRRCFASIGTGRALAAAFQTLAAADAAPAGRVPEDILAALVCMMPLDEEAAGTLGSPSSLGSLVAIAENGSLAGRMNAVLAIKEIVSCDGAFVDLSEKVDAIVDSLVKIIKAPICPLATKAAMVATYHLARSDERVAARLATAGLVPVLIEALVEADKSVSEKALGLVDAVLTSEEGRASARAHALTMPVLVKKMFRVSDLATELAVSAMWRLGKAPCAGEEDEAVVRCLVDALRVGAFQKLLLLLQVGCRDATKEKATELLKMLNKHKGVGECVDAGDFRGLNRLSA

SEQ ID NO: 22201 - DNA, 1345 bp, Panicum virgatum
  misc_feature: Ceres CLONE 1820311
  misc_feature: Encodes the peptide sequence at SEQ ID NO. 22202
tccccgcccgccccgctccacacttccatttccccccaggccccccgcgactgctcctccaccgtcctccgctctcccgcgggcgcgcgcggcgggggccgcaacgacccagctacgcatctatctgtgctggttcaccaaggtgctgaaatgtcctttctgttcaagtcaagcaacagtggtacaactgagaaaggcttgtccctagaagaacagcaagaaaaactaaatgaattacgcaaggagcttggtgaatactcatcagcagccattcaggatttcctttcagatgcctcgttatcgagatttcttcgagcaaggaactggaatgtgcagaaagctagtaagatgatgaaagcagctgtgaagtggcggctcgcattcaagccagagaacatttgctgggcagatattgcacaggaagcagagactggaaagatatatagggcagattacaaggacaaacaagggagaactgttcttgtattgaggcctggcttagagaacactacctcagcaacagggcagatcaaatatctagtttactctctggagaaagcgattatgaacctaacagaagatcaagagaagatggtgtggctgacagatttccagtgctggacattgggaagcacaccactgaaggtaacccgtgagactgtcaatgtcttgcaagactgttatcctgagcggttggggctagcaatcctttacaatcctcctaggatatttgaatcattctggaagatagtgaagcctttcctggaccatgagacccgcaagaaggtgaagtttgtgtactcgaacgacaaggagagccagaagataatggcagaggtctttgacatggaggagctcgactcggcattcggggggaagaatccagctacattcgagtacaacagctatgcagagcgaatgcaggaggacgacaagaagatgggatctttgcacagctcaactgatagcttccttgaatcatctgagaaggaggctaatggcgcagactctgatgcctcgagcgaggcctccttctacagtggaactgactctccgagacatgacgatgaacacagcaccccgaagaagaacagctgagctggactgctttggctgctcgagctgagagatggtctaggtcgacaactcgacatacagttatctaactggagctattgtctggaccgatgggggcaccagtttacaagctggtcagatcacgctgtcgggtctagaagggatgtatgtttgctgcccatgataatatagagaatatggaagagtttggaccatcagtggcgttgtactagatgaatttctcaataagattggacttcttcgagcc

SEQ ID NO: 22202 - protein, 315 aa, Panicum virgatum
  misc_feature: Ceres CLONE 1820311
  misc_feature (98)..(267): Pfam Name: CRAL_TRIO Pfam Description: CRAL/TRIO domain
  misc_feature (13)..(83): Pfam Name: CRAL_TRIO_N Pfam Description: CRAL/TRIO, N-terminus
MSFLFKSSNSGTTEKGLSLEEQQEKLNELRKELGEYSSAAIQDFLSDASLSRFLRARNWNVQKASKMMKAAVKWRLAFKPENICWADIAQEAETGKIYRADYKDKQGRTVLVLRPGLENTTSATGQIKYLVYSLEKAIMNLTEDQEKMVWLTDFQCWTLGSTPLKVTRETVNVLQDCYPERLGLAILYNPPRIFESFWKIVKPFLDHETRKKVKFVYSNDKESQKIMAEVFDMEELDSAFGGKNPATFEYNSYAERMQEDDKKMGSLHSSTDSFLESSEKEANGADSDASSEASFYSGTDSPRHDDEHSTPKKNS

SEQ ID NO: 22203 - DNA, 1519 bp, Panicum virgatum
  misc_feature: Ceres CLONE 1820317
  misc_feature: Encodes the peptide sequence at SEQ ID NO. 22204
ctctctctctcctccccctctcatttccgtgctcctcccgttggagtatactaaaaaatttcctattcctcaaccgaagcttccagaaggcttcttcttccgtaccttccccccaacgcgaggggtcgctccttcccgcatctggaagctacggtctcccccgctcagatccggccgggctgcggaggccgcggggcagaggtcgctgccgacgccgttcctgaccaagacgtaccagctggtggacgacccggcggtggacgacgtgatctcgtggagcgaggacggctccacgttcgtggtgtggcggccggcggagttcgcgctcgacctcctccccaagtacttcaagcacaacaacttctccagcttcgtgcggcagctcaacacctatggatttaggaagatcgtgcccgaccgatgggagttcgccaacgactgcttccggcgtggggagaagcgcctgctctgcgacatacaccgccggaaggtaccaccggctccggccgcgccggcagcggctctggcgaccgccgcggctgcggcggcgtccggggcggtgaccgtcgccgcggcgccgatccccatggccctgccggtgacgctgccgggctcgccggcgctatcctccgacgagcaggtgctctcctccaactccggctcggaccacccgcaggcggtgccgtccggctccgggggcgcgtccgcatcgggcgacacgggagaggagaacgagcgcctccgccgcgagaacgcgcggctgacccgcgagctcgcgcagatgaagaagctctgcaacaacatcctggtcctcatgaccaagtacgcctcctcccagcagctcgacgcctccgcggcgctgtcctccgtcgtcaactgctccggcgagtcatcggaggccctgccgccgccgccgcccctccccccggcgatcctcgatctaatgccctcgtgcccgggcctggccaccgcggccgcgggcctcgtcgccgacgcggaccccgaccaggccgcgaggctgttcggcgtctccatcgggcagaagcggacgcgggaggacgacgacaccggcgaggagccggcggcggaccacggcggctccggcgcggaggtgaagacggaggcgtcggatccgcatcagcttccgtcaggcagcagcaaggaggcgtcgccggaccagcacccgtggcccatataccggcccacgcccgtgtaccactcgatgcggccctgcaacgggccggaccagggcgccgggtccgaccaagacgggtccaactccaggtgagtgggcccgccccagcatgtagaagcttctagcaccaccgattaatcaattgccctattatatatgggcaactaattgtcattttagagacacaataatactaggtcctttttgtgcttttatttatactctgctagttgggggattgggaaactcctccctccctttgttgtagtaatctgtactccatttcccggatgctttttgtgtataaaatcagcggtcagaatc

SEQ ID NO: 22204 - protein, 428 aa, Panicum virgatum
  misc_feature: Ceres CLONE 1820317
  misc_feature (71)..(287): Pfam Name: HSF_DNA-bind Pfam Description: HSF-type DNA-binding
  misc_feature: Useful for making plants with modulated heat sensitivity
  misc_feature: Useful for making plants with modulated low light sensitivity
  misc_feature: Useful for making plants with modulated nitrogen use efficiency
SLSPPPLISVLLPLEYTKKFPIPQPKLPEGFFFRTFPPTRGVAPSRIWKLRSPPLRSGRAAEAAGQRSLPTPFLTKTYQLVDDPAVDDVISWSEDGSTFVVWRPAEFALDLLPKYFKHNNFSSFVRQLNTYGFRKIVPDRWEFANDCFRRGEKRLLCDIHRRKVPPAPAAPAAALATAAAAAASGAVTVAAAPIPMALPVTLPGSPALSSDEQVLSSNSGSDHPQAVPSGSGGASASGDTGEENERLRRENARLTRELAQMKKLCNNILVLMTKYASSQQLDASAALSSVVNCSGESSEALPPPPPLPPAILDLMPSCPGLATAAAGLVADADPDQAARLFGVSIGQKRTREDDDTGEEPAADHGGSGAEVKTEASDPHQLPSGSSKEASPDQHPWPIYRPTPVYHSMRPCNGPDQGAGSDQDGSNSR

SEQ ID NO: 22205 - DNA, 667 bp, Panicum virgatum
  misc_feature: Ceres CLONE 1820322
  misc_feature: Encodes the peptide sequence at SEQ ID NO. 22206
tgagcaagcttgagagagagagagagaagcaagtgtgcgagcgccctgcttgttaccactagcatggacggggcggcggcggcggcgattaggcaccggacggtggaggcgaacggcatcgcgatgcacgtggcggagtccggcgacgaggggagcccgcgggcggtggtggtgttcctgcacggcttcccggagctctggtactcgtggcgccaccagatgcagcacctggccgcgcggggctaccgctgcgtggcgcccgacctccgcggctacggcggcaccgacgcgccgcccgacgtcgcctcctactccgccttccacgtcgtcggcgacgtcgtcgcactcctcgacgcgctcggcctcgccaaggtgttcgttgtgggtcacgactggggcgccatcatcgcgtggtacctctgcctgttccggccggaccgcgtgacggcgctggtcaacaccagcgtggccttcatgcgccacgtcttcatccgcgccggcgccggcgccggcgccgtcaaaaccaccgacttcttcagccgcacctacgggcccacctactacatatgccgcttccagagaaggagttctctccggccaacgcccggtacatcgtgaggcagatcctgtgcaaccgcttcacctccgaggcggccggcggcgccca

SEQ ID NO: 22206 - protein, 184 aa, Panicum virgatum
  misc_feature: Ceres CLONE 1820322
  misc_feature: SWISSPROT Homolog: EC 3.3.2.10 Soluble epoxide hydrolase
MDGAAAAAIRHRTVEANGIAMHVAESGDEGSPRAVVVFLHGFPELWYSWRHQMQHLAARGYRCVAPDLRGYGGTDAPPDVASYSAFHVVGDVVALLDALGLAKVFVVGHDWGAIIAWYLCLFRPDRVTALVNTSVAFMRHVFIRAGAGAGAVKTTDFFSRTYGPTYYICRFQRRSSLRPTPGTS

SEQ ID NO: 22207 - DNA, 736 bp, Panicum virgatum
  misc_feature: Ceres CLONE 1820324
  misc_feature: Encodes the peptide sequence at SEQ ID NO. 22208
ctttcccgaccggaccggctcagtttcttcttcgacgtcctgatccttcctggtttccagcgcttccgagcacggcgccatggcttcctctgcctccgggagggcaggacgagggctcccctcgcctgcggcagcggcggctgcggtgctgctagtactagctggagcggccccggcggcgggctgctacccgcgcgtgttcagcttcggggactcgctggcggacacgggcaactacgccttcgtctacggcaacgactccggcgatcccgcgctccggctgccctacggcgagaccttcttccaccgccccaccgggcgcttctccaatggccgcatcgtcctcgacttcatcgcggaaacgctgggtctcccgttcgtgccgccgtacctgagcgggcggagcgcggtggacttcgcctgcggggccaacttcgccgtcggcggcgccacggcgctcagcccggacttcttccgggacaggggtttcgacgacatgggcgaccgagtgcacctcgacatggagatgaagtggttccgcgagctgctcgacctcctctgccccggcaacctcgccggttgcgcagatatgatgaaccaatctctcttcttggttggggaaatcgggggcaatgactacaacatccctcttctttctaaagtgcccttcaagaagatccgctcttttgttccgagtgttgttgccaaaatctcatccacgatcactgaattgatt

SEQ ID NO: 22208 - protein, 218 aa, Panicum virgatum
  misc_feature: Ceres CLONE 1820324
  misc_feature (40)..(215): Pfam Name: Lipase_GDSL Pfam Description: GDSL-like Lipase/Acylhydrolase
  misc_feature: SWISSPROT Homolog: EC 3.2.1.51 Alpha-L-fucosidase
MASSASGRAGRGLPSPAAAAAAVLLVLAGAAPAAGCYPRVFSFGDSLADTGNYAFVYGNDSGDPALRLPYGETFFHRPTGRFSNGRIVLDFIAETLGLPFVPPYLSGRSAVDFACGANFAVGGATALSPDFFRDRGFDDMGDRVHLDMEMKWFRELLDLLCPGNLAGCADMMNQSLFLVGEIGGNDYNIPLLSKVPFKKIRSFVPSVVAKISSTITEL

SEQ ID NO: 22209 - DNA, 721 bp, Panicum virgatum
  misc_feature: Ceres CLONE 1820331
  misc_feature: Encodes the peptide sequence at SEQ ID NO. 22210
ccaccatcaccgagctctgcctctctctcggcacgcgcgcgagctctccttactcgtcgaggtgccttgatggcgaccgaagtggctgacgctccggtgccgctgccggaggcgggccccgacgccgccgcggaggcccctgccgcggacgccgtcgcggccgccggcgacgcgaagccggccaaggccaagaaggccgccgcgccgcggaagcgcgcgaacccgacccacccgccgtacgccgagatgatctcggaggcgatcacgtcgctcaaggagaggacggggtcgagccagtacgcgatcgccaagttcctggaggacaagcacaaggacaagctgccgtccaacttccgcaagatgctgctcgtgcagctgaagaagctcgccgccgccggcaagctcaccaaggtcaagaactcctacaaggtgccgtcggggcgcgccccggccgccgacaagcccaagcccaaggccaaggccaagaagcctgctgccgccaagccgaagccgaagcccgctgcgaagaagcccaaggccgccgccaagcccaaggccaaggcgcccgccaagaccaagcccgctgcgaagccgaaggccgccgccaagcccgcggccaagccgaaggctgtagctacgaagccgaagccagccgccaagccggctgcgaagccgaagccagccgccaagccggctggcaagcccaagccggccgcccagc

SEQ ID NO: 22210 - protein, 217 aa, Panicum virgatum
  misc_feature: Ceres CLONE 1820331
  misc_feature (53)..(123): Pfam Name: Linker_histone Pfam Description: linker histone H1 and H5 family
  misc_feature: Useful for making plants with modulated nitrogen use efficiency
  misc_feature: Useful for making plants with modulated oxidative stress sensitivity
MATEVADAPVPLPEAGPDAAAEAPAADAVAAAGDAKPAKAKKAAAPRKRANPTHPPYAEMISEAITSLKERTGSSQYAIAKFLEDKHKDKLPSNFRKMLLVQLKKLAAAGKLTKVKNSYKVPSGRAPAADKPKPKAKAKKPAAAKPKPKPAAKKPKAAAKPKAKAPAKTKPAAKPKAAAKPAAKPKAVATKPKPAAKPAAKPKPAAKPAGKPKPAAQ

SEQ ID NO: 22211 - DNA, 1142 bp, Panicum virgatum
  misc_feature: Ceres CLONE 1820364
  misc_feature: Encodes the peptide sequence at SEQ ID NO. 22212
aggttttccaccgaatccttgcctcttctcggaactcaccaccgcgggaaggaaggaggagggagacgaagcagaagcagaagcttctcgcagggcgttcccgttcggcggcgtccgtggcggggcgactccgggcgccatgagcagcagcaagcaggcgctgatttacagcttcgtggccaagggctccgtcgtgctggcggagcacaccgccttctccggtaacttcagcaccgtcgccgtccagtgcctccagaagctgccccccaacagcaccagatccacctactcctgcgacggccacaccttcaacttcctcgtcgaccgcggcttcgtgttcctagtggtcgcggatgaggcggccgggaggagcgtgcccttcgtcttcctagagaaggttagggaaggcttcatgcagcgatatgggtccagcatcgacgaggaggggcagcacccgctcgctgatgatgcggacgaggacgactttcttttcgaagaccgcttcagcattgcctacaaccttgaccgtgaattcggcccgacgttgaaggatcatatgcagtattgtgttaaccacccagaggaaattaacaagctctccaaggtgaaagcccacctgtcggaggtcaaagggatcatgatggataatattgagaagatattggaccgtggtgagaagattgagcttttggtgggcaagaccgagaccttacaatcacaggctgacaccttccacaggcatggcagagagctgaggcgaaagatgtggcttcagaacctaaggtttaagctgatggttggtggaggcattgcggctctgattctcatcctttggctgatggtctgcaggggattcaaatgttagatcgctcagagttgtggctcgccctctcttttttgaagtgtttgttgcgttgttgaccgtttcacatgcacataatggtcaccgaatggtgtttcagtcatgttgtgggtatcggtatcgtgtagcggatgttaattccgtgcggtccttgccgtgtttcatatgataatagtaggcagctggagtacctgtgatagataactttgtgggagaaggggataatgacgctatgacctttattatctgtacattacaaaatgcaagctcttattattgg

SEQ ID NO: 22212 - protein, 241 aa, Panicum virgatum
  misc_feature: Ceres CLONE 1820364
  misc_feature (149)..(237): Pfam Name: Synaptobrevin Pfam Description: Synaptobrevin
MSSSKQALIYSFVAKGSVVLAEHTAFSGNFSTVAVQCLQKLPPNSTRSTYSCDGHTFNFLVDRGFVFLVVADEAAGRSVPFVFLEKVREGFMQRYGSSIDEEGQHPLADDADEDDFLFEDRFSIAYNLDREFGPTLKDHMQYCVNHPEEINKLSKVKAHLSEVKGIMMDNIEKILDRGEKIELLVGKTETLQSQADTFHRHGRELRRKMWLQNLRFKLMVGGGIAALILILWLMVCRGFKC

SEQ ID NO: 22213 - DNA, 1934 bp, Panicum virgatum
  misc_feature: Ceres CLONE 1820388
  misc_feature: Encodes the peptide sequence at SEQ ID NO. 22214
ttttagcttccacaggcgtccggcgaggggagagagagagggaggtcgccggcgatggcggcagggacgatctcccgcatccggctagagaacttcatgtgccactccagcctccacatcgagctcggggagcacgtcaacttcatcaccggccagaacggaagcgggaaaagcgccatcctcacggccctatgcgtcgccttcggctgccgcgccaagaatacccagcgcgccgcatcgctcaaggacttcatcaaaaccggctgcagctatgcatccatccttgttgatattaataaccacggggaagatgcattcaagcctgaagtatttgggaatgtaatcatactggaacgcaggattactgaatcaagtagttctacagttttaaaggatcaacatgggaggaaggtggcgcatcgcaaagatgatcttgtcgaaataattgagcattttaatattgatgttgaaaacccatgtgtaattatgagtcaagacaaaagcagagaatttttacattcaggaaatgacaaggataagtttaagttctttttcaaggctactcttcttcaacaagtgaatgacttgcttggttccataagaaagaacctaaatgttgtggactcaatagttgaagagctggaaagatcgattatgccagtgctgaaggaacttgatgatattcaggacaaaataaagaatatggaacatattgaagaaatagcacatgagattgagaacttgaagaaaaagttggcctgggcatgggtttatgatgttgacaaaaagattggggaacaaacagagaagcttgagaaactcagagagcgtatccctgcatgccaagaacgaattgatcgaaatacagccattatagaggaagtgaggaaagaatttattgtgaagaaagagaatgtaagatcttttctggagaagactcaagaagtaaggaggatgaaggaaaaaatgcaacacgacattcatgaggctgtgaaactgaaaatggatctagagaaagagcatgcacgtggtatgcaagtgttgaataaaatgaatacccgtgtcagacaacttgaagtgcaagttcatgaatttcagctaaagcgcatgcagcaaacccaggctgaagtatttcaagttgaggatagcatatgggaattacagcaggagatcaattctgctaatttatgtgctacaaggttaagtgaggaagaaaagaaattatccgaagaactacaggacattattaaaagcatcagtgacattggaaaagagatagatgaagatgggcgtaggatcaatcacctgaaatctcaaattgaggatctcagacgacgccaacatgataagcaactggctagcgactgctggtcccttgcagttgattgcgcattagggaggctactagatgctttcattgtctcatgtcataaggattcactcattttacgagagtgtgcgaaagaagtaaaataccacaaccttcaaattattatatatgactttgctaaaccacgacttgacattccaaatcatttgcttccttcaacaacacacccaacaatactttcggttatccattcgaaaaatcctactatactaaatgtattggtggatcagggccacacagagaggcaggtcctagttcaagattatgaagtgggaaagtctgttgcatttgataagaggatacgaaatctgaaagaagtatatacttctgatggttgcaaaatgttttgtagaggttctgttgagaccattcttcctccaaacagaaagtggagggctggtcgtttgtgcacttctctaggagaaaaaataattgaaatagagaatgaaactgctgaaattaagaaaataaactctgagaggtgggatctcaaaggaaaattagttattgatcgagacaacatcaattcaaaattaagaacgtt

SEQ ID NO: 22214 - protein, 626 aa, Panicum virgatum
  misc_feature: Ceres CLONE 1820388
  misc_feature (5)..(548): Pfam Name: SMC_N Pfam Description: RecF/RecN/SMC N terminal domain
MAAGTISRIRLENFMCHSSLHIELGEHVNFITGQNGSGKSAILTALCVAFGCRAKNTQRAASLKDFIKTGCSYASILVDINNHGEDAFKPEVFGNVIILERRITESSSSTVLKDQHGRKVAHRKDDLVEIIEHFNIDVENPCVIMSQDKSREFLHSGNDKDKFKFFFKATLLQQVNDLLGSIRKNLNVVDSIVEELERSIMPVLKELDDIQDKIKNMEHIEEIAHEIENLKKKLAWAWVYDVDKKIGEQTEKLEKLRERIPACQERIDRNTAIIEEVRKEFIVKKENVRSFLEKTQEVRRMKEKMQHDIHEAVKLKMDLEKEHARGMQVLNKMNTRVRQLEVQVHEFQLKRMQQTQAEVFQVEDSIWELQQEINSANLCATRLSEEEKKLSEELQDIIKSISDIGKEIDEDGRRINHLKSQIEDLRRRQHDKQLASDCWSLAVDCALGRLLDAFIVSCHKDSLILRECAKEVKYHNLQIIIYDFAKPRLDIPNHLLPSTTHPTILSVIHSKNPTILNVLVDQGHTERQVLVQDYEVGKSVAFDKRIRNLKEVYTSDGCKMFCRGSVETILPPNRKWRAGRLCTSLGEKIIEIENETAEIKKINSERWDLKGKLVIDRDNINSKLRT

SEQ ID NO: 22215 - DNA, 665 bp, Panicum virgatum
  misc_feature: Ceres CLONE 1820390
  misc_feature: Encodes the peptide sequence at SEQ ID NO. 22216
atcgagcaccctccaatcttcaaggcgttttagcaggcaaggcatcgatcgatcaatcaccagcagcgcgtgccgcgtagagagatcgagagagagagagagagagagagagagagagagagagagagagagagagaggagtctcaccggagaagggaggaatcgtcctcccccccgcccccgccatgggcaaggtccgctccttcttctcccgcagcggcaagcgcggcgccggcccgtcctcgccgtcctcctccgcggcgggcagcgcgccgtcgtcgccgtccccgaggaagtcgtcggcgtcggcgccggtggccccggcggcggatatcaaggacgagatggagcgcgtgttccgcaagttcgacgcgaacggcgacgggcggatctcgcggtcggagctggcggcgctgttcgagggcgtgggccacgcggccacggacgacgaggtgtcgcgcatgatggaggaggccgacgcggacggcgacggcgccatcagcctgcccgagttcgccgcgctcgtgcgctccgccgacgccgacgccgacgccgtcgaggaggacctgcgccacgccttcatggtcttcgaccccgacggcaacggcctcctcacgcccgcccaggctcgcgcgcgtccggcgcggcctccggggaggccccca

SEQ ID NO: 22216 - protein, 159 aa, Panicum virgatum
  misc_feature: Ceres CLONE 1820390
  misc_feature (53)..(81): Pfam Name: efhand Pfam Description: EF hand
  misc_feature (89)..(117): Pfam Name: efhand Pfam Description: EF hand
  misc_feature: SWISSPROT Homolog: EC 2.7.11.1 Non-specific serine/threonine protein kinase
MGKVRSFFSRSGKRGAGPSSPSSSAAGSAPSSPSPRKSSASAPVAPAADIKDEMERVFRKFDANGDGRISRSELAALFEGVGHAATDDEVSRMMEEADADGDGAISLPEFAALVRSADADADAVEEDLRHAFMVFDPDGNGLLTPAQARARPARPPGRP

SEQ ID NO: 22217 - DNA, 1335 bp, Panicum virgatum
  misc_feature: Ceres CLONE 1820427
  misc_feature: Encodes the peptide sequence at SEQ ID NO. 22218
acttcttccccgtgcgctcgccgttacgccatcgaagcccccctcccccgccgtctcgcctcatgccggcatgccctaacctcgtcgatacgaatcggatctcgccgctgatcagatggatcatactctcgcattcttccttgtccgcatcgccttttcccttccaccttgctggtgccggcgccggatcgcgcccgcaatagccctgaccaccgattgaaaccctagccgcgccgccgcccgccgtcggggcgctcctcgactgtcgacacgtcacttctagccgggctttttgaggtgagcaagttggttaaaactgtattttcccccacattactatgcaaaatatgcaatgcacggaactggaaacggatatgctcttagtttgcaccgaaattggagctggggtatcgtttgatgtccgttgcatcctaaacagatcaatttgtttgcattcaacgatgtttgtcgggccaaggtaccgatgagatttttttttattgttgttttgtggactgaagcaaccaagcacttcttcctggtcagatgatcgtctaaagaaaagtaaatgaaagaaacaagaagagcttcatcttctcggagaagaagaagcattcttgattaccgctcttataaataacgggaatggtttagtaagatagccgcgagttggaaagatagcagaaagatgtctccacctgttaaagtcatcagtgccttgggcagcacattctcacaccgcgtcgaggccgctctgtgtctcaagggcgtgccttacgagctgatccaagaagatctcaacaacaagagtgagctgctgctcacgcacaaccctgtccacaagaaggtgcctgtgcttctccatggcgatcaggccatctgcgagtccctcgtcatcatcgagtatgttgatgaagcctttttggggccgcccctcctgccgatcgacccctacgaccgtgccatggcccgcttctgggctaacttcatggataataagcttctcaagccgttctggctggcacacttgactgagggcgaggtgcagaagggatttgcgaaagaggccaaggagaacctggcgcttctagaggtgcagctcagggggaagaggttctttgggggtgacaccgttggctacatcgacatagtcttttgttggttagctccttggctgagtgtggttgaggaggtgactggaatgactggtagacgaaagcgagttccctgctttgtgccggatatccatacggccagaatagcattaagattggtggttcgtgagacccaacaatgtatttcaacagtactctacagcgatacagttcatctcct

SEQ ID NO: 22218 - protein, 215 aa, Panicum virgatum
  misc_feature: Ceres CLONE 1820427
  misc_feature (3)..(76): Pfam Name: GST_N Pfam Description: Glutathione S-transferase, N-terminal domain
  misc_feature: SWISSPROT Homolog: EC 2.5.1.18 Glutathione transferase
MSPPVKVISALGSTFSHRVEAALCLKGVPYELIQEDLNNKSELLLTHNPVHKKVPVLLHGDQAICESLVIIEYVDEAFLGPPLLPIDPYDRAMARFWANFMDNKLLKPFWLAHLTEGEVQKGFAKEAKENLALLEVQLRGKRFFGGDTVGYIDIVFCWLAPWLSVVEEVTGMTGRRKRVPCFVPDIHTARIALRLVVRETQQCISTVLYSDTVHL

SEQ ID NO: 22219 - DNA, 613 bp, Panicum virgatum
  misc_feature: Ceres CLONE 1820451
  misc_feature: Encodes the peptide sequence at SEQ ID NO. 22220
aacatctctcattctctcgtctctctcatctctcattctctacctctcatctctcccacctctcccactgccttatctctgtgagactgggagcggagggggcgcacgagagggccgagcgggccgccgccgccgcgggagccgagcgcggcccgcccaagccgggctcggccatccgcatctccgccaccttcgtcccggcgggcagcaccccgccgccctggctcctccccggcggcgtcccggcgttcttcccgccgcggcgcggctgcgacgtgaggctgtaccaggacgcgcacgtcggggccggtgagctgggcggcgagcccgggcggtgctgggaggagctgtgcctggcggtgctgggcacgcagcacctcgtctacgtggtgggctggtcggcgttcaccagggtccggctgctgcggggcgccatgtcgccggagatggcggccaaggcggccgaggtgagggcgctgggcggcgtggcggtggaggacatgagcctgggtgacctgctcaagtacaagtcccaggagggcgtccgggtgctcctcctctgcgaggacaccacctcactccacaacttcttcctacggacgaggggcgtgat

SEQ ID NO: 22220 - protein, 203 aa, Panicum virgatum
  misc_feature: Ceres CLONE 1820451
  misc_feature: SWISSPROT Homolog: EC 3.1.4.4 Phospholipase D
HLSFSRLSHLSFSTSHLSHLSHCLISVRLGAEGAHERAERAAAAAGAERGPPKPGSAIRISATFVPAGSTPPPWLLPGGVPAFFPPRRGCDVRLYQDAHVGAGELGGEPGRCWEELCLAVLGTQHLVYVVGWSAFTRVRLLRGAMSPEMAAKAAEVRALGGVAVEDMSLGDLLKYKSQEGVRVLLLCEDTTSLHNFFLRTRGV

SEQ ID NO: 22221 - DNA, 1079 bp, Panicum virgatum
  misc_feature: Ceres CLONE 1820497
  misc_feature: Encodes the peptide sequence at SEQ ID NO. 22222
cacggcccggcgcgacggagccgacggccgagatcgcgccgcgccgcgccgcgcataaaggacgccgcccgagcacggctgtggggagagaggcgaaaagcaggcaggcaggagcttgttgctggtgttgctcgtacgcgtccggagagcgaagggaaggggagggtgcgagcgagcgagcgtcagcgagcggtggccatggcggagcagcacaaggaggagtcggtgctggagaagatctcggacaagctccacggccgcgggggcggctcctcctcatcatcgtcggactcggacgacgaccgctcgtcggcgacggccgcagtgaaggccaagatctaccgcctcttcggccgcgagaagcccgtccactccgtcctcggcggcggcaagcctgccgatctgtttctatggaggaacaagaggatttctggtggtgtgcttgccggcgcaactgccatctggctgctgtttgaggtcatggactatcacctgctcaccctgctgtgccactgcctcatcctcaccctggccatcctgttcctctggtcgaatgccaccactttcatcaacaaatctcctcctaacatccctgaggtgaagatcccagaggacctgacagtgaatgttgcgcattcactgagatacgagatcaacaggggctttgctaccttgagggagatcggtcaaggccatgacttgaaaaagtttctgattgtgattgcaggactgtggatcctttctgtccttgggagctgctgcaatttcctcaccttgttctacatagtctttatggtattgtacactgtgccagtcctgtatgagaagtatgaggataaggttgatgcttttggagagaaggccatggtcgagctaaaaaagtactacgccatcttcgacgagaaatgcctatcaaagattccaaagggtccgtcaaaaggcaagaagctgcattagaagagtagaatcagaggatggtctgtgcactgatttatcaatctgtcaatcactacatgtcggttttgaagtatggttgtagttccatgtctccatgtaatggtaaatacatagatgaacgc

SEQ ID NO: 22222 - protein, 252 aa, Panicum virgatum
  misc_feature: Ceres CLONE 1820497
  misc_feature (66)..(249): Pfam Name: Reticulon Pfam Description: Reticulon
MAEQHKEESVLEKISDKLHGRGGGSSSSSSDSDDDRSSATAAVKAKIYRLFGREKPVHSVLGGGKPADLFLWRNKRISGGVLAGATAIWLLFEVMDYHLLTLLCHCLILTLAILFLWSNATTFINKSPPNIPEVKIPEDLTVNVAHSLRYEINRGFATLREIGQGHDLKKFLIVIAGLWILSVLGSCCNFLTLFYIVFMVLYTVPVLYEKYEDKVDAFGEKAMVELKKYYAIFDEKCLSKIPKGPSKGKKLH

SEQ ID NO: 22223 - DNA, 1515 bp, Panicum virgatum
  misc_feature: Ceres CLONE 1820498
  misc_feature: Encodes the peptide sequence at SEQ ID NO. 22224
aacccagccacgcccagctcggcccagccgccgctgcattccactctccgttctcccttcgcttccccgaagcaacgccgcagtagcaaggcacagccatggcgacggcggcggcgcaggcgctcccggcatcgatggacgcgcgcgggtgggacgaggcatcgtaccgccgtggcatcctacgtgctcgcgacttctcgtcgcgcaccctcttccgcgctgtcttcttcgaccacagcgacgactcggactccgacgtcctactcgccgccgcctccagcgatggctccctcgcctccttctccctttcatcctgcatatccgccgcttccgcctcctcccaggcggaggccgccgtcacgctggttgatcccgtctgcatcgtgcaggcgcacagcggccctgcctacgatgtcaggttctatcccgatccgcagcaaccgctgctcttcagctgtggggatgacggacgcatccgtggctggagatggcacgagatgcagagctgccttgtcccgctatccctgcaaggagatcatctagaaccagcacttgacttagtcaaccctcagcatgagggtccttggggtgctcgctctccaatacctgaaaacaatgccattgcaatcaataaacaggatggatccattttcgcagcagcgggtgatgcttgtgcttactgctgggatgtggagactggtaaatgtaaaatgacattcgaggggcatactgactatttgcacagtgttgcaattcgtgagtcaaaccgccaggtggtaacaggatcagaggatggaacagcccgtatctgggattgcagaagtgggaagtgtactcaagttgtacatccagtaaagaagaaagcatttgaaagctcatgggtcagttgtgttgccattgatgcaagtgaaagttggctggcttgtggcacgtctagtggtatatcagtttggagtcttctctcaaatgagtgcatctttaatttggattgccatgcccctgttcaagacttgctgtttgataagaaccaaattttggcagttggtgctgaacctgtgctctcccgtttcacaataaatgggaccattctatcacaaatagaatgtgctcctcagtcggcattctccatctccaaccattcatctgggatggcagctgttgctggatacggaggcctggtggatgtgatctcggaacttgggagccatctgtgcacattcagtagcaggggccttgacaagtaaattatccgtgagcaacgacccactcgaaacgtcgtgagaatgcaactttcactatccattgagcttttctgtgcaatgtgatggctatattttttgcgctgctctttcgcttgtttcgttcaatgttgtgtctgacaatgcactactgaccaagatggttcctagacagtgaatagatgctagtagctcatggaaatgcagaaaagatctgttctgattctcagtggtcaagaaacgggtgaacgttttattaaaacactgcttgttcatc

SEQ ID NO: 22224 - protein, 381 aa, Panicum virgatum
  misc_feature: Ceres CLONE 1820498
  misc_feature (201)..(239): Pfam Name: WD40 Pfam Description: WD domain, G-beta repeat
  misc_feature (90)..(130): Pfam Name: WD40 Pfam Description: WD domain, G-beta repeat
  misc_feature: SWISSPROT Homolog: EC 2.7.11.7 [Myosin heavy-chain] kinase
MATAAAQALPASMDARGWDEASYRRGILRARDFSSRTLFRAVFFDHSDDSDSDVLLAAASSDGSLASFSLSSCISAASASSQAEAAVTLVDPVCIVQAHSGPAYDVRFYPDPQQPLLFSCGDDGRIRGWRWHEMQSCLVPLSLQGDHLEPALDLVNPQHEGPWGARSPIPENNAIAINKQDGSIFAAAGDACAYCWDVETGKCKMTFEGHTDYLHSVAIRESNRQVVTGSEDGTARIWDCRSGKCTQVVHPVKKKAFESSWVSCVAIDASESWLACGTSSGISVWSLLSNECIFNLDCHAPVQDLLFDKNQILAVGAEPVLSRFTINGTILSQIECAPQSAFSISNHSSGMAAVAGYGGLVDVISELGSHLCTFSSRGLDK

SEQ ID NO: 22225 - DNA, 666 bp, Panicum virgatum
  misc_feature: Ceres CLONE 1820511
  misc_feature: Encodes the peptide sequence at SEQ ID NO. 22226
ggagaagagccgccgctctcggccacgtcttcctgcaaggctgcaccgcgaggcgaagcaatggcgaccacagcgccgctgctctcgccccagcgcggtcgcgctgcccatctcccccgccgcctcccggccccgcctctcgcctgtcccctccacgcgacggcaaggctgcggtcgcttctgagcctccgccgcgcgctgctcccgtgtggggccaagttcggcaagttcgacgcctcagacgcccccgcggaggccgaggaggaggaatctgcggcggacggtgcggtggcgcaggcgcagctggcggaggaggacgacagctgcttgccgtcggatttggagggcgcgattcggcagtcggggaaggcgagcgcggatttcgtcaactccggaggcatgcgagctatcgcagagctgctgatccctcagttggaattcctcaacgaggaaggagcgcaggcagagctctgggcattgtcaaagatcttcctggacacacttgtacaggagacaggacagaaagttaccgcgattttccccgatgctggagcagctgcccttctcaagtatcagtggacagatgcacaatttaagtgtgccagcttaagcgacaggaagccagttggtcccgaggatgagataaggcctcttataatgtggaac

SEQ ID NO: 22226 - protein, 201 aa, Panicum virgatum
  misc_feature: Ceres CLONE 1820511
  misc_feature: SWISSPROT Homolog: EC 3.6.1.31 Phosphoribosyl-ATP diphosphatase
MATTAPLLSPQRGRAAHLPRRLPAPPLACPLHATARLRSLLSLRRALLPCGAKFGKFDASDAPAEAEEEESAADGAVAQAQLAEEDDSCLPSDLEGAIRQSGKASADFVNSGGMRAIAELLIPQLEFLNEEGAQAELWALSKIFLDTLVQETGQKVTAIFPDAGAAALLKYQWTDAQFKCASLSDRKPVGPEDEIRPLIMW

SEQ ID NO: 22227 - DNA, 697 bp, Panicum virgatum
  misc_feature: Ceres CLONE 1820520
  misc_feature: Encodes the peptide sequence at SEQ ID NO. 22228
atcgcttcactcccgcagcgaccaagaacccattcgaaaaacagagcagtagcagagcggagcagaggaggaagaggggcagccaagccatggagatgggagacagcttcgagtactactgggagatgcagcgcttgttagaatccgacgagctcagcgtctacctgaatggcgcgcaggaagacgcgctgtcctgctacgactccagctcgccggacgggtccttgtccaactcgtcctgggcgctggcgccggcggcgaccgcggcggacgacgccagggggcccggcgcggccgcggccgagggcggcgcggcggagggggcggccaagaacatcatcatggagcgcgaccgccggcgcaagatgaacgagaagctctacgcgctgcgcagcgtcgtgcccaacatcacaaagatggacaaggcgtcgatcatcaaggacgcgatcgagtacatccagcagctgcagacggaggagcggcgggtgctgcaggagctcgaggccggcggcggcgcgcggcgaatggacgagtacgggtacgacgagggcgcgctcctgcgggcggagcgggcgaagaggctgaagcgcgcgcggcccgtcgccccggcggcggcgcccgtggaggtcctggagctgctcgtgtcggaggtgggcgagcgcgtactggtggtgagcgtgacgtgcggcaaggggcg

SEQ ID NO: 22228 - protein, 202 aa, Panicum virgatum
  misc_feature: Ceres CLONE 1820520
  misc_feature (80)..(127): Pfam Name: HLH Pfam Description: Helix-loop-helix DNA-binding domain
MEMGDSFEYYWEMQRLLESDELSVYLNGAQEDALSCYDSSSPDGSLSNSSWALAPAATAADDARGPGAAAAEGGAAEGAAKNIIMERDRRRKMNEKLYALRSVVPNITKMDKASIIKDAIEYIQQLQTEERRVLQELEAGGGARRMDEYGYDEGALLRAERAKRLKRARPVAPAAAPVEVLELLVSEVGERVLVVSVTCGKG

SEQ ID NO: 22229 - DNA, 557 bp, Panicum virgatum
  misc_feature: Ceres CLONE 1820528
  misc_feature: Encodes the peptide sequence at SEQ ID NO. 22230
accgcacaccgatccctgacttgatcctttgctctttgacttcacttggattcgtctgaggcaactctttccaagagattcaggggatccgggggagctgacccagggccatggatttgacccctagggctccggtgctggtgcgggcgctgctcctgggcctctgcagcggggtcggcacgccggcggcggcggaggggacgatctagtatggccgggaggtggacgtggggggacgggagcgggagcgggtcggcggacggccatgtcctgacgctggcgctggaccgcacctgcggctcctggttccgctccagggactcctacgtcttcacgctcaccgacatgcagatcgggctcgtcctcagcacctccttcgggtccttcgatgccttctccttcctctcccaggcgtcgtgggacgtgctcgaccacgtgcacctccactagcgggagctcgtgcgcgggcactcgtacacgctccacaccctcgtgttcctcggcggcaactgcggcaacgacctcccctgccacgtctggtgcgacgccgacctgga

SEQ ID NO: 22230 - protein, 79 aa, Panicum virgatum
  misc_feature: Ceres CLONE 1820528
  misc_feature: SWISSPROT Homolog: EC 2.4.1.207 Xyloglucan:xyloglucosyl transferase
  misc_feature: Useful for making plants with altered carbohydrate content
MAGRWTWGDGSGSGSADGHVLTLALDRTCGSWFRSRDSYVFTLTDMQIGLVLSTSFGSFDAFSFLSQASWDVLDHVHLH

SEQ ID NO: 22231 - DNA, 1594 bp, Panicum virgatum
  misc_feature: Ceres CLONE 1820540
  misc_feature: Encodes the peptide sequence at SEQ ID NO. 22232
acctgctcgccacggaaacctgccgcaatcgagagagagctcttggcgtccatggcaccggcgaagagtgtcgacttccccgctggcgccgacgacggctgttcggcaccgggcccaaatgagggtggcgagggccaccgcgacgacgtcgaggctggtggcacggcgatcgcaccggcaccggcgacgacgatgctgaggccgaggtgtcagcgggggcgcctggcctcgctcgacgtcttcagaggcatcaccgtcgtgcttatggtcgttgtggatgatgttggtggccttgttcctgccatcagccactcaccttgggacggcgtgacccttgcagattttgtgttcgctttcttcctcttcatcgttggagtctccttggcctttgcatacaagagagtgcctgacagagcgatcgcaaccaagaaggctgtgatccgggcttcaaagctcttccttctaggcctagtactgcaaggtggcttctttcacagcatccacgatcttacttatggagttgatgttcgcaagatacggttaatgggcatacttcagagaattgcaatagcgtacttaacggcggcactttgcgaaatatggctacgaggtggtgcaagtgacattggagctggtggctatacgttgatcagaagatatcatcatcagctgtttgtgggtttggttctcacggtcacctatacggcacttttgtatggcatgtatgtgccagactgggaatatgccgtcacatctcaagacaccactttgaagcactttatggtgaaatgtggagtccggggtgctacaggaccaggatgcaatgccgtgggcatgattgatcgacatgtccttggaatccaacatctctacacacgccctgtttacctcaggacagcgcaatgcagaatcaactccccacgaaatgggccgcttccgtcaaacgctcccacatggtgtgaagctccctttgatcctgaaggcctcctcagttccctgatggcgattgtgacctgcttgaccggcctgcaaattgggcatgtcattgtgcacttcaaggagcatggagagagaatagtgcggtgttcaattccatctctaagcttgctgattcttggattcttgcttgacttgtttggcctgcgcttgaacaagtcattgtatagtctgagctacacctgcgtcaccacgggcaccgcgggtctcttcttcgtaggaatctatttgctggtggatgtttatggttacaagaagccttttttccctatggagtgggtgggaaagcatgccctcatgatttttgttctagtggcatgcaacatcgccccaatcctgctacatggcttctattggagggaaccacagaacaaccttttgaaatttttcggaataggaggctgatcatgaccacgttccttcttgtcgactattatgattttaggataacaataacacgtcatacagcactggttttagtttcaaacagcagtcagccctacacagatgctaagattagaagctaagattagaatgggcccatactggtggaaatgttataattggcaatatgaactagtacgcaatcgtgttcagt

SEQ ID NO: 22232 - protein, 449 aa, Panicum virgatum
  misc_feature: Ceres CLONE 1820540
  misc_feature: SWISSPROT Homolog: EC 2.3.1.78 Heparan-alpha-glucosaminide N-acetyltransferase
MAPAKSVDFPAGADDGCSAPGPNEGGEGHRDDVEAGGTAIAPAPATTMLRPRCQRGRLASLDVFRGITVVLMVVVDDVGGLVPAISHSPWDGVTLADFVFAFFLFIVGVSLAFAYKRVPDRAIATKKAVIRASKLFLLGLVLQGGFFHSIHDLTYGVDVRKIRLMGILQRIAIAYLTAALCEIWLRGGASDIGAGGYTLIRRYHHQLFVGLVLTVTYTALLYGMYVPDWEYAVTSQDTTLKHFMVKCGVRGATGPGCNAVGMIDRHVLGIQHLYTRPVYLRTAQCRINSPRNGPLPSNAPTWCEAPFDPEGLLSSLMAIVTCLTGLQIGHVIVHFKEHGERIVRCSIPSLSLLILGFLLDLFGLRLNKSLYSLSYTCVTTGTAGLFFVGIYLLVDVYGYKKPFFPMEWVGKHALMIFVLVACNIAPILLHGFYWREPQNNLLKFFGIGG

SEQ ID NO: 22233 - DNA, 681 bp, Panicum virgatum
  misc_feature: Ceres CLONE 1820557
  misc_feature: Encodes the peptide sequence at SEQ ID NO. 22234
gaagacatttgtgaagctgcgatgggggctagggtttcctagtgccgcttccctccatcgccgccttcgctcagcgctccgctccacccggacggtagatcgagtcttctccaagtcaaatcacatttggatctctaggcgtgcgcgaggagacaaggagcgagcagatcagcaccgcacctgctcctgggcagcggcgagcagattggcaccctcctccccatcggcgacctccctctccgtcgggcatcagcgaataggggccgttcccgtccgcagcttcactccccaccggggattcgacaccgtctgcgcctccttcccgttcgggtgtgagcgtcactgaaacagcaagatcggtgccccgacgtcccatcgacgacctccctcaaccgcacggagaggccggggtttggcctgagagaatgcaagatcctaacggcgacgatttctctgccccaaagttgcacaagaagaaggttgtataccggccgcttccatcaggcatgctgaagggtgaacctgaactgctgcgtagagaggttccgcattcatcaggcatggtccataagctgcccaaaagaagcatgaagagtgagcgcccagccacacctccatctgacagagggactcctgattccctgccggactctggtcctaccgatgaatatcgtgcgctgc

SEQ ID NO: 22234 - protein, 85 aa, Panicum virgatum
  misc_feature: Ceres CLONE 1820557
  misc_feature: Useful for making plants with modulated nitrogen use efficiency
MQDPNGDDFSAPKLHKKKVVYRPLPSGMLKGEPELLRREVPHSSGMVHKLPKRSMKSERPATPPSDRGTPDSLPDSGPTDEYRAL

SEQ ID NO: 22235 - DNA, 1077 bp, Panicum virgatum
  misc_feature: Ceres CLONE 1820589
  misc_feature: Encodes the peptide sequence at SEQ ID NO. 22236
atcgtcttccggtctctccccccttccccgatcccctcccggcctccccactccgatccgatccaatcccccccgccgccgccggccatgtccaagtacggcaccatccccacctcctcctccgcgggcggcggggcgcccctcgggggcgcctccccgctcgacttcatctcccgcgccaaggcccgcggcgcctcggcgctggccacgcgccggccctggcgcgagctcggggacatccacgccatcggcctgcccccgagcctcggcgacgcctacctccgcgtgcgcgccaacctcgcccacttcgccatgaactacgccatcgtcgtcctcgtcgtcgtcttcctctccctgctctggcaccccgtctccctcatcgtcttcctcgtctgcatgctcgcctggctcgtcctctacttcctccgcgacgacccgctcgtcttcttcggccgcgtcgtcgcggacggctacgtcctcgccgcgctcgccgtcgtcacgctcggcctgctgctgctcaccgacgccaccgccaacatcctgtcctcgctgctcatcggcctcgtgctcgtcgtcctccacgccgcgctgcacaaggcggaggacaacgccgacgacgaggtcggacgctggtacgcgccggtgcctcagcagccgtcgcactaggagctgagttgtgtcattgcgccttgtgttgtgaccctgaatacctgtttccaaagtattcctcatgagccgtgcaaattggtccatcccctgaccatgatgaagaacgtgtctcacctgctgctggccggttctgctggctggtggaagttctggatccagcaatgatgcggagttgtaacatgctgttcacgcccacttttgtgatcttggttcaaagcttctccttgttcccatgtaccaaatccggactaaagtctactgtacattttgagttcgagaaatgtgatggccgggacctgtgtttttatattgttacggtcaccatgtaggcaatgttgatgctcaaacatggcttcggtttctgtcatactatctttcttagcatggagaaaaatactgttggttggt

SEQ ID NO: 22236 - protein, 192 aa, Panicum virgatum
  misc_feature: Ceres CLONE 1820589
  misc_feature (34)..(180): Pfam Name: PRA1 Pfam Description: PRA1 family protein
MSKYGTIPTSSSAGGGAPLGGASPLDFISRAKARGASALATRRPWRELGDIHAIGLPPSLGDAYLRVRANLAHFAMNYAIVVLVVVFLSLLWHPVSLIVFLVCMLAWLVLYFLRDDPLVFFGRVVADGYVLAALAVVTLGLLLLTDATANILSSLLIGLVLVVLHAALHKAEDNADDEVGRWYAPVPQQPSH

SEQ ID NO: 22237 - DNA, 637 bp, Panicum virgatum
  misc_feature: Ceres CLONE 1820591
  misc_feature: Encodes the peptide sequence at SEQ ID NO. 22238
aaatccagcagaggacggaacgagagctagggttttgattccggccgcgcggcgcctcccccctcctccctccctccctcccaaacgcatccggcggcatcggcgggcgaagtctcggggagacaccaaggtcgggagagcctgaagcggcgtaccctccacccaatcgccgacccccccgcgcgccgcaagagttgcaattgcactattggagtttgccacttggttgttcattgaacaatttaaatatgtcatattacgcaagaaggggtggagataggggtagtggccgtatccaaggaagtggtgggcgaggtggctatgccctgcgtggaagatcaggactgcctcctcgaggtcctcttggtgttagctcccgaccatctgcacgcactattactaagtcatttagcagaaccaaagacatgacttggagacctgatctatttagtgatagtatggcggctagtggaatagaaactggtacaaaattgtacatttcaaacttggattatagggtttctaatgaggatataaaggagctgttttcagaagttggtcatttgaaacgctttgctgttcactacgatggttatggccaccctaatggcactgcagaggtggtgtttacacggcg

SEQ ID NO: 22238 - protein, 129 aa, Panicum virgatum
  misc_feature: Ceres CLONE 1820591
  misc_feature: Useful for making plants with altered alkaloid content
  misc_feature: Useful for making plants with modulated biomass
MSYYARRGGDRGSGRIQGSGGRGGYALRGRSGLPPRGPLGVSSRPSARTITKSFSRTKDMTWRPDLFSDSMAASGIETGTKLYISNLDYRVSNEDIKELFSEVGHLKRFAVHYDGYGHPNGTAEVVFTR

SEQ ID NO: 22239 - DNA, 1064 bp, Panicum virgatum
  misc_feature: Ceres CLONE 1820592
  misc_feature: Encodes the peptide sequence at SEQ ID NO. 22240
gcatcagttccgtcttctcctccccaccccgcctcccgtcgtctcctctccggccggccggcgtcctcccctgcttgccggtcactcagttgattttagactcaagatggcggtcgttttgtcaaatgtcaactctgaggcaggccttcaaaagcttaaccattacctcctcacccgaagttacattaccggataccaagcttcaaaggatggcatggctgtcttcactgcattgtcatcagctcccccatcgagctatgtcaatgttacaaggtggtacgatcatatcagtgctctccttaggtccagtggagtcattgccgaaggtgaaggtgtcaaggttgagtcatccgcttgttctgtggcttcaactcctggagttgctggccaaaagccatcgacagctcatgaagatgatgatgatgttgacctattcggtgagtagactgaagaggagcgtgcagtagcagcagcacgtgcagcagctgttaaagcttctggcaagaagaaagagtctgggaagtcatcagttcttctagatgtgaagccatgggatgatgaaactgacatgcaaaaacttgaggaagctgttaggagcgtgaagatggaaggtctgctctggggtgcatcaaaacttgttccagttggatatggcatcaagaagatgcaaattatgatgaccattgtggatgaccttgtttctgtcgacagtctgattgaggatcatctctgcactgagccaggcaatgagtacattcagagctgcgacattgtggcgttcaacaaaatctaaactggatcatcagggagccaaagttgaatggaacaccttgttaaagttccattgctgcctccgacgctcatcatagcaatcaccattatatctgttttgcctttgaacttgtttgctttaaaactgactgcatttgccacagaaagatgctagtttggatgttaatttttggaactcagcgcctcctttttctgttgtttggttctgctatttatgttttggaagcgcgtcgacagttttaacttgactgttttggaatcccggttacatt

SEQ ID NO: 22240 - protein, 112 aa, Panicum virgatum
  misc_feature: Ceres CLONE 1820592
  misc_feature: SWISSPROT Homolog: EC 6.1.1.16 Cysteine--tRNA ligase
MAVVLSNVNSEAGLQKLNHYLLTRSYITGYQASKDGMAVFTALSSAPPSSYVNVTRWYDHISALLRSSGVIAEGEGVKVESSACSVASTPGVAGQKPSTAHEDDDDVDLFGE

SEQ ID NO: 22241 - DNA, 691 bp, Panicum virgatum
  misc_feature: Ceres CLONE 1820605
  misc_feature: Encodes the peptide sequence at SEQ ID NO. 22242
gacacttgaagtggccaaaagttgcctggatatgataagctaggggcaaaggtttccactgaaaacatggattctgggtgtgacgagtagtcatcagcaattcagcaggcaaacggagggggccgtcacagcaagcgcgtggtgaccgcggtcgtcgcgaccgtcgccggcgtgctcctcctgctggcggtcggctgcttcgtctggaggaagaggaggaaacgtcagggcgagacggattcgacgtcggcgccggccggtggagaggatgtgctcccgttcagggccaggaaacacccggcgctagaggaggattggaaatgcgccaagaaagacgtcgacctcccgttgtttgacctggaggtgatcctggccgccaccgacagctttgctcttcacaacaagattggcgaaggcggatttggtccggtttacatggggaagctcgaggacgggcaagaagtagccgtgaagaggctgtcccggagatcgatgcaaggggcggtggagttcaagaacgaggtgaagctgatcgccaagctccagcacaggaacctcgtgaggctgctcggctgctgcatcgacgaggacgagaggatgctcctgtacgagtacatgcacaaccagagcctcgacaccttcatatttgatgaaaggaagcggaggttgctgaggtggcagaagcgctttg

SEQ ID NO: 22242 - protein, 85 aa, Panicum virgatum
  misc_feature: Ceres CLONE 1820605
  misc_feature: SWISSPROT Homolog: EC 2.7.11.1 Non-specific serine/threonine protein kinase
  misc_feature: Useful for making plants with altered carbohydrate content
  misc_feature: Useful for making plants with altered cell wall content and/or composition
  misc_feature: Useful for making plants with modulated biomass
MGKLEDGQEVAVKRLSRRSMQGAVEFKNEVKLIAKLQHRNLVRLLGCCIDEDERMLLYEYMHNQSLDTFIFDERKRRLLRWQKRF

SEQ ID NO: 22243 - DNA, 632 bp, Panicum virgatum
  misc_feature: Ceres CLONE 1820611
  misc_feature: Encodes the peptide sequence at SEQ ID NO. 22244
accagtgccaagaatcccctcgatcagaagaaaaaaaccagaaaaacccggcgaaaaatcccatctttccctccattccgctctcgattccgcggagagaggagccctgggcgaatccgccaaccacgaccccccgatcgccaccaacaaccagcccaccggggaggaggggacgggtgagagggcggcgaccccgcaggaggaggaggaggagagggtgccgtacctccagttcgtgcagcagggggcggggcaggggctggggctggcggccgcggcctacgcgtacgcccaggagggcgccgggccgctccgccccggcgtccaccactttgaggggaccggccagggcggcgtcgggcccgtctaccaacgcttccacgccgttttttttcacctcctcaagttcctccaccgcaagggtggcgagtccgttgaagaaattgaccgacgtgtccctccagtggtgaaggaagcccccaccctcccccgctctgctgcccaggaggtccgtccagctgggctggtgggcaccgccactggcctcgcaaagtccggcatcgaccgtgcagaacccaagggcagggagctctacacccgctacgagcccgtggctgaacgccgcgcagctg

SEQ ID NO: 22244 - protein, 210 aa, Panicum virgatum
  misc_feature: Ceres CLONE 1820611
  misc_feature (64)..(210): Pfam Name: REF Pfam Description: Rubber elongation factor protein (REF)
PVPRIPSIRRKKPEKPGEKSHLSLHSALDSAERGALGESANHDPPIATNNQPTGEEGTGERAATPQEEEEERVPYLQFVQQGAGQGLGLAAAAYAYAQEGAGPLRPGVHHFEGTGQGGVGPVYQRFHAVFFHLLKFLHRKGGESVEEIDRRVPPVVKEAPTLPRSAAQEVRPAGLVGTATGLAKSGIDRAEPKGRELYTRYEPVAERRAA

SEQ ID NO: 22245 - DNA, 591 bp, Panicum virgatum
  misc_feature: Ceres CLONE 1820613
  misc_feature: Encodes the peptide sequence at SEQ ID NO. 22246
accatatccgccgccggctcctcgtccttttggcatccagatcccatccccgtctttcatcctcgcggcacccttcgccatgggcaagattaagatcggaatcaacggtttcggaaggatcggcaggctcgtggcccgtgtcgccctccagagcgaggatgtcgagctcgtcgccgtcaacgaccccttcatcaccaccgagtacatgacctacatgttcaagtacgacaccgtgcacggccactggaagcacagtgacatcaacctcaaggactccaagacccttctcttcggtgagaagccggtcactgtcttcggcttcaggaactttttttatatcccgtggggtgaagctggtgcctactatgttgtggagtccactggtgtcttcactgacaaggacaaggctgcggctcacttgaagggtggtgccaagaaggttattatctctgctccaagcaaagatgcccctatgtttgttgttggtgtcaatgaggacaagtacacctctgatattaacattgtctccaatgctagctgcaccacaaattgccttgctcccctcgctaaggtcatcaatgacaactttgg

SEQ ID NO: 22246 - protein, 170 aa, Panicum virgatum
  misc_feature: Ceres CLONE 1820613
  misc_feature (4)..(154): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MGKIKIGINGFGRIGRLVARVALQSEDVELVAVNDPFITTEYMTYMFKYDTVHGHWKHSDINLKDSKTLLFGEKPVTVFGFRNFFYIPWGEAGAYYVVESTGVFTDKDKAAAHLKGGAKKVIISAPSKDAPMFVVGVNEDKYTSDINIVSNASCTTNCLAPLAKVINDNF

SEQ ID NO: 22247 - DNA, 664 bp, Panicum virgatum
  misc_feature: Ceres CLONE 1820616
  misc_feature: Encodes the peptide sequence at SEQ ID NO. 22248
actcttcgcgccgccggagcacccaaattctcatccccctcactcaccggagcgccgcagccccctcaccacccccacccttcacccggccatggcggagcgcggcggagagcgcggtggcgagcgcggcgggttcggccggcgcttcggccgcggcgaccgtggcgggcgccgtggtggccggcgcgggcagcgccaggaggaggagaagtgggtccccgtcaccaagctcggccgcctcgtgaaggagcaaaagatcagcaagatcgaggagatctacctacactcgctccccgtcaaggagcaccagatcgtggagaccctcgtccctgggctcaaggacgaggtcatgaagatcacgcccgtgcagaagcagacgcgcgccgggcagcgcacccgcttcaaggccttcgtcgtcgtcggagactgcgacggccacgtcgggctcggcgtcaagtgcgccaaggaggtggccaccgccatccgcggcgccatcatcctcgccaagctctccgtcgtgcccgtcaggagggggtactggggtaacaagatcggccagccgcataccgtgccctgcaaggtcaccggcaagtgcggttccgtcaccgtgcgcatggtgcccgctcccaggggttccggcatcgtcgccgcgcgcgtgcctaag

SEQ ID NO: 22248 - protein, 190 aa, Panicum virgatum
  misc_feature: Ceres CLONE 1820616
  misc_feature (81)..(147): Pfam Name: Ribosomal_S5 Pfam Description: Ribosomal protein S5, N-terminal domain
MAERGGERGGERGGFGRRFGRGDRGGRRGGRRGQRQEEEKWVPVTKLGRLVKEQKISKIEEIYLHSLPVKEHQIVETLVPGLKDEVMKITPVQKQTRAGQRTRFKAFVVVGDCDGHVGLGVKCAKEVATAIRGAIILAKLSVVPVRRGYWGNKIGQPHTVPCKVTGKCGSVTVRMVPAPRGSGIVAARVP

SEQ ID NO: 22249 - DNA, 686 bp, Panicum virgatum
  misc_feature: Ceres CLONE 1820617
  misc_feature: Encodes the peptide sequence at SEQ ID NO. 22250
atggaatctggatccgcccggcctctcgtctccgccgccctcttccccgcgcctcgggcgctccgcccagagcgcatcgccctcgctgagcttccaaagtcctccacctccaacacccgccaatcgaaatcctccgctcccgtgcccgtgctccgtcgcggctccaaataccccgcccccatctccgaagcacgccgctccctctggcttcccgcctcctcgcctgctccgcgtcccgccgcaccctcatggccaccgccgccgctgccgccgcagcagcagcagtctcctccccggccgccccgcgcgccgcggccaccgcccgccggggattcgtcacgttcggcgggggcgcctcccgctcctcgcccgcgctgcggcccggccgcgggctctccggagtgcgaacccatgttgcagctgttgaacaagctgttgcaaaagatgctaccaagctggatgcaccagttgttgttgttacaggtgcctccagagggattggaaaggctgttgctttagcccttggaaaagcaaggtgcaaggttctggtgaactatgcccggtcatcaaaagaggctgaagatgttgccaaagcgattgaagcggctggtggtgaggccattacatttggaggagatgtttcaaaagaagctgatgtagaatctatgatgaaagcagctctgaat

SEQ ID NO: 22250 - protein, 145 aa, Panicum virgatum
  misc_feature: Ceres CLONE 1820617
  misc_feature: SWISSPROT Homolog: EC 1.1.1.100 3-oxoacyl-[acyl-carrier-protein] reductase
MATAAAAAAAAAVSSPAAPRAAATARRGFVTFGGGASRSSPALRPGRGLSGVRTHVAAVEQAVAKDATKLDAPVVVVTGASRGIGKAVALALGKARCKVLVNYARSSKEAEDVAKAIEAAGGEAITFGGDVSKEADVESMMKAAL

SEQ ID NO: 22251 - DNA, 541 bp, Panicum virgatum
  misc_feature: Ceres CLONE 1820632
  misc_feature: Encodes the peptide sequence at SEQ ID NO. 22252
atgattttgcttcgcccatccctgtgcgttccttgtcttgccccctgtactttgcttttgaactagcgagaattgattcaatccctggtcaaacctcgcatcctgatggtgccgctgccggcccccggccgcttcacccccaagagggagctctgccaccggtaggcccagcactgtttccaggtcaccttccccgagcccgaatagcctcccgggcctttcgtaaacacgctgcaggctgcgggcggtccggccgcactggccggtctccaactggctcccttcccagactggttggagcgggaggaactgttggacctcctcaaggtcatccactcataccaccggcacattccgggctagctgaagctgctcctcgccaaaatgaaagcgtcggggacgttctgcgtgaattggatcctctgacacatgtacatgtgggcgagcttctccctctccgaacagttcggactctgcctgatcacactctggacggcggcggccgcatgcttacccatttttatcactatccccatgctat

SEQ ID NO: 22252 - protein, 37 aa, Panicum virgatum
  misc_feature: Ceres CLONE 1820632
  misc_feature: Useful for making plants with altered carbohydrate content
MYMWASFSLSEQFGLCLITLWTAAAACLPIFITIPML

SEQ ID NO: 22253 - DNA, 1467 bp, Panicum virgatum
  misc_feature: Ceres CLONE 1820633
  misc_feature: Encodes the peptide sequence at SEQ ID NO. 22254
agcggagcccccaaccccaactcgacccgggaaggagagagggatagagattggagaggccgcggcggggagggcgccggcagcggcagccggagatgggggaggtggccgcgctgcgccagctcgtcggccaggtgcaggagctctgggacctctacggcgcccacgcccacccgctccccagatggtatttacttgactttgaacatggttcaatcaaagatgattattgtggaggacggactggatacaactcggaattactgaagatcatggagactaaccaatctcctcctcgcaagcgactgcggagagatcgaaaccgcgagaaagagctctgctcaaacacaactgcggtaatgcaacaggagatttggaaagagttccctgaagatctatttgaaactgtcattacaaggcttccagttgctgcaatttttcgattccgcactgtctgccgaaagtggtcttctcttttgggctcagacagtttctctcatcagtactctgaagctccacatggactgccatggttctatacaatcacccatgagaatgcaaacaataatgttgcaatgtatgacccttcactgaagaaatggcaccacccatctgttcctcttgctcctacaaagatagttattccagtggcatctgtgggtggccttgtctgtttattggatctgaaccacaggaatttctacatttgcaaccctcttaggcaatcactcaaggagatcccacccagatcagtccagggatggtcaagagtcgcagtagggatggtgttgaacggaagaagttctagtcatggctacaaagtaatgtggttaggaaatgatgggacttatgaagtgtatgactctacaaagaacatgtggtcttgtccaggagtttttcctacaagcatcaaactgccacttgctctgaatttcaggtcacagcctgtggcggttggcagcacgctatacttcatgtgtgcagaaccagatggtgttttgtcatatgatgtaagcacagggatttggagacagtttgccatcccactgccactgcatctgactgaccacacacttgccgagttccagggaagggtcatgcttgtgggtctgctgtgcaagaatgcagcgacctgtgtctgcatatgggagttgcagaagatgactctcctctggaaggaggtggacagaatgccaaatatctggtgcttagagttctacggtaagcacatgaagatgacatgcctgggcaacagtggtttgctcatgctctccttgaaggcaaagcggatgaaccgccttgttacgtacaaccttttgaaaagggagtggcagaaggttcctgattgcatgctcccatgcagccgcaaaaagcagtggatagcatgtggcacagcatttgatccgtgcccctctgccttggcctgacagggcttttaccttcttcagcgaagcatggtgaaatttt

SEQ ID NO: 22254 - protein, 443 aa, Panicum virgatum
  misc_feature: Ceres CLONE 1820633
  misc_feature (92)..(139): Pfam Name: F-box Pfam Description: F-box domain
MGEVAALRQLVGQVQELWDLYGAHAHPLPRWYLLDFEHGSIKDDYCGGRTGYNSELLKIMETNQSPPRKRLRRDRNREKELCSNTTAVMQQEIWKEFPEDLFETVITRLPVAAIFRFRTVCRKWSSLLGSDSFSHQYSEAPHGLPWFYTITHENANNNVAMYDPSLKKWHHPSVPLAPTKIVIPVASVGGLVCLLDLNHRNFYICNPLRQSLKEIPPRSVQGWSRVAVGMVLNGRSSSHGYKVMWLGNDGTYEVYDSTKNMWSCPGVFPTSIKLPLALNFRSQPVAVGSTLYFMCAEPDGVLSYDVSTGIWRQFAIPLPLHLTDHTLAEFQGRVMLVGLLCKNAATCVCIWELQKMTLLWKEVDRMPNIWCLEFYGKHMKMTCLGNSGLLMLSLKAKRMNRLVTYNLLKREWQKVPDCMLPCSRKKQWIACGTAFDPCPSALA

SEQ ID NO: 22255 - DNA, 1060 bp, Panicum virgatum
  misc_feature: Ceres CLONE 1820634
  misc_feature: Encodes the peptide sequence at SEQ ID NO. 22256
actcgccgcgggtctgccgcaggcgtcttcccgaagccaacgcaaccgcttccttctccgcctcctctccgctcccttccccgctcccattccgccaccgccgctccacgcgagtccacaagtaaagcggcggcgcgagcagccaggagccgcggttcctcgcgcggagggggttgcgaaaccgagcgccgcaggcggccggcattcctgtggtccggcgagatgttgggggagctcctgtcgaagatcctgctgctgctcttcgggtacgccatgccggcgttcgagtgcttcaagacggtggaggcgcgccccaacgacgcgcccatgctccgcttctggtgccagtactggattattgtggccatggttatagcctttgagagcgtgatctcttggatgccgatgtattcagaaatgaagctggctttctttgtctatctctggtaccccaaaacaaagggaagtgatgttgtatatgacacctttcttcggcccatagtgatgcaatatgaaccaaacatcgagcagaggctactgcatctgagggcgaaatctgggcaactgcttagcttctacttgaagaatttcgcagacaaagggacagccttcttcatggatgtcctccgctatgtcgtatcagataaacctgaaggatccaatgcagagaggaacaagaagtccggctggagccccttcgccaccaagcgccggccgccgtcaccgccaccgcaggagtccatcttcgagagcaaccctgacgccgccgtggtggccgaggctctgcgcgctacaatcggcgccgcagggggaggcgccaggccccggcgagcacccaacggcaagcattactagagtgaaatcaagagactcctacagaaactataggggatgattttatttgttgtacatagaatgtatggatgaatcaaagaaaaacagagagaaaagggagagtacatagcacaatcagcaacaaattgaccattcacaattgtgaagaacaatggatgtgtatcaagtatggttcaggtgatatgatagaaatcattagtttttc

SEQ ID NO: 22256 - protein, 210 aa, Panicum virgatum
  misc_feature: Ceres CLONE 1820634
  misc_feature (2)..(94): Pfam Name: TB2_DP1_HVA22 Pfam Description: TB2/DP1, HVA22 family
MLGELLSKILLLLFGYAMPAFECFKTVEARPNDAPMLRFWCQYWIIVAMVIAFESVISWMPMYSEMKLAFFVYLWYPKTKGSDVVYDTFLRPIVMQYEPNIEQRLLHLRAKSGQLLSFYLKNFADKGTAFFMDVLRYVVSDKPEGSNAERNKKSGWSPFATKRRPPSPPPQESIFESNPDAAVVAEALRATIGAAGGGARPRRAPNGKHY

SEQ ID NO: 22257 - DNA, 722 bp, Panicum virgatum
  misc_feature: Ceres CLONE 1820635
  misc_feature: Encodes the peptide sequence at SEQ ID NO. 22258
ctgcctgcgctgcactgtcacactcgcacgcgctccgcacgctctcggcagccgcagacgcccccgctgcgacccgggggagagaggcagacagccatggccgccgcggcgggcgacgacgccgggatggacgccgtccagaggcggctcatgttcgaggacgagtgcattttggtggatgagcaggacaatgttgttggacacgaatcaaaatacaactgccatctgatggaaaagattgaatctgagaatctgctccatagggctttcagtgtgttccttttcaactcaaaatatgagctgctactccagcaaaggtctgcaacaaaggttacatttcctttagtttggacaaacacctgctgcagccatcctctgtaccgtgagtctgaacttatccaggagaactaccttggtgtgagaaatgcagcacagaggaagctcctggatgagctgggcatcccagctgaagatgccccagtcgaccaatttacccctgttggtcggatgctctacaaggctccatctgatggaaaatggggcgagcatgagcttgactctatcctgatcattgtccgagacgtgaagctgcagccgaacccagatgaggtcgccgacgtgaagtatgtgaaccgcgagcagctcaaggagctgatccagaaggcggacgctggtgaggatggcgtgaagctctcccccctggttcgggtgatcgtcgacac

SEQ ID NO: 22258 - protein, 208 aa, Panicum virgatum
  misc_feature: Ceres CLONE 1820635
  misc_feature (54)..(199): Pfam Name: NUDIX Pfam Description: NUDIX domain
  misc_feature: SWISSPROT Homolog: EC 5.3.3.2 Isopentenyl-diphosphate Delta-isomerase
MAAAAGDDAGMDAVQRRLMFEDECILVDEQDNVVGHESKYNCHLMEKIESENLLHRAFSVFLFNSKYELLLQQRSATKVTFPLVWTNTCCSHPLYRESELIQENYLGVRNAAQRKLLDELGIPAEDAPVDQFTPVGRMLYKAPSDGKWGEHELDSILIIVRDVKLQPNPDEVADVKYVNREQLKELIQKADAGEDGVKLSPLVRVIVD

SEQ ID NO: 22259 - DNA, 1393 bp, Panicum virgatum
  misc_feature: Ceres CLONE 1820652
  misc_feature: Encodes the peptide sequence at SEQ ID NO. 22260
agccaattggggttttcttcccaccacagccgccaatcgaagggagcgagccgggagtagaggaaggaggaagggagcaagaagaaggagaggaggaggagcaccgtgaggaggaggacgccgtcgagcctgcgcccccgatcggctacttcgacgcccctgctcggcactactctgcgacaccccgcccctgctccgactcaccgccgcgtcgagcccgtcctccccgaaccgccaggtcctgctactgaagagaagaccgacgaccaggactaccaggagtctcaggagttctacgaggagcactcaggagcagaaccaaactggtgatcattggtatggcggactgagcccccccgatgaccaccgtgaaccggaaaaagtgtggtggcgggcggcagatcagggccactatgtgcccaaaagtgaccccagtttttcaaaaaaagcaaaaagcaaaagcttaccaagactatgggtcaagtcgccgctgcatgcaacagcggtgtgattgggcgactggaaagtgcgatgatgcaacaagcacgaagaaacagcaatatatggtggcgactcgagccttcgggcgagctagcaagcaagcatcccatttgcagcgggcacgcatactttgtcttctcgctcggccgaaaaatagaggagatacagttcgagagttcgagtgttgccggatatcaaataaaccaaagcaggttttagaaacctcccaaagctctgttcggcgcgacaagtgggagatgcttgtgttgcttgtgttgctgcttctctgccatggactcggcaacacccatggctcacaggacgaccacgccggcgacggcgacatgctctcgctgctggatttcaagagggccatcaccagcgacccaactggagccctggcctcgtggaacacaagcaaccccttgtgcaggtgggcggggatcacatgcggccgggcgcaccgggggcgtgtgatcacatcactggaacttgcaggccagggcctcaaaggtgaaatcacctcctctcttggaaatctcacgtctctgaggacgctgaacctgtccataaacagcttctccggccgcttgcctcctctgggccgtctcggcaaactggaggaccttgatctgagcttgaacttgttgggcgatgctattcctgatggaattgccaattgctccagacttcgtatacttgacctctcttggaacttcctagtcggtgaacttcaccctaatgttggcttactttctggtctctcagttttatatctatgggagaatagacttgcaggaaccatcccaccgtccctcggcaatatgactcacctagaacaactcgatctaggatataataatctgtcgggaagtatccccgccgagctcgg

SEQ ID NO: 22260 - protein, 344 aa, Panicum virgatum
  misc_feature: Ceres CLONE 1820652
  misc_feature (159)..(199): Pfam Name: LRRNT_2 Pfam Description: Leucine rich repeat N-terminal domain
  misc_feature: SWISSPROT Homolog: EC 2.7.11.1 Non-specific serine/threonine protein kinase
MTTVNRKKCGGGRQIRATMCPKVTPVFQKKQKAKAYQDYGSSRRCMQQRCDWATGKCDDATSTKKQQYMVATRAFGRASKQASHLQRARILCLLARPKNRGDTVREFECCRISNKPKQVLETSQSSVRRDKWEMLVLLVLLLLCHGLGNTHGSQDDHAGDGDMLSLLDFKRAITSDPTGALASWNTSNPLCRWAGITCGRAHRGRVITSLELAGQGLKGEITSSLGNLTSLRTLNLSINSFSGRLPPLGRLGKLEDLDLSLNLLGDAIPDGIANCSRLRILDLSWNFLVGELHPNVGLLSGLSVLYLWENRLAGTIPPSLGNMTHLEQLDLGYNNLSGSIPAEL

SEQ ID NO: 22261 - DNA, 1098 bp, Panicum virgatum
  misc_feature: Ceres CLONE 1820655
  misc_feature: Encodes the peptide sequence at SEQ ID NO. 22262
atctcgattctgtagttgtgaagtttgacaactgagctcagcaaagttatccaaaatttaagagtgacgcacaaagccagagagagagagcaatggcgcactaccagcaggggcagccgaccacccgcgccgtcgacgagtacggcaacccgattcctggtggccacggtattcaggggcaggccggcgggtacggcgccgcgggcaccgccggcggctacgacgccgggggatacggcggccagcaggccgggtatggccccaccggcaccggtacgcacgacgtcgggggctatggcggcgctggtcagccaggtttcggaatgcacggcaccggtgggcacaccggcggcgtgcccggagccacggggatgggtacccagggcaccggtcacggcgcacaaggagtgactggaacccacggcgccgcgttccctcacggagctgagcacaagacgggcggaatcctccgccgctccggcagctcctccagctccagctcgtcatctgaggatgacgggatgggcggtcgaaggaagaagggcctcaaggagaagatcaaggagaaaatgcccggagggcacaaggacaaccagggccagcacgcgacggcccccggagcgtacggcggcacgacagggtatgctgggtcgaccggcaccggcgccaccggtgagaataagggcatgatggagaagatcaaggagaagctcccgggcggccacaaggacggcgaccggcaccacaccacggcgaccggcggttacgggcccggccgcacgggaaccaccgacacatacgggacgaccacggaggggacgcacgagaagaagggcttcatggataagatcaaggagaagctccccggccagcactgagcaagatcccactcgcctcccaagtttgtcgtgtcaagtacagaataaaattgaccaagaataaagcggcagctctgtctgtactggtatatgtgtgtctgcgctgtacctagctaccttgaatttccttgttctgagtaaaatcttgtacgtgtgtagttcttagtgtgtttatttccgatgtgatcttgtgaaaaataaaattgtgtccttccatggt

SEQ ID NO: 22262 - protein, 261 aa, Panicum virgatum
  misc_feature: Ceres CLONE 1820655
  misc_feature (11)..(261): Pfam Name: Dehydrin Pfam Description: Dehydrin
MAHYQQGQPTTRAVDEYGNPIPGGHGIQGQAGGYGAAGTAGGYDAGGYGGQQAGYGPTGTGTHDVGGYGGAGQPGFGMHGTGGHTGGVPGATGMGTQGTGHGAQGVTGTHGAAFPHGAEHKTGGILRRSGSSSSSSSSSEDDGMGGRRKKGLKEKIKEKMPGGHKDNQGQHATAPGAYGGTTGYAGSTGTGATGENKGMMEKIKEKLPGGHKDGDRHHTTATGGYGPGRTGTTDTYGTTTEGTHEKKGFMDKIKEKLPGQH

SEQ ID NO: 22263 - DNA, 330 bp, Panicum virgatum
  misc_feature: Ceres CLONE 1820667
  misc_feature: Encodes the peptide sequence at SEQ ID NO. 22264
agccacagacctcaaaccgaccgggcggcgatggtgtcggactcggagctggtggagcggctgcaggaggtgctgcggtcgtcggacctcaacaccacgaccaccgccgccctgcgccgccgcctcgaggaggacttcggcgccgacctctcccacaagaaggccttcatccgggagcaggtcgacctcttcctcgccgaggtcgccgcaaaggccgagccggaggagcccaaggaggaggagcccgaggaggcagcggtgcccaaggaggaggagccgggggtggagccggaggagggcgagggggacttcccgcccccgggcctcctg

SEQ ID NO: 22264 - protein, 99 aa, Panicum virgatum
  misc_feature: Ceres CLONE 1820667
  misc_feature (3)..(56): Pfam Name: DEK_C Pfam Description: DEK C terminal domain
MVSDSELVERLQEVLRSSDLNTTTTAALRRRLEEDFGADLSHKKAFIREQVDLFLAEVAAKAEPEEPKEEEPEEAAVPKEEEPGVEPEEGEGDFPPPGL

SEQ ID NO: 22265 - DNA, 659 bp, Panicum virgatum
  misc_feature: Ceres CLONE 1820675
  misc_feature: Encodes the peptide sequence at SEQ ID NO. 22266
aacatagcttgttcattccctggctggctggcttcccactcttcactcgcacaaaacgcacatgcgtggcacagatagagatatgccaagcatgcccgccgtctcagccgccaccggagcggcgcctccgccgaccaaggtcgtcgtcgaggacatctgcggcttcctgcgcgtcctcgacgacggcaccgtgctccggtcggcggcggggccggcgttctgcccgaccaccttccccgacagccacccgtcggtgcagtggaaggaggccgtgtacgacaaggccaagaacctccgagtccgcatgtacaggccggccgccgcacccgccgggaagctgccggtgctcgtccacttccacggcggcggcttctgcctcgggtcgtgcacgtgggctaacgtgcacgcgttctgtctccgcctcgccgcggaggccggcgccgtcgtgctctccgcggggtaccgcctcgccccggagcaccgcctccccgcggcggtcgacgacggcgccgggttcctgcgctggctccacgagcagtccgcgagccccgccgccgcgggcgccgacgcctggcttgccgaggccgccgacttcggccgcgtcttcgtcaccggcgactcggcgggcggcaccatagcgcaccacctcgccgtgcgcg

SEQ ID NO: 22266 - protein, 189 aa, Panicum virgatum
  misc_feature: Ceres CLONE 1820675
  misc_feature (86)..(189): Pfam Name: Abhydrolase_3 Pfam Description: alpha/beta hydrolase fold
  misc_feature: SWISSPROT Homolog: EC 3.1.1.3 Triacylglycerol lipase
MPAVSAATGAAPPPTKVVVEDICGFLRVLDDGTVLRSAAGPAFCPTTFPDSHPSVQWKEAVYDKAKNLRVRMYRPAAAPAGKLPVLVHFHGGGFCLGSCTWANVHAFCLRLAAEAGAVVLSAGYRLAPEHRLPAAVDDGAGFLRWLHEQSASPAAAGADAWLAEAADFGRVFVTGDSAGGTIAHHLAVR

SEQ ID NO: 22267 - DNA, 679 bp, Panicum virgatum
  misc_feature: Ceres CLONE 1820703
  misc_feature: Encodes the peptide sequence at SEQ ID NO. 22268
atatcagcatcattgtaccagccaccgctatctctctctctctggatacaacaacagggaactagagccatggctgctccgaagaagacgatgagagccctgcagtacgacaagtatggcggaggtgcagagggtctcaagcatgtggaggtgccggtcccgtcgccgaagaagggggaggtgctgctcaagctggaggcggccagcatcaaccctatcgactggaaaattcagaagggcatggtccggcccttccttcccaggaagttccccttcataccagttggagacatgtctggcgaagtcgtcgagctgggcagcgatgtgaccgacctcaaaccaggcgacaaggtcatctccatcagcttcccgactggcggcgggctcgcggaatacgcggtggcgccggcgtcgcttacggtggcacggccgccggaggtgtccgcggccgaaggcgcctctctgccgacggccgcgtccaccgcgctccagcagctgaaggccgcaggggtcagcagcttcgacgggtccggcggcagcaacggccccaggaacgtgctggtcaccgcggcctccggcggcgtcggccactacgccgtgcagctggccaagctggcggggctccacgtgacggccacctgcggcgcgcgcaacctgtgcttcgtccggggcctgggcg

SEQ ID NO: 22268 - protein, 203 aa, Panicum virgatum
  misc_feature: Ceres CLONE 1820703
  misc_feature (35)..(120): Pfam Name: ADH_N Pfam Description: Alcohol dehydrogenase GroES-like domain
  misc_feature: SWISSPROT Homolog: EC 1.6.5.5 NADPH:quinone reductase
MAAPKKTMRALQYDKYGGGAEGLKHVEVPVPSPKKGEVLLKLEAASINPIDWKIQKGMVRPFLPRKFPFIPVGDMSGEVVELGSDVTDLKPGDKVISISFPTGGGLAEYAVAPASLTVARPPEVSAAEGASLPTAASTALQQLKAAGVSSFDGSGGSNGPRNVLVTAASGGVGHYAVQLAKLAGLHVTATCGARNLCFVRGLG

SEQ ID NO: 22269 - DNA, 304 bp, Panicum virgatum
  misc_feature: Ceres CLONE 1820706
  misc_feature: Encodes the peptide sequence at SEQ ID NO. 22270
gacgagatgctgtgggaaggcctgcaggacctgatgaagctggacgagacggacctgtggttcgcgccatttgctggagcggcaactagtttctgagagctcgattcgatcttgtactgtcaaccacgtgcacaaattaaagtgtagttactgtcttactgaccactaggtctcagctaggaataggataaccgggaacgccattcttttgttgttgtgtagtagtactccattgaacaaacaacagagcatagctagtcggttggtcaatgtgttggattaatttgataaatagtgacattct

SEQ ID NO: 22270 - protein, 29 aa, Panicum virgatum
  misc_feature: Ceres CLONE 1820706
  misc_feature: Useful for making plants with modulated biomass
MLWEGLQDLMKLDETDLWFAPFAGAATSF

SEQ ID NO: 22271 - DNA, 499 bp, Panicum virgatum
  misc_feature: Ceres CLONE 1820722
  misc_feature: Encodes the peptide sequence at SEQ ID NO. 22272
acagcagcagttatcgaccggtctcactctcagcagtcacctcgcgcaatggccgtctccaccatggcgatcgcctcctcggcgatggccggcacccccatcgacgcgggctccttcggccagggccgcaacagcatgcgcaagaacgcggccaatgccaacgaggccgcttccggcagcccatggtacggccccgaccgcgtcaactacctcggccccttctccagcgagcccccgagctacctcaccggcgagttccccggcgactacggatgggacaccgcggggctgtccgctgaccccgacaccttcgccaagaaccgcgagcttgaggtcatccactcccggtgggccatgctcggcgcgctcggctgcgtcttcccccagctgctcgctcgcaacggcgtcaagctcggcgaggccgtctggttcaaggacggctcccagatcttcagcgagggcagcctcgactacctcggcgaccccatcctcatccaca

SEQ ID NO: 22272 - protein, 150 aa, Panicum virgatum
  misc_feature: Ceres CLONE 1820722
  misc_feature (61)..(147): Pfam Name: Chloroa_b-bind Pfam Description: Chlorophyll A-B binding protein
MAVSTMAIASSAMAGTPIDAGSFGQGRNSMRKNAANANEAASGSPWYGPDRVNYLGPFSSEPPSYLTGEFPGDYGWDTAGLSADPDTFAKNRELEVIHSRWAMLGALGCVFPQLLARNGVKLGEAVWFKDGSQIFSEGSLDYLGDPILIH

SEQ ID NO: 22273 - DNA, 1038 bp, Panicum virgatum
  misc_feature: Ceres CLONE 1820727
  misc_feature: Encodes the peptide sequence at SEQ ID NO. 22274
acaaacacatcgcctcctttcttccccacttccccttctccctgcatccagtcctccagtgctcctcccccgcgccggcacgaaaccctagttcctagacctgtgccgctgtccacctcccctcctagagatagagagagagagagatgtactcggaccagatttccaccggccgcaagcgttctatccacgagcgcctcgacggcgacctccccggcggcgctggcgccggcggccgtacccgccacatggcgtccaagaggcaacggcagatagatgaaaaatggaagcatgatctgtatcgggaagatgatggaccaacttcaaaatcaatcggtccaagggatttacgattgaagctgcagatgagaagttctcaactaggctttaccagcacaaagagttctggtgtgcgtgatctacgcgagaagctgtctggaacaatgcacccgcaaccatcgaatgctgaccccccaaagccaaagccagtatcagaagttgtcaaaatctcaaggcgtgaagcagctgatgaaatgcccgcgcgccaaagtcagaaagcatcaaaacagccttcagcgaagaagacatctcaacctaaggctgaaagtccactcgaaaatttcctgagttcacttgggcttgagaagtattcaattaccttccaggctgaggaggttgacatggcagcccttaggcatatgactgacagtgatctgaaggctttgggcattccaatgggtcctcggaagaagattatcctcgccttggagtccagagcataggactgtggcaaaggagcaaatgtagaaaggtggtggagatttgcaaggcatgctcatgtgcaagtttgacaaacctttgtatgggtcgtggaaagtgtacaacgacgcatgttctgtcctgttgggatgctcaaccaagttaggatgttagaaggaaggccatgtcgccaatgatgtaacttatcggtcacctgttaattaaacggcgccatatacatgttgaggctattcggttggtcttggagtgctgttttgt

SEQ ID NO: 22274 - protein, 211 aa, Panicum virgatum
  misc_feature: Ceres CLONE 1820727
  misc_feature (149)..(211): Pfam Name: SAM_1 Pfam Description: SAM domain (Sterile alpha motif)
MYSDQISTGRKRSIHERLDGDLPGGAGAGGRTRHMASKRQRQIDEKWKHDLYREDDGPTSKSIGPRDLRLKLQMRSSQLGFTSTKSSGVRDLREKLSGTMHPQPSNADPPKPKPVSEVVKISRREAADEMPARQSQKASKQPSAKKTSQPKAESPLENFLSSLGLEKYSITFQAEEVDMAALRHMTDSDLKALGIPMGPRKKIILALESRA

SEQ ID NO: 22275 - DNA, 1178 bp, Panicum virgatum
  misc_feature: Ceres CLONE 1820737
  misc_feature: Encodes the peptide sequence at SEQ ID NO. 22276
tttggccttttctttctttcagggcttacttcacatcttagttatgtttcctttaagttttattccatgtttctcgttttatacacaacaagcttaagtattctagtcctccatgttaggtgcatctttgcatcaagtcaaactccacctaattaatcagaactctgaaggaacatgtcctcgagtcattcgagaattactgaaaccgcagggaaccaaacaaaagcatacacctccgctgttaagcatgccatttccacatgtttttttttttgtgtagaacgaataatttcatagtttggaaacaatactgggaatagtactgccaagacgctgaatgcaccgtctagcagttgctgaaaacattttttttcctgctgatcaggtcgttcgcggtaaaggacgagatattctgcctgttcgagggtgtgctggacaacctggggcggctgagccagcagtacgggctgtccaagggcaccaacgaggtggtcctcgtcatcgaggcttacaagacactgcgggaccgggcgccatacccggccagcttcatgctctcgcagctcaccggcagctatgccttcgtgctcttcgacaagtccaccaactccctgctcgtcgcatctgatcccgagggcaaggtgcggctcttctgggggatcactgcggatggctgcgtcgccttctctgacgacattgacatgctcaaaggatcctgtggcaagtcacttgcacctttcccacaaggttgcttctactccaatgctcttggaggcttgaagtgctatgagaaccctaagaacaaggtgaccgctgttcctgcaaatgaagaagaaatctgtggtgcaactttcaaggtggaaggctctacagtcctcaccgcactgcattaggaggagatgttcgtgtggatgcgtggatggctgcggttcaatgcaaaactctgtacatggcggtgtaccataatggaaaggcatgcaactggtctatctgtatcatcccccgtacaaagaggagtactgccatcgtggcaagaacttcaccagtgtcgtttgttgtttgtttgtttgttgttgtgtgggtgttgggtgtgtctgaacctgctgtatcccttgttgttcaacttacatggaacttgagagttgaaaccgggttctagtcgaccagttgcatggatg

SEQ ID NO: 22276 - protein, 113 aa, Panicum virgatum
  misc_feature: Ceres CLONE 1820737
  misc_feature: SWISSPROT Homolog: EC 6.3.5.4 Asparagine synthase (glutamine-hydrolyzing)
MLSQLTGSYAFVLFDKSTNSLLVASDPEGKVRLFWGITADGCVAFSDDIDMLKGSCGKSLAPFPQGCFYSNALGGLKCYENPKNKVTAVPANEEEICGATFKVEGSTVLTALH

SEQ ID NO: 22277 - DNA, 1289 bp, Panicum virgatum
  misc_feature: Ceres CLONE 1820760
  misc_feature: Encodes the peptide sequence at SEQ ID NO. 22278
atccatccacacacacacagacacacaccattgtcatctagctgttcttgttgggcagctgaacaccctgctgggcactgcgcatctcctgctctggagaacaattctcagtttgtcttgcctggtttttctctagtagttcagaaggagaaggttttacaggtgcaagagccaagaggttgttgagatagggtttgaagacatggaggatgtggtgaagttcatctttggaatttctggaaatgtcattgctttctttctcttcctatccccagtgcctaccttctggaggataatcaaaagaagatcaacagaggacttctcaggagtgccgtacaacatgacgctcctcaactgcctcttatcagcttggtacggcctgccgttcgtgtccccgaacaacatcctggtgtcgacgatcaacggcgcgggcgcggcgatcgaggtggtgtacgtggtggtcttcctggtgttcgcgtcgagccggcggacgcggctgcggatgctgggcctggcgtcggcggtggccgcggtgttcgccgccgtggcgctggtctccctgctggcgctccggggcgagggccgcaagctcctctgcggcatcgccgccaccgtcttctccatctgcatgtacggctcgccgctctccatcatgaggctggtggtgaagaccaagagcgtggagtacatgccgttcctgctgtcgctggcggtgttcctgtgcggcacgtcctggttcgtctacggcctgctcggccgcgaccccttcgtcgcgatccccaacgggtgcgggagcttcctgggcgccgcgcagctcatcctgtacgccgtctaccgaaacggcggcggcaacaaagccggtgccgagcggggcggcaagcagcacgccgctgacggcgccgacaacgacgtggagatggcatctggctccgacgtgaagggcagcgacaataaggtcgtcgacgacgtcgacgtcgacgtcgacggcgccgcccgcaaggaggatcggaccggctggtctagctaggcatgcagtttgcggtccacggaatctgcttcctgctgattactagagaatagcaaacacgtgtgttagctaccgtacgtctcgaatttcttttccggtttctctttctcatgtgcaagtgcaagctttttttcttttggctctctctccccctgcaaatcgactgttctcctctcccgtgatacgggagcgcgtgtaccaatatgtatcatgtaacgtgtcggtattgttattagtacacatggaagaaaaattagagatc

SEQ ID NO: 22278 - protein, 274 aa, Panicum virgatum
  misc_feature: Ceres CLONE 1820760
  misc_feature (130)..(216): Pfam Name: MtN3_slv Pfam Description: MtN3/saliva family
  misc_feature (7)..(96): Pfam Name: MtN3_slv Pfam Description: MtN3/saliva family
MEDVVKFIFGISGNVIAFFLFLSPVPTFWRIIKRRSTEDFSGVPYNMTLLNCLLSAWYGLPFVSPNNILVSTINGAGAAIEVVYVVVFLVFASSRRTRLRMLGLASAVAAVFAAVALVSLLALRGEGRKLLCGIAATVFSICMYGSPLSIMRLVVKTKSVEYMPFLLSLAVFLCGTSWFVYGLLGRDPFVAIPNGCGSFLGAAQLILYAVYRNGGGNKAGAERGGKQHAADGADNDVEMASGSDVKGSDNKVVDDVDVDVDGAARKEDRTGWSS

SEQ ID NO: 22279 - DNA, 725 bp, Panicum virgatum
  misc_feature: Ceres CLONE 1820775
  misc_feature: Encodes the peptide sequence at SEQ ID NO. 22280
ttcccagctcccactttcccaccccgaaaatggccaaaaccttgtgtgaaacggagcactcgtaaaaacccacccgctgctcacacacccatcccatcgacgccattggcaccgctagtcccgccaccctcagccccggtgtgcagaggcgctgaatggccttgcgcctgtagattctggtcccttgccagtcgccaccgaccaatccggccgaggtttgaccaagatcggcaggcggccgcgtgcgtcgggctcgatccgactcgtctcctaggatggcggcggtggcggacggatcggcttctgcggcggcggcggcggccaaggaggtggagtaccaggcgggcgtgcagaagctggtggacctgctgtccaagctcaatccggccgccaaggagttcgtcccctcctcggccgccgcggcgtcgccgcccaagaaggcgctgtcggcggacgcgccggtgttcgactaccactcgatcggagccgggaatgggggcgccaaggactccgccaccgacgcttctttttacattgggagcccacagcgcaggagatggaatggatacatcaaccaaggaaggaggagagcaaatgatcgggcgaggcgtacagaaagagaggacagcattaggcgaactgtttatgtctctgaacttgaccatacagtgacggaggagagacttgctgatatctttgctacctgcggggcagttgttgattgc

SEQ ID NO: 22280 - protein, 149 aa, Panicum virgatum
  misc_feature: Ceres CLONE 1820775
  misc_feature (30)..(47): Pfam Name: PAM2 Pfam Description: Ataxin-2 C-terminal region
MAAVADGSASAAAAAAKEVEYQAGVQKLVDLLSKLNPAAKEFVPSSAAAASPPKKALSADAPVFDYHSIGAGNGGAKDSATDASFYIGSPQRRRWNGYINQGRRRANDRARRTEREDSIRRTVYVSELDHTVTEERLADIFATCGAVVD

SEQ ID NO: 22281 - DNA, 1668 bp, Panicum virgatum
  misc_feature: Ceres CLONE 1820782
  misc_feature: Encodes the peptide sequence at SEQ ID NO. 22282
gtatcccaaacatacacgcgcgcaccgaacacctcccccaggctcccagagcttcactcctctctgctccctctctcccagtgaagactaaaccatgggggcgtccaagaagccgccgttctcggccacgccgagcgccggccgggagagcgttgccgccgaggaggccccgcttctgccggcggagcacggcggcggcggctcggcgtcggtgctgggcgcagtgttcaacgtgtcgacgagcgtggtgggcgctgggatcatgtcgatcccggcggccatgcgcgtgctgggcgtggcgccggcggccgcgctgatcgcgtgtgccgcggtcctggccgacgccgccgccggcttcctgctccggcacacccgcggcgcgccgtcgtcgtacgcggcgctgatgggggacgcgttcggccgcgccggggcagcggtgctcaacgtgttcgtcgccgccaacgccgtcgggaccctcaccgtgtacctcgtcatcgttggggacgtgatgtccggcgccgcgggcggcggggacgacgcccacgccggggtgctgcaggagtggttcgggcgccgctggtggaccggccgggaggtggtgctggtggcggccgcggcgatcctcctccctctcgtgctccgcaagcgtgtcgattcgctgaggttcacatcggccctctccatcctgctagcggtggtgttcatgctcatcagcctggggatcgcggtgtacgcgctgctcaagggcacggcgaccatgccgcggatgctcccggacttctccaggctctcctccccgttcgagctcttcaccgccgtccccgtcatcgtcgtcgccttcaccttccacttcaacgtgcacccgatccgcgcggagctgagcaaggcgtcggacatgaaggcggcggtgcgcatctccctcgtgctctgcgccgccatctacgccgccgtgggcttcttcggcttcctcctcttcggggacgccaccatggccgacgtgctcgccaacttcgaccgcagctcgggcgccggcgtcccgcaggcgctcaacgacgccgcgcgcctcagctacgcgctgcacctcgtgctcgtcttcccgctcctcttcttctcgctccgggtcaacgtcgacgagctcctcttccccggccggcggcctctcgccgcggacacgcgccggttcgtgtccctcacggccgtgctcatggcggtgctctacgcgctcgccatcgccatccctagcatctggacgctcttcgagtactccgggtccacgttcgcggtcaccatctcgttgatattccccggcgccattgttctcagggatgttcatggaatagcaaagcggaaggacaaggctttggcggcgaccatgatcattctggcggtggtcacgagcagcatcgccattgcctcaaacatcatgagctccatcagcgacaaagtcagaagaggccatgaagctagcagatgatagttcagatgaatcgaggttaaggtttgtgcttagagagaatgagacactgctacggttcatgagatgcatgttgtagatgtgtgtaaagaaatacctgccggccattattgttgtatacttttgtactgatgagtggcgatacatgtactatgtataacagtaatagtaatggataatatatttttacatgc

SEQ ID NO: 22282 - protein, 459 aa, Panicum virgatum
  misc_feature: Ceres CLONE 1820782
  misc_feature (36)..(447): Pfam Name: Aa_trans Pfam Description: Transmembrane amino acid transporter protein
MGASKKPPFSATPSAGRESVAAEEAPLLPAEHGGGGSASVLGAVFNVSTSVVGAGIMSIPAAMRVLGVAPAAALIACAAVLADAAAGFLLRHTRGAPSSYAALMGDAFGRAGAAVLNVFVAANAVGTLTVYLVIVGDVMSGAAGGGDDAHAGVLQEWFGRRWWTGREVVLVAAAAILLPLVLRKRVDSLRFTSALSILLAVVFMLISLGIAVYALLKGTATMPRMLPDFSRLSSPFELFTAVPVIVVAFTFHFNVHPIRAELSKASDMKAAVRISLVLCAAIYAAVGFFGFLLFGDATMADVLANFDRSSGAGVPQALNDAARLSYALHLVLVFPLLFFSLRVNVDELLFPGRRPLAADTRRFVSLTAVLMAVLYALAIAIPSIWTLFEYSGSTFAVTISLIFPGAIVLRDVHGIAKRKDKALAATMIILAVVTSSIAIASNIMSSISDKVRRGHEASR

SEQ ID NO: 22283 - DNA, 677 bp, Panicum virgatum
  misc_feature: Ceres CLONE 1820786
  misc_feature: Encodes the peptide sequence at SEQ ID NO. 22284
atctatagaccattaccctaagcgctctccttttcgctcgagcgtgcagggaagggtcacggagatcggagagcgctatccccaatccccccaacgcaaggatcgcggtggtcaccggcgggaacaaagggatcgggctggaggtgtgccggcagctcgccggcgccggcgtcaccgtcgtcttgacggcccgggacgagacgaggggcgcagccgccgtggagaagctcagagaagcagggctctccgatgtcattttccatcagctggagatcaccgatgccccgagcatcgctaggttggctgatttcttgaaggcccgttttgggaagctagatatcctgataaataatgcttcaatccttggggttgaatacctcctagatccttcactgaccagcgaggaaaagttcagtggcatggataagggtcagaggcttgagtggctgaccagtggtgtccgggggacctacgacgctgccagagagggcctgcagacaaactactacggcaccaagcatgtcatcgaagccttactgccgctgctgcaagcttcttccgatgggagaatcgttaatgtctcatccgaatggggcctaaggctaatcaccaacgaggagctgaagcaggagctgaacgacgtcgagaagctcaccgaggcgaggctggacgaggtc

SEQ ID NO: 22284 - protein, 85 aa, Panicum virgatum
  misc_feature: Ceres CLONE 1820786
  misc_feature: SWISSPROT Homolog: EC 1.1.1.184 Carbonyl reductase (NADPH)
MDKGQRLEWLTSGVRGTYDAAREGLQTNYYGTKHVIEALLPLLQASSDGRIVNVSSEWGLRLITNEELKQELNDVEKLTEARLDE

SEQ ID NO: 22285 - DNA, 421 bp, Panicum virgatum
  misc_feature: Ceres CLONE 1820819
  misc_feature: Encodes the peptide sequence at SEQ ID NO. 22286
cttcgcctcacacaaacgcatcgagctcttactcagagaactgagaagccaaagaagaacctctccctctcgtttcctgcacgaatccggctcccatccatcgatcggaacaccacacactgccagccggacgcagccgatcaagggcaatgggcgagctgatccccgggttgccggaggaagtggcgcgggagtgcctagtccgggtgggcttcgaccagctgcccgtggtgcgccgcatctcgcgccagtggaagtcggagttggagtcgccggactaccaccgcctgcgccgggccgaggggctggcgcgcccggtgctcgcgctggtccaggcgagcccagcgccgccggccaacggtgacacgggtatctgtgcgagaaaagacgtcgctcgcccggccgtagggcaccaaaattc

SEQ ID NO: 22286 - protein, 90 aa, Panicum virgatum
  misc_feature: Ceres CLONE 1820819
  misc_feature (3)..(50): Pfam Name: F-box Pfam Description: F-box domain
MGELIPGLPEEVARECLVRVGFDQLPVVRRISRQWKSELESPDYHRLRRAEGLARPVLALVQASPAPPANGDTGICARKDVARPAVGHQN

SEQ ID NO: 22287 - DNA, 1257 bp, Panicum virgatum
  misc_feature: Ceres CLONE 1820853
  misc_feature: Encodes the peptide sequence at SEQ ID NO. 22288
atcaacatcattgcagcgagcacacagaggcaccctgcagcgagcagtaattagtgctgcagctagtattgtttagctttgcttgggcgaggtgcctgatcgcgagctcgagatgaaggttgcaatggcggccgcggcctttgttcccctcgccgtcgcggtcctcttctccgtgtcgtcggcggcggcgtcccccatccaatgggggaagctggacccgcacttctacgaccactcgtgcccgcaggcgcagcggatcgtggcgtccatcgtggagaagcggtccaaccccaacagggactccgcccggggcttcgaggtcatcgacgagatcaaggccgccctcgaggcggcctgccccggcaccgtctcctgcgccgacatcctcgccctcgccgcccgcgactccaccgtcatgactggcgggcccgggtggatcgtgccgctggggaggaaggacgctcgcggcgccagcgtccagggctccaacaacgacatcccggcaccaaacaacaccctccccaccatcatcaccaagttcaagctccagggcctcgacatcgtcgacctcgtcgcactcctcggtagccacaccatcggcgactcccggtgcacgagcttccgccagcgcctctacaaccagacgggcaacggcctcccggacatcaccctggacgcgtcctacgcggcggcgctgcgcctgcgctgcccgcgctcggggggcgaccagaacctcttcttcctcgatcccgtcacgcccttcaagttcgacaaccagtactacaagaacatcctcgcctaccgcggcctgctcgcctccgacgaggtgctcctcaccgggagccccgccaccggcgacctcgtcaagctctacgccgccaaccaggacatcttcttccagcacttcgcgcagtccatggtcaagatgggaaacatctcgccgctcaccggggccgacggcgagatcagaaagcactgcaggagggtcaaccacaactgatctctgtttggttccgatacagttgggaaatttaatttgcttgtttctgaagtttttggttggttggtttgttaatttagtgctctcatcagcttattgctcagatttctcatttgttctcttcaactgtgtatgaactttccttgtccatgtgttgtgtatttccttgatggatttggtgttcttgttagaggaatccgtttcgattgtacgttggactcgaggtacattaatgttggttatatcaggttccagcc

SEQ ID NO: 22288 - protein, 295 aa, Panicum virgatum
  misc_feature: Ceres CLONE 1820853
  misc_feature (21)..(257): Pfam Name: peroxidase Pfam Description: Peroxidase
  misc_feature: SWISSPROT Homolog: EC 1.11.1.7 Peroxidase
  misc_feature: Useful for making plants with altered carbohydrate content
  misc_feature: Useful for making plants with altered cell wall content and/or composition
  misc_feature: Useful for making plants with modulated nitrogen use efficiency
  misc_feature: Useful for making plants with modulated light quality response
MKVAMAAAAFVPLAVAVLFSVSSAAASPIQWGKLDPHFYDHSCPQAQRIVASIVEKRSNPNRDSARGFEVIDEIKAALEAACPGTVSCADILALAARDSTVMTGGPGWIVPLGRKDARGASVQGSNNDIPAPNNTLPTIITKFKLQGLDIVDLVALLGSHTIGDSRCTSFRQRLYNQTGNGLPDITLDASYAAALRLRCPRSGGDQNLFFLDPVTPFKFDNQYYKNILAYRGLLASDEVLLTGSPATGDLVKLYAANQDIFFQHFAQSMVKMGNISPLTGADGEIRKHCRRVNHN

SEQ ID NO: 22289 - DNA, 1435 bp, Panicum virgatum
  misc_feature: Ceres CLONE 1820869
  misc_feature: Encodes the peptide sequence at SEQ ID NO. 22290
attccacacttcacacttatcagtaggatcctcagtacctggcaaattcttcatctcttctcctcgcgagcctctctccaccagtgagctcgtcgctcccattctttccaccggtgaagtctggggaaggaatggcggagaacggagcaaagcagcccctgttacaggacggcgaccctcctaactccggcgaaacaaggccgactcagggagctggagcgaagagattccggcgctgcaggacggcgccctccgccgatgcggcgcaggattctccaccaggaagcaagaaccggagccaaccggagcgcggcaggagcgccggctcgccgccgttcgcaccacccaaggagctgctgcgtggcgcgcgcccgagcttccggctcgtgggcgtcctcctgctggcctacctcctcgccgggaccatcgcgttctacctcgccatggaccacatgtccggcggccgcaccaggagccgtgtggtggacgcgctctacttctgcgtggtcaccatgacgaccgtcgggtacggcgacctcgtcccggccagcgacgccgccaagctgctggcctgtgccttcgccttcgctggcgtggccctcgtcggcaccttcctcagcaaggccgccgactacctcgtcgagaagcaggaggcgctcctgttccgcgcgctccacctccgccgcgccggcgaccgcagggcgctgcgggacatggaggccaacaaggtccggtacaagctctacacctctgccgcgctcctggcagcggcgctcgtttccgggacggcgttcctggtggaggtcgagggcatgcgccctgtggacgcattctactgcgtgtgcgcgacggtgacgaccctcgggtacggcgaccggagcttctcgtccgtgccggggcgcgcgttcgcggcggcgtggatcacggtgagcacggtggtggtggcgctcttcttcctgtacgcggcggagctgggtgcggagcggcgccagcgggcgctcgcgcagtgggtgctcaggcgacggaccacctgcacggacctcgaggcggcggacatggacggcgaccaccgggtcggggccgcggacttcgtgctgtacaagctcaaggagctggggaagatcagtcaagaggagatcgccgagtttctggaggagttcgaccagctcgacgccgacaactccggcaccctctcgccgcatgacctcatcgtggcacagcctggttagatgatggctgggcaatcaccggcagccagcaaggccagtggagtcagcgtcgagagcattctcgaaaagcagagaagagcaacagtgccacacgctttcaattattgctatgtgtgttttcaatcgtcgccttaggtgctgtagggccaattattgtgatgggctgtcactccataacccagtttatttatttatttatttttatg

SEQ ID NO: 22290 - protein, 365 aa, Panicum virgatum
  misc_feature: Ceres CLONE 1820869
  misc_feature (88)..(171): Pfam Name: Ion_trans_2 Pfam Description: Ion channel
  misc_feature (209)..(284): Pfam Name: Ion_trans_2 Pfam Description: Ion channel
MAENGAKQPLLQDGDPPNSGETRPTQGAGAKRFRRCRTAPSADAAQDSPPGSKNRSQPERGRSAGSPPFAPPKELLRGARPSFRLVGVLLLAYLLAGTIAFYLAMDHMSGGRTRSRVVDALYFCVVTMTTVGYGDLVPASDAAKLLACAFAFAGVALVGTFLSKAADYLVEKQEALLFRALHLRRAGDRRALRDMEANKVRYKLYTSAALLAAALVSGTAFLVEVEGMRPVDAFYCVCATVTTLGYGDRSFSSVPGRAFAAAWITVSTVVVALFFLYAAELGAERRQRALAQWVLRRRTTCTDLEAADMDGDHRVGAADFVLYKLKELGKISQEEIAEFLEEFDQLDADNSGTLSPHDLIVAQPG

SEQ ID NO: 22291 - DNA, 1236 bp, Panicum virgatum
  misc_feature: Ceres CLONE 1820879
  misc_feature: Encodes the peptide sequence at SEQ ID NO. 22292
gacgagcggcgatggccacctcgctcccgccgatcgactgggaggcagagagctaccccgcctacccagacttcgcggccatcccctttttcgccgtcttcttcctcgccgtccgtttcctcctcgaccgcttcgtattcgagtggttagtcaggaagctgattttcaagaaggggggtgagaagcttgatcctagtacatatgctggcaagagaaagatcaggaaatttaaagaatcagcttggaaatgcatttatttcctttccggggagctactggcattgtctgtgacatacaatgagccatggttcacaaccacaagaaatttctgggttggaccgggtgatcagatctggccagatcaaaaaataaaatttaaactcaaggcagtctatatgtatgttgctggtttttacacatactcaatatttgcccttttgttttgggaaataaggcgctcagactttggtatttcaatgactcaccatgtagcaactgtttgtctgatagcactgtcttacatattcagatttgctcgcgtgggttcagttgttcttgccatccatgatgctactgacgtgttcctggagcttggaaagatttccaagtacagtggccacgagttgcttgcagatgtttcatttcttgttttcgtcagttcttgggtactccttcgccttatatattatccattctggattctctggagcacaagctatgaagttgtgctgactatagacaaggagaagcataagtttgacgggccaatatactactatgtattcaacagtcttctcttctccctgcttgttctacacatatattggtgggtattaatgtatcggatgcttgtgaagcaaatacagtctagagggcatgttggggatgatatacgatctgattctgaaggtgaagaggaacatgaggattgattgagctctgtaaattaagaagaaaaaggatcctgaggattgattgaccatgagctgtgtaggttctgaaggtgtagaggaacacgaggggatggcttaagttgtgtaaattctgaagatgaaaaaggaacctgttgctctgccttttcagatcattgctgtttgtttgatgggggctcttcataaattaagaatacactagtgccttcacttgggcataatacatttatgtaaaactaggtcaaattgtatagcacctacacagcagttaatggaaaacattacttgtgtacatgtctgccag

SEQ ID NO: 22292 - protein, 306 aa, Panicum virgatum
  misc_feature: Ceres CLONE 1820879
  misc_feature (91)..(303): Pfam Name: LAG1 Pfam Description: Longevity-assurance protein (LAG1)
  misc_feature: SWISSPROT Homolog: EC 2.3.1.24 Sphingosine N-acyltransferase
MATSLPPIDWEAESYPAYPDFAAIPFFAVFFLAVRFLLDRFVFEWLVRKLIFKKGGEKLDPSTYAGKRKIRKFKESAWKCIYFLSGELLALSVTYNEPWFTTTRNFWVGPGDQIWPDQKIKFKLKAVYMYVAGFYTYSIFALLFWEIRRSDFGISMTHHVATVCLIALSYIFRFARVGSVVLAIHDATDVFLELGKISKYSGHELLADVSFLVFVSSWVLLRLIYYPFWILWSTSYEVVLTIDKEKHKFDGPIYYYVFNSLLFSLLVLHIYWWVLMYRMLVKQIQSRGHVGDDIRSDSEGEEEHED

SEQ ID NO: 22293 - DNA, 711 bp, Panicum virgatum
  misc_feature: Ceres CLONE 1820886
  misc_feature: Encodes the peptide sequence at SEQ ID NO. 22294
gactcctcgcgttcgccgcggcgtcaacgcggcttccttcccgcggcctctccgcctccgcctcccagatccggcgcccatggcgcggaacccgggctgcaccgtcttcataggtaacttggatgacagggttcctgagagggttctgtatgagattcttgttcaggtaggtcgagttgtagacctacacatacctcgtgacaaggaaactagtcggcaaaaaggttatgcttttgctgagtatgaatcagaggagattgcccagtatgctgttaagctattttctggccttgttcgacttcataataaaacgcttagatttgcgatctctgggcaagacaaaccctcatcaaatgccaatatgcctgtaactcctaggttaaaccctgtaccaacaccaaagcctcctcatcttatgaggtctagtgatactcccgcatcacagcaaacagtagtgaatggcaggattgcagggtatggtatctcaccaagtcattcatatgacacacattctcaagccccatcaagtgggttaccaagtggaggactaagcaatggtacgtatgagtatagtagacgtgtattgggttctgttctgaatgacgctagccgtcgaggtaccagggaaccagttccatacccatcctactagcatgttgagagccagtgacgataacttgatatgctgacggaataggccgctgaagccat

SEQ ID NO: 22294 - protein, 190 aa, Panicum virgatum; identical to SEQ ID NO: 10340
  misc_feature: Ceres CLONE 1820886
  misc_feature (9)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase

SEQ ID NO: 22295 - DNA, 1518 bp, Panicum virgatum
  misc_feature: Ceres CLONE 1820893
  misc_feature: Encodes the peptide sequence at SEQ ID NO. 22296
agaaaaccacaacggcggcaaaaccctcgccgccactccacctctcccatgccgccgcccgaaagcgccgccggagaccccggcggcaccctgtcggcgtcggccatcgtcggtggcaccgtgaccgggcaccacctgctccaaatcgactgctactcgcgcaccaaggaggagctccccagcggtaagcgcatcaagtcttgccctttcagagcggggggttcctcttggcgcatcagctactaccccaatggcgagacttccgaagctgcagagttcatatccgtctatctccacctcgaccagagcgtcgcagagcccgtgaaggcgcgagccaggttcagcctgctcgatcaggtcgggaaaccggtgctgtcgcacagcctgaccacaaggatacacgatttctgcaaagccaccggtggatttgggtacgatcgattcatcaagagggcatggcttgaggagtcgaagcatctcaaggacgaccgcttcacagtcaggtgtgacgtcatcgttaccaaggagctctgtgcggaggagaggccgcctccgtttccgttggttctggtgccgccgtcgaacctgcaccagaatctcggtgatctcttggcgtccagagagggggcagatgtcaccttcctggttgccggtgagacgttcaaggcgcacaagtgtgttcttgctgcccggtcggccgtcttcaaggcagaggtcttcggcgcaatgaaagagagcatggatggggcgctcatacgcgtcgatgacatggacgcacaggtgttcatggctttgctcaatttcgtgtacaccgatgcgctgccggatttccgagacatgaagaaacaagaagaggctgcaatggctcagcatttgcttgttgctgctgacaggtataaccttgagaggctgaagctgatttgtgaagataggttgtgcgctcacattgatacagcctctgctgcaaccatcttggcgttggctgagcaacaccactgcggcgggcttaaggaggcatgcttcaggttcctgagctccatatcgactctgaatgctgtaatggcaactgatggctttgaccatttgactagaagctgcccctctgttctgaaagagcttatgtccagtattgctgctcgtgtgccctgctgatttggatgaagcatggtcaggaaatatcaggtttagtacgatgtttggtctggatgtcaaactaaggacagataccaagtagtagtgcaagtgttagtgctagccttatcatcatcataaggaggcagtgcacctctgatctgtatcttctttcattcggtcattgcatcctttattactgctatactattaaccgtgtagtagtttatcttcttagaacgaattagtaacaatatatggcagtgtgatgaatgtcgggttacttgcaagcctctacattgacatggaaattgtcttctttcatgcagttcttgcagttgcagatactactgtaatgcttgatgttacaccttggttatgcatgcc

SEQ ID NO: 22296 - protein, 367 aa, Panicum virgatum
  misc_feature: Ceres CLONE 1820893
  misc_feature (184)..(300): Pfam Name: BTB Pfam Description: BTB/POZ domain
  misc_feature (33)..(157): Pfam Name: MATH Pfam Description: MATH domain
MPPPESAAGDPGGTLSASAIVGGTVTGHHLLQIDCYSRTKEELPSGKRIKSCPFRAGGSSWRISYYPNGETSEAAEFISVYLHLDQSVAEPVKARARFSLLDQVGKPVLSHSLTTRIHDFCKATGGFGYDRFIKRAWLEESKHLKDDRFTVRCDVIVTKELCAEERPPPFPLVLVPPSNLHQNLGDLLASREGADVTFLVAGETFKAHKCVLAARSAVFKAEVFGAMKESMDGALIRVDDMDAQVFMALLNFVYTDALPDFRDMKKQEEAAMAQHLLVAADRYNLERLKLICEDRLCAHIDTASAATILALAEQHHCGGLKEACFRFLSSISTLNAVMATDGFDHLTRSCPSVLKELMSSIAARVPC

SEQ ID NO: 22297 - DNA, 647 bp, Panicum virgatum
  misc_feature: Ceres CLONE 1820927
  misc_feature: Encodes the peptide sequence at SEQ ID NO. 22298
cctctcttccaccacctccaacccactgctccaaatctccatcctctcagacacaaagaggagctcagacccaagaagcagcaggcagaggcagcttatagcttgttggagccttgaaggtgtccaaggtgggagagacacgacgacggccgcgacaggctagccgtccagcagctagctcccgcggagccgatggctagcgccgacgtcgacgtcgggacggagctcagtctcgggctgccgggaggcggcgccgaggcggccaaggccgcgaagaggggcttcgaggacaccatcgacctcaagctgaagctgcccaccgccggcatggaggaagccgccgccggcaagccggagccagccgccgagaaggccaagaggcccgccgaggcgccggccgctgatgcagagaagccacccgcatccaaggcacaagctgtgggttggccaccagtacgatcataccgcaggaacgtcatgaccgtccagtcagtgaagagcaagaaggaagaggaacccgagaagcagcagcccgctgccaatgccggcagtaacagctctgccttcgtgaaggtcagcatggatggcgcaccttacctgcgcaaggtggacctgaagatgtacaacagctacaaggacctctcaat

SEQ ID NO: 22298 - protein, 151 aa, Panicum virgatum
  misc_feature: Ceres CLONE 1820927
  misc_feature (10)..(151): Pfam Name: AUX_IAA Pfam Description: AUX/IAA family
  misc_feature: The sequence is a functional homolog of SEQ ID NO 739 in the 10/374,780 US patent application
  misc_feature: Useful for making plants with modulated nitrogen use efficiency
  misc_feature: The sequence is a functional homolog of SEQ ID NO 2004 in the 10/374,780 US patent application
  misc_feature: The sequence is a functional homolog of SEQ ID NO 660 in the 11/479,226 US patent application
  misc_feature: Useful for making plants with altered alkaloid content
MASADVDVGTELSLGLPGGGAEAAKAAKRGFEDTIDLKLKLPTAGMEEAAAGKPEPAAEKAKRPAEAPAADAEKPPASKAQAVGWPPVRSYRRNVMTVQSVKSKKEEEPEKQQPAANAGSNSSAFVKVSMDGAPYLRKVDLKMYNSYKDLS

SEQ ID NO: 22299 - DNA, 1837 bp, Panicum virgatum
  misc_feature: Ceres CLONE 1820930
  misc_feature: Encodes the peptide sequence at SEQ ID NO. 22300
gtctaccgccggccgcatcctcctcacctgacctcaacccccaccacccaccgttcgccgccggcgggccaaggaaggagctcatggggaacatgactcgctcggactcgcccgtctcccgccgcatcgtcctctccttcctcgacttcctcaactccgttaaattagctcctggggctgatcccgaagctctccaagttgctagggattgcctggaatccatttttagtgtcgactcatcagctgctggcgaggggatacagccaggactgttacttgaactgtttacttcccttgaagctgatggaagagataagccaagacctggattggtaccacaatcagtatcaaacaagccgagtacatctaatattgaggaagactctaataactgtacaacatcaaatagtgacatccaggtggaggatacctttgacctagatcattcaggagatgaactatttgcaaaagtttatgctgcacttgatgaaatcaatttctttaaaacatctcctgctggagctgaagatcctggccaactttcaaaagcaacgcaatacttcaatgaagcagtactatcgatgcaaaagtcagggaggaaaaaagcaagcttagttgaccttgcagagtcctttaaatcaagaggtaatgaattcatgagatcaaaccaacaccttaaagcagtagaactgtacacctgtgccattgcattgagcaggaaaaatgctatttactactgtaacagggctgctgcctatacccttcttaatatgaacaatgaagctattgtggattgcctaaagtcgattgaaatcaaccccaactacagcaaagcatatagccgacttggatctgcttattttgctctagggaattatcaagatgccttatacaagggatacttgaaagccgccgagcttgatcctagtaatgaaaatgtccggcagaatattgaggttaccaaaaagaaattggatgaacgacaagtcccaccagaagagcagaatacgcacacacgtcaagctcaaggatcacacccaatgtttacaaataatggtattccttttaatctgtttccaccgggtagttctgcaagtcctgaattctttgccaacttcatcaatcgtggatctgatcttggtcaaccaccatctggacaatcgatgagtataaatctgaatgacattttttgtcaagcaaatgtcaatgctagcaggcaaggatcgagtcaaacagggaattcaaatactccacccgcttctttcccaaccggtgctgcagttcctccttttgccttctcaggatcaggtaatgaaggaaatcgtgcacaccaagcttctagtggacatgaaagggaacatggtgaaccaggcatacatagggatgatggcatccatataaacttgacaggacccgagcaggctgcagaggctttgagaactgtgatgcagatgtttgggccacaaatgggtccacacgaaggcacacctagaggaccaggttaaggtgtgggaagcaggaaatgtgtaaatgtggcttactgtatacagaagtcttaaagatggcatgttattttgtccttccaccctgagaagcgagcatggaaattcttgggcgccttttcaccgaacatagtattttcctggccatcccaatgttgatgaatcattagctatgctgagtcttgtttgttgaaattctctggtgattccatttttaccattttacttgccgatctatgtgtaatctgaaagtccccctccccccacgggacttttctgtttgacttgttggttggcagttgttactttataaaacatttgtaagtttattatgt

SEQ ID NO: 22300 - protein, 473 aa, Panicum virgatum
  misc_feature: Ceres CLONE 1820930
  misc_feature (215)..(248): Pfam Name: TPR_1 Pfam Description: Tetratricopeptide repeat
  misc_feature (249)..(283): Pfam Name: TPR_1 Pfam Description: Tetratricopeptide repeat
  misc_feature: SWISSPROT Homolog: EC 3.1.3.16 Phosphoprotein phosphatase
MGNMTRSDSPVSRRIVLSFLDFLNSVKLAPGADPEALQVARDCLESIFSVDSSAAGEGIQPGLLLELFTSLEADGRDKPRPGLVPQSVSNKPSTSNIEEDSNNCTTSNSDIQVEDTFDLDHSGDELFAKVYAALDEINFFKTSPAGAEDPGQLSKATQYFNEAVLSMQKSGRKKASLVDLAESFKSRGNEFMRSNQHLKAVELYTCAIALSRKNAIYYCNRAAAYTLLNMNNEAIVDCLKSIEINPNYSKAYSRLGSAYFALGNYQDALYKGYLKAAELDPSNENVRQNIEVTKKKLDERQVPPEEQNTHTRQAQGSHPMFTNNGIPFNLFPPGSSASPEFFANFINRGSDLGQPPSGQSMSINLNDIFCQANVNASRQGSSQTGNSNTPPASFPTGAAVPPFAFSGSGNEGNRAHQASSGHEREHGEPGIHRDDGIHINLTGPEQAAEALRTVMQMFGPQMGPHEGTPRGPG

SEQ ID NO: 22301 - DNA, 2006 bp, Panicum virgatum
  misc_feature: Ceres CLONE 1820939
  misc_feature: Encodes the peptide sequence at SEQ ID NO. 22302
gcaagagcttccccatttcgaacgccggagcgcgaggaagacgcacgcagaggagatttggcacactacaaagattagaaactgaattgtaagatggcatcagcggagctttcccgtgaggagaatgtgtacatggccaagctcgctgagcaggctgagaggtacgaggagatggttgagttcatggagaaggtagccaagaccgttgactcggaggagctcactgtcgaggagcgcaacctcctgtctgttgcctacaagaatgtcattggagcccgccgtgcttcatggcgcatcatctcctccattgagcagaaggaggagggccgaggcaatgaggaccgtgtaacactcatcaaggactaccgtggcaagattgagactgagctcaccaagatctgtgacggcatcctcaagctgctcgagtcccaccttgtgccctcatccactgcccccgagtccaaggtattctacctcaagatgaagggtgattactacagataccttgctgagttcaagactggggctgagagaaaggatgctgctgagaataccatggtggcatacaaggctgcccaggacattgctttggctgagctagctccaactcaccctattaggcttggcttggcacttaacttctcagtgttctactatgagattctcaactcacctgatcgcgcctgcagtcttgcaaagcaggcttttgatgaggccatctcggagctggacaccctgagcgaggagtcctacaaggacagcactttgatcatgcagctccttcgtgataacttgaccctatggacatccgacatctcggaggaccctgctgaggagatcagggaggcgccgaagcacgactcaagcgaggggcagtaaagcaggctttacgtgccctagaaactagtagctagtgtttgctgctgtctaatgacactatgcaaatgttatctggaccctggtttcttcggtgcgacgcttgtagccgtgctatgattattgtcggcaaaatctgggggctccccatatgagatgttgccgggcaaggcctcggtgcgtcccacttgtagcaggtgggttacactggagccaggtttggttgggtagggaagccccaaatactgttggtgtcacttgtatttttatcttttcatcgctgtttattgtgagtggtcctgcgttaattgctggtccatgctgtcggttcttttttggattctttacaggggtgattggggtattcgcatttttaccccccgacccatctcagcgatgaatcttttgctttggtcgggtaagatgaggtgaagttatcgctgtggtcgcttggctgtggttgatggctgttgctgatttgtcatgagagaacagtactgctgactggctggtagctggtggctggtgctgatttagtatgagataatagtactgctggctggttggctgacaagccaagcgaacacagtgtggtttgatcaactatttactagttgtttctgctccaaaggtgattcgtaaatctctactaaaccatgaatcctacactttcggttataattcgagatctagctctgaaaaaggaaatttatatattttataaaaagataaaggtctggcaaaactgctacatggaaagctcaaccatcatgttatggaagaaggaaagcgtcacagatcacaatgagcgactctgcgaggtgggagcaatcgatgaagcacggactctacaaaacacagtgagcgactaccagttgcgagcaatctatgacgcacgggctctcctctcttttctgggcacagggcactccattgtgcggtcggacctcgacgagtactcacaggatgacagattgaccggacaggattcatttctgcaatgcgtttcatgttcatgtttacaacgtcggtggaatcacggcgtctaacaatcttcagttggagtacaaagtgtactactctaacatttgacatttggcccttatttagatgcataaagttttggccgg

SEQ ID NO: 22302 - protein, 261 aa, Panicum virgatum; identical to SEQ ID NO: 15902
  misc_feature: Ceres CLONE 1820939
  misc_feature (8)..(245): Pfam Name: 14-3-3 Pfam Description: 14-3-3 protein
  misc_feature: The sequence is a functional homolog of SEQ ID NO 789 in the 11/479,226 US patent application
  misc_feature: The sequence is a functional homolog of SEQ ID NO 786 in the 11/479,226 US patent application
  misc_feature: The sequence is a functional homolog of SEQ ID NO 2350 in the 10/374,780 US patent application
  misc_feature: The sequence is a functional homolog of SEQ ID NO 344 in the 10/412,699 US patent application
  misc_feature: The sequence is a functional homolog of SEQ ID NO 790 in the 10/225,066 US patent application
  misc_feature: The sequence is a functional homolog of SEQ ID NO 805 in the 11/479,226 US patent application
  misc_feature: The sequence is a functional homolog of SEQ ID NO 801 in the 11/479,226 US patent application
  misc_feature: Useful for making plants with modulated drought sensitivity
  misc_feature: Useful for making plants with modulated water use efficiency
  misc_feature: The sequence is a functional homolog of SEQ ID NO 342 in the 10/412,699 US patent application
  misc_feature: The sequence is a functional homolog of SEQ ID NO 782 in the 11/479,226 US patent application
  misc_feature: The sequence is a functional homolog of SEQ ID NO 797 in the 11/479,226 US patent application
  misc_feature: The sequence is a functional homolog of SEQ ID NO 793 in the 11/479,226 US patent application
  misc_feature: The sequence is a functional homolog of SEQ ID NO 809 in the 11/479,226 US patent application
  misc_feature: The sequence is a functional homolog of SEQ ID NO 1777 in the 11/479,226 US patent application

SEQ ID NO: 22303 - DNA, 1310 bp, Panicum virgatum
  misc_feature: Ceres CLONE 1820944
  misc_feature: Encodes the peptide sequence at SEQ ID NO. 22304
aacgagcacagatagccctcttgttcttgtattctctcgccgctcgctcgcgcgcgtcctagcaggcactgaaatggccgccgccgctgctagcggctgtctcgttccacggctgacgcccgcggcgagatcgaggtgtcggtgccggccccggcggcgtctggcgccgcggtgcgtggcggcggacgggaggacgacgacgatgcagagcaaggccggggacgcgctggaggtgtgccgggtggtgaacggcatgtggcaggtgagcggcgcgtcgtggggccgcgcggagccggcggcggccgtggacgccatgctccggtacgccgacggcggcctcgccacgttcgacatggcggacatatatgggccagcagaggatttgtatggcatgttcatcaatagagtcaggtgggagcgcccacctgagttgcttgaagaaatcaaggggcttacaaagtgggtgccgcctcccgttaagatgacaagaagttacgttgaggataatatcaatagatctaggaagaggatggatgttgctgcattggacatgttgcagttccactggtgggattacgcaaatcctggatatttggatgcactaaagcacatcacagacctgaaggaggaaggcaagataaagaccgtagctctgacaaacttcgatacagacagactgcaaataattctagaaaacggaatcccagttgttagcaaccaggttcaacattccatcgttgatatgcgccctcagcaaagaatggcagagctttgccagttaactggagttaaacttataacgtatggcacagtgatgggtggtcttttgtctgaaaagtttcttgacaccaacgtatcaataccttttgctgggcctcctctaaataccccatctttgcagaagtataagaggatggtcgatgcttggggtggctggagcttgttccagactttgctgcaaactttaaagaaggtatcattgaaacatggtgttcctatcgcaactgttgctgtgcgatacatactgaaccagacatctgttgcgggttccatggtaggtgtgagattgggactctccgagcacatcaaagacaccaacgccatattctcacttgaattggatgaagaggacatgaacagcatcaccccccgggttttaaaaaggaagaaaaatgatggatattatcggggattgtggcgatgagtacagagcttagttcatgctgctgcttggttgatatacttgttgtgacggaaccgccaaaattaaaactctaattaaacgtaatgggccgtcgtttgaacaaaaa

SEQ ID NO: 22304 - protein, 376 aa, Panicum virgatum
  misc_feature: Ceres CLONE 1820944
  misc_feature (48)..(362): Pfam Name: Aldo_ket_red Pfam Description: Aldo/keto reductase family
  misc_feature: SWISSPROT Homolog: EC 1.1.1.116 D-arabinose 1-dehydrogenase
MAAAAASGCLVPRLTPAARSRCRCRPRRRLAPRCVAADGRTTTMQSKAGDALEVCRVVNGMWQVSGASWGRAEPAAAVDAMLRYADGGLATFDMADIYGPAEDLYGMFINRVRWERPPELLEEIKGLTKWVPPPVKMTRSYVEDNINRSRKRMDVAALDMLQFHWWDYANPGYLDALKHITDLKEEGKIKTVALTNFDTDRLQIILENGIPVVSNQVQHSIVDMRPQQRMAELCQLTGVKLITYGTVMGGLLSEKFLDTNVSIPFAGPPLNTPSLQKYKRMVDAWGGWSLFQTLLQTLKKVSLKHGVPIATVAVRYILNQTSVAGSMVGVRLGLSEHIKDTNAIFSLELDEEDMNSITPRVLKRKKNDGYYRGLWR

SEQ ID NO: 22305 - DNA, 646 bp, Panicum virgatum
  misc_feature: Ceres CLONE 1820975
  misc_feature: Encodes the peptide sequence at SEQ ID NO. 22306
ctcgccgccgccgccgtcgcccgccaagccggcgcggccctgcgcggcgcccttggggggctgcggccgctcacctccctccaaccgtcgcacgccgcctccagcgaagaggtgctcgtggaaggaaaggccagtgcgcgcgcctccgtgctcaaccgcccgggctacctcaacgccctcacaaccaccatgggagctagactcaataagttttatgaatcatgggaggacaacccagatattggctttgtcatgatgaagggcagcggacgagcgttctgtgctggaggggatgttgttagattgcgcaaacttgtcagtgaaggaaaaatggaggaatgtcaggattttttcaagactctgtacagtttcatttattttctaggcacgtacttgaaaccacatgttgccattcttgatggtgttactatgggtggtggaggaggtgtttcgattcctggaacatttcgcattgcaactgatagaacagtctttgcaactccagaagttcatattggattccatcctgatgctgcagcctccttttacttgtcgcatctaactggtcatgttggggaatacgtggccttgactggtgaaaaactcaatggagcagatatgattgcccttggtcttgcgacacact

SEQ ID NO: 22306 - protein, 215 aa, Panicum virgatum
  misc_feature: Ceres CLONE 1820975
  misc_feature (50)..(213): Pfam Name: ECH Pfam Description: Enoyl-CoA hydratase/isomerase family
  misc_feature: SWISSPROT Homolog: EC 3.1.2.4 3-hydroxyisobutyryl-CoA hydrolase
LAAAAVARQAGAALRGALGGLRPLTSLQPSHAASSEEVLVEGKASARASVLNRPGYLNALTTTMGARLNKFYESWEDNPDIGFVMMKGSGRAFCAGGDVVRLRKLVSEGKMEECQDFFKTLYSFIYFLGTYLKPHVAILDGVTMGGGGGVSIPGTFRIATDRTVFATPEVHIGFHPDAAASFYLSHLTGHVGEYVALTGEKLNGADMIALGLATH

SEQ ID NO: 22307 - DNA, 1452 bp, Panicum virgatum
  misc_feature: Ceres CLONE 1820976
  misc_feature: Encodes the peptide sequence at SEQ ID NO. 22308
tcatcagctcttcctcctcacctcgcttccaagcgacaccagaattggcagcggcaacagccaccaccacagccgcaccacttgagcttcttccccttggcttccactccactgaaccgggccggaaaggcgggggcggggggcaggcgcgagaggccatggcgagcaacggcgacgggaagggccgcgtggcggcggcggcggcgcccgggggagggtacgggtacgggtacggcgggtacgaggggcccgaggagcgcaagtggtggccgtggctcgtgcccaccgtcatcgtcgcctgcatcgcggtcttcgtcgtcgagatatacgagaacaactgccccaggcacgggagccagttcgggggttgcgtcgccggcttcctgcgccgcttctccttccagccgctccgggagaacccgctcctcgggccgtcatcctccactttgcagaaaatgggagcccttgactggaacaaaattgttcatcagcaccaaggctggcgccttattagctgcatctggctccatgctggcctgatccatttggttgtgaacatgctaagtttgctgtttataggaatccgccttgaacagcaatttgggtttgttcgcattggtgccatatacctactatccggttttggtggcagcgtgctgtctgcactcttcctacagaacaactacatctctgttggtgcatctggagctttatttggcctgcttggatccatgctctcagagctactcatgaactggactatttattccaacaaggcagcagccataataactctcctgtttattattgcgctcaacttggctattgggatactacctcacgcagacaacttcgctcatattggtggattcgctactggcttccttttgggctttgttctgttggctaggcctcaatttggttggatggaacgccatgagttgccacagactagccaacctcctaagtacaaagaataccaatacgtgctgtgggttgtggcattcgtcttgctattggctgggtttgtgatttcactggtgatgcttttcaaggggaagaatgggaacgatggctgtcactggtgccactacctgaactgcgtgccaacatcgaagtggaagtgcgacacctaggcgcctcagttttccactcacacttccgacgaaatatgtagtgttcagattcagaagaccattttttatgctgtttgtctgtagatatgaacaagttctttgttctttattggattggactttcctggtttcttaaactactttgttgagccttggcgtgtttataaatcgaggttgataccttttcaagattattgtttagagcgccagattgtcttatgttctgcagttctgccaatccttaatctgaggaatacgattgccacatttgctgttattttcaataatttaagtctatgtaagcagtgaccattgc

SEQ ID NO: 22308 - protein, 325 aa, Panicum virgatum
  misc_feature: Ceres CLONE 1820976
  misc_feature (108)..(253): Pfam Name: Rhomboid Pfam Description: Rhomboid family
  misc_feature: SWISSPROT Homolog: EC 3.4.21.105 Rhomboid protease
  misc_feature: Useful for making plants with altered cell wall content and/or composition
MASNGDGKGRVAAAAAPGGGYGYGYGGYEGPEERKWWPWLVPTVIVACIAVFVVEIYENNCPRHGSQFGGCVAGFLRRFSFQPLRENPLLGPSSSTLQKMGALDWNKIVHQHQGWRLISCIWLHAGLIHLVVNMLSLLFIGIRLEQQFGFVRIGAIYLLSGFGGSVLSALFLQNNYISVGASGALFGLLGSMLSELLMNWTIYSNKAAAIITLLFIIALNLAIGILPHADNFAHIGGFATGFLLGFVLLARPQFGWMERHELPQTSQPPKYKEYQYVLWVVAFVLLLAGFVISLVMLFKGKNGNDGCHWCHYLNCVPTSKWKCDT

SEQ ID NO: 22309 - DNA, 584 bp, Panicum virgatum
  misc_feature: Ceres CLONE 1820980
  misc_feature: Encodes the peptide sequence at SEQ ID NO. 22310
cgagcaagcaacagccacgaacccctttcccatcgcccgccaccgagatcaattcgagctagacaagatcacaagatcgacatggagtacgacgagcagtcgccggaggccgccgccggggaggagtacgccacggtcatgtccgcgccgcccaagcgccccgcggggcggaccaagttccgggagacccgccacccggtgtaccgcggcgtgcggcggcgcggccccgcggggcgctgggtctgcgaggtccgggagcccaacaagaagtcccgcatctggctcggcaccttcgccaccgccgaggccgccgcgcgcgcgctttatttcgccgcgctcgcgctccggggccgcgcggcctgcctcaacttcgccgactcggcgcgcctgctccgcgtcgacccggccacgctcgccacccccgaggacatccgccgcgtcgccatcaagctcgtctagggctccgtgaagcaggatgccaccgcggcggtcgcctcctcgtcgatctgggccgacccgaccgcgcccatggggatggcgacgcaccaccatactgacgcttcgccggacgactgctcgacaaa

SEQ ID NO: 22310 - protein, 125 aa, Panicum virgatum
  misc_feature: Ceres CLONE 1820980
  misc_feature (39)..(91): Pfam Name: AP2 Pfam Description: AP2 domain
  misc_feature: The sequence is a functional homolog of SEQ ID NO 4 in US patent 7317141
  misc_feature: The sequence is a functional homolog of SEQ ID NO 750 in the 11/435,388 US patent application
  misc_feature: The sequence is a functional homolog of SEQ ID NO 1245 in the 10/374,780 US patent application
  misc_feature: The sequence is a functional homolog of SEQ ID NO 1224 in the 10/374,780 US patent application
  misc_feature: The sequence is a functional homolog of SEQ ID NO 1413 in the 10/412,699 US patent application
  misc_feature: The sequence is a functional homolog of SEQ ID NO 710 in the 11/435,388 US patent application
  misc_feature: The sequence is a functional homolog of SEQ ID NO 1229 in the 10/374,780 US patent application
  misc_feature: The sequence is a functional homolog of SEQ ID NO 1223 in the 10/374,780 US patent application
  misc_feature: The sequence is a functional homolog of SEQ ID NO 1412 in the 10/412,699 US patent application
  misc_feature: The sequence is a functional homolog of SEQ ID NO 716 in the 11/435,388 US patent application
  misc_feature: The sequence is a functional homolog of SEQ ID NO 1232 in the 10/374,780 US patent application
  misc_feature: The sequence is a functional homolog of SEQ ID NO 718 in the 11/435,388 US patent application
  misc_feature: Useful for making plants with modulated water use efficiency
  misc_feature: Useful for making plants with modulated salt sensitivity
  misc_feature: Useful for making plants with modulated nitrogen use efficiency
  misc_feature: Useful for making plants with modulated low light sensitivity
  misc_feature: The sequence is a functional homolog of SEQ ID NO 1248 in the 10/374,780 US patent application
  misc_feature: The sequence is a functional homolog of SEQ ID NO 1227 in the 10/374,780 US patent application
  misc_feature: The sequence is a functional homolog of SEQ ID NO 706 in the 11/435,388 US patent application
  misc_feature: The sequence is a functional homolog of SEQ ID NO 1225 in the 10/374,780 US patent application
  misc_feature: The sequence is a functional homolog of SEQ ID NO 1722 in the 10/412,699 US patent application
  misc_feature: The sequence is a functional homolog of SEQ ID NO 192 in the 11/375,241 US patent application
  misc_feature: The sequence is a functional homolog of SEQ ID NO 1958 in the 10/374,780 US patent application
  misc_feature: The sequence is a functional homolog of SEQ ID NO 2241 in the 10/666,642 US patent application
  misc_feature: The sequence is a functional homolog of SEQ ID NO 424 in the 10/714,887 US patent application
  misc_feature: The sequence is a functional homolog of SEQ ID NO 46 in the 10/412,699 US patent application
  misc_feature: The sequence is a functional homolog of SEQ ID NO 57 in the 10/838,616 US patent application
  misc_feature: The sequence is a functional homolog of SEQ ID NO 576 in the 11/435,388 US patent application
  misc_feature: The sequence is a functional homolog of SEQ ID NO 72 in the 10/669,824 US patent application
  misc_feature: The sequence is a functional homolog of SEQ ID NO 72 in the 10/870,198 US patent application
  misc_feature: The sequence is a functional homolog of SEQ ID NO 98 in the 10/675,852 US patent application
  misc_feature: The sequence is a functional homolog of SEQ ID NO 1314 in the 11/479,226 US patent application
  misc_feature: The sequence is a functional homolog of SEQ ID NO 16 in the 10/225,068 US patent application
  misc_feature: The sequence is a functional homolog of SEQ ID NO 186 in the 10/374,780 US patent application
  misc_feature: The sequence is a functional homolog of SEQ ID NO 190 in the 11/375,241 US patent application
  misc_feature: The sequence is a functional homolog of SEQ ID NO 516 in the 11/435,388 US patent application
  misc_feature: The sequence is a functional homolog of SEQ ID NO 566 in the 10/225,066 US patent application
  misc_feature: The sequence is a functional homolog of SEQ ID NO 616 in the 10/412,699 US patent application
  misc_feature: The sequence is a functional homolog of SEQ ID NO 1239 in the 10/374,780 US patent application
  misc_feature: The sequence is a functional homolog of SEQ ID NO 764 in the 11/435,388 US patent application
  misc_feature: The sequence is a functional homolog of SEQ ID NO 1720 in the 10/412,699 US patent application
  misc_feature: The sequence is a functional homolog of SEQ ID NO 1956 in the 10/374,780 US patent application
  misc_feature: The sequence is a functional homolog of SEQ ID NO 196 in the 11/375,241 US patent application
  misc_feature: The sequence is a functional homolog of SEQ ID NO 2239 in the 10/666,642 US patent application
  misc_feature: The sequence is a functional homolog of SEQ ID NO 422 in the 10/714,887 US patent application
  misc_feature: The sequence is a functional homolog of SEQ ID NO 44 in the 10/412,699 US patent application
  misc_feature: The sequence is a functional homolog of SEQ ID NO 55 in the 10/838,616 US patent application
  misc_feature: The sequence is a functional homolog of SEQ ID NO 574 in the 11/435,388 US patent application
  misc_feature: The sequence is a functional homolog of SEQ ID NO 70 in the 10/669,824 US patent application
  misc_feature: The sequence is a functional homolog of SEQ ID NO 70 in the 10/870,198 US patent application
  misc_feature: The sequence is a functional homolog of SEQ ID NO 96 in the 10/675,852 US patent application
  misc_feature: The sequence is a functional homolog of SEQ ID NO 2 in US patent 7253000
  misc_feature: The sequence is a functional homolog of SEQ ID NO 1246 in the 10/374,780 US patent application
  misc_feature: The sequence is a functional homolog of SEQ ID NO 748 in the 11/435,388 US patent application
  misc_feature: The sequence is a functional homolog of SEQ ID NO 1230 in the 10/374,780 US patent application
  misc_feature: The sequence is a functional homolog of SEQ ID NO 724 in the 11/435,388 US patent application
  misc_feature: The sequence is a functional homolog of SEQ ID NO 752 in the 11/435,388 US patent application
  misc_feature: The sequence is a functional homolog of SEQ ID NO 1235 in the 10/374,780 US patent application
  misc_feature: The sequence is a functional homolog of SEQ ID NO 714 in the 11/435,388 US patent application
  misc_feature: The sequence is a functional homolog of SEQ ID NO 692 in the 11/435,388 US patent application
  misc_feature: Useful for making plants with altered terpenoid content
  misc_feature: Useful for making plants with modulated flowering time
  misc_feature: The sequence is a functional homolog of SEQ ID NO 1228 in the 10/374,780 US patent application
  misc_feature: The sequence is a functional homolog of SEQ ID NO 722 in the 11/435,388 US patent application
  misc_feature: The sequence is a functional homolog of SEQ ID NO 2 in US patent 7138277
  misc_feature: The sequence is a functional homolog of SEQ ID NO 1226 in the 10/374,780 US patent application
  misc_feature: The sequence is a functional homolog of SEQ ID NO 1244 in the 10/374,780 US patent application
  misc_feature: The sequence is a functional homolog of SEQ ID NO 744 in the 11/435,388 US patent application
  misc_feature: The sequence is a functional homolog of SEQ ID NO 704 in the 11/435,388 US patent application
  misc_feature: The sequence is a functional homolog of SEQ ID NO 700 in the 11/435,388 US patent application
  misc_feature: The sequence is a functional homolog of SEQ ID NO 1243 in the 10/374,780 US patent application
  misc_feature: The sequence is a functional homolog of SEQ ID NO 768 in the 11/435,388 US patent application
  misc_feature: The sequence is a functional homolog of SEQ ID NO 698 in the 11/435,388 US patent application
  misc_feature: The sequence is a functional homolog of SEQ ID NO 1247 in the 10/374,780 US patent application
  misc_feature: The sequence is a functional homolog of SEQ ID NO 746 in the 11/435,388 US patent application
  misc_feature: The sequence is a functional homolog of SEQ ID NO 1238 in the 10/374,780 US patent application
  misc_feature: The sequence is a functional homolog of SEQ ID NO 770 in the 11/435,388 US patent application
  misc_feature: The sequence is a functional homolog of SEQ ID NO 1221 in the 10/374,780 US patent application
  misc_feature: The sequence is a functional homolog of SEQ ID NO 1410 in the 10/412,699 US patent application
  misc_feature: The sequence is a functional homolog of SEQ ID NO 720 in the 11/435,388 US patent application
  misc_feature: The sequence is a functional homolog of SEQ ID NO 780 in the 11/435,388 US patent application
  misc_feature: The sequence is a functional homolog of SEQ ID NO 1241 in the 10/374,780 US patent application
  misc_feature: The sequence is a functional homolog of SEQ ID NO 762 in the 11/435,388 US patent application
  misc_feature: The sequence is a functional homolog of SEQ ID NO 694 in the 11/435,388 US patent application
  misc_feature: The sequence is a functional homolog of SEQ ID NO 696 in the 11/435,388 US patent application
  misc_feature: The sequence is a functional homolog of SEQ ID NO 1222 in the 10/374,780 US patent application
  misc_feature: The sequence is a functional homolog of SEQ ID NO 1411 in the 10/412,699 US patent application
  misc_feature: The sequence is a functional homolog of SEQ ID NO 712 in the 11/435,388 US patent application
  misc_feature: Useful for making plants with modulated biomass
  misc_feature: The sequence is a functional homolog of SEQ ID NO 776 in the 11/435,388 US patent application
  misc_feature: The sequence is a functional homolog of SEQ ID NO 778 in the 11/435,388 US patent application
  misc_feature: The sequence is a functional homolog of SEQ ID NO 702 in the 11/435,388 US patent application
  misc_feature: The sequence is a functional homolog of SEQ ID NO 1234 in the 10/374,780 US patent application
  misc_feature: The sequence is a functional homolog of SEQ ID NO 1231 in the 10/374,780 US patent application
  misc_feature: The sequence is a functional homolog of SEQ ID NO 708 in the 11/435,388 US patent application
  misc_feature: The sequence is a functional homolog of SEQ ID NO 1050 in the 10/666,642 US patent application
  misc_feature: The sequence is a functional homolog of SEQ ID NO 1233 in the 10/374,780 US patent application
  misc_feature: The sequence is a functional homolog of SEQ ID NO 610 in the 11/435,388 US patent application
  misc_feature: The sequence is a functional homolog of SEQ ID NO 628 in the 11/479,226 US patent application
  misc_feature: The sequence is a functional homolog of SEQ ID NO 2596 in the 10/374,780 US patent application
  misc_feature: The sequence is a functional homolog of SEQ ID NO 644 in the 10/225,066 US patent application
  misc_feature: The sequence is a functional homolog of SEQ ID NO 1356 in the 10/666,642 US patent application
  misc_feature: The sequence is a functional homolog of SEQ ID NO 1726 in the 10/412,699 US patent application
  misc_feature: The sequence is a functional homolog of SEQ ID NO 191 in the 11/479,226 US patent application
  misc_feature: The sequence is a functional homolog of SEQ ID NO 2230 in the 10/374,780 US patent application
  misc_feature: The sequence is a functional homolog of SEQ ID NO 50 in the 10/412,699 US patent application
  misc_feature: The sequence is a functional homolog of SEQ ID NO 788 in the 10/225,066 US patent application
MEYDEQSPEAAAGEEYATVMSAPPKRPAGRTKFRETRHPVYRGVRRRGPAGRWVCEVREPNKKSRIWLGTFATAEAAARALYFAALALRGRAACLNFADSARLLRVDPATLATPEDIRRVAIKLV

SEQ ID NO: 22311 - DNA, 1216 bp, Panicum virgatum
  misc_feature: Ceres CLONE 1820986
  misc_feature: Encodes the peptide sequence at SEQ ID NO. 22312
gactgctggctgcgccggggtgggcgccactgaaccctagcgcaagcacgttgccgcggcgcagcccaccgccgaagcgctccacctcggcccgccacgccgccgcccattaccgcagcgctccgccgccgcgcacccgcgcagccacccaccgccggtgcgcaccgccggcggcaagcttccggcgacgccgaggacgaccggtggctccctgaggagaggtgcccctctcgtaattcgacgattcatgctgctgatttaggtgttgctttctcaacagagccatggtgggggcgcgtgtgcagctgaaggggtggcaacaggcagctgttgcgtttggttctgcatttggggccctgcttgaccctagaagggctgacctgatagctgctcttggagagactactgggaagccagcatttgagcgtgtgcttcagcgaatgaagaatagcgcagaaggcaaggaagttctcttggagcgtcctcgtgtcatctcctcgcaggtttctcatgcctgggacatgccacagaacacattcggtgcagcctatgctcagttcatggggtcaaggaacttctcaccagacgatcgcccacctgtccgtttcatggacactgatgagctggcctacgttgcgacacaggcccgtgaagttcatgacttttggcacgttctgtttggccttccgacgaacctgattggagagactgccctcaaggtgatagaatttgagcagatgttcctcccaatgtgcatgctgtcagttgttgggggctctgcaaggttcagcgagaaacaaaggacactgtttttccagcattacttcccatgggcagcaaaagcaggtctcaagtgcacggatctgatgtctgtatactatgagaagcactttcatgaagacctggaggaagtgagaagaaactggggcattctaccatgccctgatcccaaaaagagaggtgtatagacaggcgtactctgcatggacttgtatttagttttcatactctgcatggacttgtatttagttttcatctttgcttatgtcagttcttttggaataacgtcatgagctatgttactgataccttaggaagttgcaaagtactatggttagtatgttgaaggtcgtactcctacgctgctggtatttgcaatgctatgggagtcgaacaagttcctcgacattatttatgactgagatttacttcgacg

SEQ ID NO: 22312 - protein, 227 aa, Panicum virgatum
  misc_feature: Ceres CLONE 1820986
  misc_feature (3)..(218): Pfam Name: Coq4 Pfam Description: Coenzyme Q (ubiquinone) biosynthesis protein Coq4
MVGARVQLKGWQQAAVAFGSAFGALLDPRRADLIAALGETTGKPAFERVLQRMKNSAEGKEVLLERPRVISSQVSHAWDMPQNTFGAAYAQFMGSRNFSPDDRPPVRFMDTDELAYVATQAREVHDFWHVLFGLPTNLIGETALKVIEFEQMFLPMCMLSVVGGSARFSEKQRTLFFQHYFPWAAKAGLKCTDLMSVYYEKHFHEDLEEVRRNWGILPCPDPKKRGV

SEQ ID NO: 22313 - DNA, 1467 bp, Panicum virgatum
  misc_feature: Ceres CLONE 1820991
  misc_feature: Encodes the peptide sequence at SEQ ID NO. 22314
agcctccagtacctcggatacgtgcgcggctcgttttcctcccttctccctccggtctgcctgcgcagcaggggagcagcaggcagcacacagcagcagagatggcggactacgtgtacggccctgggcggacccacctgttcgtcccgggcccggtgaacatcccggaccccgtcatccgcgccatgaaccgccagaacgaggactaccgctcgccggccgtgcccgccctcaccaagatcctcctcgaggacgtcaagaagatcttcaagaccacctccggcacccccttcatcatcccgaccaccgggacgggcgcgtgggagagcacgctgacgaacacgctgtcgcccggcgaccgcatcgtgtccttcctcatcgggcagttcagcctgctgtggatcgaccagcagcagcgcctgggcttcaacgtggacgtggtggagagcgagtggggccggggcgccgacctcgacgtgctcgaggccaagctccgccaggacacggcgcacaccatcaaggccatcgccatcgtccacaacgagaccgccaccggcgtcaccaacaacctcgccaccgtccgcaagctcctcgacgcgtaccggcacccagcgctggtgctggtggacggcgtgtcgtccatctgcgcgctggacttccgcatggacgagtggggcgtggacgtggcgctgacggggtcgcagaaggcgctgtcgatgccgacggggttgggcatcgtgtgcgccagccccaaggcgctggaagccagcaagacggccaagtccctgcgcgtcttcttcgactggaaggactacctcaagttctacgagatgggcacctactggccctacacgccctccatccagctcctctacggcctgcgcgccgcgctcgacctcctcgaggaggaggggctcgacaacgtcatcaacaggcacacccgcctcggcaccgccacccggctggccgtggaggcgtgggggctcaagaactgcacccagaaggaggagtggttcagcaacacggtcaccgccgtcgtcgtgccctcctacatcgacagcggcgagatcgtcaagcacgcctggaagcggtacaacctcagcctcggcctcggcctcaacaaggtcgccgggaaggtcttcaggattggccacctcggcaacctcaacgagctgcaactgctggggtgcctgagcggggtggagatggtgctcaaggacgtgggctacccggtgaagctcggcagcggagtggcggccgcggcggcgtacctatcgaattcgacgcctctgatcccctccaggatctgagctccgcgcgcgacggccacagaaggccggcaacgacggcgacggccggaaagaacaaacggaaacctgggcagaccggccgcacgcagtagtagctcttggctatacactctctgcatgtaaagtttaattttcacacacagctgtgctaaggagt

SEQ ID NO: 22314 - protein, 402 aa, Panicum virgatum
  misc_feature: Ceres CLONE 1820991
  misc_feature (11)..(361): Pfam Name: Aminotran_5 Pfam Description: Aminotransferase class-V
  misc_feature: SWISSPROT Homolog: EC 2.6.1.45 Serine--glyoxylate transaminase
  misc_feature: Useful for making plants with modulated nitrogen use efficiency
MADYVYGPGRTHLFVPGPVNIPDPVIRAMNRQNEDYRSPAVPALTKILLEDVKKIFKTTSGTPFIIPTTGTGAWESTLTNTLSPGDRIVSFLIGQFSLLWIDQQQRLGFNVDVVESEWGRGADLDVLEAKLRQDTAHTIKAIAIVHNETATGVTNNLATVRKLLDAYRHPALVLVDGVSSICALDFRMDEWGVDVALTGSQKALSMPTGLGIVCASPKALEASKTAKSLRVFFDWKDYLKFYEMGTYWPYTPSIQLLYGLRAALDLLEEEGLDNVINRHTRLGTATRLAVEAWGLKNCTQKEEWFSNTVTAVVVPSYIDSGEIVKHAWKRYNLSLGLGLNKVAGKVFRIGHLGNLNELQLLGCLSGVEMVLKDVGYPVKLGSGVAAAAAYLSNSTPLIPSRI

SEQ ID NO: 22315 - DNA, 562 bp, Panicum virgatum
  misc_feature: Ceres CLONE 1820991-R
cccgtcgccggcacgatctacctgaccatcgcgaccgtcgccttgtgcagcgaccggccgctctcgttcgccgcgccgtcggggcagaccgcctggagctactacaaggtggcgatcccgctggacaaggtcgcggcggtggagccggtgatgaccaaggagagcccgccggagaagtacgtgcacgtcgtcaccgtcgacgcccacgacttctggttcatgggcttcgtcagctacgacaaggccgtgcaccacctcaccgaggccgtcgtctcccaccgcttgtcgtcccagtaccagaagcagggcgtcgccggcgccgccgccgccgccgccgccggccagtgatgagagctccgttcgccggagacgcgtgtgtagttagccctgtgcagtgtagcgactagtgagtgctttgtgtcatgcttgttgcttgtgagatggacggtctaccgactcctgtgtgcgtgtggtacatttccgtggtatttgtgaattgtttgatgtgtatacacttgttaatactacctccatttcatagttcgcgatttcaaattgtttg

SEQ ID NO: 22316 - DNA, 1821 bp, Panicum virgatum
  misc_feature: Ceres CLONE 1821002
  misc_feature: Encodes the peptide sequence at SEQ ID NO. 22317
gaaagaaagggggctgtttctctccccccgtctctgtttcatcagcatcgccggcgatggcggcgctgaggaggctgctggcggatgcgccgccggggcagcaccacaagcagggcggcgcgccgtcggactggagcgcggggtacctcaacgggtggctgtcgcagcagacgccggtgttcgggctccgcctctgggtgctcatcggcatcgccgtcggcgccgccatcgtgctcgtgctcctcctcatcttcgtctgcctctcgcgccgccgccgccgccgcgacgaggtgctcgcggccaacctctaccccgccgacaccaagctgctcaagcagcacctgcagcaggccacgccgaccaaggatatccaggagatcgtccgccgccaccagcagccgcagcagccgcagacgccgccgcagcccgcggtgcagctcgcgaaagcagagccgccggtgacgccgccgccgcagcatagggcgcaggcgccggtggtgccgaccccgcccgcgcggaaaacgcctggcagcggcttgtcggccacgacgagcggcgggagcgagcgggacggggccacgccgaggagcaccgggagcgccgcgggggcgccggaggtctcgcacctcgggtgggggcactggttcacgctccgtgagctggaggaggccacggacgggctagccgaggagaatgtcatcggggagggcggctacgggatcgtgtacaggggcacgttgcacgactccaccatgatcgccgtcaagaacctgctcaataataggggccaggccgagaaggagttcaaggtggaggtcgaagcaatcggtcgtgttcggcacaagaatctcgtcaggttgcttggctactgcgtagagggtgcttacaggatgcttgtatatgagtatgtggacaatggtaatcttgatcagtggcttcatggtgatgttggggaagtgagcccactaacctgggacatcaggatgaacattatgcttgcaactgctaaagggctggcctatcttcatgaggggctggagcccaaggttgtccatcgtgacatcaaagctagcaatattcttcttgatcagcagtggaatgccaaagtatcggattttgggctcgcaaagctattgtgctcagagaaaagctacgttacaacccgtgttatgggaacctttggctatgtggcacctgaatatgccagtactgggatgttaaacgagaggagtgatgtctatagctttggtgtacttataatggagatcatcactggtagatctcctgtagattatacaagaccagctggagaggtgaacttggttgaatggctgaagaccatggtcgccgagaggaaagcagaggaagtagtggaccctaagatggctgaaaagccttctcccaaaacactgaagcgggcgctgcttgttgcgcttcgctgcgtcgaccctgatgccaacaagaggcctaaaatggggcatgtaattcacatgctcgaaatggatgatctcctattccgagatgataagaaggccggaagggatagttcagacagatacagctccaaggaggacgggagcttcagcaggcgcgagcaccaacggtacagatgatgaacaccaatgcgatactagaccggaatatgaggttgtatggattgccactagagagtagcgatattaaccatgttcccatttcattctttcccctctttcaatctcattgctctttgattgtattatgtatatgcgagcatcattctgtggggacacttgatacttgaattacacagacaagtgtagcaagcatggtgctgtgact

SEQ ID NO: 22317 - protein, 518 aa, Panicum virgatum
  misc_feature: Ceres CLONE 1821002
  misc_feature (209)..(480): Pfam Name: Pkinase_Tyr Pfam Description: Protein tyrosine kinase
  misc_feature: SWISSPROT Homolog: EC 2.7.11.1 Non-specific serine/threonine protein kinase
MAALRRLLADAPPGQHHKQGGAPSDWSAGYLNGWLSQQTPVFGLRLWVLIGIAVGAAIVLVLLLIFVCLSRRRRRRDEVLAANLYPADTKLLKQHLQQATPTKDIQEIVRRHQQPQQPQTPPQPAVQLAKAEPPVTPPPQHRAQAPVVPTPPARKTPGSGLSATTSGGSERDGATPRSTGSAAGAPEVSHLGWGHWFTLRELEEATDGLAEENVIGEGGYGIVYRGTLHDSTMIAVKNLLNNRGQAEKEFKVEVEAIGRVRHKNLVRLLGYCVEGAYRMLVYEYVDNGNLDQWLHGDVGEVSPLTWDIRMNIMLATAKGLAYLHEGLEPKVVHRDIKASNILLDQQWNAKVSDFGLAKLLCSEKSYVTTRVMGTFGYVAPEYASTGMLNERSDVYSFGVLIMEIITGRSPVDYTRPAGEVNLVEWLKTMVAERKAEEVVDPKMAEKPSPKTLKRALLVALRCVDPDANKRPKMGHVIHMLEMDDLLFRDDKKAGRDSSDRYSSKEDGSFSRREHQRYR

SEQ ID NO: 22318 - DNA, 381 bp, Panicum virgatum
  misc_feature: Ceres CLONE 1821003
  misc_feature: Encodes the peptide sequence at SEQ ID NO. 22319
acgagcgccagccagtcacctaccccgaagccgccgcgaccgatcgagccgagcgccccgccccacgccgcgccgcgccgcaccgaaaccctagctccttctcctcagccatagccaccgtctcgctcacgccgcaggtggtcttctccaccgagtcgggcggcgccctctcgtccgccaccatcctccgcttcccgccaaacttcgtgcgccagctcagcaccaaggcccgccgcaactgcagcaacatcggcgtcgcgcagatcgtcgccgcggcgtggtcagactgccccgccggccgcccccactccggcggcggcggcggccgcgcccgcggcgtggtctcctcccacgccgcggtcgaggagggcggaggggatg

SEQ ID NO: 22319 - protein, 126 aa, Panicum virgatum
  misc_feature: Ceres CLONE 1821003
  misc_feature: SWISSPROT Homolog: EC 2.5.1.48 Cystathionine gamma-synthase
ERQPVTYPEAAATDRAERPAPRRAAPHRNPSSFSSAIATVSLTPQVVFSTESGGALSSATILRFPPNFVRQLSTKARRNCSNIGVAQIVAAAWSDCPAGRPHSGGGGGRARGVVSSHAAVEEGGGD

SEQ ID NO: 22320 - DNA, 712 bp, Panicum virgatum
  misc_feature: Ceres CLONE 1821008
  misc_feature: Encodes the peptide sequence at SEQ ID NO. 22321
acgttcctgaagtgtttcaggaggccaaatcagccagcaagaggttctccactccaccgcccagaaaatccgcgtcttcgctagacctgaatgggaatccaccgttgccggtgagggcgccgggcaagctgaagcataggaaggagggccgtgccaacggaagggccaaggttgctgcactggaggtgctcgagaaatggtccgtcgatcgctcccagctgctcattgggcacaggttctcgtccggagctcacagtcggttgtttcacggaatctacaaggagcagcctgttgccgtcaagttcatcagacagcctgatgacgaggaagatgcagagctggctgctcagcttgagaagcagttcaacacggaagttaccactctgtcacgactcaatcatcctaatgtcattaagctggttggagcatgcagcagtccaccagtattctgcgtcatcactgaattcctttctggtggttctttgagagcgtttttgcacaagcaagatcacaaagctcttccactagacaagattatctcaattagcttggatattgcacgcggcatggcatacattcactcgcagggagttgtccatcgtgatgtgaaaccagagaacatcatattcgacgaagaattttgcgctaagattgttgatttttgaattgcttgtgaacaagagtactgtgaccctctggcaaacgacaccgg

SEQ ID NO: 22321 - protein, 220 aa, Panicum virgatum
  misc_feature: Ceres CLONE 1821008
  misc_feature (73)..(220): Pfam Name: Pkinase_Tyr Pfam Description: Protein tyrosine kinase
  misc_feature: SWISSPROT Homolog: EC 2.7.11.1 Non-specific serine/threonine protein kinase
VPEVFQEAKSASKRFSTPPPRKSASSLDLNGNPPLPVRAPGKLKHRKEGRANGRAKVAALEVLEKWSVDRSQLLIGHRFSSGAHSRLFHGIYKEQPVAVKFIRQPDDEEDAELAAQLEKQFNTEVTTLSRLNHPNVIKLVGACSSPPVFCVITEFLSGGSLRAFLHKQDHKALPLDKIISISLDIARGMAYIHSQGVVHRDVKPENIIFDEEFCAKIVDF

SEQ ID NO: 22322 - DNA, 681 bp, Panicum virgatum
  misc_feature: Ceres CLONE 1821010
  misc_feature: Encodes the peptide sequence at SEQ ID NO. 22323
ccgtggtttccttcctgaaatgtccaaggaagagcgtgaaaaggttgctaggagtgagacattagcaatacggctgtctaacattgcaaacatgatcctttttgctgcaaaagtgtatgcttcagtacgcagtggctcacttgctattattgcttcaacattggattctcttctagatttactgtcagggtttatcttgtggtttactgccttttcaatgcaaactccaaacccctacagatacccaattggtaaaaagcgcatgcagccactgggaatacttgtttttgcttctgttatggcaactcttggcctccagatcattctggaatcaatgcgctcactggtgtctgataaagatgaattcagcttaacaagcgagcaggaaaagtgggttgtggacatcatgctctcggtgacattagtgaaacttgccctggtgatatattgccgctcgttcaccaacgaaattgtcaaggcatatgctcaggatcacttttttgatgtcatcaccaatgtcattggtctggttgctgcactacttgcgaattatattgaaggctggattgatccagttggtgcaataattcttgcaatctacacaatcagaacatggtcgatgacggtgctggagaacgtgcactccctggtggggcagtcggcctcgccagagtacctcca

SEQ ID NO: 22323 - protein, 226 aa, Panicum virgatum
  misc_feature: Ceres CLONE 1821010
  misc_feature (23)..(226): Pfam Name: Cation_efflux Pfam Description: Cation efflux family
RGFLPEMSKEEREKVARSETLAIRLSNIANMILFAAKVYASVRSGSLAIIASTLDSLLDLLSGFILWFTAFSMQTPNPYRYPIGKKRMQPLGILVFASVMATLGLQIILESMRSLVSDKDEFSLTSEQEKWVVDIMLSVTLVKLALVIYCRSFTNEIVKAYAQDHFFDVITNVIGLVAALLANYIEGWIDPVGAIILAIYTIRTWSMTVLENVHSLVGQSASPEYL

SEQ ID NO: 22324 - DNA, 660 bp, Panicum virgatum
  misc_feature: Ceres CLONE 1821019
  misc_feature: Encodes the peptide sequence at SEQ ID NO. 22325
cccgtgctctctcagaggtgggttggcttctccccctcttaccaagtcctcggttctagggttttagttggaaggggagatggcggcggcggatgtggagtaccgctgcttcgtcggcggcctcgcctgggccaccgacaacgcgtccctccagcaggccttcgcctcctacggcgacgtcctcgactccaaggtcatcaccgaccgtgagacggggaggtcccgcgggttcggcttcgtcaccttctcaaccgagcagtcgatgctcgacgccatcgaagccatgaacggcaaggagctcgacggccgcaacatcaccgtcaaccaggcccaatcccgcggcggtggcggcggcggcggcggcggcggttacggcggcggtcgccagggaggctacggcggcggcggcggcggctacggcggcggtcgccgtgagggcggctacggtggcggcggctacgacggtggcggtggcggatacagcggcggtcgccgcgagggcggctacggcggtggtggctacggcacccgcgcagcgcgaaccagcgacagagatcgacatggccgccgccgcctcctcctccgccgtccccggcctcgccggcgccgccctcgccagccggccggcattctccaccagcttcgtgcggggcgggcggg

SEQ ID NO: 22325 - protein, 193 aa, Panicum virgatum
  misc_feature: Ceres CLONE 1821019
  misc_feature (10)..(81): Pfam Name: RRM_1 Pfam Description: RNA recognition motif. (a.k.a. RRM, RBD, or RNP domain)
  misc_feature (48)..(147): Pfam Name: GRP Pfam Description: Glycine rich protein family
  misc_feature: SWISSPROT Homolog: EC 5.2.1.8 Peptidylprolyl isomerase
  misc_feature: Useful for making plants with altered alkaloid content
  misc_feature: Useful for making plants with modulated flowering time
  misc_feature: Useful for making plants with altered lignin content
  misc_feature: Useful for making plants with modulated nitrogen use efficiency
  misc_feature: Useful for making plants with modulated biomass
MAAADVEYRCFVGGLAWATDNASLQQAFASYGDVLDSKVITDRETGRSRGFGFVTFSTEQSMLDAIEAMNGKELDGRNITVNQAQSRGGGGGGGGGGYGGGRQGGYGGGGGGYGGGRREGGYGGGGYDGGGGGYSGGRREGGYGGGGYGTRAARTSDRDRHGRRRLLLRRPRPRRRRPRQPAGILHQLRAGRA

SEQ ID NO: 22326 - DNA, 958 bp, Panicum virgatum
  misc_feature: Ceres CLONE 1821047
  misc_feature: Encodes the peptide sequence at SEQ ID NO. 22327
atcacagttcacaagctcgaagaactcgaaggccgaagcacgcagctcagagtgtgaatcgaagctcgaatagctagctactactagctgatcgagtagcttctgtgttctgtccacagcaagcccggcccacaactaacgatggcggtggcggcgaagacgacgatgcccgtggcagccgggagcggccggaggcggtacgcgctgctgctggcgctgtgggactcggagtacgcaaagaatgtgtacggcgggtaccggaacgtcttcgtcgccgcgttcggggaggagggcgagaggtgggactgcttccgcgtgattgccggcgagttcccggcgccggaggacctggcgtcgtacgacggcttcgtggtcagcggcagcccgcacgacgcgtacggcgaggagccctgggtccgccgcctctgcgcgctcctccggacgctccacgccatggagaagcgggtcctcggcgtctgcttcggccaccaggtcctgtgccgggcgctgggcgggagggtcggcaaggcgcggcacgggtgggacgtcggggtgaagaaggtgaccttcgtgcgggacctggagggcttcggcttcctgggaggtctcgaggagctcccgtcgagcgcctccctcgtcgaggtccaccaggacgaggtgtgggagctcccgccgggggcgacggcgctggcctactcggagaagacgcgcgtggaggcgttcgcggtgggcgagcacgcgctaggcatccagggccacccggagtacaccgccgacatcctccacaacctcatcgaccgcctcaccggccagagcgccatcccggcgagcgtcggcgatgaggcgcgacggacggtggcggagaccggcggccctgaccgcgtgttctggacgggcctctgcaagaggtttctcagaggtggagaaagcagcagcccgcggcctccgccggtgcgcg

SEQ ID NO: 22327 - protein, 272 aa, Panicum virgatum
  misc_feature: Ceres CLONE 1821047
  misc_feature (31)..(224): Pfam Name: GATase Pfam Description: Glutamine amidotransferase class-I
  misc_feature: SWISSPROT Homolog: EC 6.3.5.2 GMP synthase (glutamine-hydrolyzing)
MAVAAKTTMPVAAGSGRRRYALLLALWDSEYAKNVYGGYRNVFVAAFGEEGERWDCFRVIAGEFPAPEDLASYDGFVVSGSPHDAYGEEPWVRRLCALLRTLHAMEKRVLGVCFGHQVLCRALGGRVGKARHGWDVGVKKVTFVRDLEGFGFLGGLEELPSSASLVEVHQDEVWELPPGATALAYSEKTRVEAFAVGEHALGIQGHPEYTADILHNLIDRLTGQSAIPASVGDEARRTVAETGGPDRVFWTGLCKRFLRGGESSSPRPPPVR

SEQ ID NO: 22328 - DNA, 696 bp, Panicum virgatum
  misc_feature: Ceres CLONE 1821068
  misc_feature: Encodes the peptide sequence at SEQ ID NO. 22329
cccaattcccaacctcacatccccctccttccgcccgagcttcttccttcgtttaaacccaaaccctaatcgcgacctccgttcccccaaaaccctacccttgcggcggccatggacggcggcggtggcggaggcggcggcggcggagtcgggggaggtgtcatggtgggcggcggggtcggccccggcggcggcggcgtgggcgggggcgggggcggcgacgtcgagctcgtcagcaagacgctgcagttcgagcacaagctgttctacttcgatctgaaggagaacccgcgggggaggtacctcaagatctccgagaagacctcggccacgcgctccaccatcatcgtccccgtcgacggcgtcgcctggttcctcgacctcttcgactactacatccgcaccgacgagcgcgacgccttcagcaaggagctgcggctgcaaaccaaggtgttctatttcgatatcggggagaacaagagaggccgattcctcaaggtttcagaggcctctgtcaacagaaatcgtagtacaataattgttccggctggcagctctggtgaagaaggttgggaagcattcaggaatgtgctattggaaataaataatgaggcttctcgactgtatgtcctaccaaatcatccaaatcagcaacacatggaaccaccagaacgccttcctggcctttctgatgat

SEQ ID NO: 22329 - protein, 194 aa, Panicum virgatum
  misc_feature: Ceres CLONE 1821068
  misc_feature (12)..(168): Pfam Name: PurA Pfam Description: PurA ssDNA and RNA-binding protein
MDGGGGGGGGGGVGGGVMVGGGVGPGGGGVGGGGGGDVELVSKTLQFEHKLFYFDLKENPRGRYLKISEKTSATRSTIIVPVDGVAWFLDLFDYYIRTDERDAFSKELRLQTKVFYFDIGENKRGRFLKVSEASVNRNRSTIIVPAGSSGEEGWEAFRNVLLEINNEASRLYVLPNHPNQQHMEPPERLPGLSD

SEQ ID NO: 22330 - DNA, 666 bp, Panicum virgatum
  misc_feature: Ceres CLONE 1821080
  misc_feature: Encodes the peptide sequence at SEQ ID NO. 22331
caatgaaggaaatgaaatgttcacctaacacttatacatacagtattcttataaatggcctttgccgtgtacagaagtacaataaggcttttgtgttctggcaagaaatgcagaaacagggattggttcctaatgttgtgacttacacaaccatgatttctgggcttgcaaaggtaggtaacataacagatgcttgcagtctctttgagagatttaaggccaacggtggaatccccgacgcagcaagtttcaatgctcttatagagggaatgagccatgcgaatagagcaattgaggcatatcaggtatttgaagaaactcgattacgaggatgtagaattaatgtaaaggcatgcatcagtcttctagatgctttgaacaaagctgaatgtcttgagcaggctgctgttgtgggtgcagttttgagagagattgcgaagtcccagcatgcttcgagatccttgtaaaattcagcttcactggttgctatctttacagtaatggcactatgaatctaatcattttattgcacaggacttactacaaacatcagccaaattgatctggcttgttcatgctgtttgatcggttgataattagtaagaagttttgactttactgtggttcaacctttaagatagtgttctatgattcggtgtgaacact

SEQ ID NO: 22331 - protein, 154 aa, Panicum virgatum
  misc_feature: Ceres CLONE 1821080
  misc_feature (11)..(45): Pfam Name: PPR Pfam Description: PPR repeat
  misc_feature (46)..(80): Pfam Name: PPR Pfam Description: PPR repeat
  misc_feature (81)..(115): Pfam Name: PPR Pfam Description: PPR repeat
MKEMKCSPNTYTYSILINGLCRVQKYNKAFVFWQEMQKQGLVPNVVTYTTMISGLAKVGNITDACSLFERFKANGGIPDAASFNALIEGMSHANRAIEAYQVFEETRLRGCRINVKACISLLDALNKAECLEQAAVVGAVLREIAKSQHASRSL

SEQ ID NO: 22332 - DNA, 1196 bp, Panicum virgatum
  misc_feature: Ceres CLONE 1821089
  misc_feature: Encodes the peptide sequence at SEQ ID NO. 22333
aagaagagggaggagggcaagcgaccggcctgcccccaaaacccccgctctcatctccgtcaaaacccctagcgaagcctccccctctccagtctccaccttttcgccggccgcctgctcgaaagcaaccgcggaggggaagaagctgctgcgtaggagaagaaacggcggcggcggcggcgtcgtgtaggctgctgcaggccggagagggcaagctattggcagcggcggcggttttggaatgcagcagcagcagcagcagcagcacctgatgcagatgaaccagagcatgattgggggctacgcatcccctaccgctgtcaccaccgatcacatccagcagtacctggatgagaacaagcagctgatccttgccatcctcgacaaccagaacaatgggaaggtggaagagagcgaacggcaccaagctaagctccagcacaacctcatgtacctggccgccatcgccgatagtcagccgccacagacggcaccgctgtcacagtacccgtccaacctgatgatgcagccgggcccgcggtacatggggccgcagtcggggcagatgatgagcccgcagtcgctgatggcggcgcggtcctccatgatgtacgcgcacccgtccctgtcgccgcttcagcagcagcaggcggcgcacggccagcttggcatggccccaggcggcggcagcgggttcaacatcctccacggcgaggccagcatgggcggcggcgcaggtgccggcgccggcaacagcatgatgaacgccggcatgttctcgggcttcggccgccctggcagcggcagcggcgccaaggaggggtcgacctcgctgtcggtggacatcagggggggcggcggcagctccggcgcgcagagcggggacggggagtacctgaaggccggcaccgaggaggaaggcagctaagacactggcgccggcatagcggcggcggcagcagcagcagcagcagcaggattagcaggtagctttgagaactgaggagagtagtagtgtagtagtggtagctagtatgtggtcggtaaggtaggtttgccccatgggaacctggaggtggtagtgaccagcatcagcatgcatgctgggtcacttgttttggatgtgcgtggcaggttctctcgcccaagatgatgatgtagtatggaacgttgcattgctggtgccctcttgcgcc

SEQ ID NO: 22333 - protein, 228 aa, Panicum virgatum
  misc_feature: Ceres CLONE 1821089
  misc_feature (20)..(90): Pfam Name: SSXT Pfam Description: SSXT protein (N-terminal region)
MQQQQQQQHLMQMNQSMIGGYASPTAVTTDHIQQYLDENKQLILAILDNQNNGKVEESERHQAKLQHNLMYLAAIADSQPPQTAPLSQYPSNLMMQPGPRYMGPQSGQMMSPQSLMAARSSMMYAHPSLSPLQQQQAAHGQLGMAPGGGSGFNILHGEASMGGGAGAGAGNSMMNAGMFSGFGRPGSGSGAKEGSTSLSVDIRGGGGSSGAQSGDGEYLKAGTEEEGS

SEQ ID NO: 22334 - DNA, 614 bp, Panicum virgatum
  misc_feature: Ceres CLONE 1821093
  misc_feature: Encodes the peptide sequence at SEQ ID NO. 22335
ggcaagaaagctcgcagcgcagacgttcctctccgccccgtcttctgttgtctgctgctcccctgtacttacttggagatcaatctagctacacccaacatctgttggagaggacagccaccgcactgcacatcaacactgatctccgccggggggcatgggggcgacaggtaccaggggtgcggccgggactgaagggggaagcgggcaaacggtcgtcggagggggggaagagccaggccccgggtaatggtggccatgacgacgacgcagcgccggtctctgatgggcatgtggtggggtggccgccggtgagggcgtaccgaaataacgctctccatgtcgcggcggaggcagcgtccgccaagaccaccaagcacgctggtgagcagcacggggggctgtacgtgaaggtgagaatggacggagcgccctacctccggaaggtggaccttcggacgtacggcgggtacagggagctgagggacgcgctggacgcgctcttcggctgcttctcctcggcggcggtcgacggcggctgccagttcgccatcgcctacgaggacaaggacggcgacctcatgctcggcggcgacgtgccatgggatatgttc

SEQ ID NO: 22335 - protein, 203 aa, Panicum virgatum
  misc_feature: Ceres CLONE 1821093
  misc_feature (40)..(203): Pfam Name: AUX_IAA Pfam Description: AUX/IAA family
QESSQRRRSSPPRLLLSAAPLYLLGDQSSYTQHLLERTATALHINTDLRRGAWGRQVPGVRPGLKGEAGKRSSEGGKSQAPGNGGHDDDAAPVSDGHVVGWPPVRAYRNNALHVAAEAASAKTTKHAGEQHGGLYVKVRMDGAPYLRKVDLRTYGGYRELRDALDALFGCFSSAAVDGGCQFAIAYEDKDGDLMLGGDVPWDM

SEQ ID NO: 22336 - DNA, 1236 bp, Panicum virgatum
  misc_feature: Ceres CLONE 1821114
  misc_feature: Encodes the peptide sequence at SEQ ID NO. 22337
aaaaagaggaaaaaaataaaatccaagtcttaaccgagtctcccccttccccgatccgccggccgatccacccaccgccgccccgccatgccggcgttcaaggccccggcgccgggcttcgccgtccgcttcagcccgttccacgagaaccgcctcctcgccgcggcgtcgcagcacttcggccttgtcggcaacggccacctcatcgtcctcgacctcgccgccgcggggcccggcgccgccccggcccccgtcttctccttcccgacctccgacgcgctcttcgactgcgcctggtccgagtcccacgagtccctctgcgccgccgcgtccggggacggctccgtgcgcctcttcgacgccgcgctcccgccggcgcagaaccccgtccgcctcctccgggagcacgcgcgcgaggtccacggcctcgactggaaccccgtccgccgggacgccttcgtctccgcctcctgggacgacacgctcaagctctggtcccccgaccgcccggcctccgtccgcaccttccgcggccacgagtactgcgtctacggcgccgcctggtccgcgcgccacccggacgtcttcgcctccgcctccggcgaccgcactgcgcgggtctgggacgtgcgcgacccggcgccctcgctcatcctgcccgcgcacgaccacgaggtgctctcgctcgactgggacaagtacgacccctccatcctcgccaccgcctccgtcgacaagtccatccgcgtctgggacgtgcgcgcgcccaacgcgcccgtcgcgcagctctccggccacggctacgccgtcaagcgcgtccgcttctcgccgcaccgccagggcatgctcatgtcctgctcctacgacatgaccgtctgcatgtgggactaccgcgccgaggacgcgctgctcgccaggtacaaccaccacaccgagttcgtcgccggtatcgacatgagcgtgctcgtcgacgggctgcttgccagcaccggctgggacgagatggtctacatctggccctttgggaccgatcccagagccatgtagcaaaacaaatccaattcgatagaccaggtgatttgtaccattctgttttctcttatctgctttgcattgggtggtggccatagtaatacaaactactacctgtgaattgtcactcatctcttctcaaatgagctgaggggggtggaataatgtcaataacaaattgttgtcaagttcatctagtttact

SEQ ID NO: 22337 - protein, 319 aa, Panicum virgatum
  misc_feature: Ceres CLONE 1821114
  misc_feature (184)..(223): Pfam Name: WD40 Pfam Description: WD domain, G-beta repeat
  misc_feature (141)..(180): Pfam Name: WD40 Pfam Description: WD domain, G-beta repeat
  misc_feature (228)..(267): Pfam Name: WD40 Pfam Description: WD domain, G-beta repeat
  misc_feature (98)..(137): Pfam Name: WD40 Pfam Description: WD domain, G-beta repeat
  misc_feature: SWISSPROT Homolog: EC 2.3.1.48 Histone acetyltransferase
MPAFKAPAPGFAVRFSPFHENRLLAAASQHFGLVGNGHLIVLDLAAAGPGAAPAPVFSFPTSDALFDCAWSESHESLCAAASGDGSVRLFDAALPPAQNPVRLLREHAREVHGLDWNPVRRDAFVSASWDDTLKLWSPDRPASVRTFRGHEYCVYGAAWSARHPDVFASASGDRTARVWDVRDPAPSLILPAHDHEVLSLDWDKYDPSILATASVDKSIRVWDVRAPNAPVAQLSGHGYAVKRVRFSPHRQGMLMSCSYDMTVCMWDYRAEDALLARYNHHTEFVAGIDMSVLVDGLLASTGWDEMVYIWPFGTDPRAM

SEQ ID NO: 22338 - DNA, 493 bp, Panicum virgatum
  misc_feature: Ceres CLONE 1821123
  misc_feature: Encodes the peptide sequence at SEQ ID NO. 22339
actcccactccaaccacagcagcagctagcgaccggtctcactctcaccaatcgcctcacgcaatggccgcctccaccatggcgatctcctccccggcgatggccggcacccccatcaaggtgggctccttcggcgagggccgcatcaccatgcgcaagaccgcggccaagcccaaggtggcggcgtccggcagcccatggtacggccccgaccgcgtcaagtacctcggccccttctccggcgagcccccgagctacctcaccggcgagttccccggcgactacagctgggacaccgcggggctgtccgctgaccccgagaccttcgccaagaaccgcgagctggaggtcatccactcccggtgggccatgctcggcgcgctcggctgcgtcttccccgagctgctcgctcgcaacggcgtcaagttcggcgaggccgtctggttcacggcttcaagcgggctccctcatatttttgaggaggggcgccgca

SEQ ID NO: 22339 - protein, 143 aa, Panicum virgatum
  misc_feature: Ceres CLONE 1821123
  misc_feature (61)..(141): Pfam Name: Chloroa_b-bind Pfam Description: Chlorophyll A-B binding protein
MAASTMAISSPAMAGTPIKVGSFGEGRITMRKTAAKPKVAASGSPWYGPDRVKYLGPFSGEPPSYLTGEFPGDYSWDTAGLSADPETFAKNRELEVIHSRWAMLGALGCVFPELLARNGVKFGEAVWFTASSGLPHIFEEGRR

SEQ ID NO: 22340 - DNA, 664 bp, Panicum virgatum
  misc_feature: Ceres CLONE 1821126
  misc_feature: Encodes the peptide sequence at SEQ ID NO. 22341
aaaggagagagcggccggattgttgttaacttttttttttggtttggaggttgatttggaaggtgagaagagagaagcgagggtgagatcgaccggccgatcgggagggcaggccatggggcgcgggaaggtgctgctgcagcggatcgagaacaagatcagccggcaggtgacgttcgccaagcgccggaacggcctgctcaagaaggcgtacgagctctccatcctctgcgacgccgaggtcgggctcgtcctcttctcccacgctggccgcctctaccagttctcatcctcctccaatctgcttaaaactttggagaggtaccagaggtacatctatgcttctgctgatgctgcagcgccgtctagtgatgagatgcagaataactatcaagaatatatgaagttgaagacaagagttgaggttttacaacgctcgcaaaggaatcttctgggtgaagacctggctccacttaccaccagtgaacttgaccagcttgagagtcaagtagacaagaccttgaagcaaatcagatcaagaaagactcaagtgctacttgatgaactctgcgacttgaagagaaaggaacatatgctccaagatgccaacatggtcctgaaaagaaagctggacgaggtcgaggcagaggcgcctcctcgccca

SEQ ID NO: 22341 - protein, 182 aa, Panicum virgatum
  misc_feature: Ceres CLONE 1821126
  misc_feature (75)..(174): Pfam Name: K-box Pfam Description: K-box region
  misc_feature (9)..(59): Pfam Name: SRF-TF Pfam Description: SRF-type transcription factor (DNA-binding and dimerisation domain)
  misc_feature: The sequence is a functional homolog of SEQ ID NO 4 in US patent 7057087
  misc_feature: The sequence is a functional homolog of SEQ ID NO 30 in the 10/666,642 US patent application
  misc_feature: Useful for making plants with modulated biomass
  misc_feature: Useful for making plants with modulated flowering time
  misc_feature: The sequence is a functional homolog of SEQ ID NO 36 in the 10/666,642 US patent application
  misc_feature: The sequence is a functional homolog of SEQ ID NO 60 in the 10/412,699 US patent application
  misc_feature: The sequence is a functional homolog of SEQ ID NO 28 in the 10/666,642 US patent application
  misc_feature: The sequence is a functional homolog of SEQ ID NO 707 in the 10/666,642 US patent application
  misc_feature: Useful for making plants with altered alkaloid content
  misc_feature: Useful for making plants with modulated phosphate use efficiency
  misc_feature: The sequence is a functional homolog of SEQ ID NO 2 in US patent 7273968
  misc_feature: The sequence is a functional homolog of SEQ ID NO 6 in US patent 7279615
  misc_feature: The sequence is a functional homolog of SEQ ID NO 1360 in the 10/666,642 US patent application
  misc_feature: The sequence is a functional homolog of SEQ ID NO 22 in the 10/666,642 US patent application
  misc_feature: The sequence is a functional homolog of SEQ ID NO 730 in the 10/666,642 US patent application
  misc_feature: Useful for making plants with altered terpenoid content
  misc_feature: The sequence is a functional homolog of SEQ ID NO 46 in the 10/666,642 US patent application
  misc_feature: The sequence is a functional homolog of SEQ ID NO 1362 in the 10/666,642 US patent application
  misc_feature: The sequence is a functional homolog of SEQ ID NO 199 in the 11/479,226 US patent application
  misc_feature: The sequence is a functional homolog of SEQ ID NO 34 in the 10/666,642 US patent application
  misc_feature: The sequence is a functional homolog of SEQ ID NO 58 in the 10/412,699 US patent application
  misc_feature: The sequence is a functional homolog of SEQ ID NO 1701 in the 10/412,699 US patent application
  misc_feature: The sequence is a functional homolog of SEQ ID NO 1949 in the 10/412,699 US patent application
  misc_feature: The sequence is a functional homolog of SEQ ID NO 1965 in the 10/412,699 US patent application
  misc_feature: The sequence is a functional homolog of SEQ ID NO 1963 in the 10/412,699 US patent application
  misc_feature: The sequence is a functional homolog of SEQ ID NO 1967 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
MGRGKVLLQRIENKISRQVTFAKRRNGLLKKAYELSILCDAEVGLVLFSHAGRLYQFSSSSNLLKTLERYQRYIYASADAAAPSSDEMQNNYQEYMKLKTRVEVLQRSQRNLLGEDLAPLTTSELDQLESQVDKTLKQIRSRKTQVLLDELCDLKRKEHMLQDANMVLKRKLDEVEAEAPPR

SEQ ID NO: 22342 - DNA, 1700 bp, Panicum virgatum
  misc_feature: Ceres CLONE 1821127
  misc_feature: Encodes the peptide sequence at SEQ ID NO. 22343
acggctctcacaccgcgcacccccgcgtatgaacgcgcgcgcgcgcccaccgcacccgcgcacacgcagcaacagcccatggccgccgagcccggggcgctggcgttgcacgaatccgcgagggcacttgcggcctcggtgcagccgcaggtggccgccgtgctcttcgtgtccgcggcgtgcacggtggcgctcgccgccctcctggccgtgctgcggctgcgcccgccgtggtggtgcgcgtgccccgtctgcgaggcctacctgacggcgtcgtgggccggcgagttcgacaacctctgcgactggtacgcgcacctgctgcgcgcctcgccggcgcagaccgtgcacgtccacgtcctccggaacgtgctcaccgccaacccggccaccgtcgaccacatgctgcgcgcccgctttgacaactaccccaagggcgcgcccttctcggccatcctcgccgacttcctcggccgcgggatcttcaacgtcgacggggacgcgtggctcttccagcgcaagctcgccgcggccgagctcgcctcgccggcgctgcacgccttcgccgtgcgtgtcgtggcctccgagctgcggggccggctcgcccccctgctcgactctgcctcccgggagggcaggggccgggtgctcgatctgcaggacgtgttccgccgcttcgccttcgactgcatatgcaagatctctttcgggctcgaccccggctgcctcgagctgtcgatgccggtgtcgtcgttcgagaacgcgttcgacgtggcctccacgctctccgccaggcgcgccaccgtgcccatgcagatcatctggaggctcaagcgcttcttcagcttgggggacgagaggaagctccgggacgcggtgcgcctcgtcgacaggctcgccgaggaggtcatccggcagcgccgcaagctcggcggcgtagcctcgggcagcgacctcctgtcgcgcttcatgggttccatcaacgacgacaagtacctccgcgacatcgtcgtcagcttcatgctcgccggccgcgacaccgtcgcctcggcgctaaccgccttcttcctgctcctctccgatcacccggaggtcgccgcggccatccgggacgaggtcgcccgcgtcgccggcgacgccgaccggctcacggcctccaccttccacaagctcaagggcatgcactacgtgcacgcggcactgtacgagagcatgcggctgttcccgccggtgcagttcgactccaagttcgccgccggcgacgacaagctcccggacggcacggccgtggcgaagggcacccgggtcacctaccacgcctacgccatgggccgcatggagtccgtgtggggccccgactgcggcgagttccggcccgagcgctggctccgggacggccggttcgtcccggagagcccgtaccggtaccccgtcttccagggcggcgcgcgcgtgtgcatcggcaaggagctggccctcatggagatgaaggccgtcatcgtcgccgtggtccggagcttcgacgtcgaggcgatcgagcggagctcccggcggcccaggttcgcgccggggctgaccgccacgttcgcgggcggggtaccggtgcgagtgcgccggcgagcacgtgagagcggggacggcccgccaatctgacgaaacggaataaaaaactgttggtgtcatcacgattctcccccctc

SEQ ID NO: 22343 - protein, 524 aa, Panicum virgatum
  misc_feature: Ceres CLONE 1821127
  misc_feature (46)..(509): Pfam Name: p450 Pfam Description: Cytochrome P450
  misc_feature: SWISSPROT Homolog: EC 1.14.13.98 Cholesterol 24-hydroxylase
MAAEPGALALHESARALAASVQPQVAAVLFVSAACTVALAALLAVLRLRPPWWCACPVCEAYLTASWAGEFDNLCDWYAHLLRASPAQTVHVHVLRNVLTANPATVDHMLRARFDNYPKGAPFSAILADFLGRGIFNVDGDAWLFQRKLAAAELASPALHAFAVRVVASELRGRLAPLLDSASREGRGRVLDLQDVFRRFAFDCICKISFGLDPGCLELSMPVSSFENAFDVASTLSARRATVPMQIIWRLKRFFSLGDERKLRDAVRLVDRLAEEVIRQRRKLGGVASGSDLLSRFMGSINDDKYLRDIVVSFMLAGRDTVASALTAFFLLLSDHPEVAAAIRDEVARVAGDADRLTASTFHKLKGMHYVHAALYESMRLFPPVQFDSKFAAGDDKLPDGTAVAKGTRVTYHAYAMGRMESVWGPDCGEFRPERWLRDGRFVPESPYRYPVFQGGARVCIGKELALMEMKAVIVAVVRSFDVEAIERSSRRPRFAPGLTATFAGGVPVRVRRRARESGDGPPI

SEQ ID NO: 22344 - DNA, 675 bp, Panicum virgatum
  misc_feature: Ceres CLONE 1821136
  misc_feature: Encodes the peptide sequence at SEQ ID NO. 22345
agtcatctccaaaatctctctatctcaacaccaaaagaggaagctgctgcaagtcactggaggtggcacgggccttggcagcaagctgcgcggcgcggcgggaaattgggaggcccgcggcgacatgttcggctgagatggggaggccacgggcaggcggtagcagcttctccaacgagcgatggctagcgcaacagtatccggcagcaggttggaagcgccatcaggttgctgatgttaaaaagctcattgagactacacaagggcagaatgtctacccagctgatcaacagatgcttattcatcaagggaatgttctaaaaaatgagacgacactcgaagagaacaaagttcttgagaacaatttcattgttataatgttgtccaagaagggatcatcaagtgctggtactgctaaggctcccacaagtcagacctcagttgatagggcgattcctgcctcccctgcaactcaaccaccagcagcagcaccagcacccattgtgcctgttagtgcacctgccccaactgcagcagctggtccagctccaacctctacggcaatcactgaagcggatccttatggtcaagctgcgtcaaaccttgttgctggtggcaatctagaagcaactatacagtctattcttgaaatgggtggaggcgcatgggaccgtg

SEQ ID NO: 22345 - protein, 179 aa, Panicum virgatum
  misc_feature: Ceres CLONE 1821136
  misc_feature (15)..(87): Pfam Name: ubiquitin Pfam Description: Ubiquitin family
MGRPRAGGSSFSNERWLAQQYPAAGWKRHQVADVKKLIETTQGQNVYPADQQMLIHQGNVLKNETTLEENKVLENNFIVIMLSKKGSSSAGTAKAPTSQTSVDRAIPASPATQPPAAAPAPIVPVSAPAPTAAAGPAPTSTAITEADPYGQAASNLVAGGNLEATIQSILEMGGGAWDR

SEQ ID NO: 22346 - DNA, 688 bp, Panicum virgatum
  misc_feature: Ceres CLONE 1821153
  misc_feature: Encodes the peptide sequence at SEQ ID NO. 22347
ctcgaaagcgctactcttaagacctccagctcctccgctgctcgttctcctcgcttgcggtggcggcggccttcgggggaagaagaggataggaaaagggagatgaactgatgaaggcgtgcgcgaaggcggcgggggagaggctccccctggttcgtcctcccaccgggcgggcgctggctcggagctctgcaggagcagttaatcgcatctatgagatcaaagggcgcatacaaacacgccctctggcaatctgtgttgctgatgtctcagacatatcacgatttgctttagtagatcacttgccgcatggattgcttcatagtctacttcctgggcctgtcactgttgttctaaaacgaggtgaagacagtatattagagagatcacttaatcctggcttggatagcattggagttcgtgtgccggatctggatttcatacgatccattgctcgtggtgctggaagtgcacttgcacttactagtgccaacttaagcggacgacctagtagtgtcagcatcagagatttcgaggatttatggccgcattgttcatatgtctttgatggtggaatacttccttctgggcgtgctggttcaacaattgttgacctaataacaccaggagtctacaagatattgagagatggaagtttcagggaggaaacaacacgggtgcttggcag

SEQ ID NO: 22347 - protein, 192 aa, Panicum virgatum
  misc_feature: Ceres CLONE 1821153
  misc_feature (5)..(181): Pfam Name: Sua5_yciO_yrdC Pfam Description: yrdC domain
MKACAKAAGERLPLVRPPTGRALARSSAGAVNRIYEIKGRIQTRPLAICVADVSDISRFALVDHLPHGLLHSLLPGPVTVVLKRGEDSILERSLNPGLDSIGVRVPDLDFIRSIARGAGSALALTSANLSGRPSSVSIRDFEDLWPHCSYVFDGGILPSGRAGSTIVDLITPGVYKILRDGSFREETTRVLG

SEQ ID NO: 22348 - DNA, 1111 bp, Panicum virgatum
  misc_feature: Ceres CLONE 1821154
  misc_feature: Encodes the peptide sequence at SEQ ID NO. 22349
agagccgtcgtcctcgcccctccccgtccccagcgaagccaagccggcacaatgccaggcgccgccgtggcctcgcctctcctcctctcgctctcctcgtcctcctccccattcctctcttccccatccacttccttcctgccgcccacttcctccgctgccccgcactccgccggcaggaccaaggcggcggtctccgtcctccgcgcgctgcgggccgaggcggccaccctccccgtgctctccttcactggagacaaggtcggggaggtcaccctcgacctcaagtccgcgccgccctccaccgcgcgcgccgtcgtgcaccgcgccatcatcaccgaccgccagaacgcgcgccggggcacggcctccacgctcacccgcggcgaggtcagcggcggagggaggaagccctaccagcagaagaagacggggaaggcgcggcgcgggtcgcagcgcaccccgctccgcccaggtggtggcgtcgtgttcggccccaagccccgcgactggtccatcaagatcaaccgcaaggagaagcgcctcgccatctccaccgcgctcgccagcgccgccgtggccgaggacgccttcgtcgtcgaggagttcgacgaggccttcgcgtcagggcccaagaccaaggacttcgtggccgctctgcagcggtgggggctcgaccccaagcagaaggccatgttctttgccacggagttcgacgacaatgtgcggcttagcggcaggaacatcggttctctcaagatgctcacacccaggacgcttaatctgtacgacatcctcgacgcccgcaagctcttctttactcctgctgccgtagactacctcaactccaggtatggaaccagcgcttctgatgactatgatactgacgatgaggacgatgccgaagaggagcaagaagtagtagaagaaggcacaacagtggaggcggctcaagatgtgactgaagagagcgaggcagatggcagttcctaggtgaggaggtgtagatctacaaatttttatttcttatttgttatgttacccttgggtgagcacgaattgttcgggaattacctccctaacgaggaagccttttgtctgcttttattct

SEQ ID NO: 22349 - protein, 313 aa, Panicum virgatum
  misc_feature: Ceres CLONE 1821154
  misc_feature (73)..(267): Pfam Name: Ribosomal_L4 Pfam Description: Ribosomal protein L4/L1 family
MPGAAVASPLLLSLSSSSSPFLSSPSTSFLPPTSSAAPHSAGRTKAAVSVLRALRAEAATLPVLSFTGDKVGEVTLDLKSAPPSTARAVVHRAIITDRQNARRGTASTLTRGEVSGGGRKPYQQKKTGKARRGSQRTPLRPGGGVVFGPKPRDWSIKINRKEKRLAISTALASAAVAEDAFVVEEFDEAFASGPKTKDFVAALQRWGLDPKQKAMFFATEFDDNVRLSGRNIGSLKMLTPRTLNLYDILDARKLFFTPAAVDYLNSRYGTSASDDYDTDDEDDAEEEQEVVEEGTTVEAAQDVTEESEADGSS

SEQ ID NO: 22350 - DNA, 1640 bp, Panicum virgatum
  misc_feature: Ceres CLONE 1821171
  misc_feature: Encodes the peptide sequence at SEQ ID NO. 22351
gaactgaaacccccccaaatccgcagcgcttgccctatccacctcgattccgatcctcccgtggcggcggcggcgtcgaaggcgaaggcggcggggccatgggcgggggcggtgacggagacgcgtgggcggatcaggagcagggcaacggcgggggcagccgcggtgggggcggcggcggcggggaggccaagcggtcggagatctacacctacgaggccggctggcacatctacgccatgaactggagcgtgcgccgcgacaagaagtaccgcctcgccatcggcagcctcctcgagcaggtccccaaccgcgtcgaggtcgtccagctcgacgaggcctcgggcgacatcgcccccgtcctcgccttcgaccaccagtacccgcccaccaagaccatgttcatcccggacccgcacgcgctccgccccgacctgctcgccacctccgccgaccacctccgcatctggcgcatcccctccgccgacgacgccgacggcgacgccccctccgccaacaactccggctccgtccgctgcaacggcgccccgcagccgggcgtcgagctccgctgcgagctcaacggcaaccgcaacagcgactactgcggcccgctcacctccttcgactggaacgacgccgacccgcgccgcatcggcacctcctccatcgacaccacctgcaccatctgggacgtcgagcgcgaggccgtcgacacccagctcatcgcccacgacaaggaggtctatgacatcgcctggggcggcgcgggggtcttcgcctccgtctccgctgacggctctgtccgtgtctttgatctccgggacaaggagcattccacaatcatctacgagtctggttcaggtggcggcggtggcggctccaattctggtgctggagatggcggcgctgcatcgccaacaccgctcgtcaggctgggctggaacaagcaggaccctaggtacatggccaccatcatcctggatagccctaaggtggtagtgcttgatatccgctacccgacactgccagtggtagagctgcatcgtcaccatgcccctgtcaatgccatcgcgtgggcacctcactcttcatgccacatctgcacagccggtgatgacatgcaggccctgatatgggacctatcatccatgggcactgggagcaacggtggcaacaatggaaatggtaatgctgccgcagctgctgcagcagagggtggtctggatcccattctggcatatacggcaggagcagagattgagcagctgcagtggtcggcgacccagcctgactgggttgctattgcatttgccaataaacttcagattctcagggtctgattgcctaatcccatctggttcactgagaagagttaaagacaaatggcaaacttaggataatcttgcaattgctttggtgttgcttatctatgctgtgcacaactgatgtccaatgattggttgtttctagtggtagaacagaagatttgctagttagaagctggaattggcaaacatggtttgtagattaaagtagctgctatggtaatagtgttggtgataatgggaactgaagttagctatctctttctgatagtatgttctgcatctgctcattagcatgtagattgacagctt

SEQ ID NO: 22351 - protein, 414 aa, Panicum virgatum
  misc_feature: Ceres CLONE 1821171
  misc_feature (309)..(348): Pfam Name: WD40 Pfam Description: WD domain, G-beta repeat
  misc_feature (203)..(240): Pfam Name: WD40 Pfam Description: WD domain, G-beta repeat
  misc_feature: SWISSPROT Homolog: EC 2.3.1.48 Histone acetyltransferase
MGGGGDGDAWADQEQGNGGGSRGGGGGGGEAKRSEIYTYEAGWHIYAMNWSVRRDKKYRLAIGSLLEQVPNRVEVVQLDEASGDIAPVLAFDHQYPPTKTMFIPDPHALRPDLLATSADHLRIWRIPSADDADGDAPSANNSGSVRCNGAPQPGVELRCELNGNRNSDYCGPLTSFDWNDADPRRIGTSSIDTTCTIWDVEREAVDTQLIAHDKEVYDIAWGGAGVFASVSADGSVRVFDLRDKEHSTIIYESGSGGGGGGSNSGAGDGGAASPTPLVRLGWNKQDPRYMATIILDSPKVVVLDIRYPTLPVVELHRHHAPVNAIAWAPHSSCHICTAGDDMQALIWDLSSMGTGSNGGNNGNGNAAAAAAAEGGLDPILAYTAGAEIEQLQWSATQPDWVAIAFANKLQILRV

SEQ ID NO: 22352 - DNA, 736 bp, Panicum virgatum
  misc_feature: Ceres CLONE 1821189
  misc_feature: Encodes the peptide sequence at SEQ ID NO. 22353
gaaatatttttggacgctgacccaaccaacccccgcctcgacgcatccccaccaacccctgcctcacgctccgcctccgagcctcagaccaacccagatcaccaatcgccggcgccacctatatatcgcggcacacccgcccctgacctcctcagcttcacgctccgaagcttcaactacccatccagtttacctgagcagagcacgaaagcagagcgcggagagggaggtagctacctgagccgagctgacagcagagcagattggtgcggcaatggctgcggcgagtatgatcagggcgccggccgggcagaatccgaggctcgcggggaggggcggcggcgtggtccggtgctcgttgcagggcgcggtggtgggcggccgggccgagtggcagagcagctgcgcggtgctgtccagcaaggtggccgcgctcggcgcgcactcggtcaacggctacgtcgcgcccgcgcccgcgccgccgcagcacggggcggtgctggatctggtccccgtgagcagcatcgacggcggcgtcaagaagaacctgccgcagccgctgcgtatcgcggacctgtccccggcgccgatgcacgggtcgcagctgcgcgtggcgtaccagggcgtgcccggcgcgtacagcgagaaggcggccggcaaggcgtacccgggcagcgacgccatcccctgcgaccagttcgaggtggcgtttcaggccgtggagctctggatcgcc

SEQ ID NO: 22353 - protein, 153 aa, Panicum virgatum
  misc_feature: Ceres CLONE 1821189
  misc_feature: Useful for making plants with altered lignin content
MAAASMIRAPAGQNPRLAGRGGGVVRCSLQGAVVGGRAEWQSSCAVLSSKVAALGAHSVNGYVAPAPAPPQHGAVLDLVPVSSIDGGVKKNLPQPLRIADLSPAPMHGSQLRVAYQGVPGAYSEKAAGKAYPGSDAIPCDQFEVAFQAVELWI

SEQ ID NO: 22354 - DNA, 1389 bp, Panicum virgatum
  misc_feature: Ceres CLONE 1821192
  misc_feature: Encodes the peptide sequence at SEQ ID NO. 22355
atcttccagctcgggaatcccatcctcctcggctcggccatggcgcgcctgctgctcttcccgtcgcaagcgtgggtcgatcccgacctccgcctccactcggtggcgccctcgtcggcctccaagcctcccgcgcacagccaacacggtggtcgcgtctttatcgcccgcgttgcagagcgcgtctccaggcctcctcctgccggagctcgccgcctcgggctcctctccgctgtccgccgacacccccttcctggcctctgctcgaaggagggcgcttttcttgaagctttctgtcacccttcagacaaggataatagaagcaggaatttgcttctgcaattcggtgcacttccatgttgcactacagtttggtttactactgcacaatcagcacattctagtgtgggaacaaagttaaatatggtttacgaggtcggagagctgtttgagctgggaattcagctgtcgtatcttcttatactacttggtctgcttggagctggtacattttttgtcattcgtcaggttctcgttcgcagagagcttgatctttctgccaaagagctgcaagaacaagtgagaagtggtgatgcaagtgctacagagtattttgagcttggagcagttatgctacggagaaaattttatccagctgctatcaaatatctgcagcaagcaattgaaaaatgggacagagatgagcaagatcttgcgcaggtgtacaatgccctgggggtcagttacaagcgagataacaaactggacaaggcaatccagcagtttgagaaggccgtggagctccaaccaggctatgtgacggcttggaacaacctaggcgacgcatatgagcagaagaaagacctgaagtcggccctcaaggcttttgaggaggtcctcctctttgatcccaacaacaaggttgcaaggccacgcgtggacgacctccggcagcgcgccagcatgtacaagggcgtgcctgtaaagtctgaaaagcgatagctgtattcccttttgggggtaaaattgtgcattactgcatttgtcctgtccccatggcggagtagcagttgttcaatttttgaacggtagcatttgtaaacatgacgactcggctcggaatggtgcctgaagaaaggcagatgtaatatgcatgcttatcttgttggagcaatgcagaatgtgctgtaggagcctgtgattgtgttcgcctgttgatctgctgtaagatggaagtggttatctgcaaaaagccgttgaggcggtgacagagagattgccctggagagccttacaaggtttctgcagcactgttgggaggtgccatcggggtttataaggctaattacagtgcaaagtttcaatatacaattaccaatagtgattacc

SEQ ID NO: 22355 - protein, 320 aa, Panicum virgatum
  misc_feature: Ceres CLONE 1821192
  misc_feature (226)..(259): Pfam Name: TPR_1 Pfam Description: Tetratricopeptide repeat
  misc_feature (260)..(293): Pfam Name: TPR_1 Pfam Description: Tetratricopeptide repeat
MARLLLFPSQAWVDPDLRLHSVAPSSASKPPAHSQHGGRVFIARVAERVSRPPPAGARRLGLLSAVRRHPLPGLCSKEGAFLEAFCHPSDKDNRSRNLLLQFGALPCCTTVWFTTAQSAHSSVGTKLNMVYEVGELFELGIQLSYLLILLGLLGAGTFFVIRQVLVRRELDLSAKELQEQVRSGDASATEYFELGAVMLRRKFYPAAIKYLQQAIEKWDRDEQDLAQVYNALGVSYKRDNKLDKAIQQFEKAVELQPGYVTAWNNLGDAYEQKKDLKSALKAFEEVLLFDPNNKVARPRVDDLRQRASMYKGVPVKSEKR

SEQ ID NO: 22356 - DNA, 953 bp, Panicum virgatum
  misc_feature: Ceres CLONE 1821204-R
  misc_feature: Encodes the peptide sequence at SEQ ID NO. 22357
cggcggcgacggccgcgtccggattttcggcaccctcaagctccagaacgggaccggggaggtgaaccaggtctggcaggtgggcccattctccggcggggccatcggtacccactcgacgactaatgccgagaacctgaactccaaggggaagctgaacctcctcaccggggccagcaccgccgccagcggggggagcagcgtcctcaggaagagaaatacccatggagtcctgaatgctgtgagctggggccttctgctgcctatgggagccatttttgcgagatacctcaagacattcaaatcggctgatcccgcatggttttacctccatgtcgcgtgccagctgattggatatggtgtcggagtgtctggctgggcaactgggattcatcttggaaacatgtccaaggggatcacctattcagttcacaggaacattgggatcgcagtatttgctcttggtactctgcagatctttgcgctcttcttgaggccgaagaaggatcacaagtaccggttctactggaacatttaccatcactccatcggttacaccatcatcatactgggagtcatcaacatcttcaagggaatgtccatcctgagtgtcgaccagaagtggaagacggcctacatcattgccatctgcatcctgggcgccattgccttgatcctggaagtcgttacatggggcattgtcttgaagcggaggaaagaggacagcaagacctacaatggcaatgggaacggccacttgccggtatctatgtaatgactccatagtcaggtcccctttggcctgtagttatcttcagcggtgtgttggtgtgcagatgtaggcggtagctcctgtgatcatagtgtctaatctctctttttgtgtgatagatgtgtgtaaactgcacaattatactggagatgagtcatgactcatgagtgatactagtggc

SEQ ID NO: 22357 - protein, 257 aa, Panicum virgatum
  misc_feature: Ceres CLONE 1821204-R
  misc_feature: Useful for making plants with modulated phosphate use efficiency
GGDGRVRIFGTLKLQNGTGEVNQVWQVGPFSGGAIGTHSTTNAENLNSKGKLNLLTGASTAASGGSSVLRKRNTHGVLNAVSWGLLLPMGAIFARYLKTFKSADPAWFYLHVACQLIGYGVGVSGWATGIHLGNMSKGITYSVHRNIGIAVFALGTLQIFALFLRPKKDHKYRFYWNIYHHSIGYTIIILGVINIFKGMSILSVDQKWKTAYIIAICILGAIALILEVVTWGIVLKRRKEDSKTYNGNGNGHLPVSM

SEQ ID NO: 22358 - DNA, 563 bp, Panicum virgatum
  misc_feature: Ceres CLONE 1821204
accagtccaccaccacccggcggccgctgcatccaagctccaagcccgcacccaaagtccgcagcctttctgcgtttccccaccagagattccccttccttggagcctagtgcgcgcgcgcgccccccgcacacgcaaggacacccccgcagctgcggggacgctcgccatgtccttcccgcggctcctcgtcctcttcctcctggcggcggcggtggccgcgccgccgcgccgcggggccgcggccgccgcctgcgcggcggagaggttctcgggcaaccgcgtcttcgcgacgtgcgtcgacctgccccacctgagcgcgtccctgcactggacctacgacaccgcggcgtcgtccctgtccgtcgcgttcctcgcggccccgccctccggcggctgggtcgcctgggggctcaaccccaccgccgagagcatgagcggcacgcaggcgctcatcgccggccccaagggcggcggcgcctacgaggtgcagacgtacggcatctccgggtactcgctgggctcccctgggctactctcctacccgacgtccgacctcgccg

SEQ ID NO: 22359 - DNA, 1162 bp, Panicum virgatum
  misc_feature: Ceres CLONE 1821222
  misc_feature: Encodes the peptide sequence at SEQ ID NO. 22360
agcgacgcaacgagctcgtaacgcccgtaccctctctctcgcggccacccctttcctgccggcgacgaccgccgccacgtctacgccgggccctttgccggcgacgagccccgaaaagatcgactcttttatgagtccacaaggcacccaggatgaagtttttagaacacacccccttcgacagcataaatctgttcctcgaccaactcaacctcggcgattgtgcaatcagaggaaaccttgaagccttctcatgcaagcacactgcgacagaccgccggctttcaattagcctagaacatgagattcttgattacttaggaaagtcctctgacagtaacccttcttcaccagtggagcacctatcctccagatcaagccggaagacattgatatatctagttcttactcttgggcacatgtatccagattatgatttcagtgctgttcgggcacacttgttcttccaagaagaggagatggaaagtttcaagcagatgatagacacctacttatctgatgcttctaggcaatgggcagcaacaaatgagggcagttctcttctggacagtatgactaaagctattgatgaggttatcaaaatcagagagtgtgacatctacagctataacccagactctgatggagatccagttcaagagaaaggggccatatggtcattctactacttcttctacaataggaagctaaagcgagttgtgagctttcgatgtcactgcactagcaaattatcagcagatgacttcctaactggtgtggcgtctgatggtgaagaggaagatgccttgattgacatggacatatgactgaccgcgttctgctcagaacctgttgtgtgtgtgtaatatatagcgtatatgccctattcccgttaggaagcttttaatataacttcccttttatcgtagcctgcggaagctatggctcttgttagcgttgtatatgcggattggagatttggtagcggcaaacttttaatccctgaggtttgaactgtcacgctatgttcgtactctagtgcttgctggaactgaattctatgtcctgcttagttaaagaataaaatatttcagacaattgtgtaatcaaatttgctctactgttcattgactggtgtttatggaactcccatctttgttgc

SEQ ID NO: 22360 - protein, 224 aa, Panicum virgatum
  misc_feature: Ceres CLONE 1821222
  misc_feature (25)..(193): Pfam Name: Maf1 Pfam Description: Maf1 regulator
MKFLEHTPFDSINLFLDQLNLGDCAIRGNLEAFSCKHTATDRRLSISLEHEILDYLGKSSDSNPSSPVEHLSSRSSRKTLIYLVLTLGHMYPDYDFSAVRAHLFFQEEEMESFKQMIDTYLSDASRQWAATNEGSSLLDSMTKAIDEVIKIRECDIYSYNPDSDGDPVQEKGAIWSFYYFFYNRKLKRVVSFRCHCTSKLSADDFLTGVASDGEEEDALIDMDI

SEQ ID NO: 22361 - DNA, 1113 bp, Panicum virgatum
  misc_feature: Ceres CLONE 1821240
  misc_feature: Encodes the peptide sequence at SEQ ID NO. 22362
acacacggcgtcctttgtgtgagcacaccgcgcagccaagaaaaagggggaagaagaaccagccaactagcatccttgcttttgggtttctcatccgagcagcggcggcgtcggcggagaagagagaagagcggggcggcatggccgagcacaaggaggagccggtgctggagtcggtgatggataagatctccgacaagttccacggcggggactcctcgtcatcgtccgactcggacgacgagaagaagaaggggtcctcgtcggcgtcgtcggcggaggccatgaaggccaagatctaccgcctcttcggccgcgagagacccgtccactccgtcctcggcggcggcaagcctgctgatcttgtcctatggaggaacaagaagatctccggcggtgtccttgctggtgccaccaccatctggctcctgttcgaggtcatggagtaccatctcctcaccttggtgtgccactgcctcatcctctcactggccatccttttcctgtggtccaatgcctccactttcatcaacaagtctccaccaaacattcctgaggtgaaaatcccagaagatgcggcagttaacgttgctctcacactgagatatgagatcaacaggggcttcgctaccttgagggagattggacatggccgtgatcttaagaaattcctgattgttatagcaggtctctggcttctttcagttcttgggagctgctgcaatttcctgacattatcttatattgtcttcatggtgctgtacactgtcccagtactgtatgagaagtatgaggacaaggttgatgcttttggtgagaaggctatgattgaacttaggaagtactatgccatcttcgatgagaagtgcctatcgaagattcctaagggtcctctgaaagataagaagcactagatttgcagtaaggttcttgctatgaatatgataaatgactacctatcaccttcggttttggaaggatggctgttggtccaagtcactagttgatagtatatatctgtatgggcaattctattgtgactgattgttgtgatctgctgtgatattttgaagtcatgtgggctgaaaagttgttgatcttgcttttggtttc

SEQ ID NO: 22362 - protein, 257 aa, Panicum virgatum
  misc_feature: Ceres CLONE 1821240
  misc_feature (72)..(255): Pfam Name: Reticulon Pfam Description: Reticulon
MAEHKEEPVLESVMDKISDKFHGGDSSSSSDSDDEKKKGSSSASSAEAMKAKIYRLFGRERPVHSVLGGGKPADLVLWRNKKISGGVLAGATTIWLLFEVMEYHLLTLVCHCLILSLAILFLWSNASTFINKSPPNIPEVKIPEDAAVNVALTLRYEINRGFATLREIGHGRDLKKFLIVIAGLWLLSVLGSCCNFLTLSYIVFMVLYTVPVLYEKYEDKVDAFGEKAMIELRKYYAIFDEKCLSKIPKGPLKDKKH

SEQ ID NO: 22363 - DNA, 1675 bp, Panicum virgatum
  misc_feature: Ceres CLONE 1821257
  misc_feature: Encodes the peptide sequence at SEQ ID NO. 22364
atcccccggccgaggaaacgcgacgcaagcgcacacggattcatatacctctctgtttggggggagcggcggacgaatcgggtgggagcggaggatggcggcagcagcaggagccgggaggccgtcgataaccgcgccgccgacaccgccggctccattaccctccagcaagcttgttaccgcctgcttcttcgccctgctcctccccatcctcctcacaggggaggtggcggtggccgaggctctgtcgatcggggtcaactacgggcagatcgccaacaacctcccgtcgccggcgcgggtgtcgtggctgctccgttcgatgcgcatcagcaaggtgaagctctacgacgcggaccccaacgtcctgcgcgcgttcctgggcacgggcgtcgacttcgtggtgggcatcggcaacgaggccgtcccggcgatggtgagccccgcggcggcgcaggcgtggctgcagcagcacctggtgccgcacctccgcgctggcgcgcgcgtcacctgcgtcaccgtgggcaacgaggtgttcaagggcaacgacacggcgctccaggcggcggtgctccccgccatggagtccgtgcaccgcgccctgggcgcgctgggcctgcagggccgcgtcaacgtcaccacggcgcactcgctggacatcatgggcgtctccttcccgccgtcggcgggggcgttcagcccggcggcgctgccgcacctgcggccgttcctgggcttcctctccgcgacgcgcgcgccgttcctcatcaactgctacccctacttcgcctacagggacgacccggcgcgggtgccgctggagtacgcgctgctccagcccaacgccgccggcgtcgccgacccgcacacgggcctccgctacgacaacatgctgtacgcgcaggtggacgccgtgtacgcggccatccaggcgctgggccacacggacgtcgaggtggtggtctccgagaccgggtggccgtcgcggggcgaccccgacgagcccggcgccacgcccgagaacgccggcacctacgtccgcaacctcctgcagcggatcgaggcggggcagggcacgccgctgcgccccgccgcgcccgtcggcgtcttcgtcttcgcgctcttcaacgagaacctcaagcccggcccggcgtcggagcgcaactacggcctcttctaccccgacggcacgcccgtctacaacgccggcgtgcacggctacctcccgccgatgctcgccgtctccaacgcggcgcgacaggtgattcaattgtttacgctggtggccgtcgcgtccgtcgccttcgtcttatcctgacagcatgagctaccgacgacggagtactaacaactacagacagggaatgtgagctgagcatctcgtgctgacagggttggtttcctgttgcaactcgcgagcagggacttactgagtggtctggtcatctacaccttggtgtactctggatttatgatggcgttcaggagcccccttccttattggactcatactgacattaggttagagctgactgaaaaatgtgcatgatagactcatcagagcttatcttttgacccagaaaggtaggaacagtagcaacagctgctttgactgctactatgtattggcagataattgatatcgattcaataccatgcaatattattcttttcc

SEQ ID NO: 22364 - protein, 407 aa, Panicum virgatum
  misc_feature: Ceres CLONE 1821257
  misc_feature (53)..(373): Pfam Name: Glyco_hydro_17 Pfam Description: Glycosyl hydrolases family 17
  misc_feature: SWISSPROT Homolog: EC 3.2.1.39 Glucan endo-1,3-beta-D-glucosidase
  misc_feature: Useful for making plants with altered carbohydrate content
  misc_feature: Useful for making plants with altered cell wall content and/or composition
  misc_feature: Useful for making plants with altered lignin content
MAAAAGAGRPSITAPPTPPAPLPSSKLVTACFFALLLPILLTGEVAVAEALSIGVNYGQIANNLPSPARVSWLLRSMRISKVKLYDADPNVLRAFLGTGVDFVVGIGNEAVPAMVSPAAAQAWLQQHLVPHLRAGARVTCVTVGNEVFKGNDTALQAAVLPAMESVHRALGALGLQGRVNVTTAHSLDIMGVSFPPSAGAFSPAALPHLRPFLGFLSATRAPFLINCYPYFAYRDDPARVPLEYALLQPNAAGVADPHTGLRYDNMLYAQVDAVYAAIQALGHTDVEVVVSETGWPSRGDPDEPGATPENAGTYVRNLLQRIEAGQGTPLRPAAPVGVFVFALFNENLKPGPASERNYGLFYPDGTPVYNAGVHGYLPPMLAVSNAARQVIQLFTLVAVASVAFVLS

SEQ ID NO: 22365 - DNA, 1667 bp, Panicum virgatum
  misc_feature: Ceres CLONE 1821265
  misc_feature: Encodes the peptide sequence at SEQ ID NO. 22366
gtcccggctcccgcaactgcatctctcgcgtcttctcgcctctccctacttcctaaccgccaccggcgtccccaatcccgaaaccctagcaccgcccagccctcgccgccggcggccatggccgagaccgtcgacgacaaggtcagctacttccaggccgtcaccggcatctccgacccggacctctgcacggagatcctcgccgcgcacaactgggacctgcaggtcgccgtgtcctccatcaccgccaacccctcctccccctccgcctccgcctccacgtcctcgcgcgagcagggcccgtccgccccgctggcagatgcggagttcgtcgcgcccccgccgccgatgccgccggcgccccagcagcagcagcagccggggatcgcgtggaagctggtgacgctccccttctacgtggtctctggaggggtcggcctcgtcgccggcaccttccgcctcggcgcctgggtcgctgggggcgtgctgtcccgctccctctccctcctcggcctcgcagggcaggccggcggcgaccgcctgctcgagctgccgccgtccgccgccgaggcggctgaattcgtcgcggagttcgagcgcgagttcggcgccggccgcggcccgcgcttcgtggccgaggggttctccgacgcgttgcagcgagcgcagcgggaattcaagctcctgttcgtgtatctccactctcctgatcacccggatacccctgccttctgtgggggctgcctctgcgccgagcccgtcgcggccttcatagatgagaacttcgttgcgtggggcggtagcatcagaaggaccgaagggttcaagatgagtaacagcctgaatgcgtcgaggttccccttttgtgctgtggtcatggcttctacgaaccaaagaatcatgctattgcagcaggttgaagggcctaaatcacctgaagagatgataacaattcttcaacgggttgttgaagaatgtgctacatcactcgttgctgccaggattgaagctgaagagagactaaataaccagcgtttacgtgaagagcaagatgctgcctacagagctgcacttgaagctgaccaggccagggaacaggaaaggctagaagaactggaaagacgtgaaagagaggcggcagaagctgagagaaaacgtaaagaggaagaggaagctctagcgagggctgccgaagaagcagctgaaaaggaagctgctcttgcaaggagaaggcaagagaaagccatggctcttggagctgaacctgataaagggcctggcgttactcgggttctcataagatttccgactggagaacgcaaagagaggagattccacagctctgcccccatcacttcgctctatgactacgttgattctttggattgcttggaagcagagaagtacagcctagtttcgaatttcccacgggtcacatacggtccagagaagcactccctgacgctggaagaagcaggcttgcatccacaggcgagcctgtttatcgagatagaacaatgatgttgtaagttcagaaaaccaaaactcgcaagtataggtgctcctttttccaatttgttcagcaacagttaaggatttccagatgtattacaccacaggtgcatccttcttttgtactcggtttattcaataaattcaccttcacc

SEQ ID NO: 22366 - protein, 467 aa, Panicum virgatum
  misc_feature: Ceres CLONE 1821265
  misc_feature (384)..(465): Pfam Name: UBX Pfam Description: UBX domain
MAETVDDKVSYFQAVTGISDPDLCTEILAAHNWDLQVAVSSITANPSSPSASASTSSREQGPSAPLADAEFVAPPPPMPPAPQQQQQPGIAWKLVTLPFYVVSGGVGLVAGTFRLGAWVAGGVLSRSLSLLGLAGQAGGDRLLELPPSAAEAAEFVAEFEREFGAGRGPRFVAEGFSDALQRAQREFKLLFVYLHSPDHPDTPAFCGGCLCAEPVAAFIDENFVAWGGSIRRTEGFKMSNSLNASRFPFCAVVMASTNQRIMLLQQVEGPKSPEEMITILQRVVEECATSLVAARIEAEERLNNQRLREEQDAAYRAALEADQAREQERLEELERREREAAEAERKRKEEEEALARAAEEAAEKEAALARRRQEKAMALGAEPDKGPGVTRVLIRFPTGERKERRFHSSAPITSLYDYVDSLDCLEAEKYSLVSNFPRVTYGPEKHSLTLEEAGLHPQASLFIEIEQ

SEQ ID NO: 22367 - DNA, 729 bp, Panicum virgatum
  misc_feature: Ceres CLONE 1821268
  misc_feature: Encodes the peptide sequence at SEQ ID NO. 22368
atttcgcccaggtaaaactcgtttgccatttcgctctctctctctctctctctctctctctctctctctctcgcaactcgcgatttcttttactgtgctcgttctggcgtgcggtggcggagctccctacgacgactgagccatgtgcggcggtgcgatcctcgccaacctcaccaagcagccgggcccgcgccggctcacggagcgggacctctggcaggagaagaagaagcccaagaggagcgccggcgggggtaggcgctggttcctggctgaggaggatgaggacttcgaggccgacttcgaggacttccagggcgactccgacgagtcagatttggagctcggggagggggaggacgacgacgtcgtcgagatcaagcccttcgccgccaagaggacttcctccaaagatggcttaagcaccatgattactgctggttatgatggccctgcagcaaggtcagccaaaaggaagagaaagaatcaatacaggggcatccgccagcgcccttggggtaagtgggctgctgagatcagagatcctcagaagggtgttcgtgtctggcttggtactttcaacagtcctgaggaagctgcaagagcttatgatgctgaagcacgcaggatccgtggtaagaaggccaaggttaacttccctgatgcacccacagtttctcagaagcgtcgtagtggcccagctgccgctaaagcaccccagttaagtgt

SEQ ID NO: 22368 - protein, 195 aa, Panicum virgatum
  misc_feature: Ceres CLONE 1821268
  misc_feature (115)..(166): Pfam Name: AP2 Pfam Description: AP2 domain
  misc_feature: Useful for making plants with altered lignin content
  misc_feature: Useful for making plants with altered alkaloid content
MCGGAILANLTKQPGPRRLTERDLWQEKKKPKRSAGGGRRWFLAEEDEDFEADFEDFQGDSDESDLELGEGEDDDVVEIKPFAAKRTSSKDGLSTMITAGYDGPAARSAKRKRKNQYRGIRQRPWGKWAAEIRDPQKGVRVWLGTFNSPEEAARAYDAEARRIRGKKAKVNFPDAPTVSQKRRSGPAAAKAPQLS

SEQ ID NO: 22369 - DNA, 1415 bp, Panicum virgatum
  misc_feature: Ceres CLONE 1821278
  misc_feature: Encodes the peptide sequence at SEQ ID NO. 22370
gtagttggctgctcgcctgcctctaatgcaggcagcttctagagcagagaggctcccctccccggcagctgcaggtccggaacgttgggtgctcgccgccgctcttcccgcctctagctctttactctttccttgttttattcacgtggaagatcttgcacgcacgcgtgcgcgctcgtggtgagttgcggcagggcgctgaccaccggaagccaaggggaagaggagccacatgcgccagctaccagctacccactgggtatggtggtggtggtatccatgcgctgccatcccgcccgcgcgcgcaccgccgctggctgcgcgtccgcctcctccccaaccgcccaagtaaacaccacaccacgccgccccaatccgtatcgtatcccaccaccacctgtactcgtgctcgtgtagcagcagccggggcagggcggcgcaacagaaaaccagacgccacgccacgccctttgaatgcctgccctgcccctgccctctgacccggctcggactccgtctccgcctcgcccctgtcctcctgtgccggcccggcaacgggcccgtcacttttatatactccccgcctcaccttcccctcttggcagcagccggcggatcatcattttggccccgtgaatccacccccccccccatcaccgcctcaccggccgcggcctagtccactccaccactccctcctcctccgggcgtcggaagcaggcgaccatgtgcccggggtcggtggacgcggcgccggcggcggggaagagcgtgtgcgtcatggacgccgcggggccgctgggccacgcactcgtcgaccgcctcctccgccggggctacaccgtccacgccgccacgtacggcctcgggggggacgacggcggcgcggaggcggccgccctgcgcaagcagtacctgccgcgcggcgccggcgacgcgtacgggcaccgcctcaaggtgttccgggccgatcccttcgactaccacgccatcgccgacgccgtccgcgggtgcgccggcgtcttctgcatgttcaacacgcccgacgaccaggcgcagtgcgatgagttgacggtggaggaggaggaggttcgcgcggcgcacaacgtgctggaggcgtgcgcgcagacggacgccatggagcgcgtcgtcttcacgtcctccgtcaccgccgtcgtctggaccggcgacgccgacaaggaggacgggcacctcgccgtcgacgagaggtgctggagcgacctcgccttctgcaggaaattcaaggtacgtgcgtccgtgcgtgtcaatcactagtcaatactgcccgtagcgcgcagtcgccattgtaaaattcaaccggatgatttctggttgctgacggcggaaagttactaaaaagatgatcagatcaaataaattaagcctacgtgtgc

SEQ ID NO: 22370 - protein, 189 aa, Panicum virgatum
  misc_feature: Ceres CLONE 1821278
  misc_feature: SWISSPROT Homolog: EC 1.1.1.219 Dihydrokaempferol 4-reductase
MCPGSVDAAPAAGKSVCVMDAAGPLGHALVDRLLRRGYTVHAATYGLGGDDGGAEAAALRKQYLPRGAGDAYGHRLKVFRADPFDYHAIADAVRGCAGVFCMFNTPDDQAQCDELTVEEEEVRAAHNVLEACAQTDAMERVVFTSSVTAVVWTGDADKEDGHLAVDERCWSDLAFCRKFKVRASVRVNH

SEQ ID NO: 22371 - DNA, 738 bp, Panicum virgatum
  misc_feature: Ceres CLONE 1821289
  misc_feature: Encodes the peptide sequence at SEQ ID NO. 22372
ttatatctcttgtggtgacctgtgtaaaagttgcaagaagctagagcagtagctggctactggcgtcgtcggtcaatcgatcgatcgatcagctgtccagatagacagatttataggtgatcgagcaagatggtaagggcttgatcacattcacgggcgtgagctgggtgctggcggccctgctggtgctcgccgccggcaccgcgtcggcgctggcggcggggctgaagaaggggttctacaagaagagctgcccgcgggcggaggacatcgcgcgggaggtggtgtgggcgcgcgtcgccggcaaccgcgagctcgccgccaagttcctccgcatgttcttccacgactgcttcgtcaggggctgcgacgcgtcggtgctgctggactcgccgaccaacacggcggagaaggacgcggcgccgaacctgtcgctggccggcttcgacgtgatcgacgaggtgaaggcggcgctggagcgggcgtgccccggcgtcgtctcctgcgccgacatcgtcgcgctcgccgccagggactccgtctcgttccagtacaagaggaacctgtgggaggtggagacggggcggcgcgacggcacggtgtcgagcgaccaggaggcgctggacgacatcccggcgccgtcctccaccttcgacatcctcctcgccaacttctccagcaaggggctcggactccaggacctcgtcgtcctctcaggcggccacacgatcggcatcg

SEQ ID NO: 22372 - protein, 134 aa, Panicum virgatum
  misc_feature: Ceres CLONE 1821289
  misc_feature (1)..(134): Pfam Name: peroxidase Pfam Description: Peroxidase
  misc_feature: SWISSPROT Homolog: EC 1.11.1.7 Peroxidase
  misc_feature: Useful for making plants with altered carbohydrate content
  misc_feature: Useful for making plants with modulated nitrogen use efficiency
  misc_feature: Useful for making plants with altered cell wall content and/or composition
  misc_feature: Useful for making plants with modulated phosphate use efficiency
MFFHDCFVRGCDASVLLDSPTNTAEKDAAPNLSLAGFDVIDEVKAALERACPGVVSCADIVALAARDSVSFQYKRNLWEVETGRRDGTVSSDQEALDDIPAPSSTFDILLANFSSKGLGLQDLVVLSGGHTIGI

SEQ ID NO: 22373 - DNA, 712 bp, Panicum virgatum
  misc_feature: Ceres CLONE 1821291
  misc_feature: Encodes the peptide sequence at SEQ ID NO. 22374
tagaatgcaccggggagtacaacaacttgcatacccttgacctttatcaaaccaaagtgactgtgctacctccatgggttactacgattggtaccctagagcgtataaaccttcaaggttgctgggagctgctggagttgcctaaaaatattggtaacttgagaagactcacagttttggacatagaggattgcaagaaactgtgttgcatgccttcaggtattggagagctgacccgtttaacacaactgggcttgtttgttgttgggtgtggtaaagatgatgcgagaatctcggagcttgtcaatcttgataggctaagtggtaaattggaaattagaaaccttaagtatttgaaggatccatttgatgctgagaaggcttgcttgaaacagaagaatggcataaggaaccttgttttggattggtcattgaatggaggatttgaagagttagccttagatgtggaacaagaacagggtgtgttgagtgctcttgaagcaccatcgcaaattgagagcttgcaaataaaaggttaccgaggttgctgtttgccaaggtggttgatggagcagaatgattcttcttattgtgaaggcacaacgttaaagcaaactggtccttgtcagtacctatctttaacaagtatgacactatcagaatgtctcaacttgaaacatatgcgaggacttttgatgtttccttcgctgaa

SEQ ID NO: 22374 - protein, 236 aa, Panicum virgatum
  misc_feature: Ceres CLONE 1821291
  misc_feature: SWISSPROT Homolog: EC 3.1.3.16 Phosphoprotein phosphatase
ECTGEYNNLHTLDLYQTKVTVLPPWVTTIGTLERINLQGCWELLELPKNIGNLRRLTVLDIEDCKKLCCMPSGIGELTRLTQLGLFVVGCGKDDARISELVNLDRLSGKLEIRNLKYLKDPFDAEKACLKQKNGIRNLVLDWSLNGGFEELALDVEQEQGVLSALEAPSQIESLQIKGYRGCCLPRWLMEQNDSSYCEGTTLKQTGPCQYLSLTSMTLSECLNLKHMRGLLMFPSL

SEQ ID NO: 22375 - DNA, 744 bp, Panicum virgatum
  misc_feature: Ceres CLONE 1821292
  misc_feature: Encodes the peptide sequence at SEQ ID NO. 22376
atcggacctcgggtcctcacgcgccgcctccccaagcctcttctccgctcggctcggcgctcgcccaggtcgccgcgccggtcgcccccagtccccgactccctctcctcagctcgcccagctcgcctctcgcgtctcgctcagctcgctgcgccgtcggccgtcgcctgtccgcctgcctgctaccggcctgccgcaggcctacagtgccgtcggcgcaggcctgcgccggcgcccccagaggccagaggcccagaccccagtggaggaagcgcctgccccagctcccaaaggtccgccaccggcagcagcgatggcgtcgtcgtcgtcgcgccctctgctccgccacctagtggcgctggcaggcggccgtgtccgcgccaaccaccgcctgctctcctcctccccctcggctgtctctgccgagcggacattgcagtcgccagcggagccggaggccgtgcgcatgacggagggttgcgtccggagaataaaagaattacatgctaaagagccatccgctgaaggtaagatgctgcggttaagcgttgaggctggtggatgttctggattccagtattctttctctctcgatgacaagaaaaactcagatgacagggtctttgagactgatggtgttaaattggttgtggatggcatttcatatgactttgtgaaaggtgccactatagattacgaggaggaaactatacgttcagcattttgtggtttctacaaatcccg

SEQ ID NO: 22376 - protein, 143 aa, Panicum virgatum
  misc_feature: Ceres CLONE 1821292
  misc_feature (50)..(142): Pfam Name: Fe-S_biosyn Pfam Description: Iron-sulphur cluster biosynthesis
MASSSSRPLLRHLVALAGGRVRANHRLLSSSPSAVSAERTLQSPAEPEAVRMTEGCVRRIKELHAKEPSAEGKMLRLSVEAGGCSGFQYSFSLDDKKNSDDRVFETDGVKLVVDGISYDFVKGATIDYEEETIRSAFCGFYKS

SEQ ID NO: 22377 - DNA, 1076 bp, Panicum virgatum
  misc_feature: Ceres CLONE 1821299
  misc_feature: Encodes the peptide sequence at SEQ ID NO. 22378
gcgtctggcgtcgtcgccccgaccgtgctccgccactggaccgagccaccaaattccttcccatttcgaattagccaaacccccgtccacgcctcgccgaaccctagccccggcgatctcgcatggccacccacccgcgatctctccacgccctgctcggcggcggcgcagtcgccgacgtgctgctgtggcggcggaggaacgcctcggcggcggccgtggtgggcgccacggcggtctggttcgtcttcgagcgcgcgggctacagcctcccctcggtcctggccaacgccctgctcctcctcgtcgccatcctcttcttctgggccaagtccgcgtcgctgctcaacaggcctcttccacctcttcctaatctagaggtttcagatgtggttgttgagaaagctgcagatcgtgctcttgtatggatcaatagagtgcttgctgttggccaggatattgccatcaagagagataggaaaacttttataagggtgatattgatactgtgggtggtttcgtatgttggaatgctcttcaacttccttacgctcatttacattggggtaatgctttctctgttggttccaccactgtatgagaagtaccaggatcatgttgatgaaaagctcggtgtagcacacagtgtactatcaaggcacatagataccatcattaccagggcggggcaagccaagcagaagaagactgagtaaaagaaatgttttggctgtattctggaacatctccggctgtctagtggagttgaccgtgagcctttcatctttgactatcatatctatgatctccactaaaattaattttcgatatgctgatctgaggttttggtgcacattgtttttcaagctgagaaatgaggtggcgtatgtatttttctttctgaacatgaggtttacaatgggtgcatatcgtgaaatgatattggatattgcaaactcgtacatacaagaatgtcagctgcttgcgcagttaaccatacgatcttgctcttactgattttaattttaaactctccctgacgaactttgtggagctcgctctatgcggctatgccc

SEQ ID NO: 22378 - protein, 197 aa, Panicum virgatum
  misc_feature: Ceres CLONE 1821299
  misc_feature (17)..(194): Pfam Name: Reticulon Pfam Description: Reticulon
MATHPRSLHALLGGGAVADVLLWRRRNASAAAVVGATAVWFVFERAGYSLPSVLANALLLLVAILFFWAKSASLLNRPLPPLPNLEVSDVVVEKAADRALVWINRVLAVGQDIAIKRDRKTFIRVILILWVVSYVGMLFNFLTLIYIGVMLSLLVPPLYEKYQDHVDEKLGVAHSVLSRHIDTIITRAGQAKQKKTE

SEQ ID NO: 22379 - DNA, 499 bp, Panicum virgatum
  misc_feature: Ceres CLONE 1821305
  misc_feature: Encodes the peptide sequence at SEQ ID NO. 22380
gagcgagctcccggcgcgcgatggagggtgacaagaagtcggcgggcggggccccggcctactggggcctgggcgcgcggccctgcgacgagtgcggcgcccaggccgcgcggctctactgccgcgcggacgcggcgttcctctgcgccgggtgcgacgcgcgcgcgcacggcgcccggatccgcctcgcccgcgtctggctctgcgacgtctgcgagcacaccccggccgccgtctcctgccgcccggaccccgccgcgctctgcgcctcctgcgacgccgacatcctctccgccaaccccctcgcccgctcccaccaccgcgggagcatgggccccttctacggcccgctcggcgacccgctctcagcccttccccccttcggtggccgtgcccgccgctgaatacgacgaccggagcaacgaggtccagactgcggcgtggctcctccacaagctccaccaccgacacaaggaacgcgccatttcgtatgtgttct

SEQ ID NO: 22380 - protein, 127 aa, Panicum virgatum
  misc_feature: Ceres CLONE 1821305
  misc_feature (17)..(57): Pfam Name: zf-B_box Pfam Description: B-box zinc finger
  misc_feature (58)..(104): Pfam Name: zf-B_box Pfam Description: B-box zinc finger
  misc_feature: Useful for making plants with modulated light quality sensitivity
  misc_feature: The sequence is a functional homolog of SEQ ID NO 1293 in the 11/479,226 US patent application
  misc_feature: The sequence is a functional homolog of SEQ ID NO 598 in the 10/412,699 US patent application
  misc_feature: Useful for making plants with altered lignin content
  misc_feature: Useful for making plants with modulated cold sensitivity
  misc_feature: The sequence is a functional homolog of SEQ ID NO 410 in the 10/666,642 US patent application
  misc_feature: Useful for making plants with modulated flowering time
MEGDKKSAGGAPAYWGLGARPCDECGAQAARLYCRADAAFLCAGCDARAHGARIRLARVWLCDVCEHTPAAVSCRPDPAALCASCDADILSANPLARSHHRGSMGPFYGPLGDPLSALPPFGGRARR

SEQ ID NO: 22381 - DNA, 1389 bp, Panicum virgatum
  misc_feature: Ceres CLONE 1821306
  misc_feature: Encodes the peptide sequence at SEQ ID NO. 22382
aagctattcactccactcttcacttttctccccaaaccccgccgcacacgtctctccgcctccaaaaaccccgaccgccgccggcggccatgctcctccgccaccgcctcctccctcgcctactactccttccctccacccacacctccacatctaccctcctccgtccctcgcgtttgccgcgccgcctctccctctcgccccgcttctcagcactctcccacctagcggccgccgagaccgtcgaccaatcagacaacgagggggcgccccacgaggatgtgcaggtcaagctcccgctcgatcgcctcttcgtgccgcccggggcgacagtggatgcgggaaaccaggaggccgtgagcgcgcgggtcctcaagggatccaacatcgtgctgggcccgtacgcgcgcggcgacgcgcaggtggtcaacgcggatttcgtgaagagcagcgtgcgtcccgatgactgcccccgggacgggcgtccggagttcgcgctcgttggccggtccaacgttggcaaatcatcgctgctcaactcgctcgtccgccgcaagcgcctcgcgctcacctccaagaagcctgggaagacccaatgtatcaatcatttcatagtaaatgacagctggtatcttgttgacttgcctggttatggatatgcttctgcaccgcaggaagctcgtactaattgggatgaatttactcgaaattattttctcagtagggagactttggtatctgtttttctccttatagatgcaagtatacctgccaagaagattgatcttgactatgctagttggcttggtcagaacaaggtccccatgacactggtgttcacaaaatgtgataaacgcaagaagaagaaaaacggcgggaggagaccggaagaaaacgtggaaaccttccagagtctgatccgtgaatactttgaggcggcacctccctggatcatgacgagcagtgtgaccaaccagggccgcgatgagatactgctgcacatgtctcagcttaggaattattggctcaagcattgagatgcaatgacaacaaacagaaccgaagcaaccgaaacggcatatagagctctgtggttcattgatgcatcagcagtcggcacctcttcaatcaggccttggcaccaactaaccctgcctttcgagctgttgattgtccaatatggcccctgtacatgatttcccaatcaacactctgggaatgcagagaaggcgctaaaatcggctgatcctgggttttctattgtgtacacgtacaataccaaacgttttccctttgttccctcctgattatattaataggcttgtgtatgatgtggattaataaaccctggtgtcagctaatcatcagcgggaatctcacttttttgtc

SEQ ID NO: 22382 - protein, 315 aa, Panicum virgatum
  misc_feature: Ceres CLONE 1821306
  misc_feature (133)..(254): Pfam Name: MMR_HSR1 Pfam Description: GTPase of unknown function
  misc_feature: Useful for making plants with modulated heat sensitivity
MLLRHRLLPRLLLLPSTHTSTSTLLRPSRLPRRLSLSPRFSALSHLAAAETVDQSDNEGAPHEDVQVKLPLDRLFVPPGATVDAGNQEAVSARVLKGSNIVLGPYARGDAQVVNADFVKSSVRPDDCPRDGRPEFALVGRSNVGKSSLLNSLVRRKRLALTSKKPGKTQCINHFIVNDSWYLVDLPGYGYASAPQEARTNWDEFTRNYFLSRETLVSVFLLIDASIPAKKIDLDYASWLGQNKVPMTLVFTKCDKRKKKKNGGRRPEENVETFQSLIREYFEAAPPWIMTSSVTNQGRDEILLHMSQLRNYWLKH

SEQ ID NO: 22383 - DNA, 1119 bp, Panicum virgatum
  misc_feature: Ceres CLONE 1821307
  misc_feature: Encodes the peptide sequence at SEQ ID NO. 22384
attacggacacggacacggacacggacaccctcctttctctccctctctcccccctcacccaagaactgcaaccgcgcacggctcgccacgaggagcctgcgtacgggggcgacgccgcatccagacaggcaggccatgaggacgaggcgcggcgcgtgctactcctgccacgcggaggcggccgacggcccagacgcgcaccgccggaagaggcgccggacggcagcggccgaggggtcgccgccgccggccggctgccgcggcggcggcggcctaggaggcatgttcgaggagctgcctgacgatctcgtcgtgtcgatactgcgcgacgtcgcggcgtccgccggctcgccggccgacctcgccggcgccatgctcacgtgcaagaggttcagggagctcgggcagagcaaggtggtgctcgcgcgggcatcgccgcggtgcctcgccgtgcgcgccgcggactggtcggacgacgcgcaccgcttcctgcagcgctgcgcggacgccggcaacctcgaagcgtgctaccttctcggcatgatccggttctactgcctgggcagccgcgggtccggcgcggagctgatggcggcggcggcggcggtgggcgggcaccgcgaggcgctctactcgctggccgtgatccagttcaacggcagtggcggcggcaaggacgaccgcgacctgcgcgcgggcgccgcgctgtgcgcgcgcgcggcgtcgctgggccacgtggacgcgctccgcgagctcgggcactgcctccaggacggctacggcgtgcgccgctccgtgctggacgggcgccgcctcctcatccaggccaacgcccgcgagctggccgcctcgtcggcggcggcggcggcggcgcccggcagcaacggaggcgggaagggggccccgcggcggcactcgtgcctcctgagcgacttcgggtgcggcgccgcggccgcggccgcggcgggggaggcgcacgcggcgaaccggttcctggtggactggttcgcgacgcggccgctcgcccaggcggcggccggcgcaggcgccgggacgggcgcggcctcgccggaagacgacggcgcgctgcggctgtgctcacaggcgctgtgcgggcg

SEQ ID NO: 22384 - protein, 327 aa, Panicum virgatum
  misc_feature: Ceres CLONE 1821307
  misc_feature: Useful for making plants with altered lignin content
MRTRRGACYSCHAEAADGPDAHRRKRRRTAAAEGSPPPAGCRGGGGLGGMFEELPDDLVVSILRDVAASAGSPADLAGAMLTCKRFRELGQSKVVLARASPRCLAVRAADWSDDAHRFLQRCADAGNLEACYLLGMIRFYCLGSRGSGAELMAAAAAVGGHREALYSLAVIQFNGSGGGKDDRDLRAGAALCARAASLGHVDALRELGHCLQDGYGVRRSVLDGRRLLIQANARELAASSAAAAAAPGSNGGGKGAPRRHSCLLSDFGCGAAAAAAAGEAHAANRFLVDWFATRPLAQAAAGAGAGTGAASPEDDGALRLCSQALCG

SEQ ID NO: 22385 - DNA, 685 bp, Panicum virgatum
  misc_feature: Ceres CLONE 1821310
  misc_feature: Encodes the peptide sequence at SEQ ID NO. 22386
atgctcctccccctcctcagatcccatccgctcctccaccacgccgcgcgcctgtcctccccgcgcacccgcctgctcctccgccgcgacgcgctcccgctcccgctcccgccggcgcgctccccgcaccactcgccgatccgcatggccgcctcctccggctccaacgccagctcccccgccccgtcgccgccgcctgcagtggtgcacaagtcaaagatacaattttgctctgcttgtggaagcccgacaaaattggctgtacctgatggagatgagaagatgagggctatttgttcttcttgtggaagagttcactacgaaaaccccaaaatggttgttggttgcctggtggagcatgataataaggttctcctttgtagaagaaagattgaaccggcttatggtctttggactcttcctgctggttatttggaggtgggggagtctgctgcagaaggagcctctagagaaacattagaagaagcatgtgcagatgtagagataatctcaccttttgctcagttggatattccgctgattggccaaagttacattattttccgagcaagattgaagacccccaacttttcacctggaccggagtctctagaatgtgctctttttgctttggatgatataccatttgattctctagcattttcttcgatcattgtcaccttaa

SEQ ID NO: 22386 - protein, 180 aa, Panicum virgatum
  misc_feature: Ceres CLONE 1821310
  misc_feature (62)..(180): Pfam Name: NUDIX Pfam Description: NUDIX domain
  misc_feature: SWISSPROT Homolog: EC 3.6.1.22 NAD(+) diphosphatase
MAASSGSNASSPAPSPPPAVVHKSKIQFCSACGSPTKLAVPDGDEKMRAICSSCGRVHYENPKMVVGCLVEHDNKVLLCRRKIEPAYGLWTLPAGYLEVGESAAEGASRETLEEACADVEIISPFAQLDIPLIGQSYIIFRARLKTPNFSPGPESLECALFALDDIPFDSLAFSSIIVTL

SEQ ID NO: 22387 - DNA, 1346 bp, Panicum virgatum
  misc_feature: Ceres CLONE 1821312
  misc_feature: Encodes the peptide sequence at SEQ ID NO. 22388
gccgtgctccactagggatcctgatccagattcgtcgtgggggataccggacaccccccttactcccgcaaagcatcgaaactgggatccatggcggcggcggagggggcgaggaagaaggtcatcatcgacaccgaccccggaatcggtccgtaatacaacaccccgccttatcttcttccaacctcaacctctcgtgtgccgcggtcggctgacggaccagtgcgagtgtccttgggcggcggagcagatgacgcgatggccatcttcgtggcgctgcgctcgccggagctcgaggtgctcggcctcaccaccaccttcggcaacgtccacaccgccctcgcgacgcgcaacgcgctccacctgctggaggctgttggccggaccgacatccccgtcgcggagggatcccatgtaacggtcaagaaagccagcaagctcaggatcgcgagctttgtccacggttcagacggtctaggaaaccaggacttccctgcaccgactacgaaaccgatagatcagacagctgctgccttccttgttgagcagtcaaatctgtaccccggacaagttaccgtcgtcgctcttggtccgctgaccaaccttgctctggccatcgagcttgacccttccttccccaagaagatagggcagattatcattctcggtggtgcatattcggtcaatggaaatgtcaaccctgcagctgaggcaaatatatttggggatcctgacgcggcagatattgtgttcacttgcggtgctgatattttggccataggactaaacgtaacgcaccaagtagttcttacagacgctgaccgggagaagcttgaacaatgtgatagcaaatatgctcactacttatgcaagataatgggcgtctattatgattaccacaaagatgcttacttcataaaaggagtgtatcttcatgatccgacaacgcttatagctgcagtaaatccgtcgttgatgacttacacagaaggtgtcgtgagggtacagacggttggaataacaaagggtcttacagttttcgacaataccaaaaaaaggtacggggagatcacagcctggacgggcatgccgaccgtgaaggttgcggacaccgttgatgcccccgccgtggtggagctgatgatgcagacgcttatgacagatgattaaccatcgaccgctgattagcacgacccaggaagagtcctgattgaagctgatgctgcactatgcacccatgcttctcgaaagaaagctctttgtacttgtaacttggatgatgcgcctctattttgttgagacttctatacagtctataagaaagaaagaaaagcgttggaatgtgt

SEQ ID NO: 22388 - protein, 303 aa, Panicum virgatum
  misc_feature: Ceres CLONE 1821312
  misc_feature (1)..(296): Pfam Name: IU_nuc_hydro Pfam Description: Inosine-uridine preferring nucleoside hydrolase
  misc_feature: SWISSPROT Homolog: EC 3.2.2.8 Ribosylpyrimidine nucleosidase
MAIFVALRSPELEVLGLTTTFGNVHTALATRNALHLLEAVGRTDIPVAEGSHVTVKKASKLRIASFVHGSDGLGNQDFPAPTTKPIDQTAAAFLVEQSNLYPGQVTVVALGPLTNLALAIELDPSFPKKIGQIIILGGAYSVNGNVNPAAEANIFGDPDAADIVFTCGADILAIGLNVTHQVVLTDADREKLEQCDSKYAHYLCKIMGVYYDYHKDAYFIKGVYLHDPTTLIAAVNPSLMTYTEGVVRVQTVGITKGLTVFDNTKKRYGEITAWTGMPTVKVADTVDAPAVVELMMQTLMTDD

SEQ ID NO: 22389 - DNA, 335 bp, Panicum virgatum
  misc_feature: Ceres CLONE 1821328
  misc_feature: Encodes the peptide sequence at SEQ ID NO. 22390
tctcccgccgctctcacttcctccccggtgcaggtgtgcgaaggatggagattggtggcaacttcatcaagttcacgagccatcacgcgtgtacctggaggagaggcgcccccatgtcccccctggcaaagaattgaggacgcaagtccgcccaccaactcgtcgcccacatggccttcttccgcgactccttcactccctacttacagaagttcacgcgggtgaccatgatcctgccgatctggggcaacccgtactctgacaaagtgacggaaaattccgtggcacactgaaaggccgtaagtacgtacacggaccccgacggcgccgccgta

SEQ ID NO: 22390 - protein, 40 aa, Panicum virgatum
  misc_feature: Ceres CLONE 1821328
  misc_feature: SWISSPROT Homolog: EC 5.5.1.6 Chalcone isomerase
MAFFRDSFTPYLQKFTRVTMILPIWGNPYSDKVTENSVAH

SEQ ID NO: 22391 - DNA, 1232 bp, Panicum virgatum
  misc_feature: Ceres CLONE 1821332
  misc_feature: Encodes the peptide sequence at SEQ ID NO. 22392
tccgccgctctctcctccaccgagttcttctcgccgcaaaactaggtgttcctctctgctctctctccatctcgattcccggccgaataagatggcggcggccgcgcgtctcctcgcgcgaatctcccggcagggcgtcgcctcggtcgctgtggcgggggcggtgaggcggcggccggatgcggcgtcgctcctgggggcgtccgcgctggcggcggcggatccctgcgcttcgatcaaggtcattcctttgttgaatcaatcagcacgatacaaaacatcggcatttcaacggtttgggttttcaacttcggcccctcagcaagatgataaggaggcaaacaaacacacagatgatggagttaataaaagcgctggagtgagtactgaagcttcaggtgaagccaataatgtgcctggaactgacaagacccaggaagcagattcagaagacctagacctatcgaaggaggacctcgtgaagctacttcttgagaaagacgagtctttgaaattgaaagaccaggaggttaaagacatgaaggataaggtgctgcgcagctacgccgagatggagaatgtccttgccagaacaaagcgggaatcagagaacaccaagaagtatgccatacagaacttctccaagagtttgttagatgttgcagacaatttatctcgagcatcatctgttgtcaaggaaagtttctcaaagatagatacgtccaacaattctgatgaagctgtaccactactaaaaaccttgctagagggagttgagatgactgagaagcaacttggagaggtcttcaagaaatttggagttgaaaagtttgatcctctgaatgagaaatttgatccaaataggcactatgcacttttccaaattcctgatccttcaaaaccgtcagggactgttgctgctgttgtgaaggttggctacatgttgcatgaccgtgtactccgtcctgctgaagttggtgtcactgagggcggtccagttgaagaagaatcagtggagaaatctagcaagtcagaataaacccggggtgcctcctgcactcatctgacttttttggttggataagcatacatcatatcataggttatgttttcacaaggagatttgtaatacaaatcgccatttttgtagtggtgagcttatttgttgaagttagcccagaaatttgtcttttttgatactggtcactaataaaaaaacatgattgtagacc

SEQ ID NO: 22392 - protein, 315 aa, Panicum virgatum
  misc_feature: Ceres CLONE 1821332
  misc_feature (113)..(299): Pfam Name: GrpE Pfam Description: GrpE
MAAAARLLARISRQGVASVAVAGAVRRRPDAASLLGASALAAADPCASIKVIPLLNQSARYKTSAFQRFGFSTSAPQQDDKEANKHTDDGVNKSAGVSTEASGEANNVPGTDKTQEADSEDLDLSKEDLVKLLLEKDESLKLKDQEVKDMKDKVLRSYAEMENVLARTKRESENTKKYAIQNFSKSLLDVADNLSRASSVVKESFSKIDTSNNSDEAVPLLKTLLEGVEMTEKQLGEVFKKFGVEKFDPLNEKFDPNRHYALFQIPDPSKPSGTVAAVVKVGYMLHDRVLRPAEVGVTEGGPVEEESVEKSSKSE

SEQ ID NO: 22393 - DNA, 1170 bp, Panicum virgatum
  misc_feature: Ceres CLONE 1821355
  misc_feature: Encodes the peptide sequence at SEQ ID NO. 22394
gaaggggtttcggctcaaccgaatcctccccgcgcccggccgctcctcgtcgacgccgccgaccaacacgacgtctggtatcaccccacgccaccaccgaattccctctcgccgacgcaacgcttaaccctcccgatgccgccgccggactccgcctccacgcgctcctccctgagctccctcccgctcgccgccaacctgatgacggacccgaccccctccccaacctccgccgcgccgcctcccaaccccctcgccgcggcctcctcctacctccgccaccacctctcccgcctggcctcccacctcaccgctccgcgcccggccctcgccgcggcggcgacccgcgcgccggggccccagggcgcgtcgctctcccttgcgctcgcgcccgacgaggtcgcgcgcgcgctaaccggcacgcccgtcttcacggtctgcaactccaacaacgagttcgtgctcgtttccgaccccagcaccggcctccgctccctcggcctgctttgcttccgttccgaggatgccgacgccctcctcacacatgtgaggacgaggcaaccggtgctagggaggggagcgaaagtcgtgcctattacacttgatcaggtttatatgttgaaggccgaaggtatcgcatttcggttcttacctgacccacttcaaataaagaatgcactggagttgaaatcaggcttaactggttttgatggtgttcctgtttttcagtcagatctgctggttgtgaaaaagcagaagaagcgctactgtccaatatattttcaaaaggaagacatagaaagggagcttacaaaggcgtctaaatcttcaagaggatcagccttgtctaagcaaattatggttgggagtttggaggatgtcctgaagaaaatggagataaatgagggaaattcagggtgggatgatttgatcttcattcccccagggaagagcctcaaccaacatatcaatgaggtatcagcgtgattttgttccacggtgatggctcagggtttgaacacgacaccattcacttgagatgctgtgatggccagccaataaaaaaaaagagtcaaatagctgcctgagctttcttttttttttaatatttattattttggttagccttgtcgaggaattttttcatcaactaataaaaatatggttgtg

SEQ ID NO: 22394 - protein, 283 aa, Panicum virgatum
  misc_feature: Ceres CLONE 1821355
  misc_feature (31)..(283): Pfam Name: Tic22 Pfam Description: Tic22-like family
MPPPDSASTRSSLSSLPLAANLMTDPTPSPTSAAPPPNPLAAASSYLRHHLSRLASHLTAPRPALAAAATRAPGPQGASLSLALAPDEVARALTGTPVFTVCNSNNEFVLVSDPSTGLRSLGLLCFRSEDADALLTHVRTRQPVLGRGAKVVPITLDQVYMLKAEGIAFRFLPDPLQIKNALELKSGLTGFDGVPVFQSDLLVVKKQKKRYCPIYFQKEDIERELTKASKSSRGSALSKQIMVGSLEDVLKKMEINEGNSGWDDLIFIPPGKSLNQHINEVSA

SEQ ID NO: 22395 - DNA, 685 bp, Panicum virgatum
  misc_feature: Ceres CLONE 1821399
  misc_feature: Encodes the peptide sequence at SEQ ID NO. 22396
ctcatcatattgggccttggtatgcaacagcccagccctgtccacaacaggatagtaacctcacgaaaggggccccatttagtcagaatcagaagttcagaacccatttgcttctccgtcacctccacctcgtcgacacctccgatccacccactctgccgaccatggcggctgcggcggcgcagaagctcctttcggcgagcacgaagatcatcggcgtcggccgcaactacatggcccacgccaaggaactcggcaacccagtccccaaggtccgcgcggcccctcccatccgatcccaaaacactcccgtgcttccaacttcgatcgcgcaggctcccgcgcgcgccctctgatttgcatctcgcggcgctgcccgtgtgctgcgtatgttgcaggagcccgttctgttcctgaagccgacctcgtcgttcctccacgccggcgtggccaacgccgccatcgagatccccgagccgctcgagtccctgcaccacgaggtcgagctcgccgtcgtcatttcccggcgcgggcgcgatgtccccgaggcgtcagctatggacttcgtgggaggttatgcacttgctttggacatgacagcaagggaccttcaatctgctgctaagtctgcaggtcttccatggactttggctaaaggacaggacaccttcactccaattagtgc

SEQ ID NO: 22396 - protein, 98 aa, Panicum virgatum
  misc_feature: Ceres CLONE 1821399
  misc_feature (1)..(98): Pfam Name: FAA_hydrolase Pfam Description: Fumarylacetoacetate (FAA) hydrolase family
MLQEPVLFLKPTSSFLHAGVANAAIEIPEPLESLHHEVELAVVISRRGRDVPEASAMDFVGGYALALDMTARDLQSAAKSAGLPWTLAKGQDTFTPIS

SEQ ID NO: 22397 - DNA, 1148 bp, Panicum virgatum
  misc_feature: Ceres CLONE 1821408
  misc_feature: Encodes the peptide sequence at SEQ ID NO. 22398
gtcctctgcggcgcaacggccacacctcctccggcccccgaccttcctcggctcccctctctctcctcgccgctgcccgtttctctctcctcgccgcaccggtgcaccggagccatgaacaacctcctttcggattcctttgagctccctcggcgggactcttcaagagatgcagacattgaaatgggattgcatcaggctgatgcttcagacaacttaaaggatttcttgaaaaaggttgatgcaattgagagcctaattgcaaagctgacaaatctattgaataagcttcagactgcaaacgaggaatccaaagcagttacaaaagcaagtgccatgaaagcgatcaagcagcggatggagaaagatattgatgaagtggggaaaattgctcgtcaggcgaagacaaaagttgatgaactcgaaaaaaataacttatcaaataggcaaaaacctggatgtggaaaggggtctgctgtggaccggtcaagagaacagactactggagcaattaaaaagaaattgaaggagcggatggatgattttcaggctttaagagaagcaatcaggcaagaataccgtgaggttgttgaaagaagggtttttactgtaactggtaatcgtcctgatgaagagacaatcgatgacttgatagagactggaaaaagtgagcaaatcttcaaagacgcaatccaacagcagggaagaggccagatactggacaccgttgctgaaatacaggagcgacatgatgctgtaagggatctagagaggaagctacttgagttgcaacagatattcatggacatggcagttcttgttgaggctcaaggagacatgatcaacaacatcgagacacatgtttcgaatgctaccaatcacatacagcaaggcgttagcgctctacagaatgccaagagattgcagaagaattcgagaaagtggatgtgctatgccatcatcatactgctggtgatagtggtgatcattgttgtggcagtcatccagccgtggaagaagggcacttaacattgtgttttctgcttgtgtaatatgtgtgtagcttttgtgggcatttcttgatttatcattgtacctatggtcgacacaacagaaagcttctgcttgcctttctggcattttcgatt

SEQ ID NO: 22398 - protein, 304 aa, Panicum virgatum
  misc_feature: Ceres CLONE 1821408
  misc_feature (210)..(272): Pfam Name: SNARE Pfam Description: SNARE domain
  misc_feature (34)..(141): Pfam Name: Syntaxin Pfam Description: Syntaxin
MNNLLSDSFELPRRDSSRDADIEMGLHQADASDNLKDFLKKVDAIESLIAKLTNLLNKLQTANEESKAVTKASAMKAIKQRMEKDIDEVGKIARQAKTKVDELEKNNLSNRQKPGCGKGSAVDRSREQTTGAIKKKLKERMDDFQALREAIRQEYREVVERRVFTVTGNRPDEETIDDLIETGKSEQIFKDAIQQQGRGQILDTVAEIQERHDAVRDLERKLLELQQIFMDMAVLVEAQGDMINNIETHVSNATNHIQQGVSALQNAKRLQKNSRKWMCYAIIILLVIVVIIVVAVIQPWKKGT

SEQ ID NO: 22399 - DNA, 1101 bp, Panicum virgatum
  misc_feature: Ceres CLONE 1821424
  misc_feature: Encodes the peptide sequence at SEQ ID NO. 22400
gcatcccgcagccagaaccctagcctcgccgccatggccgcctccatgctccgctccggccaccgactcttcctccgccgccagcgcctctctgcggcattctccaccgcctcggccgaggagctcatcgacgtccgcaagcttcccaccgactacgacctctccacctttgacccatcctccccgtcccggccgcctccgtccgaccgcgtgtggcgcctcgtcgaggacgtctcctccctcaccctcgcggagtccgccgctctctcctctctccttctccgccgccttgacataccctgggcaccccccatcgccatcctcaactccgctgcggggcttggcggcggcggcggcggcggcacggccggcgcggctggagagaaggctgcggcggcagccgagaagacggtcttcgagctgcggctggaggcgttcgacgcggcgagcaagatcaaggtgatcaaggagatccggtcgttcactgacctggggctgaaggaagccaaggagctggtggagaaggcgcctgcggtgatcaagggcggcgtatccaaggaggatgctgaggcgatcgtcgagcgaatgaaggctgttggagccaaggttgtcatggactgatcggagcacgccattcactggtgatgttgacaatcttttaaccgtatgattttcatgttggcccggctccatgtgctgctcatttcacatggttgaagggctgaaggccggcactgtaactggaattttgagcctcaacggccttcagctattcattaaatcatgtgtttcctcttattctgttgaggaatagcttatcactagcatgagatgcggaataaattactttgaaaattgagataaacaacacacacatctggagttttacagtatgtgtaatgttacttttggttggcagatatctctgcatgccaatattatggtgtcatgcccgtagcagagcagcctgagctatgtattatctgtcttctgtatttgtccgatgattgatcatacgaattggtataatggtatgtaactgatgatggtgttatggctcgtgatttacattcagtacttcttgagttgtgctgtatcctg

SEQ ID NO: 22400 - protein, 195 aa, Panicum virgatum
  misc_feature: Ceres CLONE 1821424
  misc_feature (128)..(195): Pfam Name: Ribosomal_L12 Pfam Description: Ribosomal protein L7/L12 C-terminal domain
MAASMLRSGHRLFLRRQRLSAAFSTASAEELIDVRKLPTDYDLSTFDPSSPSRPPPSDRVWRLVEDVSSLTLAESAALSSLLLRRLDIPWAPPIAILNSAAGLGGGGGGGTAGAAGEKAAAAAEKTVFELRLEAFDAASKIKVIKEIRSFTDLGLKEAKELVEKAPAVIKGGVSKEDAEAIVERMKAVGAKVVMD

SEQ ID NO: 22401 - DNA, 713 bp, Panicum virgatum
  misc_feature: Ceres CLONE 1821428
  misc_feature: Encodes the peptide sequence at SEQ ID NO. 22402
catgtacccaagtgcagtagatcattttaaaaagcagttcacgtttcttgaggaacattatgccaagggttctacaggaaccccacctgagaggcaacataactcattgccacggccttctgttgtctattcggataaccgacaacaaagcacagccaacatcaccgaggatctttccaagtgtttaatcagagaaaatacacaaaagacacagcaacattctgcttcagttgctgcaaataaatttccactccatgttcctcatggtgctgccacgaggcctggtaaagcagttggttcagtgctgcagtacaaccccggtccagcatctgctgctgaacagtatgaccaacgaagggtcgctaggcacccagcaattgcaccaaacaatatcccttctggaagctcataccctagaagaaatcagacctgcaagagtgagacgggtgatgcagaaaggatggacgtgagccaagctggacagtcaaaggcatacacagcaaacaagttacctgctaccgtggatggtcgcagtggccactggtagatttccgctgtgcaccagcaaactatttcctgacttgctatcagcatcagttacttatgctaagtgctacatcattctgacaaattcagaaatgtagtcctgtacagatttgtattctttgtcctgatgcctaaattctgaaagatcgtagaactgaaagattctc

SEQ ID NO: 22402 - protein, 181 aa, Panicum virgatum
  misc_feature: Ceres CLONE 1821428
  misc_feature: SWISSPROT Homolog: EC 2.7.11.24 Mitogen-activated protein kinase
MYPSAVDHFKKQFTFLEEHYAKGSTGTPPERQHNSLPRPSVVYSDNRQQSTANITEDLSKCLIRENTQKTQQHSASVAANKFPLHVPHGAATRPGKAVGSVLQYNPGPASAAEQYDQRRVARHPAIAPNNIPSGSSYPRRNQTCKSETGDAERMDVSQAGQSKAYTANKLPATVDGRSGHW

SEQ ID NO: 22403 - DNA, 1150 bp, Panicum virgatum
  misc_feature: Ceres CLONE 1821429
  misc_feature: Encodes the peptide sequence at SEQ ID NO. 22404
ggccatcgtttctggccttgccgtcgccgtcgccgtcgccgtgctgctcctgccgtcgctgttgccgtcggcgttgatggggctcgccggggaaggatcgcccgtcagtggcggagggttcagtgaaaacggcaagttcagctacgggtatgcaagctctccagggaaaagatcttccatggaggacttccatgaaaccagagtagatggtgtcgatggagagacagttgggttgttcggcgttttcgacggccacggtggtgctcgagcagcggagtttgtaaaacaaaaccttttcaccaatttaatcaagcacccaaagttcttcagcgataccaaatcagctattgctgaaacttacactcacacggactcggaacttctgaaagctgataccagccatcatcgagatgcggggtcaaccgcttccactgcaattcttgtaggtgatcgcttggtggttgcaaatgttggggattctagggcagtcatatgcagaggaggggatgctatagcagtgtcaagagaccacaagccagatcagacagacgagaagcagaggatagaggaagctggtggatttgtgatgtgggctggaacatggcgtgttggtggcgttcttgctgtttctcgagcattcggtgacaagctcctaaagcagtatgtggtcgctgatccagagatcaaggaggaggttgtggacagctccttggagttcctcatccttgcaagtgatggtctgtgggacgtggtgaccaacgaggaagccgtgggcatggtgaagccgatcctggactcggagcaggcggccaagcggctcctcgcggaggcctcccagcggggcagcgccgacaacatcacctgcgtcgtcgtgcgcttcatggagtagcacaacgggctgggcagggccaccaacgaccaagcctcgtgaacatctgctgctgtgacatcttgttcttggcaccaaatatacaattttactctgctttctgcttcgtagcatcattctagagatgcagttaaaccagcgtcatgtgtaagttgttttacttaaaatgtaaatctactgtatgttactgaaaatgtaagcgaacgacacctgcgctcgtgtcttggaatgaaatctggcaagaaaaagaaccgttcctcc

SEQ ID NO: 22404 - protein, 270 aa, Panicum virgatum
  misc_feature: Ceres CLONE 1821429
  misc_feature (21)..(261): Pfam Name: PP2C Pfam Description: Protein phosphatase 2C
  misc_feature: SWISSPROT Homolog: EC 3.1.3.16 Phosphoprotein phosphatase
MGLAGEGSPVSGGGFSENGKFSYGYASSPGKRSSMEDFHETRVDGVDGETVGLFGVFDGHGGARAAEFVKQNLFTNLIKHPKFFSDTKSAIAETYTHTDSELLKADTSHHRDAGSTASTAILVGDRLVVANVGDSRAVICRGGDAIAVSRDHKPDQTDEKQRIEEAGGFVMWAGTWRVGGVLAVSRAFGDKLLKQYVVADPEIKEEVVDSSLEFLILASDGLWDVVTNEEAVGMVKPILDSEQAAKRLLAEASQRGSADNITCVVVRFME

SEQ ID NO: 22405 - DNA, 617 bp, Panicum virgatum
  misc_feature: Ceres CLONE 1821443
  misc_feature: Encodes the peptide sequence at SEQ ID NO. 22406
aggtagcctcctctcctcctcggcgtctgggcctcactccgggcgtcgcgcttcgtctcccccagacgccgccgcctagggcttcctccgccgccctccaccgcctccctcgggtcgccgccgtcctccacctcctcgtcgggtcgccgccgtcctccacctcctcgtcgggtcgccggcgcccttcaccgcctccctcgggtcgccgccacctccctcgggtcgcccccccccccccctccgtcgcctgggcctgcgctgccttgtctgcaacagtgagcagcttgttctccgcggcggcggcttggagcggagccggagggagaagatggtggcggcgatcagggtgcccaagaccaagcgcgccaggcgggagctcctcaagcacgcgcccaagctcgttgagaccggcaaaaagacactgatcctccatggtaccaagactagtgctgtgttgaactctgtgctgtcagatatttaccacctgaagcgtgataatgctgtgaagttcaccaagaagaatgacaacattatgccttttgaaagtggtggagaatcttctttggaatttttctccctcaagacagactgcagccttatagtgtatggttctcatt

SEQ ID NO: 22406 - protein, 96 aa, Panicum virgatum
  misc_feature: Ceres CLONE 1821443
  misc_feature: Useful for making plants with modulated biomass
MVAAIRVPKTKRARRELLKHAPKLVETGKKTLILHGTKTSAVLNSVLSDIYHLKRDNAVKFTKKNDNIMPFESGGESSLEFFSLKTDCSLIVYGSH

SEQ ID NO: 22407 - DNA, 1478 bp, Panicum virgatum
  misc_feature: Ceres CLONE 1821444
  misc_feature: Encodes the peptide sequence at SEQ ID NO. 22408
agctgctaccaacccccaaccaaacacacggctgatagcctccggctccgctccgccgttgcttttcggatccgctgccttgctgacagactgacaatgggtgggagtgacaatgggtgggagtgagggagcccgaccccgcgtgtccgccacgcccgaggccaccgccgcttcccgaatggccgccgccgcctcctcctcgccctcgcctccatcgccgtcgcctcccggggcggcgtccccggtcgaggagccccgcgggggcgggggcgggggaggccggccacctgtcccgccgtacgtgaaggcggcggcggggtccctgggcggcgtcatggaggcgtgctgcctgcagccgatcgacgtcgtcaagacgcggctgcagctcgaccgctcgggggcctaccggggcatcgcgcattgcggcgccaccgtcgcccgcgccgagggcgtgcgcgcgctctggaaggggctcacgcccttcgccacccacctcacgcttaagtacgcgctgcgcctcggctccaacgccgtgctgcagtccgccttcaaggaccccgccaccggcaaggtctccgcgcacgggcgcctcgcgtccgggttcggcgccggcgtcatcgaggcgctcctcatcgtcaccccctttgaggtggtaaagattagattgcaacagcaaaaaggattgagcccagacatgcttagatataaaggtcccatacactgtgcaaggactatagttcgggaagaaggcctacttggtctgtggtctggagcattaccaactgttatgcgcaatggcacaaaccaagctgcaatgttctcagccaagaacacattcgacattgttctatggaagaagcatgagggagacggtaaggtcctccttccatggcaatccatgatctcagggttccttgcaggaaccgcagggcctgtctgcaccggacccttcgatgttgtgaagactaggttgatggctcaagggagaactggtgacatcaagtacacgggcatggtccatgcgatacggacaatatacgccgaagagggactgcgagcgctgtggaaaggcttgctcccccggcttatgaggattccacctggacaggctataatgtgggcagtggctgatcaggtgatgggcctctatgagcgaagttacctgcagccagctcatgtttgatcagtatcctacttcagtgctacactgaaaatttttgggttagtcgtcataattttgaattggtggttagacatggaattcgtcaactgaaagtgcaagctgttccagtaactggaaattcctttgatcattgctaatagctgggaaatgatggaagcaatgaactcttgtactattttaaagtcaataattgtgaaactcccattttgactgggatagaatattgctgttctggtgaccatcatgactgttaaactacagcagcattagtatcatactagctaatgctcatcag

SEQ ID NO: 22408 - protein, 334 aa, Panicum virgatum
  misc_feature: Ceres CLONE 1821444
  misc_feature (236)..(328): Pfam Name: Mito_carr Pfam Description: Mitochondrial carrier protein
  misc_feature (133)..(228): Pfam Name: Mito_carr Pfam Description: Mitochondrial carrier protein
  misc_feature (39)..(128): Pfam Name: Mito_carr Pfam Description: Mitochondrial carrier protein
MAAAASSSPSPPSPSPPGAASPVEEPRGGGGGGGRPPVPPYVKAAAGSLGGVMEACCLQPIDVVKTRLQLDRSGAYRGIAHCGATVARAEGVRALWKGLTPFATHLTLKYALRLGSNAVLQSAFKDPATGKVSAHGRLASGFGAGVIEALLIVTPFEVVKIRLQQQKGLSPDMLRYKGPIHCARTIVREEGLLGLWSGALPTVMRNGTNQAAMFSAKNTFDIVLWKKHEGDGKVLLPWQSMISGFLAGTAGPVCTGPFDVVKTRLMAQGRTGDIKYTGMVHAIRTIYAEEGLRALWKGLLPRLMRIPPGQAIMWAVADQVMGLYERSYLQPAHV

SEQ ID NO: 22409 - DNA, 693 bp, Panicum virgatum
  misc_feature: Ceres CLONE 1821454
  misc_feature: Encodes the peptide sequence at SEQ ID NO. 22410
agctagtagtcttgagcaagagaagctaagacgatggcctctgctaccctgctcaagtcctccttccttcccaagaagtccgaatggggcgccagcaggcaggtcgccgcgcccaggccggtcaccgtgtccatggtcgtcgtccgcgccagcgcctacgccgatgagctcgtcaagacggcgaaaacggtggcgtcgccggggcggggcatcctggccatggacgagtcgaacgcgacgtgcgggaagcggctggcgtccatcgggctggagaacacggaggcgaaccggcaggcgtaccggacgctgctggtgaccgcgccggggctcgggcagtacatctcgggcgccatcctcttcgaggagacgctgtaccagtcggccgtggacgggcgcaagatcgtggacatcctggcggagcagggcatcgtgcccgggatcaaggtcgacaagggcctcgtcccgctcgccggctccaacaacgagtcgtggtgccaggggctcgacggcctcgccgcccgcgaggccgcctactaccaggcgggcgcccgcttcgccaagtggcgcaccgtggtcagcatccccaacgggccctcggagctcgccgtcaaggaggccgcgtggggcctggcccgctacgcggcaatctcgcaggacaacgggcttgtgccgatcgtggagcctgagatcctc

SEQ ID NO: 22410 - protein, 219 aa, Panicum virgatum
  misc_feature: Ceres CLONE 1821454
  misc_feature (45)..(219): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature: Useful for making plants with modulated biomass
  misc_feature: Useful for making plants with modulated phosphate use efficiency
MASATLLKSSFLPKKSEWGASRQVAAPRPVTVSMVVVRASAYADELVKTAKTVASPGRGILAMDESNATCGKRLASIGLENTEANRQAYRTLLVTAPGLGQYISGAILFEETLYQSAVDGRKIVDILAEQGIVPGIKVDKGLVPLAGSNNESWCQGLDGLAAREAAYYQAGARFAKWRTVVSIPNGPSELAVKEAAWGLARYAAISQDNGLVPIVEPEI

SEQ ID NO: 22411 - DNA, 363 bp, Panicum virgatum
  misc_feature: Ceres CLONE 1821465
  misc_feature: Encodes the peptide sequence at SEQ ID NO. 22412
acgagcgccagccagtcaccacctacccaagccgccgcgatcgatcgagccgagcgccccgcccccacgccgccaccgaaaccctagctcctcctcctcctcagccatggccaccgtctcgctcacgccgcaggtggtcttctccaccgagtcgggcggcgccctctcctccgccacaatcctccgtttcccgccaaacttcgtgcgccagctcagcaccaaggcccgccgcaactgcagcaacatcggcgtcgcgcagatcgtcgccgcggcgtggtcggactgccccgccggccgcccccactccggcggcgggggcggcccctcccccgccccagggccgcgaccggcctcttcgggctc

SEQ ID NO: 22412 - protein, 85 aa, Panicum virgatum
  misc_feature: Ceres CLONE 1821465
  misc_feature: SWISSPROT Homolog: EC 2.5.1.48 Cystathionine gamma-synthase
MATVSLTPQVVFSTESGGALSSATILRFPPNFVRQLSTKARRNCSNIGVAQIVAAAWSDCPAGRPHSGGGGGPSPAPGPRPASSG

SEQ ID NO: 22413 - DNA, 712 bp, Panicum virgatum
  misc_feature: Ceres CLONE 1821476
  misc_feature: Encodes the peptide sequence at SEQ ID NO. 22414
gatacagagaggcaggaggaggcaccctcaagccggcttcacaagtcctctcctcccctctgctgccatctcctctcctctgctctgtgtgtgcaagaaaccccaaaggaggagagaggtgaaagcaagaggctaggcttccttgacggagatgggggtgcagaggtacaggttcttcttctgcgggtgcggcgccaatgcggcggccggcgaccgtgagggcgacgacgacgggaatttcggcgtgttcggcgagaaggctgagaagggggctgaagcaggcccgcgggggctgtcgtgggcgcaggtggaggcgatgacgagcgggttcacctcggccgtggtcggcgagggcgggttcagcaccgtgtacctcgcgcgcctctccggcgcgctcgccgccgtcaaggtccaccgcagcagcgagcgcctccaccgcgtgttccgccaggagctcgacgcgctccagcgcgtccggcacccgcacatcgtccgcctcctcgccttctgcgaacagcaagaggaaggcgtgctggtgcttgaattcgcggcgaacgggaacctgcacgagcggctccacggcgggggcaaggccgcgggggcgatgccgtgggcgcggcgggtgtcggtggcgctgcaggtggcgcgggcgctcgagtacctgcacgaccagtgcgaggcgcaggtcgtgcacggcgacgtgaaggcctcg

SEQ ID NO: 22414 - protein, 186 aa, Panicum virgatum
  misc_feature: Ceres CLONE 1821476
  misc_feature (61)..(184): Pfam Name: Pkinase_Tyr Pfam Description: Protein tyrosine kinase
  misc_feature: SWISSPROT Homolog: EC 2.7.11.1 Non-specific serine/threonine protein kinase
MGVQRYRFFFCGCGANAAAGDREGDDDGNFGVFGEKAEKGAEAGPRGLSWAQVEAMTSGFTSAVVGEGGFSTVYLARLSGALAAVKVHRSSERLHRVFRQELDALQRVRHPHIVRLLAFCEQQEEGVLVLEFAANGNLHERLHGGGKAAGAMPWARRVSVALQVARALEYLHDQCEAQVVHGDVKA

SEQ ID NO: 22415 - DNA, 1821 bp, Panicum virgatum
  misc_feature: Ceres CLONE 1821478
  misc_feature: Encodes the peptide sequence at SEQ ID NO. 22416
atagcgtgcggcggcggcggcagcggcagccggtgaactccgtgtggcgctcctgcactctgacagattttagggctttctcctctggcagcatctcgcaatccccctcgcacccatctcctcctccctttccctctccagcggcggcggcagctccggctcacgacagcgaagggacacccaagatggcgacgatcgtgaacacgacggaggaggagcccatgctggcggtggttcgcttcaccgccgagctcgcctgggccgacgcaggcccggaggtcgccgaccccgaggtcacccgtctctgcctcgaggcgcaggagcacatcctcgcggggcgctggctcgacatggcctccctcatgcttgcctccgctgacctcctcctcacctctccgtcccgcgtccccgacaaagatcttgagtgcatcctctccgtcatctgcagccttgtcaccaaggccggatccgaggaccaggcgccgcagatcactgacctcatatgcgccaagcttacccagcagcctgatgacaagccagtcctgcgccttaaagttctgtttagcttgtacaatcttctsccgagcccctatggcaaggcatttgtttacaaaaaggctctcgagctttccattgccgggaaggctaccgagtgcatcatcccatcattcaagaacatcgacagctttgtcagtgagtggggaattggaaatttggagcagagggagctgtaccgtgccatcgccaggatcctcaaagaccacaagggcatgaccaaggagtacttcaacttcctcaacaagtacctcgccactttcaagggatcagatgatgactctgctacaattggtgatgcaaaggaagaggctgttgcggcaatcattgagtttgtcaaatcatctacactctttcagtgtgatctacttaatatgccagctgttgcacagcttgagaaggatgaaaagtatcagttactttatgaacttctaaagatattccttacaaagaggcttgattcctatttagagtttcagactgcaaactcggccttgctgaaagattatggactggttcatgaggactgcataactaaaatgcgcctcatgtctttgctcgatctgagcagccattgctatggtgaagtcccttattcagcaatcacttcagcacttcagatcaatgatgatgaggtggagcaatgcatcgtgaaagcaattgcgttcaagatattgaattgcagggttgatcagcttaaccagactgtcatcgtcagtcggcatactgagaggatatttgggatgccacagtggcagggtctgcgcacaaaacttggaatctggaggggaaatattgccagtgctatcaacacaatccaagctaacaaagtcactgatgaggggacacaagggatgcaaggcttgatgatccgctgatttgaaacgaatgcaagaatagagtttatagctcgagggattagatgagcaatcttgtatgagaatttatcatatgatttagacccgtgatgatgctggatagatttgagttgcaatgcatgctccccaacaccatttgttccatgtttttgtcagcacagccgtgcaagtcagctgttacacataccaaattttgacaggatgcagtttgtttcttcactgctaactcttgcccttcctaaattttgatcgctagcaacctgcgcgtccccatgagctcttagtatttttgtgattctgtgtgatatctggagagcatgtatctttgacgtatatgcatgtgtagttgggttaaaaatatttcgatctattgaaatctttgatgtat

SEQ ID NO: 22416 - protein, 415 aa, Panicum virgatum
  misc_feature: Ceres CLONE 1821478
  misc_feature (262)..(364): Pfam Name: PCI Pfam Description: PCI domain
MATIVNTTEEEPMLAVVRFTAELAWADAGPEVADPEVTRLCLEAQEHILAGRWLDMASLMLASADLLLTSPSRVPDKDLECILSVICSLVTKAGSEDQAPQITDLICAKLTQQPDDKPVLRLKVLFSLYNLLPSPYGKAFVYKKALELSIAGKATECIIPSFKNIDSFVSEWGIGNLEQRELYRAIARILKDHKGMTKEYFNFLNKYLATFKGSDDDSATIGDAKEEAVAAIIEFVKSSTLFQCDLLNMPAVAQLEKDEKYQLLYELLKIFLTKRLDSYLEFQTANSALLKDYGLVHEDCITKMRLMSLLDLSSHCYGEVPYSAITSALQINDDEVEQCIVKAIAFKILNCRVDQLNQTVIVSRHTERIFGMPQWQGLRTKLGIWRGNIASAINTIQANKVTDEGTQGMQGLMIR

SEQ ID NO: 22417 - DNA, 349 bp, Panicum virgatum
  misc_feature: Ceres CLONE 1821496
  misc_feature: Encodes the peptide sequence at SEQ ID NO. 22418
aacatcgccattccacttcaggattccaaactatcgcgcacaatactatagccatggcggccagctccgaccaaacaagcatcaacgtcctcctcgtcccgttcccggtccagggccacatcaacccgctgctccagttcggcaagcggctcgccagccactgcggcgtccggtgcaccctcgcggcgacccgcttcgtcgccaactccaccaggccgaccccgagctcggtgcacgtcgccgtcttctccgacggctgcgacggcggcgggcccgaggaggtggggggggggggggggttgggcgcccccttcctccggccgctcgtgtccgccgggtcccggccgct

SEQ ID NO: 22418 - protein, 98 aa, Panicum virgatum
  misc_feature: Ceres CLONE 1821496
  misc_feature: SWISSPROT Homolog: EC 2.4.1.195 N-hydroxythioamide S-beta-glucosyltransferase
MAASSDQTSINVLLVPFPVQGHINPLLQFGKRLASHCGVRCTLAATRFVANSTRPTPSSVHVAVFSDGCDGGGPEEVGGGGGLGAPFLRPLVSAGSRP

SEQ ID NO: 22419 - DNA, 456 bp, Panicum virgatum
  misc_feature: Ceres CLONE 1821508
  misc_feature: Encodes the peptide sequence at SEQ ID NO. 22420
cctccgttcccctctatcccattcccgcattcctggaggtcgccctccgtggagcgccccggggggtgggaggaggagggccagagatgatgatggcgcgggtgtcggcgggggcgatggacgccgccgcggtggacgacgtgctgcgacgcctcctcgagggcggccgcggcgggaggcaggtgcagctgtcggaggcccagatccgcccgctccgcgtcccggccaagcaggtgctgctcgcgcagccccacctcctccgcatccacgcgcccgtcaagatctgcggtgattttttttgtcagtttgttgatcttctgaagctattcgatttgggtggttatcctccgacttcaacttatattttccttggacactatgtggatacaggcaaacaaagcttagcaaccatatgtcttcctctggcacacgcgttgaatcaccctgataatatat

SEQ ID NO: 22420 - protein, 123 aa, Panicum virgatum
  misc_feature: Ceres CLONE 1821508
  misc_feature: SWISSPROT Homolog: EC 3.1.3.16 Phosphoprotein phosphatase
MMMARVSAGAMDAAAVDDVLRRLLEGGRGGRQVQLSEAQIRPLRVPAKQVLLAQPHLLRIHAPVKICGDFFCQFVDLLKLFDLGGYPPTSTYIFLGHYVDTGKQSLATICLPLAHALNHPDNI

SEQ ID NO: 22421 - DNA, 1366 bp, Panicum virgatum
  misc_feature: Ceres CLONE 1821542
  misc_feature: Encodes the peptide sequence at SEQ ID NO. 22422
accgaagccgcagtagcgcacccgcgccgacgcgagcgcgatggccgccgcggcttactcctacttcgccggcccggccatcatgccgtcgcagcgcgccgtcgcggcgaacgacaactccgccgccgcctccgccgctccttccccgaccaagtcgcgggacccccgcttctccggatgcgcgcccgccaccgtccgccacatcgcccgctccttcgccgccgcggccgcggccgccgatactgccggcggcggcgaccccgtcatctccatcgacggcgtcgacgccaccaacgtttgtgttctggggagggtggtgagcttggtgaacatggaggctgccgtgcaattcatgctcgacgacggcactgggaagatcgccctggtgcggtggatcactgaccagatggatgctaacgaggtggcttttgtccagaatggagtgtacctcaaggttcaagtcactctcgtagggtttaaagctaagcagcagggttttgctcgctctatcaggcctgttaccaatttcactgaaattgtgctgcatttcattgaatgtatgcatgtgcatttggaaaatgtccggccaaagatgcaaggtcaactccctcgcgctgttcaaacaaatgcatctactcatgagatgcaaggacaagtccctcacacagttcaaacaaacacacctgcttgtacacctttttctggtggagtaagagagcatcaagttcatttttcttctgaagtaaaccaagggcgatttcctccatcagttcaaacaaacacatctactcatgtacccttttctggtggagtgagagaacagcaaattcattttactcctcgatcaaaccaattttcagctcacccaggtactggtgtacagctgaatggtctgcacagaatggttttggaagttatgcaacaaccagatatactcgcaaatgaaaatggggtacatgttgatgaagtggcgaggagacttggaatgccaagagcacaaattctggccactgctgtgcagctggtcgactgggcctgcatttattccaccatcgatgactatcatttcaggtctcttttaaatggctgatcgatgcaatcatcttcgagactagtataacaatatatgagattcgttccagtttatagggattgaacagctgcatgtatatgctttgagtatccatgtctagcgcacacattttcattttgtacatatagcactcatgtgttagtggccaagcagattactcagacatgcatatcgattagaatgctaaccattagcatgtggaagttgctggatggacctgcttagtactgtttgcttgtttttttaaaaaaaaatttgagtactgagatatac

SEQ ID NO: 22422 - protein, 349 aa, Panicum virgatum
  misc_feature: Ceres CLONE 1821542
  misc_feature (177)..(341): Pfam Name: RPA_C Pfam Description: Replication protein A C terminal
MAAAAYSYFAGPAIMPSQRAVAANDNSAAASAAPSPTKSRDPRFSGCAPATVRHIARSFAAAAAAADTAGGGDPVISIDGVDATNVCVLGRVVSLVNMEAAVQFMLDDGTGKIALVRWITDQMDANEVAFVQNGVYLKVQVTLVGFKAKQQGFARSIRPVTNFTEIVLHFIECMHVHLENVRPKMQGQLPRAVQTNASTHEMQGQVPHTVQTNTPACTPFSGGVREHQVHFSSEVNQGRFPPSVQTNTSTHVPFSGGVREQQIHFTPRSNQFSAHPGTGVQLNGLHRMVLEVMQQPDILANENGVHVDEVARRLGMPRAQILATAVQLVDWACIYSTIDDYHFRSLLNG

SEQ ID NO: 22423 - DNA, 1490 bp, Panicum virgatum
  misc_feature: Ceres CLONE 1821543
  misc_feature: Encodes the peptide sequence at SEQ ID NO. 22424
atgtgtgagtggaagaggccagagggtgagattgatggatacgggaggcggctgcagcgccgccgctgccggagtggaggaggaagcggcgcagagggagcgggaatgggaggaggccgcggaggcggttgcgtacgactcctgcacctgtccgccgcccatcgtcgcggtgtgcggcccgggtaacagcggcaagtccgccttctcccgcatcatgctcaacaccctcatcgcaaggtacagaaatgtcggatacctggatattgatgttggtcagcctgaattcactcctccagggtttgtgtcacttcatgtatttgaggaacagactaaagatttgacaattctgtatctgcgcaatccaaagaggtgcttctttttcggcgatgcctgtgcaaaaagaaacccaaaacttctcttgacctacatatttgacctttatgactatttcctcaaagagttctattgctttcgtgatgttgataatcccaagaaatcagctataccacttgttatcaatacatcaggatggataaaaggtactgggcttcatgtgctaactgagatgttgaaatatgtatccccaactcatgttattcgggtatctacaacagtagagcataaaaatttaccatgtggaacgttttggatgaataaatttgatgaatctccacctgttaatttattcaaaattcgtgcagcacataattctcctcgccgtttgttagtaaagaaagaggcaaggattattcgagaactcaggctgaccgcttacttcaggcagtgcttacctagagacttcaacatcttcagtttgagtgatttaattcaaggctttgcttctgtacatccgtttcaacttcgcctgtcaaaaatacatgatattgatctacactgccaggtttctcgaactgatgcgcatcacttcttgaatggtacaattgttggtctttcaaccagtgcctctcctcctttatcaactgaaagttccactccttgctgcattggactggggtttatcagagctgtagaaatttctgaagactgcattcatttgatcacaccaatttctcacaagctcatggaaaaggtcgacatcatttttcaaagctgtattgcagctcctagttgcctcttgcaggtgtctggtatattaagcgacataacagataggctgctgaagatctagatcttcgaatatgcttacaaatataatcattagggatggaaactgtacaattattagttgtggcaatgaacaatcaaaatagagatgccagaaaccagtacacctttaacctgtatggaatgagtttcatcatgtattagctgaattcacctgaagagtaaagagatttgagatttgatgttacaatcatacagcacaaaatggtacctaaaaatatcgttttttgctggttaattatgttgaacccgttgttgtactagtattctgttatcaaatgtaacatgttgaaaatcttggatgg

SEQ ID NO: 22424 - protein, 384 aa, Panicum virgatum
  misc_feature: Ceres CLONE 1821543
  misc_feature (236)..(368): Pfam Name: NUC156 Pfam Description: NUC156 domain
MDTGGGCSAAAAGVEEEAAQREREWEEAAEAVAYDSCTCPPPIVAVCGPGNSGKSAFSRIMLNTLIARYRNVGYLDIDVGQPEFTPPGFVSLHVFEEQTKDLTILYLRNPKRCFFFGDACAKRNPKLLLTYIFDLYDYFLKEFYCFRDVDNPKKSAIPLVINTSGWIKGTGLHVLTEMLKYVSPTHVIRVSTTVEHKNLPCGTFWMNKFDESPPVNLFKIRAAHNSPRRLLVKKEARIIRELRLTAYFRQCLPRDFNIFSLSDLIQGFASVHPFQLRLSKIHDIDLHCQVSRTDAHHFLNGTIVGLSTSASPPLSTESSTPCCIGLGFIRAVEISEDCIHLITPISHKLMEKVDIIFQSCIAAPSCLLQVSGILSDITDRLLKI

SEQ ID NO: 22425 - DNA, 729 bp, Panicum virgatum
  misc_feature: Ceres CLONE 1821554
  misc_feature: Encodes the peptide sequence at SEQ ID NO. 22426
aacccgctcaaaggaccacaagaagctctagatattaattcagattgtgagagaaataattactcagcaggccgaggcgatggcgaacctgttcctgaagcaggcgaagcagtacgtggcgacgcggccgtcctacccgccggagctcttcgacttcatcgcctccaagacgccccgccgcgacctcgcctgggacgtcggcaccggcaacggccaggccgcagcatcgctggcgaagctttacaaggccgtggtgggcacggacacgagcgcgcagcagctcgcccacgcgccgcccctccccaacgtgcgctacgtgcacaccccggcggacctgccgctcgccgggatccacggcgccgtcgcggcgccggcctccgtcgacctcatcaccgtcgcgcaggccttccactggctcgacctcccgcgcttctacgcgcaggcccgctccgtgctgcgccccgggcgcggggtgctcgcggcctggtgctacacggagccgcgcgtcggcgccgccgtcgacgccgtgttctggcgcctctaccgcggctcggcgccgcactgggcccccaaccgccggatggtcgacgacgagtaccgcggcgccgacttccccttcgaccccgtcgacggcgaggcgcacacggggcccttcgagttctccacggagcggcggatggacctggacgactacctcatgtacatcacgtcgtggtcggcgtaccagac

SEQ ID NO: 22426 - protein, 216 aa, Panicum virgatum
  misc_feature: Ceres CLONE 1821554
  misc_feature (38)..(133): Pfam Name: Methyltransf_12 Pfam Description: Methyltransferase domain
  misc_feature: SWISSPROT Homolog: EC 2.1.1.144 Trans-aconitate 2-methyltransferase
MANLFLKQAKQYVATRPSYPPELFDFIASKTPRRDLAWDVGTGNGQAAASLAKLYKAVVGTDTSAQQLAHAPPLPNVRYVHTPADLPLAGIHGAVAAPASVDLITVAQAFHWLDLPRFYAQARSVLRPGRGVLAAWCYTEPRVGAAVDAVFWRLYRGSAPHWAPNRRMVDDEYRGADFPFDPVDGEAHTGPFEFSTERRMDLDDYLMYITSWSAYQ

SEQ ID NO: 22427 - DNA, 715 bp, Panicum virgatum
  misc_feature: Ceres CLONE 1821603
  misc_feature: Encodes the peptide sequence at SEQ ID NO. 22428
tcagtcacacagcacaagaagcaagctcgatcagtccacctccaccaccacacgtctcaccacagtcagcatgctccgcttccgagccaccgcttcggccatggcgcggcgggtgtcgtccctgctgctgctgctgctgctgggcgcgctggcggcggcggcggcggcggccagcttcgaccaggagttcgacatcacctggggcgacggacgcggcaagatccaggacggcggccgccgcctcacgctcacgctcgaccgcacctccggctccggcttccagtccaggcgcgagtacctcttcggcaagatcgacatgcagatcaagctcgtccccggcaactccgccggcaccgtcaccgcctactacctctcctcgcaggggagcacccacgacgagatcgacttcgagttcctgggcaacgtcaccggcgagccctacacgctgcacaccaacgtgttcacgcaggggcagggccagcgcgagcagcagttccgcctctggttcgaccccaccaccgacttccacacctactccatcctctggaaccccaagcacatcatcttcatggtggacgacctgcccatcagggacttccggaacctggagagcaaggtgatcgcgttccccaagagccagcccatgcgcctctactccagcctctgggacggcgacgactgggccacgcagggcgggcgcgtcaagacggactgg

SEQ ID NO: 22428 - protein, 204 aa, Panicum virgatum
  misc_feature: Ceres CLONE 1821603
  misc_feature (26)..(204): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
  misc_feature: Useful for making plants with altered carbohydrate content
  misc_feature: Useful for making plants with altered cell wall content and/or composition
  misc_feature: Useful for making plants with altered lignin content
MARRVSSLLLLLLLGALAAAAAAASFDQEFDITWGDGRGKIQDGGRRLTLTLDRTSGSGFQSRREYLFGKIDMQIKLVPGNSAGTVTAYYLSSQGSTHDEIDFEFLGNVTGEPYTLHTNVFTQGQGQREQQFRLWFDPTTDFHTYSILWNPKHIIFMVDDLPIRDFRNLESKVIAFPKSQPMRLYSSLWDGDDWATQGGRVKTD

SEQ ID NO: 22429 - DNA, 740 bp, Panicum virgatum
  misc_feature: Ceres CLONE 1821612
  misc_feature: Encodes the peptide sequence at SEQ ID NO. 22430
acaaatcccccgcaacctcccgacgcatcctctcattccaaaccctcgttcctccagcaccaagagaatcggagcggcctcgatggcgcccaaggcggagaagaagccggcggccaagaagcccgcagaggaggaacccgcggagaaggcggctccggcggagaaggcccccgctggcaagaagcccaaggcggagaagcggctcccggcgggcaagtctgccggcaaggagggcggcgacaagaaggggaggaagaaggccaagaagagcgtggagacgtacaagatctacatcttcaaggtcctcaagcaggtgcaccccgacatcggcatctcctccaaggccatgtccatcatgaactccttcatcaacgacatcttcgagaagctcgccgcggaggccgccaagctcgcccgctacaacaagaagcccaccatcacctcccgcgagatgcagacctcggtgcgcctcgtcctccccggggagctcgccaagcacgccgtgtcagagggcaccaaggctgtcaccaagttcacctcgtcttaggctatgatgaaaggcttgtttgcgcctgcctgtgatgtgttgcttctgctgttagtagtggtagttcggagtattggctggtgtggtgtagtgagctgttccggtggcttttgtgacttatcgtggtggtaatggaaggctattgttatcaagccacactgctgctgcgcgctgcatcctagctcactagtac

SEQ ID NO: 22430 - protein, 154 aa, Panicum virgatum
  misc_feature: Ceres CLONE 1821612
  misc_feature (61)..(131): Pfam Name: Histone Pfam Description: Core histone H2A/H2B/H3/H4
  misc_feature: Useful for biocontainment applications
  misc_feature: Useful for making plants with modulated flowering time
MAPKAEKKPAAKKPAEEEPAEKAAPAEKAPAGKKPKAEKRLPAGKSAGKEGGDKKGRKKAKKSVETYKIYIFKVLKQVHPDIGISSKAMSIMNSFINDIFEKLAAEAAKLARYNKKPTITSREMQTSVRLVLPGELAKHAVSEGTKAVTKFTSS

SEQ ID NO: 22431 - DNA, 1147 bp, Panicum virgatum
  misc_feature: Ceres CLONE 1821615
  misc_feature: Encodes the peptide sequence at SEQ ID NO. 22432
cttccggcacattccacttcaccgagctccgagctcggaccaggcccgcaacggcttccatggccgctgccgaccccgccgccgcggcctccttccgccgcgcggtcggcccctacccgctccggctccccttgccacgggcccctccgcccggtcgcctccgcgtctcctccaccgtcgtcgctctccacaagcgcaaccccaagcggctcaagtacgccgccgagcgccagttcaagagaggggacgccgggatgctgcgggtgaaggtggagccctccggcgaggacttctggaagctggacccggtaatcgacctcatcaatcgcggcgccgtcggggtgatccctactgacaccgtctactccatcgtctgtgatctgagtaacaatgaatctattgagcgccttcgcagagtgaaaggcattggagactcaaagccactcagcatcctatgtcgctcattacgtgatatcgatacctacacaacaggatttcctcgaggtaccaaccaagggcaacctaacattttccgtgctgtcaagcgtgtaatacgtgggccttacacctttattttacctgcaaccaagcaatttcccaaacaatgcattaggcatggttcttcgacaaggtatgcaaaaaggagacaggttggcgtccgaattccagatgatcccatctgccaggcaatattgcaaaatttggatgaacctttgatctgcacaagtgtcaaatatctatcagaggatgaatggatacttgatccagtaatcattgccgatctttatgagccactgggccttgatttcattgttgatggtggtcctagaattgctgatccttctactgtggtagatatgacaggaacagaccctactataattcgtcagggaaagggtccgaagctggattggatggtagcagaagatgaagaagaggaggcacaatcaaagttcgcttttaaagctgcttgaaatttgcttcgcctcacctagtgtatgggtttgcaatgccccaaccagaggcaccatcttttgacttcataggatgtgagtagtagtatgaagtatgtacacggaacgtacagtagactgtatgctgtaaatatgaaggcgatgtaactgcgagttggcagaatttacccagc

SEQ ID NO: 22432 - protein, 304 aa, Panicum virgatum
  misc_feature: Ceres CLONE 1821615
  misc_feature (85)..(278): Pfam Name: Sua5_yciO_yrdC Pfam Description: yrdC domain
MAAADPAAAASFRRAVGPYPLRLPLPRAPPPGRLRVSSTVVALHKRNPKRLKYAAERQFKRGDAGMLRVKVEPSGEDFWKLDPVIDLINRGAVGVIPTDTVYSIVCDLSNNESIERLRRVKGIGDSKPLSILCRSLRDIDTYTTGFPRGTNQGQPNIFRAVKRVIRGPYTFILPATKQFPKQCIRHGSSTRYAKRRQVGVRIPDDPICQAILQNLDEPLICTSVKYLSEDEWILDPVIIADLYEPLGLDFIVDGGPRIADPSTVVDMTGTDPTIIRQGKGPKLDWMVAEDEEEEAQSKFAFKAA

SEQ ID NO: 22433 - DNA, 626 bp, Panicum virgatum
  misc_feature: Ceres CLONE 1821645
  misc_feature: Encodes the peptide sequence at SEQ ID NO. 22434
tcgctttcttcttcccctccctcgtttcacctcctcccttcccaaccctcgcgcccaacgccggcccttgcttcccccacggaggccggaattacgcgcgccggccagatgagctccaaggccgccgcggccgcgggggacgtcctcccggcgctgccgccgatcaggaccgcggcgccggacgcgccggcaccggcgcagcccgcctgctcttcggcggcctcgtcgaccacggagccggcgccggaccccgaatcggctgactagcccgagccgaaggagggggaggcgggtgactgagaacctgcgactgacccctctgctccgaacgcacgggcgaaaaagctgcgggctaacgatgtcatcgagttcaccggagactttgatggaagtttccacaaaggttgggattaggaaagaaacctttctgctgatttgctcggccttcgatctcacaggtggtcggctttcgttgatcatggaaaaaccaaccctttccatgttgaggaagccccctccaatttcaaggtttccagcggggaggtgattcttgaccaaatctgaccttaccaaccaaccgggaatgccttccttttcctcgtgccacccgcttgctcagctgcaat

SEQ ID NO: 22434 - protein, 52 aa, Panicum virgatum
  misc_feature: Ceres CLONE 1821645
  misc_feature: Useful for making plants with altered carbohydrate content
MSSKAAAAAGDVLPALPPIRTAAPDAPAPAQPACSSAASSTTEPAPDPESAD

SEQ ID NO: 22435 - DNA, 1737 bp, Panicum virgatum
  misc_feature: Ceres CLONE 1821658
  misc_feature: Encodes the peptide sequence at SEQ ID NO. 22436
aacggacgcacgcaaaggaggcggagagggcaggggcagcaccgtccacacccaccatttcttcctcttcctcctcgcctccaccccttcccttcttccatcccctccccaccgggccacctctcgccctctctcccgcgccgatcgatcggcccatccatcgatcgagcacggggcgcaggcttccaatccggaacggttcctcccgttcggtacttacggttcgatcgggctggttgattgctgctctgggtgggcgccatggcggcgacggagctcttcgctgataagaacaccgtcttccgcaagctccgcgccaaatcggacaacaagatgtgcttcgattgcaacgccaagaacccaacctgggcgtccgtcacctacggcgtcttcctctgcatcgactgctcggcggtgcaccgcagcctcggcgtccacgtctccttcgtcaggtcaacaaatttggattcgtggactccagaacagttaaaaatgatggtttatggaggaaataaccgtgcacaagctttctttaagcagcatggttggacagatggtggaaaaattgaagcgaagtatacatcaagagctgctgatttgtaccggcagttgattgctaaagaggttgcgaaaagctccacagaagatggcagcagtagttggccatcttctccagtttcagcttcacaggccccaaatcaaactgctgcatttcccgatctcaagctgacagaggcatcaaaagaaaatgcaagtgaaaagactgagcctgagattgttcgttcacctagagctccatctcattctttcaagaagccaattggtgcgaagaaacctggaaataggactggtggacttggggcgcggaagcttacatccaagccaaatgaaagcctctatgagcagaagcccgaggaaccagctcctgtcctgccatcggttactgagagtactatacctaggagaaaatcctatacttcacgatttgaatatgtagaaaatgcacctgctgctaggactgggagaagttcagatgataaccagatgagtgggcatgttgcacccccaaagtcctcaaatttctttgctgaatttgggatggacagtggatatcacaaaaaaactacatccagttcatctaaagtgcaggttgaggaaagtagtgaagctagaaagaaattctcaaatgcaaaatcaatttcatcctctcagttttttggtgaccagaacagttttgaaaaggaggctcaagtttctcttcagaagttttctggttcttcttccatatcaagtgctgacctattcggtcgtccggcgaacaattccagcgtggatcttaatgcttcagatctgatcaacagaatctcattccaggccacacaggacctgtcatctctgaagaacatggcgggggagaccgggaagaagttgacatctatggcgtccaacatcatcactgatcttcaggatcggatcctctgagcttgacttatagtggagtctcctttacgttgcttcagtggctggcttcactcgtcaactgggtggcaaactgtcaggcccggcagatctgtataggagttaggtgtctgaaaaccaagtggaacttatagagaaaaaggaaaggaagcttaacgcgaatgcagttgccgttggttttgtctctgtttcagaaggagctcgacggaacctaaatatatgtattacactttgctttgtaatgaccattgcatgagc

SEQ ID NO: 22436 - protein, 406 aa, Panicum virgatum
  misc_feature: Ceres CLONE 1821658
  misc_feature (11)..(127): Pfam Name: ArfGap Pfam Description: Putative GTPase activating protein for Arf
MAATELFADKNTVFRKLRAKSDNKMCFDCNAKNPTWASVTYGVFLCIDCSAVHRSLGVHVSFVRSTNLDSWTPEQLKMMVYGGNNRAQAFFKQHGWTDGGKIEAKYTSRAADLYRQLIAKEVAKSSTEDGSSSWPSSPVSASQAPNQTAAFPDLKLTEASKENASEKTEPEIVRSPRAPSHSFKKPIGAKKPGNRTGGLGARKLTSKPNESLYEQKPEEPAPVLPSVTESTIPRRKSYTSRFEYVENAPAARTGRSSDDNQMSGHVAPPKSSNFFAEFGMDSGYHKKTTSSSSKVQVEESSEARKKFSNAKSISSSQFFGDQNSFEKEAQVSLQKFSGSSSISSADLFGRPANNSSVDLNASDLINRISFQATQDLSSLKNMAGETGKKLTSMASNIITDLQDRIL

SEQ ID NO: 22437 - DNA, 1164 bp, Panicum virgatum
  misc_feature: Ceres CLONE 1821661
  misc_feature: Encodes the peptide sequence at SEQ ID NO. 22438
cgaccagagaaaagctcgagaaatatctctcttcgtacccccgagccggcgagatggcggggatctctcgcgcgatccgggtctgcgccgccgcgtcccggcggaccctggcggccgcttcggcggcggccctgccgaaggaggcgcctgcggctggggtgcgagcgccggcggcggcgaccgggcgcaaggggcgggatcgggaggacgggaggcgagtgcagtgggtgttcctggggtgccccggggtggggaaaggcacctacgccagccgcctctcgcagctgctcgacgtcccgcacatcgccaccggcgacctggttcgtgacgcgctcgcggcccctggccccttctccaagcagcttgctgagattgtcaatcatggaaaactggtgtctgatgagatcatcataaatcttctgtcaagacgcctggaagagggagaagaaaagggtgaattgggattcatccttgatggctttcctcggaccataagacaagcggaaatacttgaaggagtcacagatattgatttggtgatcaatctcaagctccgagaggaagccctgcttgcaaaatgccttggtagaagaatgtgcagccagtgtggaggaaacttcaatgtggcctccattgatattgagggtgagaatggtggacctcgaatgtacatgcctccgctgctgcctcctccacagtgtgaatcgaagctaattactagaccagatgatactgaagaggtggtaaaggagcgattacgggtgtaccatgacttgactgaaccagtggaggaattctacagagcacgtgggaaactcttggagttcaatctacctggtggaaaacccgaatcctggccgaagttattggaagccttgaatatagaaggccctgacaacgagagatctgccgcagcatgatttttgttttaggaatgcacattgcgcatttgtagcctatgtcaaaggtagttaccttgtagtagtccatttggggtcaaattatcatggtgtagcactcaattgtatagctgatttatcatcgatgggcaagatcgatgagtgtgctggttgttatcatccaacgaaaggtctgtaaaagcccaaaaggcaagaaataattgtttgacgttgaaacattcatttgtactagcttgtatcacac

SEQ ID NO: 22438 - protein, 288 aa, Panicum virgatum
  misc_feature: Ceres CLONE 1821661
  misc_feature (60)..(254): Pfam Name: ADK Pfam Description: Adenylate kinase
  misc_feature: SWISSPROT Homolog: EC 2.7.4.3 Adenylate kinase
MAGISRAIRVCAAASRRTLAAASAAALPKEAPAAGVRAPAAATGRKGRDREDGRRVQWVFLGCPGVGKGTYASRLSQLLDVPHIATGDLVRDALAAPGPFSKQLAEIVNHGKLVSDEIIINLLSRRLEEGEEKGELGFILDGFPRTIRQAEILEGVTDIDLVINLKLREEALLAKCLGRRMCSQCGGNFNVASIDIEGENGGPRMYMPPLLPPPQCESKLITRPDDTEEVVKERLRVYHDLTEPVEEFYRARGKLLEFNLPGGKPESWPKLLEALNIEGPDNERSAAA

SEQ ID NO: 22439 - DNA, 627 bp, Panicum virgatum
  misc_feature: Ceres CLONE 1821667
  misc_feature: Encodes the peptide sequence at SEQ ID NO. 22440
gaagccatcgtcgtccgtcgtactcccttacaaggtacttaacacgggtcggcggccagcggttggaggagccgaggaggttggaggccggcttggagcagcagcagcagccggcaatggagaagccccggcaggtggtgcgcaagttcctggcgcggccgcagcacgagggcgccggcgccgtcgtccgccgcagcatcggcaggtttgagctgaggtacttcgacccgttcctggtcctcgacgagttctccgtttctgctccggcggggttccccgaccacccgcacagaggattcgagaccgtcacctacatgctcgagggttttgtgacgcacgaggacttcgagggccaccgcggcacgatcaaggccggcgacctgcagtggatgacggccggccgcggcatcgtgcactccgagatgcccgccgaccccggcacgtccaagggcctgcagctctgggtcaacctctcctccgccaacaaaatggtcgagcccgggtgccaggagatccagagcaaggacatcgcgtgcacgtccgccgacagcgtcacggtgcgcgtgatcgccgggcacgccatgggggcgcggtcgccggtgcgcacgccgacgccgaccatgtacc

SEQ ID NO: 22440 - protein, 170 aa, Panicum virgatum
  misc_feature: Ceres CLONE 1821667
  misc_feature (21)..(117): Pfam Name: Pirin Pfam Description: Pirin
MEKPRQVVRKFLARPQHEGAGAVVRRSIGRFELRYFDPFLVLDEFSVSAPAGFPDHPHRGFETVTYMLEGFVTHEDFEGHRGTIKAGDLQWMTAGRGIVHSEMPADPGTSKGLQLWVNLSSANKMVEPGCQEIQSKDIACTSADSVTVRVIAGHAMGARSPVRTPTPTMY

SEQ ID NO: 22441 - DNA, 713 bp, Panicum virgatum
  misc_feature: Ceres CLONE 1821669
  misc_feature: Encodes the peptide sequence at SEQ ID NO. 22442
atctctgtccccttcctcctcttcctcttcctcccccaccccacacctcacccgctggtgggcccagctgccggtcccccgccgttgtgagcgagccggtcggcggcattgcggtcgtctggtcggggcgcggcatggcggggtacggggaccggcggtcgctgccgctggacggcatcgccgtcgacgggggcggcagggcgccgtcgccgggcgcgggggcggggaggctcccgccgccgccgggcgggtttgcgcgcgggctcatgaagcagccgtcgcggctggcgtccggggtgcggcagttcgcgtcgcgggtgtcgatgaaggtgcccgagggggtggccgggatgcggccgggccggatgacgcggatgcagtccagcgcccaggtggggctccgcggcctccggttcctcgacaagacctccggcggcaaggaggggtggaaggccgtcgagcgccgcttcgacgagatgaccaagggcagcggccggctccagaaggagagcttcggcaagtgcatcggcatgggggactccaaggagttcgccggcgagctgttcgcggcgctggcgcggcggcggaacctggagccggaggacggcatcaccaaggagcagctcaaggagttctgggaggagatgaccgaccagaacttcgactcgcggctgcgcattttctttgacatgtgcgacaagaacggcgatggg

SEQ ID NO: 22442 - protein, 192 aa, Panicum virgatum
  misc_feature: Ceres CLONE 1821669
  misc_feature (77)..(178): Pfam Name: NADPH_Ox Pfam Description: Respiratory burst NADPH oxidase
MAGYGDRRSLPLDGIAVDGGGRAPSPGAGAGRLPPPPGGFARGLMKQPSRLASGVRQFASRVSMKVPEGVAGMRPGRMTRMQSSAQVGLRGLRFLDKTSGGKEGWKAVERRFDEMTKGSGRLQKESFGKCIGMGDSKEFAGELFAALARRRNLEPEDGITKEQLKEFWEEMTDQNFDSRLRIFFDMCDKNGD

SEQ ID NO: 22443 - DNA, 1316 bp, Panicum virgatum
  misc_feature: Ceres CLONE 1821674
  misc_feature: Encodes the peptide sequence at SEQ ID NO. 22444
acgtcagtgaagttggacccctcccggcgaggttcccatccagatggcggcgcccgcggcggacgaggcctggtgccgggagacggtgccgcgggtgatggagctggtgagcccgcgcctcccgcagcgggatgtctgcgcgctgctcgccgtcagcccctggtgctaccgcgccctcgtcgccaaccccgggctctgggaggtacttgatctccgtgagatgaagaatgccggtgaccgacttatttcagcactttccctggcaaggtatcgtcatctgaaagtactgaaccttgaatttgcgcaagatattgaggaccggcactttattcatctaaaagaaatgagtggtatctcattggaaaatttagagttcctgaacctgaatgcatgtcaaaaaatctctgacaaaggaattgaagctggtacctgtctttgtcctaatcttcagggcctttctatctactggatcgtgggactgacggactcaagcattgtccacattacaaagaactgcaggcatatagtggacctcaacttgagtggctgtaagaatatctcagataaaggaatgcggctaattgctaatagttacccgggactaaagaaattgaacataaccaggtgtgttaagttgacagatgatgggcttaaagaagtgcttcagaaatgttcctcacttgaaagcttgaacctttatgccctttcgagttttactgacaaggtttataaggaaataggattgttaagtaatcttacatttctagacctatgtggtgctcagaatctatctgacaatggtcttgtatgcatatcaagttgcagaggtctaacgtatctcaatttgacttggtgtgtacgtgttactgacactggtgttgtagctattgcgcaagggtgccagtcccttgaactgctaagtttgtttggaatagttggggtaactgatgcctgcctggaggctttatcgaaatcttgctcgcacagcctcacaacactcgatgtaaatggctgcatcggcattaagaggagccgggatgacctgcttaagttgttcccaaagctgagttgcttcaaagtgcacagctagcagccactccagattctccccggtttgcttgaatcggcgtcaaactcgtgtgtgtgagatcttgctcccatgagtgagcgaagcagcaaggcagtttttggcatcagcatcagcagctcgttacgttcctgtgttgctgggagcaagatgagtgattcaatttgtaccgaatgtttcttagaagttataacgcttgacaatcccagtacatttgtaatttgttatc

SEQ ID NO: 22444 - protein, 348 aa, Panicum virgatum
  misc_feature: Ceres CLONE 1821674
  misc_feature: SWISSPROT Homolog: EC 1.14.11.27 [Histone H3]-lysine-36 demethylase
MAAPAADEAWCRETVPRVMELVSPRLPQRDVCALLAVSPWCYRALVANPGLWEVLDLREMKNAGDRLISALSLARYRHLKVLNLEFAQDIEDRHFIHLKEMSGISLENLEFLNLNACQKISDKGIEAGTCLCPNLQGLSIYWIVGLTDSSIVHITKNCRHIVDLNLSGCKNISDKGMRLIANSYPGLKKLNITRCVKLTDDGLKEVLQKCSSLESLNLYALSSFTDKVYKEIGLLSNLTFLDLCGAQNLSDNGLVCISSCRGLTYLNLTWCVRVTDTGVVAIAQGCQSLELLSLFGIVGVTDACLEALSKSCSHSLTTLDVNGCIGIKRSRDDLLKLFPKLSCFKVHS

SEQ ID NO: 22445 - DNA, 715 bp, Panicum virgatum
  misc_feature: Ceres CLONE 1821681
  misc_feature: Encodes the peptide sequence at SEQ ID NO. 22446
cgatccaacgaaacgcgccaaccaaacaacgcgaccccgcggcgccccgtcgcgcccgccctgtccgagcctccgatcggctcgcctgtcccgccggcccggatggcggagtccgcggcgcccaagccgccggcggcggcggcggggaggaagacgcgggtggggccgtacgagctcgggaagaccatcggggaggggagcttcgccaaggtcaagcacgcgcgcgactcccgcaccggcgccgtctgcgccatcaaggtgctcgaccgcaaccacgtcctccggcacaagatggtcgagcagatcaaacgggagatttcgactatgaagctaatcaaacatcccaatgtggtccagttgcatgaggttatggctagcaaaacaaagatatacatggttcttgaatttgctgaaggaggggagctatttgataaaattgtcaattctgggaggctgggtgaagatgaagcaaggagatactttcatcaacttataaatgcggttgattactgccatagtcgaggagtttaccatagagacctgaagccagaaaatttgcttcttgattcacatggatcccttaaagtttcagacttcggactgagtgccttcgcaccacaaacaaaagaggatgggcttctgcatactgcttgtggaacgccaaactatgttgcacctgaggtgcttgccgataaaggttatgatggtatggctg

SEQ ID NO: 22446 - protein, 204 aa, Panicum virgatum
  misc_feature: Ceres CLONE 1821681
  misc_feature (23)..(203): Pfam Name: Pkinase Pfam Description: Protein kinase domain
  misc_feature: SWISSPROT Homolog: EC 2.7.11.1 Non-specific serine/threonine protein kinase
  misc_feature: Useful for making plants with modulated salt sensitivity
  misc_feature: Useful for making plants with modulated biomass
MAESAAPKPPAAAAGRKTRVGPYELGKTIGEGSFAKVKHARDSRTGAVCAIKVLDRNHVLRHKMVEQIKREISTMKLIKHPNVVQLHEVMASKTKIYMVLEFAEGGELFDKIVNSGRLGEDEARRYFHQLINAVDYCHSRGVYHRDLKPENLLLDSHGSLKVSDFGLSAFAPQTKEDGLLHTACGTPNYVAPEVLADKGYDGMA

SEQ ID NO: 22447 - DNA, 1075 bp, Panicum virgatum
  misc_feature: Ceres CLONE 1821683
  misc_feature: Encodes the peptide sequence at SEQ ID NO. 22448
gggggcggggagctttccacttcaccgccgtcgctacctgcagcagccggcccggttcgtcgcgggcgatcaaaaggccggctcgatcacagtgatctcaagcatcaaacttttccgggccaaggcgggtagatacggagcgggtgctaaagcgaagcgagagcgccctccgctggtggcgacccgcctgtcgtggtggctgcagcagcatcacctgtaccgccggcgcgtgattgcaccacgagccgtgttggtggagccggaaggtgaagagggaggaggacgggggtgggcgggctggtggtacggtggtccggaggagaaccagcggcggcggcggcgtccatgggcgtgcacgggcggtcgatgggctggtacctgggcccgccggggtcgccggcgcccgggagcgccgtcgcggaggcgcagcacgcgctgagcagcagcccggggggcggcgacgccagcttcgacaccaacatggtcatcatcctcgccgcgctgctcttcgccctgctcttcgcgctcgggctcaaccagctggcgcggtgcctcatccgctgggcgcgccgcgcgtcggagggggaggccggcgccagggggggagggctcaagaggcgcgccctccggagcatccccgtggaggtctacggcgcgtgcggcgccgacggggccgcggccgtcgccgccgacgtctgcgccatctgcctcggcgagttcgcggacggcgagaaggtgcgcgtcctgccgcgctgcgcccacggcttccatgtccggtgcgtcgacacctggctcctctcgcacgactcctgccccacgtgccgcggcaccgtgctcgaggccgccgcgcccggcaaggacaaggccgctgcctccgcccccgccggggggagccggcggcagggcagcgaggctgctgcaatcgcggtggtcatcgggtgacgtggacgggagtgccccacgagcctattgttggcggggcgccggggccacaggtatgcgagctttgttccgtggccgtgagatattttgcgatcagaaactgacaggtgggccctgttcagttgtttatagt

SEQ ID NO: 22448 - protein, 198 aa, Panicum virgatum
  misc_feature: Ceres CLONE 1821683
  misc_feature (118)..(159): Pfam Name: zf-C3HC4 Pfam Description: Zinc finger, C3HC4 type (RING finger)
  misc_feature: Useful for making plants with modulated nitrogen use efficiency
MGVHGRSMGWYLGPPGSPAPGSAVAEAQHALSSSPGGGDASFDTNMVIILAALLFALLFALGLNQLARCLIRWARRASEGEAGARGGGLKRRALRSIPVEVYGACGADGAAAVAADVCAICLGEFADGEKVRVLPRCAHGFHVRCVDTWLLSHDSCPTCRGTVLEAAAPGKDKAAASAPAGGSRRQGSEAAAIAVVIG

SEQ ID NO: 22449 - DNA, 421 bp, Panicum virgatum
  misc_feature: Ceres CLONE 1821687
  misc_feature: Encodes the peptide sequence at SEQ ID NO. 22450
gaggagcgagtagacggcgtcctccgagcgaaagctggaaggggaagagctccactagcgcgtgcgttgccaggagatgtggcggaggcggctgggagctctcctctctccgatccccgccgtcttcctcctccacagccgcctcttcttgccagtatcgccgcccccacctcctccccagagaggaatctcttgctgtcaatcctctgtgcgctgctcctcccgtcccagcgctggaagtgatggtggcaattcacacaagccgctccttgctttcgtcttaaggggccctggtactggcacaggaacgcaatgcaccactattgcttcccatttcggatttgcccatttgcgcgctggggaccttctgcgccatgacatagcctctggcagcgagaacggggagttgatcctggacacc

SEQ ID NO: 22450 - protein, 114 aa, Panicum virgatum
  misc_feature: Ceres CLONE 1821687
  misc_feature: SWISSPROT Homolog: EC 2.7.4.3 Adenylate kinase
MWRRRLGALLSPIPAVFLLHSRLFLPVSPPPPPPQRGISCCQSSVRCSSRPSAGSDGGNSHKPLLAFVLRGPGTGTGTQCTTIASHFGFAHLRAGDLLRHDIASGSENGELILD

SEQ ID NO: 22451 - DNA, 683 bp, Panicum virgatum
  misc_feature: Ceres CLONE 1821689
  misc_feature: Encodes the peptide sequence at SEQ ID NO. 22452
tggacctattgttgcccaaaaatgcaaaacagcaaaagttagagatcaaaaaagattctaagggtgttgttacagttgaaaatgcgacagttgtgagcatttcaagtattgaagaactgaggactataatttcaagaggttctgagagaaggcacactgccggaacaaatatgaatgatgagagctcaaggtctcatttaattctttcaatcattattgaaagtacgaatctccagactcaatcatatgcaagaggcaagctaagttttgtggaccttgctggttctgagagggtgaaaaaatctggttcagcaggaaaacaactgaaagaagcacaaagtatcaataaatctctttcagcattggctgatgttattggtgctttatcttctgatggacaacatataccttaccggaaccataagttaacaatgcttatgagtgattctctcggaggcaatgcgaagaccttgatgtttgtgaatgtttcaccagcagagtctaacttggaggagacttacaactcactcatgtatgcttcacgggttcgttgcattgttaatgatacaagcaagcatgttgccccaaaagaaatcgtgaggctgaagaagttgattgcctattggaaggagcaagcaggcaagcgaagtgatgaagacgaactggaagaaatacaggaagag

SEQ ID NO: 22452 - protein, 226 aa, Panicum virgatum
  misc_feature: Ceres CLONE 1821689
  misc_feature (1)..(186): Pfam Name: Kinesin Pfam Description: Kinesin motor domain
DLLLPKNAKQQKLEIKKDSKGVVTVENATVVSISSIEELRTIISRGSERRHTAGTNMNDESSRSHLILSIIIESTNLQTQSYARGKLSFVDLAGSERVKKSGSAGKQLKEAQSINKSLSALADVIGALSSDGQHIPYRNHKLTMLMSDSLGGNAKTLMFVNVSPAESNLEETYNSLMYASRVRCIVNDTSKHVAPKEIVRLKKLIAYWKEQAGKRSDEDELEEIQE

SEQ ID NO: 22453 - DNA, 736 bp, Panicum virgatum
  misc_feature: Ceres CLONE 1821695
  misc_feature: Encodes the peptide sequence at SEQ ID NO. 22454
aaaccccgccccttcatattcgcctccgcggctccgccgcctcgtcaaacccacgcgaccgcgagagctctcacagagcaccaccacgagagagacgaatcttccgaatctctcggcggcgatggcgctctccgaccgctcccgcgagtcgctcctcccgagcttcctctacgcctcctcctcggcgcgctccttcgccgccaccccctcgcgcctctccgtccccgtccccgccccggccccggccgcggctggagctggtggcggtgcgcccatctcgatccaggcgcccaaggagaagatcgagctctactcgccggcgttctacgccgcctgcacggccggagggatcgccagctgcgggctcacccacatggccgtcaccccgctcgacctcgtcaagtgcaacatgcagatcgatccagcgaaatacaagaacatctcatctggatttggtgtcctgttaaaggagcaaggggctaggggcttcttcaggggatgggtgcctaccttgcttggttacagtgctcagggggcttgcaagtttggcttctatgagttcttcaagaagtactactcagacattgcagggcctgagtatgcccagaagtacaagactctgatctacctggcaggttctgcttctgctgaggtaattgctgatgtggctctctgcccctttgaagctgtgaaaggtacgtgtgcagacgcagcctggatttgctcgtggggtgag

SEQ ID NO: 22454 - protein, 204 aa, Panicum virgatum
  misc_feature: Ceres CLONE 1821695
  misc_feature (68)..(156): Pfam Name: Mito_carr Pfam Description: Mitochondrial carrier protein
MALSDRSRESLLPSFLYASSSARSFAATPSRLSVPVPAPAPAAAGAGGGAPISIQAPKEKIELYSPAFYAACTAGGIASCGLTHMAVTPLDLVKCNMQIDPAKYKNISSGFGVLLKEQGARGFFRGWVPTLLGYSAQGACKFGFYEFFKKYYSDIAGPEYAQKYKTLIYLAGSASAEVIADVALCPFEAVKGTCADAAWICSWG

SEQ ID NO: 22455 - DNA, 711 bp, Panicum virgatum
  misc_feature: Ceres CLONE 1821707
  misc_feature: Encodes the peptide sequence at SEQ ID NO. 22456
agataagatcgagctcggggaggttggggccgaaaagaaaaagaaaaatcatctccaatctccaatcaagctaaccctagcagccgccggcggttagggtttcgagcgagatggcggcggaggcgaggcagcgcggcaccgtgaagtggttcaatgacaccaagggcttcggcttcatctcccccgaggacggcagcgaggacctcttcgtccaccagtcgtccatcaagtcggagggcttccgctccctcgccgagggcgaggaggtcgagttctccgtctcggagggcgacgacggccgcaccaaggccgtcgacgtcaccggccccgacggatcctacgtcaagggcggctccggcggcggcggcgggggcggcggcttcggatcccgcggcggggccggatctggcggcggtggccgcagctacggcggcagctggggcggcgggaggagatccggtggcgggggcggcgccggcgcctgctacaagtgcggggagcccggccacatggccagggactgccccagcgctgatggcggcggcggatacggcgggggcggctacggcggcggcggtggatacggcgggggcggctacggcggcggcggtggcggtggatgctttaagtgcggggagcctggccacatggccagggactgctcccgcggcggaggcggttacggcggcggcggctacggaggtggaggcg

SEQ ID NO: 22456 - protein, 200 aa, Panicum virgatum
  misc_feature: Ceres CLONE 1821707
  misc_feature (6)..(73): Pfam Name: CSD Pfam Description: 'Cold-shock' DNA-binding domain
  misc_feature (123)..(140): Pfam Name: zf-CCHC Pfam Description: Zinc knuckle
  misc_feature (169)..(186): Pfam Name: zf-CCHC Pfam Description: Zinc knuckle
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: The sequence is a functional homolog of SEQ ID NO 468 in the 11/479,226 US patent application
MAAEARQRGTVKWFNDTKGFGFISPEDGSEDLFVHQSSIKSEGFRSLAEGEEVEFSVSEGDDGRTKAVDVTGPDGSYVKGGSGGGGGGGGFGSRGGAGSGGGGRSYGGSWGGGRRSGGGGGAGACYKCGEPGHMARDCPSADGGGGYGGGGYGGGGGYGGGGYGGGGGGGCFKCGEPGHMARDCSRGGGGYGGGGYGGGG

SEQ ID NO: 22457 - DNA, 735 bp, Panicum virgatum
  misc_feature: Ceres CLONE 1821714
  misc_feature: Encodes the peptide sequence at SEQ ID NO. 22458
acacttccattccacacactcgagactttagagctagccaggcagccagcttccagcagcgcacgagctgggctgagcctgagagccgccgccgccgccaccagggataggatgatggcgcccaccgcctcatccttcctcgccgtcttcgtgctcgtggcggcggccgcgtcgacgccggcgcggtcgtgcgcaccgagcgacctgcgcgcgctgctgagcatgaagcaggcgctgggcaacccggcgacgctgtcgtcgtggagcccgtcgtcgcccaactgctgcgcgtgggaccacctccggtgcgacgacgccgggcgcgtgaacaacgtgttcatcgacggcgccgccgacgtgcacgggcagatcccgtcggcggtggcggggctgacggcgctcatgtcgctgtccctgttccgcctgccggggctcacgggcgccatcccgccctgcctcgcggggctctccaacctgcagttcctcaccatctcccacaccaacgtgtcgggccccatcccggaggccctggcgcggctccgcaccctggactcggttgacctctccagcaacaagctgtgcggccgcatcccggcggcgttcgccgacctgcccaacctccggtcgctggacctccagcacaaccagctgacgggccccatcccggcggggctcgtgcaggggcagttccggtcgctgatcctgtccctacaccagctgagcgggccgatcccg

SEQ ID NO: 22458 - protein, 206 aa, Panicum virgatum
  misc_feature: Ceres CLONE 1821714
  misc_feature (27)..(66): Pfam Name: LRRNT_2 Pfam Description: Leucine rich repeat N-terminal domain
  misc_feature: SWISSPROT Homolog: EC 2.7.11.1 Non-specific serine/threonine protein kinase
MAPTASSFLAVFVLVAAAASTPARSCAPSDLRALLSMKQALGNPATLSSWSPSSPNCCAWDHLRCDDAGRVNNVFIDGAADVHGQIPSAVAGLTALMSLSLFRLPGLTGAIPPCLAGLSNLQFLTISHTNVSGPIPEALARLRTLDSVDLSSNKLCGRIPAAFADLPNLRSLDLQHNQLTGPIPAGLVQGQFRSLILSLHQLSGPI

SEQ ID NO: 22459 - DNA, 734 bp, Panicum virgatum
  misc_feature: Ceres CLONE 1821718
  misc_feature: Encodes the peptide sequence at SEQ ID NO. 22460
acctggaacagagacaggcagccaccgtcgcagagcgcgcagcacctgaccgaggacgggttgggcaccgtgcgtcgtcgccggagcagggggagggatggggaggcagccgtgctgcgacaaggtggccgtgaagaagggcccgtggacggcggaggaggaccagaagctcgtcggcttcctcctcacccacggccactgctgctggcgcgtcgtccccaagctcgcagggctgctgaggtgcgggaagagctgccggctccggtggaccaactacctgaggcccgacctcaagaggggcctgctctccgacgacgaggagcggctcgtcatcgacctccacgcgcagctcgggaacaggtggtccaagatcgcggcgcggctgcccgggaggacggacaacgagatcaagaactactggaacacccacatccggaagaagctcgtccggatggggatcgaccccgtcacccacctcccgctgcaggaggcccccgccgctgctgctccccgagagcaggaggaccacctgcctccgccgccgccgccgcagcagcatcagcagaagcagggacaccagccgcctagcgatggcgggttcgtgccgcaggaggacgacgcgggcgaggaggacctgccgatgatccagccgcacgaggtcaccacggcgccacccgcgccgccggcatcggcggcggcggccgcgagcaactgcggctcggtttcttctggct

SEQ ID NO: 22460 - protein, 212 aa, Panicum virgatum
  misc_feature: Ceres CLONE 1821718
  misc_feature (14)..(61): Pfam Name: Myb_DNA-binding Pfam Description: Myb-like DNA-binding domain
  misc_feature (67)..(112): Pfam Name: Myb_DNA-binding Pfam Description: Myb-like DNA-binding domain
  misc_feature: The sequence is a functional homolog of SEQ ID NO 442 in the 10/412,699 US patent application
  misc_feature: Useful for making plants with altered carbohydrate content
  misc_feature: Useful for making plants with altered cell wall content and/or composition
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 1118 in the 10/225,066 US patent application
  misc_feature: The sequence is a functional homolog of SEQ ID NO 1396 in the 11/479,226 US patent application
  misc_feature: The sequence is a functional homolog of SEQ ID NO 2488 in the 10/374,780 US patent application
  misc_feature: The sequence is a functional homolog of SEQ ID NO 658 in the 10/412,699 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: The sequence is a functional homolog of SEQ ID NO 18 in the 11/375,241 US patent application
  misc_feature: The sequence is a functional homolog of SEQ ID NO 426 in the 10/374,780 US patent application
  misc_feature: The sequence is a functional homolog of SEQ ID NO 458 in the 10/225,066 US patent application
  misc_feature: The sequence is a functional homolog of SEQ ID NO 1033 in the 10/412,699 US patent application
  misc_feature: The sequence is a functional homolog of SEQ ID NO 540 in the 10/374,780 US patent application
  misc_feature: Useful for making plants with modulated nitrogen use efficiency
  misc_feature: Useful for making plants with altered terpenoid content
  misc_feature: Useful for making plants with modulated biomass
  misc_feature: The sequence is a functional homolog of SEQ ID NO 1100 in the 10/225,066 US patent application
  misc_feature: The sequence is a functional homolog of SEQ ID NO 158 in the 10/412,699 US patent application
  misc_feature: The sequence is a functional homolog of SEQ ID NO 2268 in the 10/374,780 US patent application
  misc_feature: The sequence is a functional homolog of SEQ ID NO 357 in the 11/479,226 US patent application
  misc_feature: The sequence is a functional homolog of SEQ ID NO 480 in the 11/435,388 US patent application
  misc_feature: The sequence is a functional homolog of SEQ ID NO 126 in the 10/412,699 US patent application
MGRQPCCDKVAVKKGPWTAEEDQKLVGFLLTHGHCCWRVVPKLAGLLRCGKSCRLRWTNYLRPDLKRGLLSDDEERLVIDLHAQLGNRWSKIAARLPGRTDNEIKNYWNTHIRKKLVRMGIDPVTHLPLQEAPAAAAPREQEDHLPPPPPPQQHQQKQGHQPPSDGGFVPQEDDAGEEDLPMIQPHEVTTAPPAPPASAAAAASNCGSVSSG

SEQ ID NO: 22461 - DNA, 1559 bp, Panicum virgatum
  misc_feature: Ceres CLONE 1821728
  misc_feature: Encodes the peptide sequence at SEQ ID NO. 22462
ggatagcttttcctgcctcctcgcctggccgccgcccgccttcgcgtgtgctccccgccccacaaccacgcaacacaggcttcctcgaaccgtcgatgagcgcccaagcaagccggtaaccaaggggcggcccggtccccccgaagctccgctcgacgccatgctcgccgcggccgtggcggcggccgccatccctccggcggcttcttattattcccccgcgaagctgtcctggagatggagggcttcccggagccgtcgggcggcaagaatcgaggctgggtactcccaattggaggtgagaaaagtcacctatcgtcctcctggaaccgaacataacttgttgaatgaaattaacctctctcttcgggagaaaagttttggtttgatatttggacggagtgggagtggaaagaccacccttttacagctcttggctggtctatcagaacctacctctgggtctatttgcattcagaagtatgatgatagtgggaatcctattggcatgtctgaaatgctaacttctcaaagagttggaattgtatttcagtttcctgagaggtatttcttagcagatactgtacttgaagaagttacttttggatggcctaggcaaaaggcagatctcctattcaaagagcagctcgctttaaatcttcaaaatgcctttaactcggttggtctgaaaaccatttcattagatgaagatccacagtctctaagtggtgggtttaagaggcgacttgctttggcaattcaactggttcaaactcctgatctattgctgcttgatgagccacttgctggtttagattggaaagctcgggctgatgtcgtgaatctcctgaaggacctaaagaagcaccacacaatactggttgtaagtcacgatctaagggaactatatccactagtagatcgctcatggagaatgcaaatgggagggagcttgaaggtggaaactttgcctgtgtaaagatgtactcattggtatagtggtcagacatgctggcataaacattactggccactcccaatctagtaagatcaactacagaactacttttataaacttggataatgtttcggaaatttcttgaagatacaatggagtcaaagatggttgtgattgagtatttggtaatacatgatgacttgtgcacaggatcgagaatcggggtacaaaaaatgctagaaaacttggatgagagatcatggacgttagtcccaaactttgactgctggaatggaacagtctgtgatgcagacgttgtcgagctaaattgatcgttgaacagtgctattggaattcggaacgaggatccaggcatccagctatagctccttgttgcacacgagttatgaggatgatgagagccttgtggagtttgaaagatgggtcaaaatgatgctgatgatggtgttggtattttcattgaagagattcagagaacctcatttactttaacttttaatagagttgtttggaatacagtttcttaaaaaactttttatgccagaagaatatagtgctcactagcagattatttccctcc

SEQ ID NO: 22462 - protein, 272 aa, Panicum virgatum
  misc_feature: Ceres CLONE 1821728
  misc_feature (72)..(262): Pfam Name: ABC_tran Pfam Description: ABC transporter
  misc_feature: SWISSPROT Homolog: EC 3.6.3.31 Polyamine-transporting ATPase
MLAAAVAAAAIPPAASYYSPAKLSWRWRASRSRRAARIEAGYSQLEVRKVTYRPPGTEHNLLNEINLSLREKSFGLIFGRSGSGKTTLLQLLAGLSEPTSGSICIQKYDDSGNPIGMSEMLTSQRVGIVFQFPERYFLADTVLEEVTFGWPRQKADLLFKEQLALNLQNAFNSVGLKTISLDEDPQSLSGGFKRRLALAIQLVQTPDLLLLDEPLAGLDWKARADVVNLLKDLKKHHTILVVSHDLRELYPLVDRSWRMQMGGSLKVETLPV

SEQ ID NO: 22463 - DNA, 1053 bp, Panicum virgatum
  misc_feature: Ceres CLONE 1821761
  misc_feature: Encodes the peptide sequence at SEQ ID NO. 22464
ttcccttccacccgaagtcgccgagtcaacaacgtccggcaccggcggcgcctacccctccctcctccctatcctccaaattccaaaacccagctaggcccgcgctcgcagcgaaccctaatggtgccgcagggggtcgcggaggccctgcaggcctacacgggcctcacgccgggggccgccgccaccatcctcgccctcatgctcgcgacctacctcctcgtctcctccctcttcgtcgcccccgccgccccctcccccacggcgcctcccaagcaacccgagcagcagcgggaggaagagaggaaggagaaggagaaggagaaggagaaggatcgggaagaggaggaggaggcgccgatgcccttcgtgtttccggaccccgtcgaggtcggcgagatcacgctcgagcagctcaggtcgtacgacggcaaggaccccgccaagcagatcctcatcgccatccgcggccaggtctacgacgtctcgcgcgggaggctcttttatggccctcagggaccatactccttgtttgccgggagggatgcaacccgggccctggcattgatgtcatttgaccctaatgacctcaccggggatttggacggcctaagccccgatgagctggaggtgttgcaagactgggaggaaaaattcaaggagaggtacccgagggtgggtcaccttgcctgtcaagatacagcaggcagtggccgcaacgccgctccgcctgaccatgaggaaggggacgcctaactccatcgccggtttgcttcgtccccttgttttcttctcacagcatcccaaggggtagatctgatgtgctcactatagtaggtggcgctgcccgcgtcatcgtgtgttgtctgtacgtgtgactaatgtacctgccctgcccgcttttgttttgatgtctagtggattagggggaggttttgagtggcagaataactctggaggctctgagggaacagcccatgtgtatatcggtgcgtgatttgtgtcatgattcctggctttgttgctcgtgtaacaacgagccagctgtcagcc

SEQ ID NO: 22464 - protein, 211 aa, Panicum virgatum
  misc_feature: Ceres CLONE 1821761
  misc_feature (93)..(190): Pfam Name: Cyt-b5 Pfam Description: Cytochrome b5-like Heme/Steroid binding domain
MVPQGVAEALQAYTGLTPGAAATILALMLATYLLVSSLFVAPAAPSPTAPPKQPEQQREEERKEKEKEKEKDREEEEEAPMPFVFPDPVEVGEITLEQLRSYDGKDPAKQILIAIRGQVYDVSRGRLFYGPQGPYSLFAGRDATRALALMSFDPNDLTGDLDGLSPDELEVLQDWEEKFKERYPRVGHLACQDTAGSGRNAAPPDHEEGDA

SEQ ID NO: 22465 - DNA, 719 bp, Panicum virgatum
  misc_feature: Ceres CLONE 1821776
  misc_feature: Encodes the peptide sequence at SEQ ID NO. 22466
atcccattcccatcacccctcacctccaacgtttgcccgagcacgacgtaagacgacgagcggcgtcgagcgacccagctagctgccgtgccgccgcgttccagttggttccggcaggcggggtccggagatgagccaggagaacggagccgccgcccacggcgaggagcaggacgtgatggaggtggagccgaagcgccgggcgccgcggctcaacgagcgtatcctctcctcgctgtcgcggaggtccgtcgccgcgcacccctggcacgacctcgagatcggtcctgaagctccggcggtcttcaacgtggtcgtggagatcaccaaggggagcaaggtcaagtacgagctggacaagaagacggggctcatcaaggtggaccgggtcctctactcctccgtcgtgtacccgcacaactacggcttcatcccccggtcgctctgcgaggacaatgaccccatggacgtcctcgtcctcatgcaggaaccagttcttcccggcgccttcctccgggcccgggcgatcggcctcatgcctatgatagatcaggtagggaaatacacgaatcatttctaccctgattccatctctgtgcaattcgattttaagtcgcaagtatctgcaccgatcttactgcctgctgtcctaccgaaaatgtcggaggaacagggtgagaaggacgacaagatcatagccgtctgcgccgacgatcccg

SEQ ID NO: 22466 - protein, 196 aa, Panicum virgatum
  misc_feature: Ceres CLONE 1821776
  misc_feature (60)..(195): Pfam Name: Pyrophosphatase Pfam Description: Inorganic pyrophosphatase
  misc_feature: SWISSPROT Homolog: EC 3.6.1.1 Inorganic diphosphatase
MSQENGAAAHGEEQDVMEVEPKRRAPRLNERILSSLSRRSVAAHPWHDLEIGPEAPAVFNVVVEITKGSKVKYELDKKTGLIKVDRVLYSSVVYPHNYGFIPRSLCEDNDPMDVLVLMQEPVLPGAFLRARAIGLMPMIDQVGKYTNHFYPDSISVQFDFKSQVSAPILLPAVLPKMSEEQGEKDDKIIAVCADDP

SEQ ID NO: 22467 - DNA, 227 bp, Panicum virgatum
  misc_feature: Ceres CLONE 1821783
  misc_feature: Encodes the peptide sequence at SEQ ID NO. 22468
atccagtccccaatccgtcgagaaattcctcccgagccatcgaaatcgaagcgaaacgaagcggcctcccccgatcctctcaagatgcagatctttgttaagaccctcaccggcaagaccatcactttggaggttgagtcgtctgacaccattgacaatgtggaggccaagatccaggaccagggggggctccctcccgaaccaccgcgtccggatcttgctgggca

SEQ ID NO: 22468 - protein, 47 aa, Panicum virgatum
  misc_feature: Ceres CLONE 1821783
  misc_feature: Useful for making plants with modulated nitrogen use efficiency
  misc_feature: Useful for making plants with modulated cold sensitivity
MQIFVKTLTGKTITLEVESSDTIDNVEAKIQDQGGLPPEPPRPDLAG

SEQ ID NO: 22469 - DNA, 432 bp, Panicum virgatum
  misc_feature: Ceres CLONE 1821792
  misc_feature: Encodes the peptide sequence at SEQ ID NO. 22470
ggcgcatcctctcccccgcttcaagatgcagatctttgtgaagaccctcaccggcaagaccatcaccctcgaggtggagtcctcccaccccattgagaacgccgaggccaacatccaggacaaggagggcctccccccagaccagccgaggctcatcttcgctggcaagcaggtcgaggacgggcgctcgcttgctgactacaacatccagaaggaaagcaccctccacctggcgctgcgcctgagaggaggcatgcggatcttcgtgaagaccctcaccgggccgaccctcaccctcgaggcggagtcctcccacacctttgaccacgtcacggcgccgattccggacaaggagggcatccccccagaacagcacaggctcatcttcgccggcaagcaggctcgaggaacggcgcacgcttgctgactaca

SEQ ID NO: 22470 - protein, 133 aa, Panicum virgatum
  misc_feature: Ceres CLONE 1821792
  misc_feature (6)..(74): Pfam Name: ubiquitin Pfam Description: Ubiquitin family
  misc_feature: Useful for making plants with modulated nitrogen use efficiency
  misc_feature: Useful for making plants with modulated cold sensitivity
MQIFVKTLTGKTITLEVESSHPIENAEANIQDKEGLPPDQPRLIFAGKQVEDGRSLADYNIQKESTLHLALRLRGGMRIFVKTLTGPTLTLEAESSHTFDHVTAPIPDKEGIPPEQHRLIFAGKQARGTAHAC

SEQ ID NO: 22471 - DNA, 710 bp, Panicum virgatum
  misc_feature: Ceres CLONE 1821828
  misc_feature: Encodes the peptide sequence at SEQ ID NO. 22472
ggatcctcaactcgaacagcccagccgcaaagccaccccgggtttccagcagctccggcacgatcgccttcgcccagtgattgagggtcagggaaaaaaattcccccgtcgcacccgcccactacgacggcgccgggagaggaatctcccgccgccacggtgctcctcggcaggtacgagctcggcgacctcctcggccgcggcgcgtccgccaaggtgtaccgcgcgcgggacctcctcaccggccactccgtcgcgatcaagtcattccccaacccccgcgccggcgccgaggaggggcgccgccccgtggccatcgagcgcgaggcggccatcctccgccgcctgcgccaccgccacgtggtgcgcctccacgagatcctagccacgcgcaagaaggtccatttcgtcctcgacctcgccgccggcggcgagctcttctcgctcgtcgacgcctccggccgcatgacggaggacctcgccaggcactacttccggcagctcatctccgccgtgcgctactgccacgcgcgcggcgtgttccaccgcgacatcaagccggagaacctactcctggacgaggccggcgagctcaaagtcgccgactttggcctcggcgccgtggccgacgacggcaacctccgccacacgctctgcggcaccccggcgtacgtggcgccggagatcctgtcgaggagagggtacgaccc

SEQ ID NO: 22472 - protein, 81 aa, Panicum virgatum
  misc_feature: Ceres CLONE 1821828
  misc_feature: SWISSPROT Homolog: EC 2.7.11.1 Non-specific serine/threonine protein kinase
  misc_feature: Useful for making plants with modulated biomass
  misc_feature: Useful for making plants with modulated salt sensitivity
  misc_feature: Useful for biocontainment applications
  misc_feature: Useful for making plants with modulated time to senescence
  misc_feature: Useful for making plants with modulated water use efficiency
MTEDLARHYFRQLISAVRYCHARGVFHRDIKPENLLLDEAGELKVADFGLGAVADDGNLRHTLCGTPAYVAPEILSRRGYD

SEQ ID NO: 22473 - DNA, 1060 bp, Panicum virgatum
  misc_feature: Ceres CLONE 1821841
  misc_feature: Encodes the peptide sequence at SEQ ID NO. 22474
ttttgcttgcatcgcaccaccaccagcagccagcaagccatctaatgcattgccgagcccacacggtgcccgccatgccaccgtcctcccctctcgtcaagctccccctcctgccgcgcggcctgctctcctatatccccacctccatcctcccgagcggccgcgagagcgccgccacgcccaccagcagctcgcactcgaagccgcagcccgcgccgccttctcccaagaagatgtcgtcgtcgtcggtgcagcagcagcagcagcagcaggcggggagcgggagcggcaaggccgaccaggcggagctggcgcgcgtgttcgagctgttcgacaagaacggcgacgggcgcatcacgcgggaggagctggaggactcgctggggaagctggggatgtccgtgccgggcgacgagctcgcgtccatgatcgcgcgcatcgacgccaacggcgacgggtgcgtggacgtggaggagttcggggagctctaccgcgccatcatggacggcggcgacggcagggccggcggcgagggcggcgccggcgccggggagggggagggggaggggggagccgccggcgaggaggcggacgaggacatgcgggaggcgttccgggtgttcgacgccaacggcgacgggtacatcacggtggacgagctcggcgcggtgctgtcgtcgctgggcctgaagcagggccgcaccgcggaggagtgccggcgcatgatcggccgcgtcgaccgcgacggcgacggcagggtcgacttccacgagttccgccagatgatgcgctccggcgggctcgccacgctcgggtgagccgccgggcggcgccgcctgcatctggccacgcatggagcgccgtgcgcctccaagcttgatccgtactagaacttgtagatattgcttatgcttggcttgtggggatctcacgtaaccacgcttgatctttcttttggttctatactcttgtgcttgttgctttgtccgttagagatcgatgggcttgctaattgactattgtatcgattgttgctcgatcatacgaattgctcgagcgg

SEQ ID NO: 22474 - protein, 247 aa, Panicum virgatum
  misc_feature: Ceres CLONE 1821841
  misc_feature (175)..(203): Pfam Name: efhand Pfam Description: EF hand
  misc_feature (213)..(241): Pfam Name: efhand Pfam Description: EF hand
  misc_feature (78)..(106): Pfam Name: efhand Pfam Description: EF hand
  misc_feature (114)..(142): Pfam Name: efhand Pfam Description: EF hand
  misc_feature (180)..(239): SWISSPROT Homolog: EC 2.7.11.1 Non-specific serine/threonine protein kinase
  misc_feature (81)..(142): SWISSPROT Homolog: EC 2.7.11.17 Calcium/calmodulin-dependent protein kinase
MPPSSPLVKLPLLPRGLLSYIPTSILPSGRESAATPTSSSHSKPQPAPPSPKKMSSSSVQQQQQQQAGSGSGKADQAELARVFELFDKNGDGRITREELEDSLGKLGMSVPGDELASMIARIDANGDGCVDVEEFGELYRAIMDGGDGRAGGEGGAGAGEGEGEGGAAGEEADEDMREAFRVFDANGDGYITVDELGAVLSSLGLKQGRTAEECRRMIGRVDRDGDGRVDFHEFRQMMRSGGLATLG

SEQ ID NO: 22475 - DNA, 736 bp, Panicum virgatum
  misc_feature: Ceres CLONE 1821848
  misc_feature: Encodes the peptide sequence at SEQ ID NO. 22476
gaaattcctcgacggatcgatcgcatctctgccaccgccgccaccacctgcctatttgggaggttgcctggccgcgcgcccatggccgtcaccgtgtgcgtcaccggcgccggcggcttcatcgggtcttggatagtcaagctcctcctcgaccgcgggtacgccgtccggggcacctcccgccgcgcagatgaccccaagaacgcgcacctctgggcgctcgacggcgcggcggagcgcctcacgatgctgcaggtggacctgctcgatcgggccagcctccgcgccgccttcgacggctgcgacggcgtcatccacaccgcctcgccgatgcacgacaaccccgaggagatcatcgagccaattatcgccgggacacggaacgtcgtggaggccgcggccgacgccggcgtgcggcgcctggtgatctcctccaccatcggcaccatgtacatgaacccgcaccgcgaccccgacgcgcccctggacgagtggagctggagcgacctcgagcactgcaagaagaccgcgaactggtactgctacgccaagacgatcgcggagcagagcgcgtggcaggcggcgcgggcgcggggcctggacctggcggtggtcatcccggtggtggtgctcggcgaactgatgcagccaagcatgaacaccagcaccctgcacatactcaagtacctcaccggccaggccaaggactatgtcaacgagtcgcacgcgtacgtgc

SEQ ID NO: 22476 - protein, 218 aa, Panicum virgatum
  misc_feature: Ceres CLONE 1821848
  misc_feature (5)..(218): Pfam Name: Epimerase Pfam Description: NAD dependent epimerase/dehydratase family
  misc_feature: SWISSPROT Homolog: EC 1.1.1.219 Dihydrokaempferol 4-reductase
  misc_feature: Useful for making plants with altered carbohydrate content
  misc_feature: Useful for making plants with altered cell wall content and/or composition
  misc_feature: Useful for making plants with altered lignin content
MAVTVCVTGAGGFIGSWIVKLLLDRGYAVRGTSRRADDPKNAHLWALDGAAERLTMLQVDLLDRASLRAAFDGCDGVIHTASPMHDNPEEIIEPIIAGTRNVVEAAADAGVRRLVISSTIGTMYMNPHRDPDAPLDEWSWSDLEHCKKTANWYCYAKTIAEQSAWQAARARGLDLAVVIPVVVLGELMQPSMNTSTLHILKYLTGQAKDYVNESHAYV

SEQ ID NO: 22477 - DNA, 688 bp, Panicum virgatum
  misc_feature: Ceres CLONE 1821859
  misc_feature: Encodes the peptide sequence at SEQ ID NO. 22478
attagagggttttgtgaacaacactcaggagttatctgtaatattcgcaggggcgtggacggtggcgggaggcggctgaaggacacccagcggcggaggctccgcaggacggcggctctactaggtcgctactacattcgactcgcgccatggcggtgagggagaagaggaggggtgcgccgccgctcgaaggcgacgagcagcggctgcggcggaagcaggaggaggcggcgctcctccgcaggatcagagggctcgtgcgctgggtcgtcgaggaggtcgtcgccggccgctccccgtccatcgtgctccaccggtaccggaactactgctcggccgctgacgctgcgtccccatcgccatgtgcctgcagctacgacgcccccgtcggcacggacgtcctctccctgctccacaaggactgccacacctcccgcctcaatgcgctcctgagggtgcttctcgtggtgcagcagctcctgcaacagaacaagcactgctccaagagggacatctactacatgtacccctccattttcgtagaagtagctgttgttgaccgtgccatcaatgatatctgcgtactcttcaagtgcagtcggcacaatctacatgtggttcctgtagtgaaaggtttggtgatgggctggataagatttctggagggtgaaaaacaagtgtattgcat

SEQ ID NO: 22478 - protein, 179 aa, Panicum virgatum
  misc_feature: Ceres CLONE 1821859
  misc_feature (88)..(157): Pfam Name: TP6A_N Pfam Description: Type IIB DNA topoisomerase
MAVREKRRGAPPLEGDEQRLRRKQEEAALLRRIRGLVRWVVEEVVAGRSPSIVLHRYRNYCSAADAASPSPCACSYDAPVGTDVLSLLHKDCHTSRLNALLRVLLVVQQLLQQNKHCSKRDIYYMYPSIFVEVAVVDRAINDICVLFKCSRHNLHVVPVVKGLVMGWIRFLEGEKQVYC

SEQ ID NO: 22479 - DNA, 1398 bp, Panicum virgatum
  misc_feature: Ceres CLONE 1821869
  misc_feature: Encodes the peptide sequence at SEQ ID NO. 22480
acgtggccgcttttccggcgttccgccctccgccgcaaactccgcaggccgcgacggttgcgcgagcgtgatgccctcgtggatggcgccctccgctccctagaagcggctgataggggagcatcaggtaaggaggccacgcgccgccggatctggcggttcttggcgaagatggtgacatcaacggcgcaagagaagcaaaacgaaaaccccttcaacgatgttcatgccaggccacccatctatctcttattcacagttggtaaaagcaacagatggtttctcacctaccaatttgctgggttctggatcatttgggtctgtgtacaaaggagagctagatggtgaagatggtgaaagtacaaatcttgttgctgtgaaggttctaaagcttcaaattcctggtgcagttaagagtttcatagctgaatgtgaagcactgcgaaacatgagacaccggaatcttgtcaagatagttacagcttgtgcaagcattgattcaagaggaaatgacttcaaagcaattgtgtatgacttcatgccaaatgggagtttagaaggttggctacatcctgatgcaaatgatgagcaaacaaagcaaagatatttagatctcacagatagagtaaccatactcctagatgtggcttatgcattggattaccttcattctgatggcccagatcctgttatacattgtgatcttaagccaagtaatgtgctcttggatgctgatatggttgcccatgttggggactttggactcgccaagattattgttgatggaagctcaattatccaacagccgatgagctctatgggattcagagggacagtcggttatgctgccccagagtatggtgctggtaatgtggtatcaacgaatggagacatttacagctacggaattcttgtgttagaaatggtaactggtaggaagcccacagactccaccttcagagaaggattgagcctccgtgaatacgttgagctggccctgtgtaacggaacgatggacgccattgacatgcgtctgtctttaagcctcaagaatgaatttcagggtgcgggtgagggtaattcttctcaccacagaaagactgactgcctgattgctttacttagacttggattgttgtgctctgaggaattgccatcccgtaggatgtcaactggagacatcatcaaggagctgcttgttatcaaacgatctctcttgtagatgcttcaagatgattcctgctgcagctagagtttcttggatatagatgatttttcaatgtgtccagtttatgccgctggtttcatcatccttttatgtcatacaatcgttgtacttcgttgctctgctagctggagtcgcagcagttgcaataatctatgcattgttggttgttg

SEQ ID NO: 22480 - protein, 333 aa, Panicum virgatum
  misc_feature: Ceres CLONE 1821869
  misc_feature (21)..(327): Pfam Name: Pkinase Pfam Description: Protein kinase domain
  misc_feature: SWISSPROT Homolog: EC 2.7.11.1 Non-specific serine/threonine protein kinase
MFMPGHPSISYSQLVKATDGFSPTNLLGSGSFGSVYKGELDGEDGESTNLVAVKVLKLQIPGAVKSFIAECEALRNMRHRNLVKIVTACASIDSRGNDFKAIVYDFMPNGSLEGWLHPDANDEQTKQRYLDLTDRVTILLDVAYALDYLHSDGPDPVIHCDLKPSNVLLDADMVAHVGDFGLAKIIVDGSSIIQQPMSSMGFRGTVGYAAPEYGAGNVVSTNGDIYSYGILVLEMVTGRKPTDSTFREGLSLREYVELALCNGTMDAIDMRLSLSLKNEFQGAGEGNSSHHRKTDCLIALLRLGLLCSEELPSRRMSTGDIIKELLVIKRSLL

SEQ ID NO: 22481 - DNA, 1228 bp, Panicum virgatum
  misc_feature: Ceres CLONE 1821871
  misc_feature: Encodes the peptide sequence at SEQ ID NO. 22482
aaagacaaactgctgaaggctttggctatcagcagacatcttccctgaatatctctctctctctcgctcgtcgtcagggctcgtgtgtgtagcagctgctggctcggaagctagccatgagcttgatcagcatgatggaggcacggctgcccccggggttccggttccacccgagggatgacgagctcgttctcgactacctctgccgcaagctctccggcggtggcgggggcgcgtacggcggcatcgccatggtcgacgtcgacctcaacaagtgcgagccgtgggagctgccagacgaggcgtgcgtgggcagccgggagtggtacttcttcagcctgcacgaccgcaagtacgcgacggggcagcgcaccaaccgcgccacgcgctccggctactggaaggccaccggcaaggaccgccccatctccatctccggtcgccgcggcggaggcgccgccaccatggtcgggatgcgcaagacgctggtgttctaccagggcagggcgccccgcgggagcaagaccgagtgggtcatgcacgagttccgcgtggagggcccggccgttgccgttgccggccgcccctgctcacctcccaaggaggactgggtgctgtgcagggtgttctacaagagcagaaccaccacggcaagaccagcaagcaccgacgagaccgcgtcgctgtccagcgagctgatcagcctgccgctgccgcacatgccccctgcagctgatgcctacctcgccttcgatcacggcgcggcggccgccatcgatggctactgccgccagcagcaaggcgacgctggcctcccggcggcgttgcaacaccagtctgcgctgccgctcgacaggagcctgtcgagcttcagggacctgctgatgagcagcatggtgcaaggcagcgacggcggcggcgccatcgcgaaggcggagctccaccaggactggacggaggcggcctacgcgcagcagcagcagcatggggcacaggcgtggaacccgtttctgatatccggatgagagcgcacggctaggctaacgtgtgcttggcgttgcaggcatcgcgtattcgcttgtgtagtgagtagtgagcagcttgctcgacgtcttttctgtagcttgatctggttagtgtgatctctgccgtttgatagctgtaggcttggtgcagtaactttttgtacaaaggattgttgcagaaaaatagattttttgtatttttt

SEQ ID NO: 22482 - protein, 302 aa, Panicum virgatum
  misc_feature: Ceres CLONE 1821871
  misc_feature (11)..(147): Pfam Name: NAM Pfam Description: No apical meristem (NAM) protein
  misc_feature: Useful for making plants with altered lignin content
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: The sequence is a functional homolog of SEQ ID NO 1197 in the 10/412,699 US patent application
  misc_feature: The sequence is a functional homolog of SEQ ID NO 866 in the 10/374,780 US patent application
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: Useful for making plants with modulated light quality sensitivity
  misc_feature: The sequence is a functional homolog of SEQ ID NO 492 in the 11/435,388 US patent application
  misc_feature: The sequence is a functional homolog of SEQ ID NO 741 in the 11/479,226 US patent application
  misc_feature: The sequence is a functional homolog of SEQ ID NO 106 in the 10/225,068 US patent application
  misc_feature: The sequence is a functional homolog of SEQ ID NO 2348 in the 10/374,780 US patent application
  misc_feature: The sequence is a functional homolog of SEQ ID NO 340 in the 10/412,699 US patent application
  misc_feature: The sequence is a functional homolog of SEQ ID NO 778 in the 11/479,226 US patent application
  misc_feature: The sequence is a functional homolog of SEQ ID NO 100 in the 10/374,780 US patent application
  misc_feature: The sequence is a functional homolog of SEQ ID NO 318 in the 10/412,699 US patent application
  misc_feature: The sequence is a functional homolog of SEQ ID NO 749 in the 11/479,226 US patent application
  misc_feature: The sequence is a functional homolog of SEQ ID NO 884 in the 10/225,066 US patent application
  misc_feature: Useful for making plants with altered terpenoid content
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: Useful for making plants with altered cell wall content and/or composition
  misc_feature: The sequence is a functional homolog of SEQ ID NO 2590 in the 10/374,780 US patent application
  misc_feature: The sequence is a functional homolog of SEQ ID NO 286 in the 10/225,066 US patent application
  misc_feature: Useful for making plants with modulated biomass
MSLISMMEARLPPGFRFHPRDDELVLDYLCRKLSGGGGGAYGGIAMVDVDLNKCEPWELPDEACVGSREWYFFSLHDRKYATGQRTNRATRSGYWKATGKDRPISISGRRGGGAATMVGMRKTLVFYQGRAPRGSKTEWVMHEFRVEGPAVAVAGRPCSPPKEDWVLCRVFYKSRTTTARPASTDETASLSSELISLPLPHMPPAADAYLAFDHGAAAAIDGYCRQQQGDAGLPAALQHQSALPLDRSLSSFRDLLMSSMVQGSDGGGAIAKAELHQDWTEAAYAQQQQHGAQAWNPFLISG

SEQ ID NO: 22483 - DNA, 1681 bp, Panicum virgatum
  misc_feature: Ceres CLONE 1821878
  misc_feature: Encodes the peptide sequence at SEQ ID NO. 22484
agaaccatttctgagaagaaaagctcgcgcctgtcacgtagctggggcggcggccgggccggtgcctactggatagatcgttcatgtgccacgccgcggtggcggactcgagggagcagcacgggcggcggcttctcgccgccgccggcggcggcggaggagaccgccgccagcagcagcagcagccccagccgctggagcccgtggtgatggaagccaacacggcggcgtcgccggcgctgtcgcggggcaggcaggcccgggagatgtcggccatggtggccgcgctggccagggtggtcgccggctcggcgccgccggccaaggcgcccccccaggccgtgcaggatgcctccgcggaggaggcgtggtggccgtacgacgagctcgccgccgagccgtcccctgctttcgtgctcgacggctacagcgagacgcagccgctgccggagcactactggccttcggctgcggcggcgacagaggcggcgacttcctcgcagacgcattaccgtgccgcctctgccgccgcggccgaggaggaggtaccttcgccgtcgtccgcctccgccgccgccggggcgagcagcagcggcagcgcggcgacgcggaagcgttaccgcggcgtgcggcagcgtccgtgggggaagtgggcggcggagatccgtgacccgcacaaggcggcgcgcgtgtggctgggcaccttcgacaccgccgaggccgccgcccgggcctacgatggcgccgcgcttaggttccgcggcagccgcgccaggctcaacttccccgagtccgccacgctcccgtccccgccgccgccggatccggcctcgcgcgcattgccgccgccgccgcccaggccggacgcgcttctggagtcgcaggctcaggcgccctccaccggcggcggcatggagcaatacgcggagtacgccaggctcttgcagagcgccggcggcgaccccggcggctcatccgggacgccaagtggcacgttgcctccccctcctcctcctgcagcgtacagcttcgccgcccagggcgtgacaccgttcagctacctgtcgccgccgcagagccgcggcgagccagcaggcaaccccgcggcggcgtgggcggcgagccactaccacggctcgtacccgccgtggcggtgggaccactcaggttgaccccgtcaacgaaaaaggttgcctacgtggagagattcagtcagcccctttaacgccacgtgggtggtcggtcaacggtgcaggcggcggggaagtcgtggggcggcacgagacgccacgtggactctcgctgtcactgacaggtcggccgctgtcggccgctcacgtcgtggaaagacgccgtcaagctgctgggcctgtccgtcagtccttgtcccggttgcggcggtcagacagttcaaacggcgcagggtcagatggacggcggaaaacggcaaacgtgattaggacgcccccgatagcttggaatcaacgtcgcctggagtcacgagcatggagagaaacgagccctgggcatagataactttcttcatctttttttaaatttagatttatattcaaatttgagtgctttcgttgaaatctttgttcaaatgctccctaccactctgttcggctggctgtggccggtgctgatttattatgagagaaaaatactgttggctggc

SEQ ID NO: 22484 - protein, 362 aa, Panicum virgatum
  misc_feature: Ceres CLONE 1821878
  misc_feature (177)..(228): Pfam Name: AP2 Pfam Description: AP2 domain
  misc_feature: The sequence is a functional homolog of SEQ ID NO 1769 in the 10/374,780 US patent application
  misc_feature: The sequence is a functional homolog of SEQ ID NO 10 in the 10/412,699 US patent application
  misc_feature: The sequence is a functional homolog of SEQ ID NO 124 in the 11/479,226 US patent application
  misc_feature: The sequence is a functional homolog of SEQ ID NO 155 in the 11/479,226 US patent application
  misc_feature: The sequence is a functional homolog of SEQ ID NO 2216 in the 10/374,780 US patent application
  misc_feature: The sequence is a functional homolog of SEQ ID NO 34 in the 10/412,699 US patent application
  misc_feature: The sequence is a functional homolog of SEQ ID NO 52 in the 10/903,236 US patent application
  misc_feature: The sequence is a functional homolog of SEQ ID NO 780 in the 10/225,066 US patent application
  misc_feature: The sequence is a functional homolog of SEQ ID NO 2217 in the 10/666,642 US patent application
  misc_feature: The sequence is a functional homolog of SEQ ID NO 24 in the 10/903,236 US patent application
  misc_feature: The sequence is a functional homolog of SEQ ID NO 84 in the 10/714,887 US patent application
  misc_feature: The sequence is a functional homolog of SEQ ID NO 84 in the 11/435,388 US patent application
  misc_feature: Useful for making plants with altered lignin content
  misc_feature: Useful for making plants with altered carbohydrate content
  misc_feature: Useful for making plants with altered alkaloid content
  misc_feature: The sequence is a functional homolog of SEQ ID NO 20 in the 10/903,236 US patent application
  misc_feature: The sequence is a functional homolog of SEQ ID NO 2213 in the 10/666,642 US patent application
  misc_feature: The sequence is a functional homolog of SEQ ID NO 80 in the 10/714,887 US patent application
  misc_feature: The sequence is a functional homolog of SEQ ID NO 80 in the 11/435,388 US patent application
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
  misc_feature: The sequence is a functional homolog of SEQ ID NO 1354 in the 10/666,642 US patent application
  misc_feature: The sequence is a functional homolog of SEQ ID NO 171 in the 11/479,226 US patent application
  misc_feature: The sequence is a functional homolog of SEQ ID NO 18 in the 10/714,887 US patent application
  misc_feature: The sequence is a functional homolog of SEQ ID NO 18 in the 11/435,388 US patent application
  misc_feature: The sequence is a functional homolog of SEQ ID NO 1954 in the 10/374,780 US patent application
  misc_feature: The sequence is a functional homolog of SEQ ID NO 8 in the 10/666,642 US patent application
  misc_feature: The sequence is a functional homolog of SEQ ID NO 8 in the 10/903,236 US patent application
  misc_feature: The sequence is a functional homolog of SEQ ID NO 164 in the 10/714,887 US patent application
  misc_feature: The sequence is a functional homolog of SEQ ID NO 164 in the 11/435,388 US patent application
  misc_feature: The sequence is a functional homolog of SEQ ID NO 32 in the 10/903,236 US patent application
  misc_feature: The sequence is a functional homolog of SEQ ID NO 166 in the 10/714,887 US patent application
  misc_feature: The sequence is a functional homolog of SEQ ID NO 166 in the 11/435,388 US patent application
  misc_feature: The sequence is a functional homolog of SEQ ID NO 34 in the 10/903,236 US patent application
  misc_feature: The sequence is a functional homolog of SEQ ID NO 16 in the 10/903,236 US patent application
  misc_feature: The sequence is a functional homolog of SEQ ID NO 2209 in the 10/666,642 US patent application
  misc_feature: The sequence is a functional homolog of SEQ ID NO 76 in the 10/714,887 US patent application
  misc_feature: The sequence is a functional homolog of SEQ ID NO 76 in the 11/435,388 US patent application
  misc_feature: The sequence is a functional homolog of SEQ ID NO 1466 in the 10/666,642 US patent application
  misc_feature: The sequence is a functional homolog of SEQ ID NO 2136 in the 10/374,780 US patent application
  misc_feature: The sequence is a functional homolog of SEQ ID NO 36 in the 10/714,887 US patent application
  misc_feature: The sequence is a functional homolog of SEQ ID NO 36 in the 11/435,388 US patent application
  misc_feature: The sequence is a functional homolog of SEQ ID NO 368 in the 10/225,066 US patent application
  misc_feature: The sequence is a functional homolog of SEQ ID NO 6 in the 10/903,236 US patent application
  misc_feature: Useful for making plants with altered lutein content
  misc_feature: Useful for making plants with modulated biomass
  misc_feature: Useful for making plants with modulated flowering time
  misc_feature: The sequence is a functional homolog of SEQ ID NO 1464 in the 10/666,642 US patent application
  misc_feature: The sequence is a functional homolog of SEQ ID NO 170 in the 10/225,066 US patent application
  misc_feature: The sequence is a functional homolog of SEQ ID NO 2 in the 10/903,236 US patent application
  misc_feature: The sequence is a functional homolog of SEQ ID NO 278 in the 10/666,642 US patent application
  misc_feature: The sequence is a functional homolog of SEQ ID NO 332 in the 10/374,780 US patent application
  misc_feature: The sequence is a functional homolog of SEQ ID NO 46 in the 10/225,068 US patent application
  misc_feature: The sequence is a functional homolog of SEQ ID NO 8 in the 10/714,887 US patent application
  misc_feature: The sequence is a functional homolog of SEQ ID NO 8 in the 11/435,388 US patent application
  misc_feature: The sequence is a functional homolog of SEQ ID NO 162 in the 10/714,887 US patent application
  misc_feature: The sequence is a functional homolog of SEQ ID NO 162 in the 11/435,388 US patent application
  misc_feature: The sequence is a functional homolog of SEQ ID NO 30 in the 10/903,236 US patent application
  misc_feature: The sequence is a functional homolog of SEQ ID NO 10 in the 10/903,236 US patent application
  misc_feature: The sequence is a functional homolog of SEQ ID NO 1735 in the 10/374,780 US patent application
  misc_feature: The sequence is a functional homolog of SEQ ID NO 2125 in the 10/666,642 US patent application
  misc_feature: The sequence is a functional homolog of SEQ ID NO 690 in the 10/666,642 US patent application
  misc_feature: The sequence is a functional homolog of SEQ ID NO 70 in the 10/714,887 US patent application
  misc_feature: The sequence is a functional homolog of SEQ ID NO 70 in the 11/435,388 US patent application
MCHAAVADSREQHGRRLLAAAGGGGGDRRQQQQQPQPLEPVVMEANTAASPALSRGRQAREMSAMVAALARVVAGSAPPAKAPPQAVQDASAEEAWWPYDELAAEPSPAFVLDGYSETQPLPEHYWPSAAAATEAATSSQTHYRAASAAAAEEEVPSPSSASAAAGASSSGSAATRKRYRGVRQRPWGKWAAEIRDPHKAARVWLGTFDTAEAAARAYDGAALRFRGSRARLNFPESATLPSPPPPDPASRALPPPPPRPDALLESQAQAPSTGGGMEQYAEYARLLQSAGGDPGGSSGTPSGTLPPPPPPAAYSFAAQGVTPFSYLSPPQSRGEPAGNPAAAWAASHYHGSYPPWRWDHSG

SEQ ID NO: 22485 - DNA, 627 bp, Panicum virgatum
  misc_feature: Ceres CLONE 1821891
  misc_feature: Encodes the peptide sequence at SEQ ID NO. 22486
aggccgcgagggagttgtctcctactgcgagcgagaaaggaattttttttgtgggggttcggaaatccgctcagctctcgactcggcgaggtgtgtctatcctacgaccgaatactcctccgccggcgacgtgcgagctcctcccttacgacgcagcaggggagggcacccacgaagagggagcggagcggagcggagcacagccggcggccatggacgcgatgcgcggcgcgctggagcgggccaagatgctggtgggcatggaggtcgaccaggaggccgggctgccgtcccctgaagagcagtccttcttcgacgacatcgaccgcaactgcacactcaacaccacccaaaggctctacggttacgcgatttgcttggcggccggcctgacatgcaccttcttgtcaatgattgttttcttcaatccggtgaaatttggggtaacattcacccttggcaacttgatggcacttggaagtactgcatttcttataggcccaaaaaggcagtttgatatgatgcttgattcactgagaatatatgccactgctatatatattgcaatgcatcatacttgctctattctgtgctctctatgttcacagcgagctgttgactctactg

SEQ ID NO: 22486 - protein, 138 aa, Panicum virgatum
  misc_feature: Ceres CLONE 1821891
  misc_feature (43)..(135): Pfam Name: SFT2 Pfam Description: SFT2-like protein
MDAMRGALERAKMLVGMEVDQEAGLPSPEEQSFFDDIDRNCTLNTTQRLYGYAICLAAGLTCTFLSMIVFFNPVKFGVTFTLGNLMALGSTAFLIGPKRQFDMMLDSLRIYATAIYIAMHHTCSILCSLCSQRAVDST

SEQ ID NO: 22487 - DNA, 1201 bp, Panicum virgatum
  misc_feature: Ceres CLONE 1821898
  misc_feature: Encodes the peptide sequence at SEQ ID NO. 22488
gtccaagcccattgccttcttcctcaacccacctctctctttcacacacgcctctccctcctcctctctctttctttctctgtgaggcagccatttccgcttcctgtcgtgggggcttgcagcggaaggagggagagaaaagggggctgctgctactgctgctgctgtttcggtgcggcggagatgtctgaggtgtcggtgataaaccaggcggaggtggaggacgccggccagctggacctgccgccgggcttccgcttccaccccaccgacgaggagatcatcacgcactacctcacccacaaggccctcgaccaccgctacacctccggcgtcatcggcgaggtcgacctcaacaagtgcgagccgtggcacctcccaggcagggccaagatgggggagaaggagtggtacttcttctgccacaaggatcgcaagtacccgacggggacccggaccaaccgcgccacggagaccggctactggaaggccaccggcaaggacaaggagatcttcaggggccgcggcatcctcgtcggcatgaagaagaccctcgtcttctaccgcggccgcgccccccgcggggagaagaccggctgggtcatgcacgagttccgcctcgagggcaagctgccccacccgctcccgcgctccgccaaggacgagtgggccgtgtgcaaggtgttcaacaaggagctggcggcgcgggcggagccaatggcggccggcgcggagctcgagcgcatcggctcgttgggcttcatcagcgagctcctcgacaacgccgagctgccgcccctcatggacccttccttcggcggcgaggtggacgagatggtcgacttcaagggcgcgtccacgtccgcccacgccgctgcgccgggcgcgagctacctgccggtcaagatggaggagcacccgccgctgcagtaccacaaccacctgcagcagcaggcgccgccgatgttctactccagccagtacttctcgctgccggcggtgaactccggcgacctgaccccggcgatccggaggtactgcaaggcggagcaggtggcctccgggcagacgacgtcggtgctcagcccgtcccgcgagaccgggctcagcaccgaccccaacgccggcggcggctgcgcgaagatctcgtcggcggcgacgccctcgtcgtcgcaccagttcccgcacgacctcgacgacc

SEQ ID NO: 22488 - protein, 339 aa, Panicum virgatum
  misc_feature: Ceres CLONE 1821898
  misc_feature (20)..(147): Pfam Name: NAM Pfam Description: No apical meristem (NAM) protein
  misc_feature: Useful for making plants with altered lignin content
  misc_feature: The sequence is a functional homolog of SEQ ID NO 476 in the 10/666,642 US patent application
  misc_feature: Useful for making plants with altered carbohydrate content
  misc_feature: Useful for making plants with modulated oxidative stress sensitivity
MSEVSVINQAEVEDAGQLDLPPGFRFHPTDEEIITHYLTHKALDHRYTSGVIGEVDLNKCEPWHLPGRAKMGEKEWYFFCHKDRKYPTGTRTNRATETGYWKATGKDKEIFRGRGILVGMKKTLVFYRGRAPRGEKTGWVMHEFRLEGKLPHPLPRSAKDEWAVCKVFNKELAARAEPMAAGAELERIGSLGFISELLDNAELPPLMDPSFGGEVDEMVDFKGASTSAHAAAPGASYLPVKMEEHPPLQYHNHLQQQAPPMFYSSQYFSLPAVNSGDLTPAIRRYCKAEQVASGQTTSVLSPSRETGLSTDPNAGGGCAKISSAATPSSSHQFPHDLDD

SEQ ID NO: 22489 - DNA, 465 bp, Panicum virgatum
  misc_feature: Ceres CLONE 1821898-R
gatcacatggtttggttgattaattgctttgatttgattgattaccttggtctctcctcgctcggggttggtgacagtccgctgacgcgaagccgatcgtcaccgcccccgccaagtccggccgctcctgacctcgggtctgattagattattatccgtccagaccgccaggggattaggacctccttgttaattaattccccccatcctaggttccttgtcttgatctatgtacatagtaccactcctactgctctgattgtgtcattaggggggtagcagcaatgattattgataggattaatgaatgggtgtagattagggggccctgcacctgcacctgcaagtgcagtgcagggggtgatttacgaattgattagttaatttgggcgcttgatgagccagctagcactagctttatatgtacatgtaccgccattaaaggcggcgggagctcgacaggcc

SEQ ID NO: 22490 - DNA, 1149 bp, Panicum virgatum
  misc_feature: Ceres CLONE 1821899
  misc_feature: Encodes the peptide sequence at SEQ ID NO. 22491
aagaaatttcatttccttcctcctcagctcactggcggcggcggcggcggcggcggcggcggctacccaagccccaacaggaggaggcggaggcgacatctccccgtcgccctccacccaaatccgctcccctccttctatattatttcccctccaatctgctgatccatcgtgtacatatgcagcacatcgggccttgttcatggagatggaggcctcacacagtcaggtggtcagcgggttggtcggcggcagcggcgccggtggaccagtcatgaccgacatcagcacaccagaggcttaatgatggaaacattgagaacgtatgctggccaaggcttcaaatgtgggtattgcgggtgcacaaacagaggtggaggtgcaactcggctaagggaccatctgggatgtattgtgggtgaggtgaagtcatgcaactctgtgcccagagttgtgagggatgcaatgagggcattacggaaggcggcgatggagaataaaagggaaaaagaacaacgtaaactcaggttggagagagatcttctgcaaggggtgcacggtgatgatggtgtgattgatcttgcaagtgatgaagaagatcaagcccgcatggaaatcaggaacaaattgagagagaagaacttttcttgtgcagtagagagaaggggtggtaatgccaatcttgttcgtgtttctgttggcaaaaggagtgtcactgcatattttgacaaggatttagcacgcagcaaagcatctgtgcagccaaggattgacactacacttttagatggatctagagagaagcttggacaagcttgggcgaagtggttccatgcaaatgatattcctgggtatcactaaaggagacaaaatccatcgccgccacctgaaggatgaaccgcggcagatttttcgcggagcgtgttggtttgaaacaatctcggatcgtttgaccattgctggactgtttcatgcggggccttcgtccgtgatccacgagaggaatcggtggactgtttcgtgtacagaccaatttatcaccagagctcttcaccacttcactgcatgtatatgcatgcacaagtagtcaaaaatgatgatgtcatccacatgcatgcaaatttaaaatttaaaaaaactataattatt

SEQ ID NO: 22491 - protein, 185 aa, Panicum virgatum
  misc_feature: Ceres CLONE 1821899
  misc_feature (7)..(52): Pfam Name: zf-C2HC_plant Pfam Description: Protein of unknown function, DUF1544
MMETLRTYAGQGFKCGYCGCTNRGGGATRLRDHLGCIVGEVKSCNSVPRVVRDAMRALRKAAMENKREKEQRKLRLERDLLQGVHGDDGVIDLASDEEDQARMEIRNKLREKNFSCAVERRGGNANLVRVSVGKRSVTAYFDKDLARSKASVQPRIDTTLLDGSREKLGQAWAKWFHANDIPGYH

SEQ ID NO: 22492 - DNA, 676 bp, Panicum virgatum
  misc_feature: Ceres CLONE 1821903
  misc_feature: Encodes the peptide sequence at SEQ ID NO. 22493
acacagtttcaattgctcgctcgcacgcgcaaacgccgcctcttcctcctcccgtcctccccccactcgccgcacccgtttccccagatcccaaggaacgaacccaccccgctcgccgcgggcattttctcgaacatctagcgcgcgcgtgcgcacatgggctccctcccggttaacgcctctccggaatgcgccgcgctgaggcgcgccacggtgtcggcgtcggacctggcgccgctcttctccgcgcagcgccggcacctggaccacttcttcgaccgcctcgacatgtcgcaggcggcggcgttcgcgcaggcgctgctcgacgcgcccggggccgtcttcttcacgggcgtcggcaagtccggcatcgtggcgcggaagatcgcgcagacgctggcgtcgctcggcttcgcgcgggcaggcttcctggcccccgtcgacgcgctccacggcgacatcggcgcgctcttcccgggggacgtgctcgtgctgctctccaagtccggcgcctccgacgagctgctcgcgctcgcgccctgcgcgcgcgccaagggcgcctacctcatctcgctcacctcggcggcgtcgggggccgactgcccgctcgccgccgcctgcgacctcaatgtgcacctgccgctgcagggggaggtctgccccttcggcctcgcgc

SEQ ID NO: 22493 - protein, 173 aa, Panicum virgatum
  misc_feature: Ceres CLONE 1821903
  misc_feature (54)..(173): Pfam Name: SIS Pfam Description: SIS domain
  misc_feature: SWISSPROT Homolog: EC 5.3.1.13 Arabinose-5-phosphate isomerase
MGSLPVNASPECAALRRATVSASDLAPLFSAQRRHLDHFFDRLDMSQAAAFAQALLDAPGAVFFTGVGKSGIVARKIAQTLASLGFARAGFLAPVDALHGDIGALFPGDVLVLLSKSGASDELLALAPCARAKGAYLISLTSAASGADCPLAAACDLNVHLPLQGEVCPFGLA

SEQ ID NO: 22494 - DNA, 700 bp, Panicum virgatum
  misc_feature: Ceres CLONE 1821906
  misc_feature: Encodes the peptide sequence at SEQ ID NO. 22495
tagattctcagtttggtccttatgtggggaaccatgaatctccatctctgtttcataaagattttatgggacggccattggatgggatctctgccccttggacagtgaagggcatgcgtgatatcggtgatccaatgtcaatacctgatatccccggagcagggcatagagaacttggtggattttctggtcctggtcagtcatccctgatgccaaacgtgactgcagaggtcttagttccaagattagttattcccgctctctgtggtgaagatggaggttgtttggataggattcgtgagttttcggaagctaagataacagtcgctgaacctatagctgattcaatggactctgctgttttaatatctggcacaccagaccagatgcatgctgcccggagtcttgttgaagcatttgttataagtgaatcatttggcccatgatatcgcgatcctggaaaggcattgaagctagtgacaaaaatgtgggttcgtgtttgtgaatatgcatccctgtttgcctgagtggcatatggtccaagaggttaattaggctgaatagatagagactaaagtcccaatctgttggttctttctaggttgttgaagaatgttccaaactcgccccttagagatatggggcacattccgggtagcacccgatatgtattgcttattgtaagcagtatgcgtgaacc

SEQ ID NO: 22495 - protein, 147 aa, Panicum virgatum
  misc_feature: Ceres CLONE 1821906
  misc_feature (74)..(136): Pfam Name: KH_1 Pfam Description: KH domain
DSQFGPYVGNHESPSLFHKDFMGRPLDGISAPWTVKGMRDIGDPMSIPDIPGAGHRELGGFSGPGQSSLMPNVTAEVLVPRLVIPALCGEDGGCLDRIREFSEAKITVAEPIADSMDSAVLISGTPDQMHAARSLVEAFVISESFGP

SEQ ID NO: 22496 - DNA, 690 bp, Panicum virgatum
  misc_feature: Ceres CLONE 1821931
  misc_feature: Encodes the peptide sequence at SEQ ID NO. 22497
acagcccgagctggctggcactggcggtgggcaacaacagcacgaagccaccggagacggacagccggcggcggcggctccgaggttcgaggcggagcggaacaggaacttgtacagcaccgaaggcgcctcggggatctccgtcgggcagcgcttcttcctaaccatgcggtgctgcagcttcgtcggcctgcggacctgcgccgagctggagccggaggccctctctcgcctccctacgctcttcggcaagccggtcgtccccttgggcctcctgccgccgtcgcccgacggagcccgcgccgccggtaacggcggcgggagcgatgccatcatcccgtggctggacgcgcagccggcggagacggtcgtgtacgtcgcgttggggagcgaagtgccactgagcatcgagctggtgcacgagctggctctggggctggagctcgccgggttcccctttctctgggctctgaggaagcccgtcggcgtcagcgacgcggacatcctccctccgggcttcgaggagcgcacgcgcggccgtgggctcgtcgccatggggtgggttccgcagatcagcatcctggcgcacggtgccgtcggcgcgttcctgacgcactgcgggtggaactccaccatcgaagggcttctgttcggacgccctctgatcatgcctcccgattcatggcgacc

SEQ ID NO: 22497 - protein, 229 aa, Panicum virgatum
  misc_feature: Ceres CLONE 1821931
  misc_feature: SWISSPROT Homolog: EC 2.4.1.236 Flavanone 7-O-glucoside 2''-O-beta-L-rhamnosyltransferase
  misc_feature: Useful for making plants with altered carbohydrate content
QPELAGTGGGQQQHEATGDGQPAAAAPRFEAERNRNLYSTEGASGISVGQRFFLTMRCCSFVGLRTCAELEPEALSRLPTLFGKPVVPLGLLPPSPDGARAAGNGGGSDAIIPWLDAQPAETVVYVALGSEVPLSIELVHELALGLELAGFPFLWALRKPVGVSDADILPPGFEERTRGRGLVAMGWVPQISILAHGAVGAFLTHCGWNSTIEGLLFGRPLIMPPDSWR

SEQ ID NO: 22498 - DNA, 1493 bp, Panicum virgatum
  misc_feature: Ceres CLONE 1821938
  misc_feature: Encodes the peptide sequence at SEQ ID NO. 22499
aagcactcctcgagagtccccggcgaagaggccagagggcgagatcgatggatacgggaggccgctgctgcagcggcggcggcgccgctgccggacttgaagaggaagcggcgcagagggagcgggaatgggaggaggccgcgcaggcggtggcgtacgattcctgcacctggccgccgcccatcgtcgcggtgtgcggcccgggtaaaagcggcaagtccgccttctcccgcctcctgctcaacaccctcatcgtaaggtacagaaatgctggatacctggatattgatgttggtcagcctgaattcactccagggtttgtgtcacttcatgtacttgaggaacagactaaagatttgacaattctgtatctgcgcaatccaaagaggtgcttctttttgggctatgtctgtgcaaaaagaaacccgaaacttctcttgacctacatatttgacctttatgactatttcctgaaagagttttatcgctttcatgaggttgataatcccatgaaatcagctataccacttgttatcaatacttcaggatggataaaaggtcctgggcttcatgtgctaccggagatgttgaaatatgtgtctccaactcatgttattcgggtatctaccacagtagagcgtaaaaatttaccatgtggaacgttttggatgaatgaatttgatgaatctccaccagttaatttatttgaaattcatgcagcgcataattctcctcgccatttgttggtaaagaaagaggcaaggattattcgtgaactcaggctgatcgcttacttcaggcagtgcttaccaagagacttcaatgtcttctgtttgaatgatttaattcaaggctttgcctctatacatctgtttcaacttcgtctgtctaaaatacatgttattgatctacactgccaggtttctagtactgatgcgcatcgcttcttgaatggtacaattgttggtctttcaaccagtgcatctcctcctttatcaattgaaagttccactccttgctgcattggactggggtttattaaagatgtagaaatttcagaagactgcattcatttgatcacaccagtttctcacaagctcgtggaaaaggtcgacatcatttttcaaagctgtgttgcagttcctagttgcctcttgcaggtgtctggtattttaagcgacgtaacagagaggctgctgaagatctagatctttggatatgcttacaaatataatcattagttgtggcaacgaacaatcaaaatagagatgccagaaactagtacacctggctttacctatatggagtatgagttgcatcatgtattagctggattcacctgaagagtaaagagatttgatgttacaatcatacagcacaaaatggtatttaaaagtatccgcttttgctggttaattatgttgaaccctttgttgtactggtattctgtcatcaaatgtaacatgttgaacatcttggatgggatttccttc

SEQ ID NO: 22499 - protein, 386 aa, Panicum virgatum
  misc_feature: Ceres CLONE 1821938
  misc_feature (238)..(370): Pfam Name: NUC156 Pfam Description: NUC156 domain
MDTGGRCCSGGGAAAGLEEEAAQREREWEEAAQAVAYDSCTWPPPIVAVCGPGKSGKSAFSRLLLNTLIVRYRNAGYLDIDVGQPEFTPGFVSLHVLEEQTKDLTILYLRNPKRCFFLGYVCAKRNPKLLLTYIFDLYDYFLKEFYRFHEVDNPMKSAIPLVINTSGWIKGPGLHVLPEMLKYVSPTHVIRVSTTVERKNLPCGTFWMNEFDESPPVNLFEIHAAHNSPRHLLVKKEARIIRELRLIAYFRQCLPRDFNVFCLNDLIQGFASIHLFQLRLSKIHVIDLHCQVSSTDAHRFLNGTIVGLSTSASPPLSIESSTPCCIGLGFIKDVEISEDCIHLITPVSHKLVEKVDIIFQSCVAVPSCLLQVSGILSDVTERLLKI

SEQ ID NO: 22500 - DNA, 571 bp, Panicum virgatum
  misc_feature: Ceres CLONE 1821939
  misc_feature: Encodes the peptide sequence at SEQ ID NO. 22501
aagctagatcgctagccagctcccgaccactaccatgtccgagtcagctgttgccacagccgcccagggcattactcgcttcatcctgctgcacggcacctctcacgggaggtggcgctcgtaccgcgtggcctcatctgctcctacgcggcgggccagcgcgtgcccgcgccggacctcgcggcctccggcgccgacgcgtcgtcgcctcgcgaacgcgactaccttcaaggactactcgcgcccgctgatggactcgctccgcgggctccccggcagccagtggggcttcctgtgctgcctcagcttcagcaggatcagcgtcgcactctcctcccacacgtttgcgtagaacgccacctccaccctgttcaccacccgcatactgccagactgctccccctcgccctctcacgtcatcgataatcttgccctggcgtactggatggacagcatcacgaacgcagagcacatcccgacgtcgatgttcctgtggtccaagttctggaggagctatctctactcgataaggccccctgatgactagtgattgactgctactctgaccaga

SEQ ID NO: 22501 - protein, 105 aa, Panicum virgatum
  misc_feature: Ceres CLONE 1821939
  misc_feature: SWISSPROT Homolog: EC 3.1.1.78 Polyneuridine-aldehyde esterase
MSESAVATAAQGITRFILLHGTSHGRWRSYRVASSAPTRRASACPRRTSRPPAPTRRRLANATTFKDYSRPLMDSLRGLPGSQWGFLCCLSFSRISVALSSHTFA

SEQ ID NO: 22502 - DNA, 1645 bp, Panicum virgatum
  misc_feature: Ceres CLONE 1821949
  misc_feature: Encodes the peptide sequence at SEQ ID NO. 22503
gtgatgctccgacggggtaggtggcgactccgcgccgtgtataaaccgctccccgcttaccttcctccctcctccgttcctcctcaccaaccaaaccctctccaatggccgcgcccgtgtcgcacacgctcccggaatccgcgcccgcctccctccgcttctccgtcggccgccgccgccgcgccgctcgcctagaggtaaaggcatcaggaaatgtctttgggaaccacttccaggttgcaacctatggcgagtctcatggagggggtgttggttgtgttatcagtggctgcccaccaagaattcctctcactgaggcggacatgcaagtagagctcgacagaagacgtccaggtcagagtagaataaccactccgagaaaggagactgatacatgcaaaattctatcagggacacatgaagggatgaccactggcacaccaattcatgtctttgtcccaaacacagatcaaagaggcggagattacagtgaaatggctaaggcatacagaccttcccatgcagatgcaacctatgacttcaagtatggtgttagagctgtgcagggaggtggaagatcatcagccagagaaaccattggcagggtggctgctggagctcttgcaaagaaaattctgaagctcaaatctggagtagagattttggcatttgtttccaaagtgtatcaagttgtacttccagaagatgcagttgattatgaaactgtaaccatggaacagatagagagcaacattgttagatgtcctgacccagaatatgcagagaaaatgattgctgccattgataaagtacgagttagaggggattcaattggtggggttgtcacatacattgcaagaaatgttccacgtggtattggctctcctgtttttgacaaacttgaagctgagctggcaaaagctatgctttctcttcctgcaagcaaggggtttgagattggcagtgggtttgctggtactgaccttactggaagcgagcataatgatgagttctatatggatgaggctggaaatgtgagaacacagactaatcgctcaggcggtgtacagggagggatatcaaatggtgaaattatttacttcaaagtggcttttaagccaacagcaaccattgggaagaaacaaaatactgtgtcaagggagcatcaggatgttgaacttttggcaagggggcgccatgatccatgtgttgtccctcgagctgttcctatggtggaatccatggctgcattggtcctgatggaccagctcatggcacacattgcacagtgcgagatgtttcctctgaaccttgctctacaagaacccattggatcggccagcagtgcttctgaattggcgccaaacctatcataatgtatattgttggaacaaaacccccctgcttgggtttctgcccaccagttttctttctttgtcagccataattctgggctttgctaagcagtttgcagttttgaaccacaccctcgattattgtacccttgagatcataaagtgagtatcatgatagaaacacattaatgttttgtgttgtgtagcaggacgcgtaccccattcttttttggtgagaggatgtatgaatacagtcgtttggtcaataaagagttgtagtatcttttttc

SEQ ID NO: 22503 - protein, 423 aa, Panicum virgatum
  misc_feature: Ceres CLONE 1821949
  misc_feature (43)..(393): Pfam Name: Chorismate_synt Pfam Description: Chorismate synthase
  misc_feature: SWISSPROT Homolog: EC 4.2.3.5 Chorismate synthase
MAAPVSHTLPESAPASLRFSVGRRRRAARLEVKASGNVFGNHFQVATYGESHGGGVGCVISGCPPRIPLTEADMQVELDRRRPGQSRITTPRKETDTCKILSGTHEGMTTGTPIHVFVPNTDQRGGDYSEMAKAYRPSHADATYDFKYGVRAVQGGGRSSARETIGRVAAGALAKKILKLKSGVEILAFVSKVYQVVLPEDAVDYETVTMEQIESNIVRCPDPEYAEKMIAAIDKVRVRGDSIGGVVTYIARNVPRGIGSPVFDKLEAELAKAMLSLPASKGFEIGSGFAGTDLTGSEHNDEFYMDEAGNVRTQTNRSGGVQGGISNGEIIYFKVAFKPTATIGKKQNTVSREHQDVELLARGRHDPCVVPRAVPMVESMAALVLMDQLMAHIAQCEMFPLNLALQEPIGSASSASELAPNLS

SEQ ID NO: 22504 - DNA, 675 bp, Panicum virgatum
  misc_feature: Ceres CLONE 1821954
  misc_feature: Encodes the peptide sequence at SEQ ID NO. 22505
ggacgcgctgcttggtcgaccgaccccctttccccaaccgacatggccgccgccgcctcctcctcctccgagggattcgtcggcgcgccagccgccctccccctcgacaaggcggcggcttcgggctccgggagcggtggcggcgaccgggtggtggattgcggggtgtgcgcgatttgcctcgataagatcgcgctccaggagaccgcccttgtcaagggatgcgaccacgcctactgcgtaacatgcattttgaggtgggcatcctacaagcagacccctcattgccctcaatgcccacagtgcaagcacacatttgaattcctcagcgtgcaccgttctcttgatggctgcctgcatgactacctgtttgaggagagcgtttgccttctcctgagggccgcttggtttgaacctcttatcgtagaggctcatgaagaggctctggaagaagacgagatttacctccagtaccaatatgatgatgatgaagatgatcttgacgaggaaacttattacatgagcaggtccccaagcattcgtattggtaacaggaggtggggtgacaatgggtacatcagaggaggcaggagagaggccaggccagtaaatgctgatgctgctggtccatccaggaccccaaagaagatagagagggctgcatcgacgtctggt

SEQ ID NO: 22505 - protein, 210 aa, Panicum virgatum
  misc_feature: Ceres CLONE 1821954
  misc_feature (43)..(85): Pfam Name: zf-C3HC4 Pfam Description: Zinc finger, C3HC4 type (RING finger)
MAAAASSSSEGFVGAPAALPLDKAAASGSGSGGGDRVVDCGVCAICLDKIALQETALVKGCDHAYCVTCILRWASYKQTPHCPQCPQCKHTFEFLSVHRSLDGCLHDYLFEESVCLLLRAAWFEPLIVEAHEEALEEDEIYLQYQYDDDEDDLDEETYYMSRSPSIRIGNRRWGDNGYIRGGRREARPVNADAAGPSRTPKKIERAASTS

SEQ ID NO: 22506 - DNA, 672 bp, Panicum virgatum
  misc_feature: Ceres CLONE 1821955
  misc_feature: Encodes the peptide sequence at SEQ ID NO. 22507
acgctcacacacaaacgcaagaagctcaaagaagccgaggcaagctcaagaggggaaaaaaagaagcctagaaggaggctcaaagggatgatgggaagcgaaggcagcacgagcccagcggcggggtgcgctgtctgcggcggcgccgcggcggtgtactgcgcggcggatgctgcggcgctctgcagcccctgcgacgccgctgtgcacgcggccaacctgctggcgtcgcgccacgagcgcgtgcctgtcgccatggccgccgcggcggcggcatccggcgtgtacgacaacctcttcgcgcccgacgacgtcgacgccgcgtcgtcgtggccggcggcggcgcccgcgcaggggcaggggagcccccaccagaacggcagctcgtccaccagcgacagcggcgcggagggcaggagcctgttcgacctgctctccgacgtcgacctcgctgcggcggcctgcgccacgggcggcgggtacctgccggacggcgtggcgcccgtccatcacggcggcgcggcaccgctgtgggcgcagcctggcatggccgagtgggcggtcgcgtggtccccagcggatgccgcggccgtcgtcgtcccgggcgccgccgccgtggtcgccgcggcggcggagcgggtggcgagggtgcagaggtaccgcgagaagcgc

SEQ ID NO: 22507 - protein, 193 aa, Panicum virgatum
  misc_feature: Ceres CLONE 1821955
  misc_feature (8)..(54): Pfam Name: zf-B_box Pfam Description: B-box zinc finger
MGSEGSTSPAAGCAVCGGAAAVYCAADAAALCSPCDAAVHAANLLASRHERVPVAMAAAAAASGVYDNLFAPDDVDAASSWPAAAPAQGQGSPHQNGSSSTSDSGAEGRSLFDLLSDVDLAAAACATGGGYLPDGVAPVHHGGAAPLWAQPGMAEWAVAWSPADAAAVVVPGAAAVVAAAAERVARVQRYREK

SEQ ID NO: 22508 - DNA, 1823 bp, Panicum virgatum
  misc_feature: Ceres CLONE 1821971
  misc_feature: Encodes the peptide sequence at SEQ ID NO. 22509
atcagggtcatctgtgtttcttccctccccctttcccttctctctcagtctcctcccttggtcttcctcacctgtcggcgacgactgggcgagcggcggtgccattcgcctcgtcttcgcccggccctttgccggcgacgagcatccatccgccagagctggcgagggagcaggggacggcgtttctcgcgtgagtatgggcaatctgcagcagctgcagctctgctactagggtttgatccttgggcatggctgagggggcgaggtttcctggtatgattggcggcggcggaggcaaggggatgcaggacaatgagatcaatggcttctacaacatgccttattaccagaagtttggggagggctcccacatgtcggtggacagcgccgacggcttcaacctggccaactgcgccggcggttctgtcgccatgtctgtggacaacagcagtgtgggctcgaatgagtcccgcacggtcatactgaagcacccaggcctccgtgatgctccgacggcaagctactcagttggcaatagtgtcttccgccccaaccgtgtggctgcgcacacgctgaatgaggatgcattggcttgtgtcttgatggacccgaatcatcctacagagatactaaataactatgagcagtggaccattgatctggggaggttggacatgggggatccttttgctcaaggagcctttgggaagctgtaccggggaacatacaatggagaagatgttgccattaagctactggagaagcctgagaatgacccggaaagagcccatttgatggagcagcaatttgtgcaagaagttatgatgttgtcaaggctgagtcacccaaatattgtgaggttcataggggcatgtaggaaatcgattgtgtggtgcattattacagaatatgccaagggcggctcagtccggcagttcctggcgagaaggcagaacaagtcagtgcctttgaggttggctgtgaaacaggcgctggatgtagcccggggaatggcttatgttcatgcattgggatttattcacagagacctaaagtcagataaccttctgattgcagcagacaaatccatcaagattgctgactttggagttgctcgtattgaggtgaaaactgaagggatgacgccggagacaggaacctaccgctggatggcaccggaaatgatccagcacaggccctatgatcataaagttgatgtctatagctttgggattgtcttgtgggaacttataactggcatgcttcccttcacaaacatgacagctgttcaggcagctttcgctgttgtaaataagggtgctcgtccagtaatccctcaagactgcctgccttctctaacgcacattatgactcgctgctgggatgcgaaccctgaagttcgcccaccatttactgagatcgtctgcatgcttgagagtgctgagatggagattgtgagtaatgtgcgtaaagcacgcttccgctgctgtatgtctcagcccatgaccaccgactgaagtggaaaatggtggctagatgaggagaattgatggaagaaaggaggaagagcctatctcaatgtgttcaccgcatcggtgctagggatctgcgttgaagcccccaggatttgagcttctgtgttgttgcattctatcttgtgtatgctccacagctgaagttatctcttctgaaagtataggtgatgttgccttgtatgttaacaaagatctaatggagctttcctatgttaataaacatctgcttgttcttgtactcgcacaagtttgcctgatttcaagttttagcgcccttctttggtgttg

SEQ ID NO: 22509 - protein, 422 aa, Panicum virgatum
  misc_feature: Ceres CLONE 1821971
  misc_feature (141)..(395): Pfam Name: Pkinase_Tyr Pfam Description: Protein tyrosine kinase
  misc_feature: SWISSPROT Homolog: EC 2.7.11.1 Non-specific serine/threonine protein kinase
MAEGARFPGMIGGGGGKGMQDNEINGFYNMPYYQKFGEGSHMSVDSADGFNLANCAGGSVAMSVDNSSVGSNESRTVILKHPGLRDAPTASYSVGNSVFRPNRVAAHTLNEDALACVLMDPNHPTEILNNYEQWTIDLGRLDMGDPFAQGAFGKLYRGTYNGEDVAIKLLEKPENDPERAHLMEQQFVQEVMMLSRLSHPNIVRFIGACRKSIVWCIITEYAKGGSVRQFLARRQNKSVPLRLAVKQALDVARGMAYVHALGFIHRDLKSDNLLIAADKSIKIADFGVARIEVKTEGMTPETGTYRWMAPEMIQHRPYDHKVDVYSFGIVLWELITGMLPFTNMTAVQAAFAVVNKGARPVIPQDCLPSLTHIMTRCWDANPEVRPPFTEIVCMLESAEMEIVSNVRKARFRCCMSQPMTTD

SEQ ID NO: 22510 - DNA, 676 bp, Panicum virgatum
  misc_feature: Ceres CLONE 1821975
  misc_feature: Encodes the peptide sequence at SEQ ID NO. 22511
gcatcgatcccatcacctcctgccggatccaccacttcgcccgccgcaggccgcaccttccctaaccttccttgcacgacccggcggccaaaccaccataaccctctgcatcgccggccggccgttgttgccataccaagctaggactaggaggagaggaaaccaacggaagagtcgcccgccctcctccttccttcctcctcaagtccaatccatataaaccacccaccacaatccctcgccaaatcaaatccgccgcatctcaaatcaggtgcgaatcgaatcgaccaagaacagcagcagcagcagcaggcatggggtccgccagccgcgccgtctcgtgcctctgctgcccctgcaggtgcctcgcctgcgggctcctgagctgcctctgcagcatcctcatctccctcctcgtcaccctcggcgtcctcgccctcgtcctctacctcatcttccgcccccacatgatcgccgccaccgtcgactccgcctccctcgccaccttcaccctctccccgacctcctcgctcgcctacaacctcaccgtcgccgtcaccgtgcgcaaccccaacaagcgcgtcggcctctactacgacaacgtcgaggccctcgccttctacaaggcccagcgcttcggctacgaccccatcgacgccttctaccagggcaccca

SEQ ID NO: 22511 - protein, 120 aa, Panicum virgatum
  misc_feature: Ceres CLONE 1821975
  misc_feature (45)..(120): Pfam Name: Hin1 Pfam Description: Harpin-induced protein 1 (Hin1)
MGSASRAVSCLCCPCRCLACGLLSCLCSILISLLVTLGVLALVLYLIFRPHMIAATVDSASLATFTLSPTSSLAYNLTVAVTVRNPNKRVGLYYDNVEALAFYKAQRFGYDPIDAFYQGT

SEQ ID NO: 22512 - DNA, 721 bp, Panicum virgatum
  misc_feature: Ceres CLONE 1821982
  misc_feature: Encodes the peptide sequence at SEQ ID NO. 22513
ttcatcaatggttgttgggacagcccattatggccacgcgcccacgcttgagcagactgcaccagggcgacgccgagacgcacatcctcttatcctctccgactctgtggtgctcgagctcgcggcgcacgatcatggtgggcgccatctccagtccggcgagcactagggtcgccgtggtcaccggcggcaacaaggggatcgggctggaggtgtgccggcagctcgccgtcgccggcgtcaccgtcgtcttgacggccagggacgaggcgaggggcgcggcggccgccgagaggctcagggagcaggggctccccgacgtccttctccatcaactggacatcaccgatgctccgagcatcgctcgactggctgatttcttgaagacccgtttcgggaagctggacatcctggtaaataatgcagcacttggtgcggttgagtatgttcatgactcggactatggatcagtaacgagcaaggaaaaggaaaagctcagtggcatggatattgatcagaggttgggatggttgtggcagaacagccgggagacttacgacactgcaaggaaaggtctgcagacaaactactacggcacaaagcaagtgatcgaagcctgtctgcctctgctcaaagcctcctccgatgggaggatcgttaatgtctcctcccacttcggtcagctaagggagaggctggatgagcggctgggcatggtcct

SEQ ID NO: 22513 - protein, 195 aa, Panicum virgatum
  misc_feature: Ceres CLONE 1821982
  misc_feature (12)..(192): Pfam Name: adh_short Pfam Description: short chain dehydrogenase
  misc_feature: SWISSPROT Homolog: EC 1.1.1.184 Carbonyl reductase (NADPH)
MVGAISSPASTRVAVVTGGNKGIGLEVCRQLAVAGVTVVLTARDEARGAAAAERLREQGLPDVLLHQLDITDAPSIARLADFLKTRFGKLDILVNNAALGAVEYVHDSDYGSVTSKEKEKLSGMDIDQRLGWLWQNSRETYDTARKGLQTNYYGTKQVIEACLPLLKASSDGRIVNVSSHFGQLRERLDERLGMV

SEQ ID NO: 22514 - DNA, 1692 bp, Panicum virgatum
  misc_feature: Ceres CLONE 1821984
  misc_feature: Encodes the peptide sequence at SEQ ID NO. 22515
gacccagcagctgccggacagcaacagccaccagcaatcggcttccatgtcctgctccgttgaacagcgtcgagtcatcgcccccatagctgcatctgcatatcaacgcacttgcagttgcaggctgcaggccacgagatgaagcggccaccagccggcaccggatgagagcttcccctcatggcagcatcgaggaggcagtcgaccaccagcagcagaaggagcggcgagctcccagggggcgccggcgctcacggccaccggtcttcgttcgatcgtgggcgggcgccgttctcccctaacgtccacggccggcagctctcttcctacagcgcccggtcctcccaggtgagcagcagcggctcgttcaaggcggcggcgcagcgggtcgccggcgcgttcaccagctgcttcgtgccgcgggtcccagtcaagaccgaggaagaggaggtgaagagcagaggcaccacagagtgccatgtctccatagattcagcaggatcagggcaagaatgtagggcgctcacaattgctgatttatcgaaggcgacctcaaatttcagcgaaaagaacataataaagcaaggaggttcgagcaccatgtacagaggaaaactcaaggatgggtctcagattgccgtcaagtgtgtcagaaagttgaacggtcagtatctaacagctgaactctggagggagcttgagactcttcagaatattgagcatcagaatctggcgaggttcctaggattcttcgagcgcaacaatgacagtcttattgtcctcgagtacgttagcaatggctccttgagggaacacttggatgaatcctgcggaaatggtttagaactcgtgcaacggctcagcatcgccatcgacgtcgctcatgccatcacctacctgcacgagtacaaagagcatccgatcatccatggaggcatccggtcgtcggtcgtgctgctgaccgacgcgctggcggcgaaggtgaccggctttgggctgctggggatggcggcctcggcctcgggctcaggcacaggctcaggctcggacgcgacgccggcgaagggcgccgccgggtacgtggacccggagtacctgagcacgtaccagctgaccgacaagagcgacgtctactccttcggcgtcctcgtcgtcgagctcgtcaccggccggccgcccgtcgagcgcagccgcggcggcgaggcccggctcaccaccaaatgggcgctgcagaagtgccgaggaggggaagccgtggtggccatggaccccaggatgcggcggagcccggcgtcggtaacggccgtggagaggatgctggcgctggcagcgcagtgcgtcgcgacggcgaggaaggaccggccgtcgatgcggcggtgcaccgaggtgctgtgggccattcggagggaataccaccgccgggaagagccgcgctgcgccggcgccgccgtggcagatgaccggagcgacgagtgggtgctcaggagtcaggtagctcgtaagccaaacagaggctgtagcctgtagatgatggttgcttgggtgattggttcggaactgtaactagcctggaagttgtgatttctgaactgctgccaaatgggaggttgctcgtatcaaaattagagattcatgtcatgcacttgccgtatgtatgtgtctgtatcacgcaatgggaatccccattttgtc

SEQ ID NO: 22515 - protein, 448 aa, Panicum virgatum
  misc_feature: Ceres CLONE 1821984
  misc_feature (127)..(404): Pfam Name: Pkinase_Tyr Pfam Description: Protein tyrosine kinase
  misc_feature: SWISSPROT Homolog: EC 2.7.11.1 Non-specific serine/threonine protein kinase
MAASRRQSTTSSRRSGELPGGAGAHGHRSSFDRGRAPFSPNVHGRQLSSYSARSSQVSSSGSFKAAAQRVAGAFTSCFVPRVPVKTEEEEVKSRGTTECHVSIDSAGSGQECRALTIADLSKATSNFSEKNIIKQGGSSTMYRGKLKDGSQIAVKCVRKLNGQYLTAELWRELETLQNIEHQNLARFLGFFERNNDSLIVLEYVSNGSLREHLDESCGNGLELVQRLSIAIDVAHAITYLHEYKEHPIIHGGIRSSVVLLTDALAAKVTGFGLLGMAASASGSGTGSGSDATPAKGAAGYVDPEYLSTYQLTDKSDVYSFGVLVVELVTGRPPVERSRGGEARLTTKWALQKCRGGEAVVAMDPRMRRSPASVTAVERMLALAAQCVATARKDRPSMRRCTEVLWAIRREYHRREEPRCAGAAVADDRSDEWVLRSQVARKPNRGCSL

SEQ ID NO: 22516 - DNA, 1162 bp, Panicum virgatum
  misc_feature: Ceres CLONE 1821993
  misc_feature: Encodes the peptide sequence at SEQ ID NO. 22517
aaccaacccagtaaaccctagctgacggacatattcgccacgcagcgatgccgccgaaggacacgaaggttccccttctcgccgcgcagccggccggcgtgtaccaagacgacgagcctttggagccccagaccgcccagccggcgtcgaccaacggcggcggcggcggcatggtcctcacgacgcagtgcgagttcccggcgctcggccgcggcgcgtcccgggacgccttcgcggtgctcgggcacgcccgggccccggcggacgtggcgcgcgcgccgatcgacctcgtcgccgtgctcgacgtcagcaccagcatgcgcggccacaagctggcgctgctcaagcaggccgtgggtttcgtcgtcgaccagctcggccccgaggaccgcctctccgttgtcgccttctcggcccgcgcgtcgcgcgtcacccgcctcgcgcgcatgtcggccgcggggaaggccgcggcgaagcgggccgtggggtccctcgccgccgaccggaagggcaccagcatcggcgagggcctccgcgtggccgcgcaggtgctcgccggacgccgccacttgaacgccgtcgccagcgtcatcctcctctccgacggcaaggaccggtccgtcgcgccggacaccaaaccggccggagtcggccgcaagagcaggagctacgcggacctcgtgccgccttcgttcgccgcgcgcgccggcggcggcggcagccggcccgcgccgatccacacgttcgggttcggcgccagccacgacgcggcggcgatgcacgctgtcgcggaggccacgggcggcacattctccttcgtggagaaccactcggcgatccaggactcgttcgcgcgctgcgtcggcgggctcctctcggtcgccgtgcaggaggcgcgcgtcgccgtcacctgcctgcaccgtggcgtgcgggtccagcaggtcaagtccggctgctacgcgagccacgtggccgctgacggccgcgccgcctccatcgacggcggatttgctaccccgcggcatagatacccatcctatcgaagcaccgtcggatggaacgtcaagattcgtgaaccataactgtcttctgcggggacaccttgatattgtgtaattaaacagtataaatacgctgacctacgcattcattatgtacggcc

SEQ ID NO: 22517 - protein, 344 aa, Panicum virgatum
  misc_feature: Ceres CLONE 1821993
  misc_feature (80)..(268): Pfam Name: VWA Pfam Description: von Willebrand factor type A domain
MPPKDTKVPLLAAQPAGVYQDDEPLEPQTAQPASTNGGGGGMVLTTQCEFPALGRGASRDAFAVLGHARAPADVARAPIDLVAVLDVSTSMRGHKLALLKQAVGFVVDQLGPEDRLSVVAFSARASRVTRLARMSAAGKAAAKRAVGSLAADRKGTSIGEGLRVAAQVLAGRRHLNAVASVILLSDGKDRSVAPDTKPAGVGRKSRSYADLVPPSFAARAGGGGSRPAPIHTFGFGASHDAAAMHAVAEATGGTFSFVENHSAIQDSFARCVGGLLSVAVQEARVAVTCLHRGVRVQQVKSGCYASHVAADGRAASIDGGFATPRHRYPSYRSTVGWNVKIREP

SEQ ID NO: 22518 - DNA, 1242 bp, Panicum virgatum
  misc_feature: Ceres CLONE 1821996
  misc_feature: Encodes the peptide sequence at SEQ ID NO. 22519
cttctcttgtgtacagatacagacgacgactagtgctgctgcagttgcgttgcgtcagagaaagagatcgaagaagaagccatagcaatggcggccgccgcagcagctgcagcgattcccgctgccgccatcagccgccccaagcaccaccgcgtctcgctgtcgctggctcccagtcccaggctgccttgcccttccctccgctcgggcttcctggggcgtgcgctggccaccgacgtgcagccggcggccgttgttgcgtccccgcgccgcggcgtgtcggtgcggatggcgtgggacgggccgctctcctcggtgcgcctcatcgtgcagggcaggaacgtcaaggtgtcggagaaggtgaaggagcacatcgaggacaaggtcgggcgggcggtgtcgaagcactgccacctggtccgcgaggtggacgtccggctgtcggcccgcggcggcgacctgggcaggggccccaagacctcccgctgcgagatcacgctcttcagcaagcgccacggcgtcctccgcgccgaggaggacgccgactccacctacgccagcatcgacatggccgcctccatcatcaagcgcaagctccgcaagatcaaggagaaggagacggaggtgcagcgccacagcgctttcaaggacgccgacgactggggccttgccattattgccgacgacgagcaccaccaacaagaacaagacctgaccgaggccgtgggcgccgaggacgaggacacggtgctcgccaaggtggtgcgcaccaaggtgttcgagatgccgccgctgggcgtggacgaggcgctgcagcagctccagaacgtggaccacgacttctacgccttcaggaacgaggacacaggcgaggtgaacatcctctacaagaggaaggagggcggctacggactcatcatccccaaccccaaggagggcggccaagtccgcaaggagagcattgccattgatgctgcaccagcaccagcaccagcagcagagccctcctcctacgccgccgccgtgcgccggggcgacaacaactagccgcatgccagcagttgcctgccaaactcgatcgtcgaccatccaattgcaatgtttcatccatcttgatcacttgtcacattttcaactctgtacgcgacatgcctgctagtaccttccgttcagcaatgagatggagattggcctaccaatttgctgatttcctatacaatataagggatcgaccatgggcca

SEQ ID NO: 22519 - protein, 319 aa, Panicum virgatum
  misc_feature: Ceres CLONE 1821996
  misc_feature (78)..(183): Pfam Name: Ribosomal_S30AE Pfam Description: Sigma 54 modulation protein / S30EA ribosomal protein
MAAAAAAAAIPAAAISRPKHHRVSLSLAPSPRLPCPSLRSGFLGRALATDVQPAAVVASPRRGVSVRMAWDGPLSSVRLIVQGRNVKVSEKVKEHIEDKVGRAVSKHCHLVREVDVRLSARGGDLGRGPKTSRCEITLFSKRHGVLRAEEDADSTYASIDMAASIIKRKLRKIKEKETEVQRHSAFKDADDWGLAIIADDEHHQQEQDLTEAVGAEDEDTVLAKVVRTKVFEMPPLGVDEALQQLQNVDHDFYAFRNEDTGEVNILYKRKEGGYGLIIPNPKEGGQVRKESIAIDAAPAPAPAAEPSSYAAAVRRGDNN

SEQ ID NO: 22520 - DNA, 1162 bp, Panicum virgatum
  misc_feature: Ceres CLONE 1821999
  misc_feature: Encodes the peptide sequence at SEQ ID NO. 22521
ctcctctgtctctctcctcgctccccacgccacgtatcgcctcgtctcctcggaagccggcagcgccccgcgggcacgggaagggggagggagggagcggggatgatgaggatgctgtcgaaggcgtgctcgatcgtggcctcctccctcccgcgctgctcctcctcctccgccgcccccacgatgagggggcagccgtccttgctgccgagcgtgcggaagcaatggctcgggaagccgctgctgtacggaatcggctccctgttggtcatgccgctgaggacgctgcacggagtgtggcgggtgtttggcgcagggcggttcctctgcaacatgaccagcgtctcatcatcccttcaaattgagcttgtaccatgccttcaagataactatgcatatatcctgcatgatgttgatactggaacagttggagtggtggacccttctgaggctatgcctattataaatgcattggaaaagagaaatcagaacttgacctatatactgaatacccatcatcactatgaccatacaggtgggaacttggaactgaaggcaaaatatggtgcaaaggttattggttctgaaaaggacagggatagaattcctggcattgacatcagtcttaaggagggtgacacatggatgtttgctggtcatcaggttcttgtactggaaactcctgggcatacatcaggtcatgtgtgctattattttgctggttctggagccatatttacaggtgacactttgttcagtctatcatgcggaaagctttttgaagggactccacagcagatgtattcctcacttcagaaaattatagctttgcctgatgagacgaaagtatactgtggacatgaatatactttgagtaattcaaaatttgccctgagtgtagaaccaggaaataaagaattacaggaatatgctgcaaatgtagctgagttgcgcaataagaatatacccacggtgccaacaacaattgggagagagaagcggtgcaatcctttcctgcggacctccaatccagaaattaagagaactctgtccattccggatcatttcgatgaagaccgtgtacttgaagttgtccgtcgaacaaaagataacttctgactaacaaaaggaaattcttgtgacatggccaactatcttgtta

SEQ ID NO: 22521 - protein, 337 aa, Panicum virgatum
  misc_feature: Ceres CLONE 1821999
  misc_feature (94)..(252): Pfam Name: Lactamase_B Pfam Description: Metallo-beta-lactamase superfamily
  misc_feature: SWISSPROT Homolog: EC 3.1.2.6 Hydroxyacylglutathione hydrolase
MRMLSKACSIVASSLPRCSSSSAAPTMRGQPSLLPSVRKQWLGKPLLYGIGSLLVMPLRTLHGVWRVFGAGRFLCNMTSVSSSLQIELVPCLQDNYAYILHDVDTGTVGVVDPSEAMPIINALEKRNQNLTYILNTHHHYDHTGGNLELKAKYGAKVIGSEKDRDRIPGIDISLKEGDTWMFAGHQVLVLETPGHTSGHVCYYFAGSGAIFTGDTLFSLSCGKLFEGTPQQMYSSLQKIIALPDETKVYCGHEYTLSNSKFALSVEPGNKELQEYAANVAELRNKNIPTVPTTIGREKRCNPFLRTSNPEIKRTLSIPDHFDEDRVLEVVRRTKDNF

SEQ ID NO: 22522 - DNA, 664 bp, Panicum virgatum
  misc_feature: Ceres CLONE 1822001
  misc_feature: Encodes the peptide sequence at SEQ ID NO. 22523
cccgcattgaactcgccctcggttcgttccagcagcgcttgcccatcggactcactgccgagacgaagccccacgccatccccccagaccccagccagcttctctctcagccccctccgcttgtcgcgttgcggacccggcacacgccggcccgcccagatatagagcgaacagagccgccggccagacagacactcgaagcggttgcttggtgcggcaagggagaaggatcatcagtccccagttggtttactactagccggccatggctgccaagaaggtggtgctgaagatcgacctgcacgacaacaaggataagaagagggtgctcaaagcggtctccactctccacggtatcgactccttctccatggacatgaaggactctaagctgacggtgatcgggctcgccgaccccgtcgacgtcgttgccaagctgcgcaaggtcggggccgcccacatcctctccgtcggcccggccaaggaggagaagaaggacgaaaagaagaacggcgacaagaaggatggcgataagaaggacggcgacaagaaggacggcgataagaaggtcgcccaaatacattttggtatatatagcttcgacaacgatgctgcagaagccgacggtgcacgatcgagcgcacagctccgcgagacggccggc

SEQ ID NO: 22523 - protein, 132 aa, Panicum virgatum
  misc_feature: Ceres CLONE 1822001
  misc_feature (6)..(73): Pfam Name: HMA Pfam Description: Heavy-metal-associated domain
MAAKKVVLKIDLHDNKDKKRVLKAVSTLHGIDSFSMDMKDSKLTVIGLADPVDVVAKLRKVGAAHILSVGPAKEEKKDEKKNGDKKDGDKKDGDKKDGDKKVAQIHFGIYSFDNDAAEADGARSSAQLRETA

SEQ ID NO: 22524 - DNA, 951 bp, Panicum virgatum
  misc_feature: Ceres CLONE 1822003
  misc_feature: Encodes the peptide sequence at SEQ ID NO. 22525
aagaaggctgtgcttggccctcctcccttcgacctcccatcacaaccgcctccacaacaacaagggatcggacagcaaggggtggatcgatcgatcgaccgagccccgcgccaccaggccaccaccaacataaccggctgctggtactggtagagaccagtaggaagggcggccaggccagcatgaagggcggcgacgtgagcagcattagcccgctggtctccttcgtcctcggcgccgccatggccaccgtctgcgtcctcttcttcatgtccgccagccccacacgccgcctcgccgacatctccgccttctcctccggaaactttttttcagcgacctccgcctcgcctcctccgactccgacaacggggtggtcgccgacggcgacgtcgaggtcaccgccacccccgcgccggcgccggcgccggtccaggcggcgtcgccgtggggcgaccttgaggaggtgctccggcgcgcggcgaccaaggaccggacggtgatcatgacgcagatcaacgcggcgtggacgcgccggggctccctgctggacctcttcttcgagagcttccgcagcggggagggcggcgtggcgcggctactggagcacctggtgatmgtgaccatggacccggccgcgtaccagggctgccmggccgtgcaccgccactgctacttcctccgcacctccaacggcgtcgactaccgctccgagaagatgttcatgagcaaggactacctcgagatgatgtggggccgcaaccgcttccagcagaccgtcctcaagctaggatacaacttcctcttcacggacgttgacgtgatgtggttccgtgaccctttccgccacatctccatggcggcggacatcgccatttccagcgacatgtacatgggcaatccctacagcctgcgcaacttccccaacggcggcttcctcttcgtgcgatc

SEQ ID NO: 22525 - protein, 148 aa, Panicum virgatum
  misc_feature: Ceres CLONE 1822003
  misc_feature: Useful for making plants with modulated biomass
  misc_feature (50)..(50): Xaa is any aa, unknown, or other
MTQINAAWTRRGSLLDLFFESFRSGEGGVARLLEHLVIVTMDPAAYQGCXAVHRHCYFLRTSNGVDYRSEKMFMSKDYLEMMWGRNRFQQTVLKLGYNFLFTDVDVMWFRDPFRHISMAADIAISSDMYMGNPYSLRNFPNGGFLFVR

SEQ ID NO: 22526 - DNA, 607 bp, Panicum virgatum
  misc_feature: Ceres CLONE 1822027
  misc_feature: Encodes the peptide sequence at SEQ ID NO. 22527
ggaaccaatcggcttgctagttggtcaagcttactgggaaacatgaggctctcggcggctgtgctctgcgccctggtggccgtccaggcggcggtgctcctcgccgccgcgccggcggcgcaggccggcgagctgcaggtcgggtactacggcaagaaatgcaagggcctggagaacatcgtcaagtggcacgtcatcagggcgctcaaggccaaccgccgcaccggcgccgcgctcgtccgtctgctcttccatgactgcttcgtcagggggtgcgatgggtctgtcctcctgttttttttctacgacaaccctcacccggagaaggaggcgccggtgaacatcggcctggccgccttcgacctcctggaggagatcaaggccgccgtcgaggacaggtgccctggcgtggtctcctgctccgacctcctcatctacgccgcccgcgacgcgtccagcatcctcagcaacggccacgtccacttcgacgtccccgccggccgcctcgacggcttcgtctccaaggccgaggaggcccacgcggagctcccggactcagccgacgacgtgaagaagctcatcgccaactttgccaggaagaacttca

SEQ ID NO: 22527 - protein, 188 aa, Panicum virgatum
  misc_feature: Ceres CLONE 1822027
  misc_feature (47)..(188): Pfam Name: peroxidase Pfam Description: Peroxidase
  misc_feature: SWISSPROT Homolog: EC 1.11.1.7 Peroxidase
  misc_feature: Useful for making plants with altered carbohydrate content
MRLSAAVLCALVAVQAAVLLAAAPAAQAGELQVGYYGKKCKGLENIVKWHVIRALKANRRTGAALVRLLFHDCFVRGCDGSVLLFFFYDNPHPEKEAPVNIGLAAFDLLEEIKAAVEDRCPGVVSCSDLLIYAARDASSILSNGHVHFDVPAGRLDGFVSKAEEAHAELPDSADDVKKLIANFARKNF

SEQ ID NO: 22528 - DNA, 661 bp, Panicum virgatum
  misc_feature: Ceres CLONE 1822049
  misc_feature: Encodes the peptide sequence at SEQ ID NO. 22529
agagactagagagagcgctctcctctcgcctatccatttccaatctcgatcggggagagctcgcgccgccattgccgccgccgcgcctggctgttcttgatcagcagcgaatggggaggcagccgtgctgcgacaaggtggggctgaagaagggcccgtggacggcggaggaggaccagaagctcgtcagcttcatcctcggcaacggccagtgctgctggcgcgccgtgcccaagctcgccgggctgctccggtgcgggaagagctgccggctgcggtggacgaactacctgcggccggacctcaagaggggcctgctctccgacgccgaggagaagctcgtcgtcgacctgcacgcccagctcggcaacaggtggtcaaagattgcgtcgcacttgccggggcggacggacaacgagatcaagaaccactggaacacccacatcaagaagaagctcaggaagatggggatcgaccccctcacgcacaagcccctgccgccacctccgcagcagcaggagcaccaaccgattccgccgcccgccggcggctcgccggaggcgcagccatcgccacctccggagcggagtcctgcagaggagaaggcggtgacggcgacggccagaaatagtagcgagcacggcaacagcgagctgctcct

SEQ ID NO: 22529 - protein, 183 aa, Panicum virgatum
  misc_feature: Ceres CLONE 1822049
  misc_feature (67)..(112): Pfam Name: Myb_DNA-binding Pfam Description: Myb-like DNA-binding domain
  misc_feature (14)..(61): Pfam Name: Myb_DNA-binding Pfam Description: Myb-like DNA-binding domain
  misc_feature: Useful for making plants with altered cell wall content and/or composition
  misc_feature: The sequence is a functional homolog of SEQ ID NO 442 in the 10/412,699 US patent application
  misc_feature: Useful for making plants with altered alkaloid content
  misc_feature: Useful for making plants with modulated nitrogen use efficiency
  misc_feature: The sequence is a functional homolog of SEQ ID NO 836 in the 10/412,699 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 824 in the 10/412,699 US patent application
  misc_feature: The sequence is a functional homolog of SEQ ID NO 296 in the 11/479,226 US patent application
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: The sequence is a functional homolog of SEQ ID NO 1002 in the 11/435,388 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: Useful for making plants with altered lignin content
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: The sequence is a functional homolog of SEQ ID NO 122 in the 10/412,699 US patent application
  misc_feature: The sequence is a functional homolog of SEQ ID NO 126 in the 11/375,241 US patent application
  misc_feature: The sequence is a functional homolog of SEQ ID NO 148 in the 10/286,264 US patent application
  misc_feature: The sequence is a functional homolog of SEQ ID NO 34 in the 10/374,780 US patent application
  misc_feature: The sequence is a functional homolog of SEQ ID NO 438 in the 10/225,066 US patent application
  misc_feature: The sequence is a functional homolog of SEQ ID NO 271 in the 11/479,226 US patent application
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 1041 in the 11/479,226 US patent application
  misc_feature: The sequence is a functional homolog of SEQ ID NO 112 in the 10/225,066 US patent application
  misc_feature: The sequence is a functional homolog of SEQ ID NO 20 in the 11/375,241 US patent application
  misc_feature: The sequence is a functional homolog of SEQ ID NO 2052 in the 10/374,780 US patent application
  misc_feature: The sequence is a functional homolog of SEQ ID NO 450 in the 10/412,699 US patent application
  misc_feature: The sequence is a functional homolog of SEQ ID NO 116 in the 10/412,699 US patent application
  misc_feature: The sequence is a functional homolog of SEQ ID NO 280 in the 11/479,226 US patent application
  misc_feature: The sequence is a functional homolog of SEQ ID NO 148 in the 10/412,699 US patent application
  misc_feature: The sequence is a functional homolog of SEQ ID NO 2266 in the 10/374,780 US patent application
  misc_feature: The sequence is a functional homolog of SEQ ID NO 341 in the 11/479,226 US patent application
  misc_feature: The sequence is a functional homolog of SEQ ID NO 58 in the 11/375,241 US patent application
  misc_feature: Useful for making plants with modulated biomass
  misc_feature: The sequence is a functional homolog of SEQ ID NO 796 in the 11/435,388 US patent application
  misc_feature: The sequence is a functional homolog of SEQ ID NO 1033 in the 10/412,699 US patent application
  misc_feature: The sequence is a functional homolog of SEQ ID NO 540 in the 10/374,780 US patent application
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: The sequence is a functional homolog of SEQ ID NO 2556 in the 10/374,780 US patent application
  misc_feature: The sequence is a functional homolog of SEQ ID NO 272 in the 10/225,066 US patent application
  misc_feature: The sequence is a functional homolog of SEQ ID NO 528 in the 11/435,388 US patent application
  misc_feature: The sequence is a functional homolog of SEQ ID NO 200 in the 10/666,642 US patent application
  misc_feature: The sequence is a functional homolog of SEQ ID NO 830 in the 10/412,699 US patent application
  misc_feature: The sequence is a functional homolog of SEQ ID NO 126 in the 10/412,699 US patent application
  misc_feature: Useful for making plants with enhanced nutritional value
  misc_feature: Useful for making plants with modulated heat sensitivity
  misc_feature: The sequence is a functional homolog of SEQ ID NO 1688 in the 11/479,226 US patent application
  misc_feature: The sequence is a functional homolog of SEQ ID NO 1852 in the 10/412,699 US patent application
  misc_feature: The sequence is a functional homolog of SEQ ID NO 2094 in the 10/374,780 US patent application
MGRQPCCDKVGLKKGPWTAEEDQKLVSFILGNGQCCWRAVPKLAGLLRCGKSCRLRWTNYLRPDLKRGLLSDAEEKLVVDLHAQLGNRWSKIASHLPGRTDNEIKNHWNTHIKKKLRKMGIDPLTHKPLPPPPQQQEHQPIPPPAGGSPEAQPSPPPERSPAEEKAVTATARNSSEHGNSELL

SEQ ID NO: 22530 - DNA, 1212 bp, Panicum virgatum
  misc_feature: Ceres CLONE 1822050
  misc_feature: Encodes the peptide sequence at SEQ ID NO. 22531
aacctcagattcctgggcctggcaggccggccgcgcggggtcgttaaaaccccggcgctcccatgcaaccaccggtcaagctagccccccaggaaccaactgctcctcctctcttacccgccggccgcctcctcgcgcccccgctcgcgagccgcgactcgaccgtgttttcttctttgccggcgggcggagagcgagctagcgagcgaggttgcggcaggcggcggcgggtagccatggcgcacgggatcatcgggagccaccaccaccccatcatggcctcgcgggtgtccatgctcgcgcacgtgctgttcctgaccaccgccgtgctcatgctcgtctggctgctgcactaccggggcggcatcaacatacagtccgaggaccccgagcaggtcttcaatgttcatccgtttgtaatgtcctgggggttcattcttcttattggagaagccatcctggcgtactcgtcgatcccgatggtggaccaccggacgcagaagatggcgcacatgatgatccacctggtgggtctcatcctgggcatcttcggcgtgtacgcggcgttcaagttccacgacgcggccgtggtgccggacctgatgagcctccactcgtggctgggcatcaccgccatcgcgctcttcggcctgcagtggctcttcggcttcgtcaccttctggctgcccgcggcgcacgagcacacccgcgacgcggcggcccccgcgcacgtcatggccgggctggccatcttcatgctggccgtgtgcgcggcccagacggggctcgtgcagaagagcgccggcgccgcctccgcctccgagatgaagctcatcaacgtcacgggcatcttcatcctcctctacggggtcgccgtcgcctccgccgtcgcgctgcgcagggccttcttgtaggcgtttgtttgtttggtcgctcaggatcggcggtttcaccatggatgtgacacgattggtgttcccttgtacgcccatgcggagttggtttgggcggcggtttgcgtggtgattgggtctgcatagtaccgtgtgagtgagtttttctgcgacattcgagttcgatcgatgccttgccttcttcaatgggagctcaaagaacaatgcacttgtacctgtcattcgtaattgtttcttgggccttctactttataggtccagggaagaactggcccacagacaacccaatgggcttccc

SEQ ID NO: 22531 - protein, 225 aa, Panicum virgatum
  misc_feature: Ceres CLONE 1822050
  misc_feature (19)..(225): Pfam Name: Cytochrom_B561 Pfam Description: Cytochrome b561
MAHGIIGSHHHPIMASRVSMLAHVLFLTTAVLMLVWLLHYRGGINIQSEDPEQVFNVHPFVMSWGFILLIGEAILAYSSIPMVDHRTQKMAHMMIHLVGLILGIFGVYAAFKFHDAAVVPDLMSLHSWLGITAIALFGLQWLFGFVTFWLPAAHEHTRDAAAPAHVMAGLAIFMLAVCAAQTGLVQKSAGAASASEMKLINVTGIFILLYGVAVASAVALRRAFL

SEQ ID NO: 22532 - DNA, 653 bp, Panicum virgatum
  misc_feature: Ceres CLONE 1822065
  misc_feature: Encodes the peptide sequence at SEQ ID NO. 22533
aagcttgctgctaaatcctgccattagtggtaagcaactaagcaagtaagtagattaagcagcgtcgcggcctcgcgggtgagagaggagaggagggactgagatggaggcggggctggcggctgggtactggggcgtgggcggggggcggggcggggcgggcgggggctcgccggctggcgtgctttgccggacgcgccccggcgtcgccgttgagagcgtggaggacaacccccgggccctccgggagctcctgttctgctgccctggcgcccttcagtacatgagtggtgtgatcctcttcgaggagaccctgtaccacaagaccaaggatggcaagcccttcgttgatgtcctcaaggagggaggcgttctccctggcatcaaggtcgacaagggcaccattgaggttgctggcactgacaaggagaccaccacccagggccatgatgaccttggcaagcgctgtgccaagtactacgaggccggtgcccgctttgccaagtggcgtgctgtcctcaagattggccccaacgagccatcgcagcttgccattgacctgaatgctcagggtcttgctcgctatgccatcatctgccaggagaatggtctggttccgattgtggagcctgagatcctcatcgatggccctc

SEQ ID NO: 22533 - protein, 183 aa, Panicum virgatum
  misc_feature: Ceres CLONE 1822065
  misc_feature (12)..(183): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature: Useful for making plants with modulated phosphate use efficiency
  misc_feature: Useful for making plants with modulated biomass
MEAGLAAGYWGVGGGRGGAGGGSPAGVLCRTRPGVAVESVEDNPRALRELLFCCPGALQYMSGVILFEETLYHKTKDGKPFVDVLKEGGVLPGIKVDKGTIEVAGTDKETTTQGHDDLGKRCAKYYEAGARFAKWRAVLKIGPNEPSQLAIDLNAQGLARYAIICQENGLVPIVEPEILIDGP

SEQ ID NO: 22534 - DNA, 660 bp, Panicum virgatum
  misc_feature: Ceres CLONE 1822085
  misc_feature: Encodes the peptide sequence at SEQ ID NO. 22535
gtccaactaaaaccctaacccctccgccgccccccaaaccccagccagcagccgccgccgccgccgccgccgccgccatccgccatccgccggcgggatggcgctgtacctgctgttcgagtctgcctccggctacggcctcttccacgcgtacggcatcgatgagatcggccagagcgtggaagccgtgcggtcctccgtcctggacctcgaacgcttcggcaaggccgtcaagctcactgccttcaaccccttctcctccgccgtcgacgcgctcaatcagtgcaacgccatctccgaagggatcatgaccgatgagctgaggagcttcttggagttgaatctgcccaagcccaaggaggggaagaaggccaagtacagcctcggcgtcgtcgagccaaaggtcggctcccatatcgccgaggtcaccggcatcccctgccagagcaacgagttcgtccaggagctgctccgcggcgtccgtctccacttcgaccgcttcatcaaggagctcaaggagtcggacttagagaaggcccaactcggcctggggcatagctacagcagggccaaggtgaagttcaatgtgaaccgtgttgacaacatggtgattcaggcaatctttctgttggatacacttgacaaggacatcaactcctt

SEQ ID NO: 22535 - protein, 187 aa, Panicum virgatum
  misc_feature: Ceres CLONE 1822085
  misc_feature (3)..(69): Pfam Name: NOP5NT Pfam Description: NOP5NT (NUC127) domain
MALYLLFESASGYGLFHAYGIDEIGQSVEAVRSSVLDLERFGKAVKLTAFNPFSSAVDALNQCNAISEGIMTDELRSFLELNLPKPKEGKKAKYSLGVVEPKVGSHIAEVTGIPCQSNEFVQELLRGVRLHFDRFIKELKESDLEKAQLGLGHSYSRAKVKFNVNRVDNMVIQAIFLLDTLDKDINS

SEQ ID NO: 22536 - DNA, 1354 bp, Panicum virgatum
  misc_feature: Ceres CLONE 1822093
  misc_feature: Encodes the peptide sequence at SEQ ID NO. 22537
cttcccactccactccatctcgtggtcgagcttcccctccagcacccgcggcggcggcggcggcggcgagctgaggaagggggcgctgcttgctggggctgggagcatggccggggcgctgctcttcatcctcctcctcttctgcccctttgcggaggagacggcggctgctgcagataaacgcgtcgtccatgatgacttgaaccccatcacaacagtcccctccacgaacccaacgcccacgattatcaccgtgccttccacaaatcctaccattaccatcccttccttgaaccctttgcccacacccatcaccgacacccctccttccacagcgccgccagccccaatcatatatccactgccaacgccttcaacctcctccccaccgactgtgccggtcaccaatcctgctgtaaccacaccatccactttccctccgtcagcacccttcaccaacccaccagcgtcaaacccaacacctacacctcctcctgctcaaataatcacagctccagctgtttctagtcagcaggtctggtgtgtggttaaagctgctggctcaagcgaagctgcactccagaacgcgctcgactacgcttgcggcattgggggagcagattgctcagcgattcagccatcgggaagctgctactatccaaatactctccaggcccatgcatcctatgctttcaacacctattaccagaggaaccctgcaccgtcgagctgtgactttgggggaacggcaatgcttgtcactgctaatccaagctcagggagctgtgtcttcgcatcgtcatcaagctctactgttggatacaatcctgcctccactgctactccattggcatcatcgtctggttctgattctggatcaccagttctgaatgctagtggggcaggctcttcagaaccatcagagtttagcccagacatcccaggagcagttgacatggataacgcttggaggtcaattaacccgccccaatgggcctgggcggccatggtctggattctgcattttgtgtgcatatagaaggaatggtttgaaaacacgcaggagcaaaaagctagagcactaggaaggtagagatttagagaatcaggtggtcgggccttagcttgactaagtctgtgaatgtatgaagtatgttgattgataattagggcagttgtatggtactccagttagtagtaggaactaggaactaagtagttctgatggatgcactcatcctgactgttcactcattagagtatatgtagctgctgcatgcctccttttgatctgagaaacgtcctatgtatgactgagctgaacaactagtggaatacatggtcgttttgtttt

SEQ ID NO: 22537 - protein, 310 aa, Panicum virgatum
  misc_feature: Ceres CLONE 1822093
  misc_feature (144)..(229): Pfam Name: X8 Pfam Description: X8 domain
  misc_feature: SWISSPROT Homolog: EC 3.2.1.39 Glucan endo-1,3-beta-D-glucosidase
  misc_feature: Useful for making plants with altered carbohydrate content
MAGALLFILLLFCPFAEETAAAADKRVVHDDLNPITTVPSTNPTPTIITVPSTNPTITIPSLNPLPTPITDTPPSTAPPAPIIYPLPTPSTSSPPTVPVTNPAVTTPSTFPPSAPFTNPPASNPTPTPPPAQIITAPAVSSQQVWCVVKAAGSSEAALQNALDYACGIGGADCSAIQPSGSCYYPNTLQAHASYAFNTYYQRNPAPSSCDFGGTAMLVTANPSSGSCVFASSSSSTVGYNPASTATPLASSSGSDSGSPVLNASGAGSSEPSEFSPDIPGAVDMDNAWRSINPPQWAWAAMVWILHFVCI

SEQ ID NO: 22538 - DNA, 642 bp, Panicum virgatum
  misc_feature: Ceres CLONE 1822103
  misc_feature: Encodes the peptide sequence at SEQ ID NO. 22539
attccgctttgagcttgcttgcagctccagctcccctcgtctcttggtggctacgccatggccaccgtagtcctgatgagctgcagcctccgcgcgccggcctgcagcggcttatctggcgtccgcgccgccccggcaccggccatcgtcgccatgcccgccgccaagcagcaggttgttggccgcggcgccaggctgcgcgcgcaggccacctacaacgtgaagctcatcacgcccgacggcgaggtagagctgcaggtgcccgacgacgtgtacatcctggaccaggccgaggaggaagggatcgacctgccctactcgtgccgcgcggggtcctgctcctcctgcgccggcaaggtcgtctccggcagcgtcgaccagtccgaccagagcttcctcgaagacgaccaggtcgccggcggctgggtgctcacctgcgccgcctaccccacctccgacgtcgtcatcgagacgcacaaggaggaggagctcacctcctcttcgtaatccgatccagtatatgcggctttcattgcttattaattatctcagctcccttgattatatatatatatatatatatatatatatatatatatatatatatatatatataaatacaccctcctgcgtgcgagctat

SEQ ID NO: 22539 - protein, 149 aa, Panicum virgatum; identical to SEQ ID NO: 10105
  misc_feature: Ceres CLONE 1822103
  misc_feature (58)..(133): Pfam Name: Fer2 Pfam Description: 2Fe-2S iron-sulfur cluster binding domain

SEQ ID NO: 22540 - DNA, 688 bp, Panicum virgatum
  misc_feature: Ceres CLONE 1822111
  misc_feature: Encodes the peptide sequence at SEQ ID NO. 22541
aacatagcttcattaattccctggctggctggattccaactctttattccgcagaaaacgcacgtggcacatactgtatagagatatgccaagcatgcccgccgtctcagccgccaccggagcggcgcctccgccgaccaaggtcgtcgtcgaggacatctacggcttcctgcgcgtcctcgacgacggcaccgtgctccggtcggcggcggagccagcgttctgcccgaccaccttccccgacagccacccgtcggtgcagtggaaggaggccgtgtacgacaaggccaagaacctccgcgtcgacttccacggcggcgggttctgcctcgggtcgtgcacgtgggccaacgtgcacgcgttctgcctccgcctcgccgcggaggccggcgccgtcgtgctctccgcggggtaccgcctcgccccggagcaccgcctccccgcggcggtcgacgacggcgccgggttcctgcgctggctccgcgagcagtccgcgaaccccgccgccgcggacgcctggctcgccgaggccgccgacttcgggcgcgtgttcatcaccggcgactcggcgggcggcaccatagcgcaccacctcgccgcgcgcgccggcttggccgccgcggtcaccaagcgcggcgagcccggccccggccccgacgtcgacccggtcacggtccggggctacgtc

SEQ ID NO: 22541 - protein, 197 aa, Panicum virgatum
  misc_feature: Ceres CLONE 1822111
  misc_feature (69)..(197): Pfam Name: Abhydrolase_3 Pfam Description: alpha/beta hydrolase fold
  misc_feature: SWISSPROT Homolog: EC 3.1.1.3 Triacylglycerol lipase
MPAVSAATGAAPPPTKVVVEDIYGFLRVLDDGTVLRSAAEPAFCPTTFPDSHPSVQWKEAVYDKAKNLRVDFHGGGFCLGSCTWANVHAFCLRLAAEAGAVVLSAGYRLAPEHRLPAAVDDGAGFLRWLREQSANPAAADAWLAEAADFGRVFITGDSAGGTIAHHLAARAGLAAAVTKRGEPGPGPDVDPVTVRGY

SEQ ID NO: 22542 - DNA, 117 bp, Panicum virgatum
  misc_feature: Ceres CLONE 1822124
  misc_feature: Encodes the peptide sequence at SEQ ID NO. 22543
gtcctcgcgctcctcctcgccgccgccgccgcgcggtctccggcgacgcctgccgcgccgactaccctggtcgcgcccactacgccggccgcgccgacgacccctgctgcgcctacg

SEQ ID NO: 22543 - protein, 38 aa, Panicum virgatum
  misc_feature: Ceres CLONE 1822124
  misc_feature: Useful for making plants with altered carbohydrate content
VLALLLAAAAARSPATPAAPTTLVAPTTPAAPTTPAAP

SEQ ID NO: 22544 - DNA, 1364 bp, Panicum virgatum
  misc_feature: Ceres CLONE 1822132
  misc_feature: Encodes the peptide sequence at SEQ ID NO. 22545
ccacccgagcgcgtggagcgcggccgcctgccctcatggcgtcgaagtggagccgggccaccccggtgagagggcatagcaggccgggggcgcggccctctagcggcagagccaaaatttggccggggaacttttgtaatttgttgtgaaattcagattttgtgattattgtgtagtcttgttaaattaaatcttgtgattgctgtgtagtgtgacgaaaccgccaaattaaaactctaattaagcgtaatgaccatcatttgaacacatcgtaaaaaaaccaagggagcagcacccgcgcatgtttacctgcttcgccgggcgcgcctcctccaccgcatcgagcatcgtcgccagcagcctcgccgcccccgcccccgcccccgcgccgtcgccccagccccgcagccccgcctccgccgcccgccccaggctcatcatgagcaagcccgtcttcgccgcctccagcgccgtcgtgggcatggacgccgtcgagcgcttgaagagcgggttcgagcagttcaagacccaggtctatgacaagaagccggagctgttcgagccgctcaaggccggccaatcccccaggtacatggtgttcgcctgcgccgactcccgctgctgcccgtcggtgaccctgggcctgcagcccggcgaggccttcaccatgcgcaacatcgccgccatggtcccgccctacgacaagaacaagtacgccggcatcggggccgccatcgagtacgccgtctgcgcgctcaaggtggaggtcctcaccgtcattggccacagccgctgcggtggcatcaaggcgctcctctccctccaggacggcgcagccgacaccttccacttcgtcgaggactgggtcaggatcggcttccaggccaagaagaaggtgctgaaagagcacccccatgctccgttcgatgaccagtgctccatcttggagaaggaggccgtgaacgtgtccctctacaacctcttgacctacccctgggtcaaggaaggtgtggagaacgggaccctcaagctggtcggcgcacgctacgacttcgtgaacggtgtgttcgacacatgggtgaaataagccaccaactcctacatcatcaaatacatacatagtacttgcataccgatatgcacctcatcgatgtgaatccgtggagtacttactgcctatttcgaccgcttcgaaccggatcgtcctatgctgtaataagcaatagcattttctactgctttactttctaaggtggagcttatatatatgtaatatatggtgcgtaatttgaccgcttttgtggtcaagagacatcagctgtataagcctttttcataatattatcatgcagtatctttttact

SEQ ID NO: 22545 - protein, 215 aa, Panicum virgatum
  misc_feature: Ceres CLONE 1822132
  misc_feature (44)..(214): Pfam Name: Pro_CA Pfam Description: Carbonic anhydrase
  misc_feature: SWISSPROT Homolog: EC 4.2.1.1 Carbonate dehydratase
MSKPVFAASSAVVGMDAVERLKSGFEQFKTQVYDKKPELFEPLKAGQSPRYMVFACADSRCCPSVTLGLQPGEAFTMRNIAAMVPPYDKNKYAGIGAAIEYAVCALKVEVLTVIGHSRCGGIKALLSLQDGAADTFHFVEDWVRIGFQAKKKVLKEHPHAPFDDQCSILEKEAVNVSLYNLLTYPWVKEGVENGTLKLVGARYDFVNGVFDTWVK

SEQ ID NO: 22546 - DNA, 1132 bp, Panicum virgatum
  misc_feature: Ceres CLONE 1822145
  misc_feature: Encodes the peptide sequence at SEQ ID NO. 22547
aaaaagactccacactcgcggccccggcagggtgcttcgccgcgaaggctgctactccctctcccttccttccgcccgcattcgtttcgccggcggcgagatggccatcgatcacgcgacccctctcgggctgaagagcagaggcgccatgggcggcggcgagtgcgacgacggcgcggagaaccagcggtggccgccgtggctgaagccgctgctgtccacgagcttcttcgtccaatgcaggatccacgcggacgcgcacaagagcgagtgcaacatgtactgcctcgactgcatgaacggcgcgctctgctccctctgcctcgcgcaccaccgcgaccaccacgccatccagattcggaggtcgtcgtaccacgacgttatccgggtgtcggagatacagaaggtgctggacatcgccggcgtgcagacgtacatcatcaacagcgcgcgcgtggtgttcctcaacgagcggccgcagccccgccccgggaagggcgtcaccaacacctgcgaggtctgcgagcgcagcctcctcgactgcttccgcttctgctccctcggatgcaagattgtcggcacgtcgcgcggataccgccccaggaagaagcacgccgccggcggcggcggcggcggcagcagcgacaagagcagcgtcgtgcagagcttctcgccgtccaccccgccgccgaccgccgccagctgccggccctggaacaagcgccgcaagggcgtcccgcaccggtcgcccttcggcagcctcatcgtcgagttctaattactcgacatcatcaccttgacaatggaccctctactgtacacatgacatagcccagcccagaaggaataaccgtgcgcctctggacgtggaggccggccggctgtgcaaacgccggcgaagggcgagagcggtaagaacatgcctagctgctctactatagtttgcttccttcatcaggtttaagtagtttacagttacagttgctagtcactaggcagtaaggtagctgctgcttacagcaacgtactaagttttgcagccttgtacattgtaatataccggtactttactccccaaatgcttagatgtatatattcatgtgctatcaacagtctggggtacgatgcagac

SEQ ID NO: 22547 - protein, 225 aa, Panicum virgatum
  misc_feature: Ceres CLONE 1822145
  misc_feature (47)..(158): Pfam Name: PLATZ Pfam Description: PLATZ transcription factor
  misc_feature: The sequence is a functional homolog of SEQ ID NO 664 in the 10/666,642 US patent application
  misc_feature: The sequence is a functional homolog of SEQ ID NO 668 in the 10/666,642 US patent application
MAIDHATPLGLKSRGAMGGGECDDGAENQRWPPWLKPLLSTSFFVQCRIHADAHKSECNMYCLDCMNGALCSLCLAHHRDHHAIQIRRSSYHDVIRVSEIQKVLDIAGVQTYIINSARVVFLNERPQPRPGKGVTNTCEVCERSLLDCFRFCSLGCKIVGTSRGYRPRKKHAAGGGGGGSSDKSSVVQSFSPSTPPPTAASCRPWNKRRKGVPHRSPFGSLIVEF

SEQ ID NO: 22548 - DNA, 1347 bp, Panicum virgatum
  misc_feature: Ceres CLONE 1822167
  misc_feature: Encodes the peptide sequence at SEQ ID NO. 22549
agcgcccaaaacgggggagaaggggacggggcgggggcgggggcggcagtcaggctctcaatccttcatcgaccgaaacagagtgtggagggtcagaccgacaggccatggagagctcgccgcccaccatcaccgtccaggtcaagttcgcccggcggaccatccccgtggaggtaccggccgccgcgaccaccgcggagctgaagcgcctcctccagccgctcaccaacgtcctcccccgcggccagaggcttgtctgcaaaggcaaagtgctccaggatgccgcgagcctgagctcgatgcaggtggtagacggatccaaggtcatgctcatcgcctcgctgggtctccatcagggggatggtcccatcacaaagaatagcagcagctctgcaacaagtgtaacaagagcctcaaatgttaaggaacgtcaaacacaaaaagcagaggcagttgttggcaaaagccgagctgagcgttggaaattgacgggtgttgttgccttgcatgattgtgacttgaaggcagtgccggaagaagtctgggactgtgcctcctcagtacggatattagatgccagcaacaactgtatcaaggaaattccgcataaaattgctgctcttaaatctttaaataaattgctcctaactgccaatgatgtagatgatgagaacatcagctgggaaggtctatcatgccttcaaaaattattaaacctgtctttaagccagaaccgactggttagcttgccatcgacattgggctcactgacttctctgcgcgaacttcgtattgcaaacaacaggcttgataacttacctatcgaaataggatcgctgaagcatctccagattctgatagcaaataacaataggatatctgcattgccttcatctataggagattgtgaatctctcaccgaggttgacttgtcatcaaatctcttaactgaactgccagagacctttgggaagctttataatctcaaggttttgcatctaaggaacaatggtcttacatccctgccttcgacgttatttaaaaagtgtatgcagcttattacacttgatctccatggaacagaaatcacaaatgatattcttcggcaggtggaggggtgggaggagttcgacgagcgtcggcggcagaaacatcagaagcagctagacttccgtgtaggctcatctggtgtgttcgatgaaggcgccgatgatgataacaggcgtaggtagtaatttattgcctgttgcgagcaagatcatctgctctgtatctggcttttgccccagataaactgtacaactcagaacagagttttagagcttgacatgaaaaactttgttactc

SEQ ID NO: 22549 - protein, 374 aa, Panicum virgatum
  misc_feature: Ceres CLONE 1822167
  misc_feature (11)..(80): Pfam Name: ubiquitin Pfam Description: Ubiquitin family
  misc_feature: SWISSPROT Homolog: EC 2.7.11.1 Non-specific serine/threonine protein kinase
MESSPPTITVQVKFARRTIPVEVPAAATTAELKRLLQPLTNVLPRGQRLVCKGKVLQDAASLSSMQVVDGSKVMLIASLGLHQGDGPITKNSSSSATSVTRASNVKERQTQKAEAVVGKSRAERWKLTGVVALHDCDLKAVPEEVWDCASSVRILDASNNCIKEIPHKIAALKSLNKLLLTANDVDDENISWEGLSCLQKLLNLSLSQNRLVSLPSTLGSLTSLRELRIANNRLDNLPIEIGSLKHLQILIANNNRISALPSSIGDCESLTEVDLSSNLLTELPETFGKLYNLKVLHLRNNGLTSLPSTLFKKCMQLITLDLHGTEITNDILRQVEGWEEFDERRRQKHQKQLDFRVGSSGVFDEGADDDNRRR

SEQ ID NO: 22550 - DNA, 1209 bp, Panicum virgatum
  misc_feature: Ceres CLONE 1822174
  misc_feature: Encodes the peptide sequence at SEQ ID NO. 22551
atcgaagctccctagccccgcccacgctgatggcccaccagtgcccccaccgctgcctcgccgccctcctcatcctcctcgccgcggccgccggcgccggcgcggccacgccgaggcagctgttcctcgttaccccggcgcccgtgacgctgaccaaccaccacggccagctgctcacgggcaactactccgtgaacctgctctggtacggccgcttcaccccggcgcaacgcgccgtcgtggccgacttcctcctctccctttcggcgccctccgtggccccggcctccgcggccgcgcccaccgtggcggcctggtgggccaccacggcgcggtaccacccgggcgcggcgcggctgacgctcggccgccaggtgctcgacccatcgctctccctcgggcgccggctctcggaggcctccctggccgccctcgccgcgcgcctctccccgcaccgcggctccgtcgccgtcgtggtcacggcgccggacgtcctcgtcgacgggttctgcctctcccgctgcggcctccacgcatcggccacctcgtccgccgctgccgccgccgcgccagtggcggcccacggcgccggagccccgcccgcacccgccgcccgcgggcgcggccgtttcgcgtacgtgtgggtggggaactcggcggaccagtgccccggggagtgcgcgtggccgttccaccagccggcgtacggcccgcaggcgccgccgctggtggcgccgaacgcggacgtcgggatggacggcttggtgatcaacctcgcgacgctgctggccggcgccgtgaccaacccgtacggcggcgggttcttccagggccccgccgaggcgccgctggaggccgtgacggcgtgcacgggcgtgttcggcgcgggcgcctacccggggtaccccgggcagctgccggtcgacgccgccaccggcgccagctacaacgcggtcggcgtcgccggccgacttttcctcctcccggccatgtgggaccccaagacctcgcagtgctccaccctcgtgtagcggacgctacgtacactaggatcggaggtagaggtcggacgaaatgggtgttggcttggtgtaaatgatgacgatcgaagggtgcggagctccgctggtagactcggtggcggcctttgtggtttctcgtgatctcgtcctgtcattgttctcgttcttgtggatagcgtcgaacttg

SEQ ID NO: 22551 - protein, 333 aa, Panicum virgatum
  misc_feature: Ceres CLONE 1822174
  misc_feature (41)..(333): Pfam Name: Phi_1 Pfam Description: Phosphate-induced protein 1 conserved region
MAHQCPHRCLAALLILLAAAAGAGAATPRQLFLVTPAPVTLTNHHGQLLTGNYSVNLLWYGRFTPAQRAVVADFLLSLSAPSVAPASAAAPTVAAWWATTARYHPGAARLTLGRQVLDPSLSLGRRLSEASLAALAARLSPHRGSVAVVVTAPDVLVDGFCLSRCGLHASATSSAAAAAAPVAAHGAGAPPAPAARGRGRFAYVWVGNSADQCPGECAWPFHQPAYGPQAPPLVAPNADVGMDGLVINLATLLAGAVTNPYGGGFFQGPAEAPLEAVTACTGVFGAGAYPGYPGQLPVDAATGASYNAVGVAGRLFLLPAMWDPKTSQCSTLV

SEQ ID NO: 22552 - DNA, 685 bp, Panicum virgatum
  misc_feature: Ceres CLONE 1822179
  misc_feature: Encodes the peptide sequence at SEQ ID NO. 22553
taggtctgtgtgaaatgggagaggatatcgctcagggatggactgaggatgaggagaagctattcgaaagagttgttttctcaaatcctgtctccttgggaaaaaacttttgggatcacctcccacatgcatttcctagtaaaactagtaaggatcttgttagctactactttaatgtcttcatgctccggaagagggctcagcagaacaggtcagaccagttgcgagtggacagtgatgatgatgaactgcatggcgactctccagtacctgggcaggaggaagaggattctgcagtgaagtcccctaaacgtgaatatttcgtcaacaattctctgcccatagagggtaaccataaagaatatgaaggagaacatattgctggaccttctttccatggggaggaaattgaaaatgcaggtgagtgcagacatctaccaaaccagatgcctctctattcaactgcagtgaatatagcacatatctacaaccaagatgagctgcaagcatcatttgacggctgacacaatggagctcatgctctgatgctcctagagctcagtgtgccgacttttcgccgaatcatgctacaagaaaccttgggaaccaaggtgcatctgtgtagatgttgtacagagaggatattccagtaatctggtgtactgttttctcgaacagagagatt

SEQ ID NO: 22553 - protein, 173 aa, Panicum virgatum
  misc_feature: Ceres CLONE 1822179
  misc_feature (10)..(60): Pfam Name: Myb_DNA-binding Pfam Description: Myb-like DNA-binding domain
GLCEMGEDIAQGWTEDEEKLFERVVFSNPVSLGKNFWDHLPHAFPSKTSKDLVSYYFNVFMLRKRAQQNRSDQLRVDSDDDELHGDSPVPGQEEEDSAVKSPKREYFVNNSLPIEGNHKEYEGEHIAGPSFHGEEIENAGECRHLPNQMPLYSTAVNIAHIYNQDELQASFDG

SEQ ID NO: 22554 - DNA, 1331 bp, Panicum virgatum
  misc_feature: Ceres CLONE 1822231
  misc_feature: Encodes the peptide sequence at SEQ ID NO. 22555
ctatcgaatactctactgctactgtagtagctagctagcgagcgcgccgccatgggtgacacgggcgcgaacatggcccactgggccgggctctacggcggcgggaacggcgcgccggcggcggggacggaggcggccgtggtgacggcgtcgagctcgacgtccggcggcagcccgacccgggcgcagccgggggtcgagggcgggcgcgtcgcgaagcccgcgcggcggcggtcccgcgcgtcccgccgcgcgccggtcacgctgctcaacacggacacctccaacttccgcgccatggtgcagcagttcaccggcatcccgcccggcccctacggccccgccggcggcgccggcgggcccgtgatcagcttcggcgccggcggcggggactacggcggtggcgccgcgcttgtgcgcccgtcgccgacgtcggccgtcatgtcgttcgaccacctggcggcggcggcgttgcagcagcagcagcaccaccaccggcacgcgtcgctgcasggccagctcttcaggccgcagcagcagtacgccgccgacgtcggctacggcggcggcggcggggacatgccgccgttcctgcacgggttcgagtcgtcggcggaggatcggctgctgctccagagcatccaggcggcgcagatgatgcccacccgcccgtcctccaccactagcaacagcaatggctacaacttcggctgatcgatctgccacctaccgccaaccagagctcgatcaacaaggtaacaacaacaataatagaaccaaggtcacttgatcagatccagggagatcaagaagccattagtttgatttgtgatcacggcgtgcatggtcgtcgtcgatcacgagctgaccgatgatgtttgttcttgcttgtcgctgatgctcaagcattatttcgttttgtttttgttggccttgccgtgtgatcagaggccaattaaggtttgcttaattagcagtttagcacacagtaattagtactactactccactagtagtagctttgctgctttagaagaagtcaagctagctaggtgctttagatgtgaaacgaagtgcagagaaaagaggcatcatgtaaatatggttggcagtaaaaagttgggcgcgcgtgcgctttcggtgtgtagtagcgcagctgatacttgatagcgaggaatctttctagagagagagattagattattgccttggctcggaagcaaagtccgggatggctgctacatgcttgtactgatcaccaattatgaagtcccgccgctaattgactgcatcctgatgatcaaataagtgttgtactgtaacttgttttc

SEQ ID NO: 22555 - protein, 220 aa, Panicum virgatum
  misc_feature: Ceres CLONE 1822231
  misc_feature (66)..(96): Pfam Name: VQ Pfam Description: VQ motif
  misc_feature (154)..(154): Xaa is any aa, unknown, or other
MGDTGANMAHWAGLYGGGNGAPAAGTEAAVVTASSSTSGGSPTRAQPGVEGGRVAKPARRRSRASRRAPVTLLNTDTSNFRAMVQQFTGIPPGPYGPAGGAGGPVISFGAGGGDYGGGAALVRPSPTSAVMSFDHLAAAALQQQQHHHRHASLXGQLFRPQQQYAADVGYGGGGGDMPPFLHGFESSAEDRLLLQSIQAAQMMPTRPSSTTSNSNGYNFG

SEQ ID NO: 22556 - DNA, 684 bp, Panicum virgatum
  misc_feature: Ceres CLONE 1822241
  misc_feature: Encodes the peptide sequence at SEQ ID NO. 22557
gcaaaaatcaaacgcccgagctccaaacccgacccggcgaccggcgtgcgtgggcggacagcggacagagcgagagagagagagtcggcggcggtgaccggcggccggcggggcgacgagatggcgaaggggttcgcgtcgtacctggcgatgaagacgggcccggaggccggggactcgtcggcggcggtgcaggcgctcatcgacgccgacctgcgggagatcggcgtcgccgcgcggaagctcgccaaccacgccttcgtcctcggcggcgggctcgacttcggcacctccttcctcaagtggcttgccttcgtcgccgcagtgtacctcttgatattggaccgcacaaactggaagaccaacatgatgacggctctcttggttccctatgttttcttcacactacctcatgtgcttttttctctgataaggtgaattggctcatacaccctaccacattgcctatcctctaggttctagatgcaatcaccatcttccatgagactgttcgtaattgtcatctaccatgtgccatgagactattcgcaatcgttatctatcatgactggttctgtaatgtgagttatgtggagtaaacttttaggatcaaagtacttgtgatttcatgctgtcatctcttagatgatctcttagtataacagcttgaatgggtaaaaactg

SEQ ID NO: 22557 - protein, 105 aa, Panicum virgatum
  misc_feature: Ceres CLONE 1822241
  misc_feature (9)..(105): Pfam Name: WCOR413 Pfam Description: Cold acclimation protein WCOR413
MAKGFASYLAMKTGPEAGDSSAAVQALIDADLREIGVAARKLANHAFVLGGGLDFGTSFLKWLAFVAAVYLLILDRTNWKTNMMTALLVPYVFFTLPHVLFSLIR

SEQ ID NO: 22558 - DNA, 1294 bp, Panicum virgatum
  misc_feature: Ceres CLONE 1822244
  misc_feature: Encodes the peptide sequence at SEQ ID NO. 22559
cgtccgctcccaccgcgcaacccgccggggcgccgccgccggcgatgaccaccccgcagtccgtctccacctctcccgcccgtatatcctacacgccgacctccccatttccaagatccttggggagggattgcggtcgggtcctcgctttccccgctaggccgcgcggtttctcgctccgcctcaggtcgtcgactgttatggccgccgccggcgtcggcggcagcggctcccccgccgcgcccggagactccacagggtcttctaggatcggagaggttaagagagtgaccaaggagacaaatgtgcatgtgaagataaaccttgacggcaccggtgttgccaactgtagcacagggataccgttcttggatcatatgctcgatcaactggcatcacatggactctttgatgtgtacgttaaggcaacaggtgacacacacattgatgatcatcactcaaacgaggacattgctctggcaattggaacggcactgcttcaatcacttggtgatcggaaagggtttaaccgatttgggcattttactgcaccactcgatgaggcagcagttgaggttatactggatctgtcgggtcgtcctcatttaagctgcggcttagatattcctactcagagagtcggtacatatgatacacagctggttgaacactttttccagtctttggtgaatacatctgggatgactcttcacatccgtcagcttgctgggaagaactcacaccatattatcgaggcatgtttcaaagcatttgctagggcccttcgacaagcaacagaatatgacctgcgccgtcatggcactgtccccagctccaaaggtgttttgtcaagatcatagcactacaggttcaaacgattgcttgccagcttttagcttgcagctatcagaggaaacaaacaaagcgggcagctatacacagcttggtttgttctgctttacatcgggagtctgcattacctttgacaacaagttatggcatccttgctaatgagattgtcaaaaatcgaatgtgccaccacccggtattgggcttatttacaacagcggtctaatgcatctgctcgctgctgcaattttctctgctgtcgggagctacgagattatctgaagattggaaaggagtagacaataagctgcgactctgaaagcaactccagtcaggattcaagaataatgctgtgccttgtataaactttgcagcatgggctgatttgagccgcatatgtaatgattgtcatttttcaagggaataaaattgtttctgtgcgtcc

SEQ ID NO: 22559 - protein, 271 aa, Panicum virgatum
  misc_feature: Ceres CLONE 1822244
  misc_feature (104)..(248): Pfam Name: IGPD Pfam Description: Imidazoleglycerol-phosphate dehydratase
  misc_feature: SWISSPROT Homolog: EC 4.2.1.19 Imidazoleglycerol-phosphate dehydratase
MTTPQSVSTSPARISYTPTSPFPRSLGRDCGRVLAFPARPRGFSLRLRSSTVMAAAGVGGSGSPAAPGDSTGSSRIGEVKRVTKETNVHVKINLDGTGVANCSTGIPFLDHMLDQLASHGLFDVYVKATGDTHIDDHHSNEDIALAIGTALLQSLGDRKGFNRFGHFTAPLDEAAVEVILDLSGRPHLSCGLDIPTQRVGTYDTQLVEHFFQSLVNTSGMTLHIRQLAGKNSHHIIEACFKAFARALRQATEYDLRRHGTVPSSKGVLSRS

SEQ ID NO: 22560 - DNA, 1627 bp, Panicum virgatum
  misc_feature: Ceres CLONE 1822261
  misc_feature: Encodes the peptide sequence at SEQ ID NO. 22561
tttgtggtttcggtaccctcgattttgactgatcagagaaagaatggaagagttacaagatagcaactcgaaaagcctggttgcccttccaggctctttggttctgcatctctttaggctgtttggtcagcaggatcagagttcatggcagaagtacatactagcttactttctgttggtcaggaatgaatacttctctggggagtcgaagagacactcagatgtgttctgtgatatttcagagttagatgtatttccatatgctatagatctggacagtgaagaacttgaactgaatgagcagaaacctattctgaaggctcagtcgggaggtgattcaagtggtaacagatcaaatgattgctactttccaggccttcatgatgatctgtctcaagactgccttgcttggtcaagcagatcagactacccttccctttcttgtctgaataaaagattcaatttgttaattaacagtggatatctgtacaaattgcgaaggaaatatggcattgttgagcattgggtgtatctcgcttgtagcttgatgccctgggaagcatttgatcccaaccgaaagcggtggatgaggctcccgagaatgccatgcgacgagtgcttctcctgtgcagacaaggaatcgcttgccgttgggacacagctgcttgtctttggccgtgaatatactggccttgctatttggatgtacaacttactggctcgcagttggtcccggtgcactccaatgaatctgccccgctgtctttttgcctcgggaagctcaggagagattgctattgttgctggtgggtgtgataagaatggacaggtgctgagatctgctgagttgtacaactcagagaatggctgctgggagactatcccagacatgaacttagccaggaggctctcttcaggtttcttcatggatggcaagttctacgtcattgggggtgtatcaagtcagagggattcattgacttgtggagaggaatacaaccttgagacaaggacctggagaagaatactggatatgtatcctggtggaaccagtgcttctcagtcacctcctcttgttgctgttgtgaataaccagctctatgccgctgaccagtcaactaatgtggtcaagaagtatgacaaggcaaataacacctggaacatactgaagccattgcctgttagagctgactcatccaatggttggggcttggctttcaaggcttgtggcgacagattgttggtaatcggcggccacagagggcctcgtggtgaggtaatattgctgcattcctggtgccctgaaggtggggaggatggtgctgactgggaggtgctctcggtgaaggagcgtgcgggcgtcttcgtttacaactgtgcaataatggggtgctgagttaccttcgcttcagtacatgccgctggtttagcaagccaacaatttcttgttgccctttacctaccctttataatgacttgtaattcagaaatgacacacccccttttcgtggagctctcgattgattgaatgtttggtagagagcatagagcattcagttcagtttacctggaacttctttttccccctgttaaactcgttcagaattccttgttcttgtccagtatg

SEQ ID NO: 22561 - protein, 450 aa, Panicum virgatum
  misc_feature: Ceres CLONE 1822261
  misc_feature (238)..(284): Pfam Name: Kelch_1 Pfam Description: Kelch motif
  misc_feature (286)..(332): Pfam Name: Kelch_1 Pfam Description: Kelch motif
MEELQDSNSKSLVALPGSLVLHLFRLFGQQDQSSWQKYILAYFLLVRNEYFSGESKRHSDVFCDISELDVFPYAIDLDSEELELNEQKPILKAQSGGDSSGNRSNDCYFPGLHDDLSQDCLAWSSRSDYPSLSCLNKRFNLLINSGYLYKLRRKYGIVEHWVYLACSLMPWEAFDPNRKRWMRLPRMPCDECFSCADKESLAVGTQLLVFGREYTGLAIWMYNLLARSWSRCTPMNLPRCLFASGSSGEIAIVAGGCDKNGQVLRSAELYNSENGCWETIPDMNLARRLSSGFFMDGKFYVIGGVSSQRDSLTCGEEYNLETRTWRRILDMYPGGTSASQSPPLVAVVNNQLYAADQSTNVVKKYDKANNTWNILKPLPVRADSSNGWGLAFKACGDRLLVIGGHRGPRGEVILLHSWCPEGGEDGADWEVLSVKERAGVFVYNCAIMGC

SEQ ID NO: 22562 - DNA, 701 bp, Panicum virgatum
  misc_feature: Ceres CLONE 1822262
  misc_feature: Encodes the peptide sequence at SEQ ID NO. 22563
agagccgtcgtcctcgcccctccccgtccccagcgaagccaagccggcacaatgccaggcgccgccgtggcctcgcctctcctcctctcgctctcctcgtcctcctccccattcctctcttccccatccacttccttcctgccgcccacttcctccgctgccccgcactccgccggcaggaccaaggcggcggtctccgtcctccgcgcgctgcgggccgaggcggccaccctccccgtgctctccttcactggagacaaggtcggggaggtcaccctcgacctcaagtccgcgccgccctccaccgcgcgcgccgtcgtgcaccgcgccatcatcaccgaccgccagaacgcgcgccggggcacggcctccacgctcacccgcggcgaggtcagcggcggagggaggaagccctaccagcagaagaagacggggaaggcgcggcgcgggtcgcagcgcaccccgctccgcccaggtggtggcgtcgtgttcggccccaagccccgcgactggtccatcaagatcaaccgcaaggagaagcgcctcgccatctccaccgcgctcgccagcgccgccgtggccgaggacgccttcgtcgtcgaggagttcgacgaggccttcgcgtcagggcccaagaccaaggacttcgtggccgctctgcagcggtgggggctcgaccccaagcagaaagccatgttctt

SEQ ID NO: 22563 - protein, 216 aa, Panicum virgatum
  misc_feature: Ceres CLONE 1822262
  misc_feature (73)..(216): Pfam Name: Ribosomal_L4 Pfam Description: Ribosomal protein L4/L1 family
MPGAAVASPLLLSLSSSSSPFLSSPSTSFLPPTSSAAPHSAGRTKAAVSVLRALRAEAATLPVLSFTGDKVGEVTLDLKSAPPSTARAVVHRAIITDRQNARRGTASTLTRGEVSGGGRKPYQQKKTGKARRGSQRTPLRPGGGVVFGPKPRDWSIKINRKEKRLAISTALASAAVAEDAFVVEEFDEAFASGPKTKDFVAALQRWGLDPKQKAMF

SEQ ID NO: 22564 - DNA, 1500 bp, Panicum virgatum
  misc_feature: Ceres CLONE 1822264
  misc_feature: Encodes the peptide sequence at SEQ ID NO. 22565
gaccccggttccaaccctagccgcccctacctctcctcgcgacacaacagcgccgccctccccctcgctccctcgatctgccctgccgccggccaccctcctttctgtctccacccgccgcaccccccagcaccatctcccttgctgcagcccgccgccttccccctcgctccgccctcctcgcggggccccgccgcgtccctctgcagcggcccccatgccgcccctgcacctccccggcgagtccccacgccgcccctgcgtctctcgcggcaagtccccgcgtcgccgctgctcctgcccgccggatccgccgcgcgtagggagtaggagcaggaccctcgtggggagcagctggaccacgccactgacaacaccggcgccatggtcctcgcggccgcagccgcactctacgctcagcggggccagaagcacgacgacgacttctacacggctacctgcacctcttctgcctttgactgccaccatgattaatcccatgtgccctctttttttttccccatcgtgaatccctaaatccctagatgttggtgtttttttttattttgctgcatctgatctgaaaatgaatgtaaaacatgcgtgtttggacattggagaatatgcagggcttttcatctagacatggcggcagtagagtgttgtaatgaatgtatatctcctatatcttgtatgtagagatttgctctctggtgcttattagaaattagagtagagagagaaatttacattttttcaggtagtggggaaaataggttagtagatatcacacaaaggcgtactgattttctgctttattgcctgttcattttgctcaattttacttgacccccttttcgctattgctataaatgcaggatacagttttggaactggaatttcaagggatcaaaagcagttcactatgctccagacatggcctgtgcgctcaccaaggcctattgcatcaaagcttgttgctgatacacctctcttaacaggacagcgtgtgctcgatgcattgtttccctcagtgcttggagggacatgtgctattcctggggcgtttggttgtggaaaaactttcattagtcaggcagtttcaaagtattccaattttgaagctgtggtttatgagggctgttgggaacgagggaatgagatggctgaccttatggatttccctcaattgacaatggtatcctaaagcacgacggtaatatgaggagaggtaggggccggccgaagttgacatgggaagaaacaattagaagagacttgaaagactggagtatacctagagatttgtccttggataggagtgcttggaaagccgcgattcacgtgccagaaccatgaataatggtctttgttgggtttcaactctagcctaccccaacttgcttgggattaaaaggctttgttgatgttgacaatgacattgaaggatggacgtgaagaatcagtcattaatagaacaactcttgtggctaacacctc

SEQ ID NO: 22565 - protein, 93 aa, Panicum virgatum
  misc_feature: Ceres CLONE 1822264
  misc_feature: SWISSPROT Homolog: EC 3.6.3.14 H(+)-transporting two-sector ATPase
MLQTWPVRSPRPIASKLVADTPLLTGQRVLDALFPSVLGGTCAIPGAFGCGKTFISQAVSKYSNFEAVVYEGCWERGNEMADLMDFPQLTMVS

SEQ ID NO: 22566 - DNA, 674 bp, Panicum virgatum
  misc_feature: Ceres CLONE 1822276
  misc_feature: Encodes the peptide sequence at SEQ ID NO. 22567
gacgccacacgcacaatagcagtaagacacacacacacagctagcgtagcaagaagtccagttaggtaaaagatgaaggtggcgactagtacaaggggcatcgttgtcctcatcggcagcatgctgctcgtctcggcatgggcatcggcagccagcaacatgcctctggcgacgaaggacgccggcgccagcttgtccgccgacttccacgcggcgtcatgcccgcagctggagagcatcgttcgcgccgccgtgcaggccgcgcgggccgtcaatgtgcaggtcaccgccggcctcctccggatcttcttccacgactgctttccggagggttgcgacgcgtccatccttcttgagccggagctgagcacggggcccaaccaatcgctgcagaagaacgctgtggatctgatcgaggccatccgagccaaggtccacgccgcctgcgggcccacggtctcctgcgccgacatcatcgcgctggccacccgcgacgccgtggccctggccggcgggccgacgttcgccatgcccctgggccgcaccgacagcctggagggcgcggacgacgtgtccatgctcccgggccccaacaccgacgtcgacagcctcctcaccgtcttcaatagcagggccctgtccgacccggccgacctggtggcgctctccggcgg

SEQ ID NO: 22567 - protein, 200 aa, Panicum virgatum
  misc_feature: Ceres CLONE 1822276
  misc_feature (57)..(200): Pfam Name: peroxidase Pfam Description: Peroxidase
  misc_feature: SWISSPROT Homolog: EC 1.11.1.7 Peroxidase
MKVATSTRGIVVLIGSMLLVSAWASAASNMPLATKDAGASLSADFHAASCPQLESIVRAAVQAARAVNVQVTAGLLRIFFHDCFPEGCDASILLEPELSTGPNQSLQKNAVDLIEAIRAKVHAACGPTVSCADIIALATRDAVALAGGPTFAMPLGRTDSLEGADDVSMLPGPNTDVDSLLTVFNSRALSDPADLVALSG

SEQ ID NO: 22568 - DNA, 1334 bp, Panicum virgatum
  misc_feature: Ceres CLONE 1822303
  misc_feature: Encodes the peptide sequence at SEQ ID NO. 22569
agaacccagagagcttcataagctcatttgtttcttcctctttgtatctagcttctgcgcttccgtgctgtcacgcccatatacatctctatcttgctctcgtagagagctagctagctcgtattgtattgagacttcagcaccatcttcttcaaggcagcgatcatggtctccccggacaccgtacggtgcgccattggcgtcatcggcaatgggactgccctggtgctctttctctccccagtgccgacattcatccgcatctggaagaagaggtcggtggagcagtactcgccggcgccgtacgtggcgacgctcctcaactgcatgatttgggtgctgtacggcctgccgctggtccaccccaacagcatgctcgtcgtcaccatcaacggcaccggcctggtcatcgagcttatctacgtcacgctcttcctcctctgctccaggggggccgcccgccgcaaggtcttcctcctcctcgccaccgaggtcgccttcgtcggcgctgtcgctatccttgtgctcagcctggcgcacacgtacgagcggaggtccatgatcgtcggcatcctcggcgtcctcttcggcatcggcatgtacgcggcgccactctccgtcatgaaaatagtgatccagacgaagagtgtggagtacatgcccctgtccctgtccctggcctccctggtgaatgccatctgctggactgcatacgccctcatcaaattcgacctctacatcaccatccccaatgggctaggggtgctcttcgctggggcgcaggtggtcctgtacgccatctactacaagtccacccaggagatcatcgaggtgcgcaagcgcaagacaaacgaggtcgccatgaccgaagtcgtcgtcaacgatggcaagaccaacaaccacaccggcgccagcctctactgatgaagagatcgatgataccaagattatggatctgaagcgattgtatctgtactgtgtgattatgatcagctatcaactatcaagtcgccgctgtccgtattgtgtgattgtgttcttcccacaagggatgaatgcctgtatgtggcctgttgttgccaaagtcctcgcgcagctggtcggagtcatgggcctcattaggtcggacaacaagatggggattctaactagttccagcttccgagtaagtttggattaattgcactgtttagtggtatttattaatggtctcttattgtctctaatgtatattgatcgccaaactcttctagacatgcacaaaggcatgcttaggaatcacgactccttgttttaaattgaatggatggaattctcaaatgcttcttctattc

SEQ ID NO: 22569 - protein, 252 aa, Panicum virgatum
  misc_feature: Ceres CLONE 1822303
  misc_feature (132)..(218): Pfam Name: MtN3_slv Pfam Description: MtN3/saliva family
  misc_feature (9)..(98): Pfam Name: MtN3_slv Pfam Description: MtN3/saliva family
MVSPDTVRCAIGVIGNGTALVLFLSPVPTFIRIWKKRSVEQYSPAPYVATLLNCMIWVLYGLPLVHPNSMLVVTINGTGLVIELIYVTLFLLCSRGAARRKVFLLLATEVAFVGAVAILVLSLAHTYERRSMIVGILGVLFGIGMYAAPLSVMKIVIQTKSVEYMPLSLSLASLVNAICWTAYALIKFDLYITIPNGLGVLFAGAQVVLYAIYYKSTQEIIEVRKRKTNEVAMTEVVVNDGKTNNHTGASLY

SEQ ID NO: 22570 - DNA, 685 bp, Panicum virgatum
  misc_feature: Ceres CLONE 1822312
  misc_feature: Encodes the peptide sequence at SEQ ID NO. 22571
gcctccaccgttcgtcccctcccaaaccgcggcaactgccaccggacccgcccgcgccgccgcgcccgcacctactccccccgccggtgctctccttgcgacccgctggcgccgatccaggagcaacgccgccgccgggggccatgacctccgctcactccaagctctactccgatgacgtcagcctcgtggtggtggtcgtcgacacgaaccccttcttctgggccgccgctgcgctccccttcgccgacttcttcgcgaatctgatccacttcgtgaactcactcctactgctgaaccacctcaaccgtgtggtcgtcatcgccgctggagtcagctcctgtgcctacatctttgattccagcgatgccagccccgctggtggtgtaggcgtcacggccacctttgaaaacgcaagccgcaaggtggaggagttcattgcacaagatgctcgtgccactgcgggcaacggttccgttgcttctgccaatgccgcgtcactgctgtctggggcactgtcccttgctttgtgctatatacagagggttttcaggtctgggactcgacatccgcaacctcggggttctccagatggtcctgaacaatatgtggcagtgatgaattcaatattttctgctcaacgttccatggtatcacatcagtcctctaaccccattttagtctc

SEQ ID NO: 22571 - protein, 180 aa, Panicum virgatum
  misc_feature: Ceres CLONE 1822312
  misc_feature (12)..(180): Pfam Name: Tfb4 Pfam Description: Transcription factor Tfb4
MTSAHSKLYSDDVSLVVVVVDTNPFFWAAAALPFADFFANLIHFVNSLLLLNHLNRVVVIAAGVSSCAYIFDSSDASPAGGVGVTATFENASRKVEEFIAQDARATAGNGSVASANAASLLSGALSLALCYIQRVFRSGTRHPQPRGSPDGPEQYVAVMNSIFSAQRSMVSHQSSNPILV

SEQ ID NO: 22572 - DNA, 666 bp, Panicum virgatum
  misc_feature: Ceres CLONE 1822328
  misc_feature: Encodes the peptide sequence at SEQ ID NO. 22573
gagcgtcaggataagaaaaccgcccgggctgcgcggaggaccgaccgagcggaggcagctcctccggcgactgcgagcgccaggctatggcgtccctctccccttccctgcacctcccgtgcaattcaagaactggcttccttggaaagacacaagggattcgtcctcgtgttacccctgttggcagagttgggtttgtcagaacagtagtggaatgcaaggaatctagaattggaaagaagcccatcgaagttccatcaaatgttactctcacattagaggagcagtttgtcaaagctaagggtccgctaggggagttatcactgagctatccaggtgaagtgaaagttgtgaaacaagaatctggtaagctgagactttttaagactgcagagaccaagagggcaaatcagatgcacggacttttcagaacattgacagacaacatcatcgttggtgtgtcgaaaggattcgataagaggcttcaattagtgggtgttggatatcgtgctgcggtggagggcaacgatctcgtgatgaaccttggtttctcgcaccctgttcggatggctatacccgaaggcctcaaggtcaaggtggaagagaacaccaggatcattgtgagcggctatgacaagagcgcaatcggtcagtttgctgctacca

SEQ ID NO: 22573 - protein, 193 aa, Panicum virgatum
  misc_feature: Ceres CLONE 1822328
  misc_feature (56)..(128): Pfam Name: Ribosomal_L6 Pfam Description: Ribosomal protein L6
  misc_feature (136)..(193): Pfam Name: Ribosomal_L6 Pfam Description: Ribosomal protein L6
MASLSPSLHLPCNSRTGFLGKTQGIRPRVTPVGRVGFVRTVVECKESRIGKKPIEVPSNVTLTLEEQFVKAKGPLGELSLSYPGEVKVVKQESGKLRLFKTAETKRANQMHGLFRTLTDNIIVGVSKGFDKRLQLVGVGYRAAVEGNDLVMNLGFSHPVRMAIPEGLKVKVEENTRIIVSGYDKSAIGQFAAT

SEQ ID NO: 22574 - DNA, 628 bp, Panicum virgatum
  misc_feature: Ceres CLONE 1822344
  misc_feature: Encodes the peptide sequence at SEQ ID NO. 22575
caactcaatactatgctagctcacatcaaagtgaaacaactggtatgggtgaacatggagtgtatccgtcataccaaccaggttctgttcctcttggactttatgcagtacaaggagagaacatatttcctgagagacctgaccagcctgagtgtcagttctatatgaaaaccggagactgcaagtttggtgctgtttgcaagtttaatcaccctaaggagcgtctgattcctgctccaaactgtgcattgagtccattaggtcttccacttcgcccgggagaacctgtctgcaccttctattctcgttacggcatctgcaagttcggtccaaattgcaaatttgaccatcctatgggaacccttatgtacggaaccgcaacctcaccgacaggtgatgcgccaaccatgcactaccagttggcatcctcaccagggcattctgaaagattgctcgacggagggtccggaaggtctcataggatttcccaaactgattcccagcaaataccctccggcaatggaagcactgagagagaggcgtcataagccgccctccctcaccttcctcatgcttattcccattcttgtctcttcagtaattatctccccacacattcaaagagctg

SEQ ID NO: 22575 - protein, 181 aa, Panicum virgatum
  misc_feature: Ceres CLONE 1822344
  misc_feature (46)..(72): Pfam Name: zf-CCCH Pfam Description: Zinc finger C-x8-C-x5-C-x3-H type (and similar)
  misc_feature (92)..(118): Pfam Name: zf-CCCH Pfam Description: Zinc finger C-x8-C-x5-C-x3-H type (and similar)
  misc_feature: Useful for making plants with modulated nitrogen use efficiency
  misc_feature: Useful for making plants with modulated low light sensitivity
TQYYASSHQSETTGMGEHGVYPSYQPGSVPLGLYAVQGENIFPERPDQPECQFYMKTGDCKFGAVCKFNHPKERLIPAPNCALSPLGLPLRPGEPVCTFYSRYGICKFGPNCKFDHPMGTLMYGTATSPTGDAPTMHYQLASSPGHSERLLDGGSGRSHRISQTDSQQIPSGNGSTEREAS

SEQ ID NO: 22576 - DNA, 664 bp, Panicum virgatum
  misc_feature: Ceres CLONE 1822352
  misc_feature: Encodes the peptide sequence at SEQ ID NO. 22577
ccaccatcaccgagctctgcatctctctcggcacgcgcactcgtcgaggtgcttgatggcgaccgaagtggctgacgctccggtgccgctgccggaggcgggccccgacaccgccgcggaggcccctgccgcggacgccgccgcggccgccggcgacgcgaagccggccaaggccaagaaggccgcagcgccgcggaagcgcgcgaacccgacccacccgccgtacgccgagatgatctcggaggcgatcacgtcgctcaaggagaggacggggtcgagccagtacgcgatcgccaagttcctggaggacaagcacaaggacaagctgccgcccaacttccgcaagatgctgctcgtgcagctgaagaagctcgccgccgccggcaagctcaccaaggtcaagaactcctacaaggtgccgtcggggcgcgccccggccgccgacaagcccaagcccaaggccaaggccaagaagcctgctgccgccaagccgaagccgaagcccgctgcgaagaagcccaaggccgccgccaagcccaaggccaaggcgcccgccaagaccaagcccgctgcgaagccgaaggccgccgccaagcccgcggccaagccgaaggctgtcgctgcgaagcccaagccagccgcccagccggctgccaagcccaag

SEQ ID NO: 22577 - protein, 202 aa, Panicum virgatum
  misc_feature: Ceres CLONE 1822352
  misc_feature (53)..(123): Pfam Name: Linker_histone Pfam Description: linker histone H1 and H5 family
MATEVADAPVPLPEAGPDTAAEAPAADAAAAAGDAKPAKAKKAAAPRKRANPTHPPYAEMISEAITSLKERTGSSQYAIAKFLEDKHKDKLPPNFRKMLLVQLKKLAAAGKLTKVKNSYKVPSGRAPAADKPKPKAKAKKPAAAKPKPKPAAKKPKAAAKPKAKAPAKTKPAAKPKAAAKPAAKPKAVAAKPKPAAQPAAKP

SEQ ID NO: 22578 - DNA, 1311 bp, Panicum virgatum
  misc_feature: Ceres CLONE 1822359
  misc_feature: Encodes the peptide sequence at SEQ ID NO. 22579
acattcactcgcccgctcctgtcactcaccaagaaccgggagagggagggaggggaggagatcagctctttcgtttcttcctcctctgatccgtgcccgctccagccaccgcatttcctccccacctccctcccccgacgcctccggagagctcgagctcaccggcggccgcaagcgagcgagcgagttccgtcgccgccgaagccggagagctcgccaccgacgaccatggtcccggccgacaccatccgcacggccatcggcgtcatcggcaatgggaccgccctcgtgctcttcctctccccagtgccgacgttctaccgcatctggaagaagcgcgcggtggagcagtactcggcgatcccgtacgtggcgacgctgctcaactgcatgatgtgggtgctgtacggcctccccgcggtgcacccgcacagcatgctcgtcatcaccatcaacggcaccggcatggccatccagctcacctacgtcgccctcttcctcctctactcggcgggcgccgcccgccgcagggtgctcctcctgctcgccgccgaggtcgccttcgtcgccgccgtcgccgccatggtgctcaccctcgcgcactcgcaccagaagcggtccatggtcgtcggcgtcctctgcgtcctcttcggaaccggcatgtacgccgcgccgctcgccgtcatgaaaatggtgatccagacgaagagcgtggagtacatgcccctgttcctgtcgctggcgtccctggggaacggcatctgctggaccgcctacgccctcatcagattcgacctctacatcaccatccccaacgggctgggcgtgctcttcgcggtggcgcagctggtcctctacgccatctactacaagtccacgcagcagatcatcgaggcgcgcaagcgcaaggccggccaggtcgccatgaccgaggtcgtcgtcgacgcgcccgccacagccaggggcaccggccccaacgccaccgccaccagcataggcggctactgatgccggcgggggcgcaccggcggcgaccggggagaactaagcagcggccaccgtcttccttctctctccttcccgaagggatggatggatcgaacgatgccttcgcatcctgtgataaatacgctgctgtcgccgccgtcctcgccgctccgattttagattttgcttcctacctactactagtaaccatgaggaagagaggggaaaaaaagacatgagaaaaaactccagaacaagggctgcactgcacctgctgtgcttacctttttaatcgcatatatgatcatctcctggtgcggtgtt

SEQ ID NO: 22579 - protein, 259 aa, Panicum virgatum
  misc_feature: Ceres CLONE 1822359
  misc_feature (132)..(218): Pfam Name: MtN3_slv Pfam Description: MtN3/saliva family
  misc_feature (9)..(98): Pfam Name: MtN3_slv Pfam Description: MtN3/saliva family
MVPADTIRTAIGVIGNGTALVLFLSPVPTFYRIWKKRAVEQYSAIPYVATLLNCMMWVLYGLPAVHPHSMLVITINGTGMAIQLTYVALFLLYSAGAARRRVLLLLAAEVAFVAAVAAMVLTLAHSHQKRSMVVGVLCVLFGTGMYAAPLAVMKMVIQTKSVEYMPLFLSLASLGNGICWTAYALIRFDLYITIPNGLGVLFAVAQLVLYAIYYKSTQQIIEARKRKAGQVAMTEVVVDAPATARGTGPNATATSIGGY

SEQ ID NO: 22580 - DNA, 672 bp, Panicum virgatum
  misc_feature: Ceres CLONE 1822361
  misc_feature: Encodes the peptide sequence at SEQ ID NO. 22581
aagcgaaagctcaagcaatccaacctttagcgcctaatccacactccaatcgagcaccaaacagcctccagatccccagacagagctctcccacccgtagcctctgcagcgagatggctcccgagctcgccggcaagatgaccgccaaggccgccgccgccgccgcggtgaagcccgcgaccagggcgtacgtgacgttcctggcgggcgacggcgactactggaagggcgtggtgggtctggccaagggcctgcgcaaggtcggctcggcgtacccgctggtggtcgccgtgctgcccgacgtgccggagtcccaccgccgcattctcgtctcgcagggctgcatcgtccgcgagatagagcccgtgtacccgccggagaaccagacgcagttcgccatggcctactacgtcatcaactactccaagctccgcatctgggagttcgtggagtacgagcggatggtgtacctggacgcggacatccaggtgttcgagaacatcgacgagctgttcgagctcgagaagggccacttctacgcggtgatggactgcttctgcgagaagacgtggagccacaccccgcagtacaagatcggctactgcccgcagtgccccgacaaggtggcctggcccaccgccgagctccgccccccgccgcccctctacttcc

SEQ ID NO: 22581 - protein, 186 aa, Panicum virgatum
  misc_feature: Ceres CLONE 1822361
  misc_feature (27)..(186): Pfam Name: Glyco_transf_8 Pfam Description: Glycosyl transferase family 8
  misc_feature: SWISSPROT Homolog: EC 2.4.1.186 Glycogenin glucosyltransferase
  misc_feature: Useful for making plants with altered carbohydrate content
  misc_feature: Useful for making plants with modulated water use efficiency
  misc_feature: Useful for making plants with altered cell wall content and/or composition
MAPELAGKMTAKAAAAAAVKPATRAYVTFLAGDGDYWKGVVGLAKGLRKVGSAYPLVVAVLPDVPESHRRILVSQGCIVREIEPVYPPENQTQFAMAYYVINYSKLRIWEFVEYERMVYLDADIQVFENIDELFELEKGHFYAVMDCFCEKTWSHTPQYKIGYCPQCPDKVAWPTAELRPPPPLYF

SEQ ID NO: 22582 - DNA, 1217 bp, Panicum virgatum
  misc_feature: Ceres CLONE 1822384
  misc_feature: Encodes the peptide sequence at SEQ ID NO. 22583
ctcttctccgcgttttccacctcagtcctagctagcagctcctttactcctcatcccctttctgggcttgtgctccatctccatcccttccccccagcagcagcggcagccaagaagcgaggccgccgcgagggccggaggctgaagcaatgggcgaccgcgcgtacgcgccggcctcgaagccggtccccgtgcgggccaccaacggcacggcgaacggcggcgccggcgggccgccccggcccgcgccgccgtccatgctgcccggcggccgcgttcctcccccgccgatgtaccggccgaagcccgcgcagtcgcggccccctctccggcgcccccgtcggagcgcgcgcgggtggtgctgcgcgtgctgcctgtggctgacgctggtgctggtgggcctggtgctcctgggcgccatcgccgcggggatgttctacgtggtgtaccgcccgcagccgcccagcttcgcggtgacctcactgcgactggcggcgctgaacgtgtccgactccgacgcgctcacctcccgcatcgacttcacggtgacggcgcgcaaccccaacgagaagatcgcgttcgcgtacggcgacatggcggcgtccttcaccgcggacggcgcgcccctcggcgacggcgtggtcccggggttcctgcacgcgccggggaacacgaccgtcatccgcggcgccgcctccgccgccgcggccaccatcgaccccgtgcaggcggccgcgctcagatccagaaagtcccacgccatgtccgcggagatggacgccaaggtggggttccagatcgggcggttcaagtcgaagcgcatcagcgtccgcgtcctctgcgcgggcttctccgcggggctcgccaagccagccccgccgcccgcgcccgctccggcgccggacgcggagcccaccgtcatcgtcgccgccgcgccggcgccggcccgcgggcgcggccgcggccgcgggcgttccccgcggtcggtcgtccggacgtcgtcctcttcctccagttccggcggcgggaagatgacgccgacggacgcaaggtgtaaggtccgcatcaagatctggatttggtcgttttgatggattcggggcccggggtagaaagaaaaattttcgtttcaactttctcttctttttttcttgcttcttctctcttgacaacagtgtatgtggatgatttattggagtatagtctatatggtttcc

SEQ ID NO: 22583 - protein, 313 aa, Panicum virgatum
  misc_feature: Ceres CLONE 1822384
  misc_feature (97)..(231): Pfam Name: Hin1 Pfam Description: Harpin-induced protein 1 (Hin1)
MGDRAYAPASKPVPVRATNGTANGGAGGPPRPAPPSMLPGGRVPPPPMYRPKPAQSRPPLRRPRRSARGWCCACCLWLTLVLVGLVLLGAIAAGMFYVVYRPQPPSFAVTSLRLAALNVSDSDALTSRIDFTVTARNPNEKIAFAYGDMAASFTADGAPLGDGVVPGFLHAPGNTTVIRGAASAAAATIDPVQAAALRSRKSHAMSAEMDAKVGFQIGRFKSKRISVRVLCAGFSAGLAKPAPPPAPAPAPDAEPTVIVAAAPAPARGRGRGRGRSPRSVVRTSSSSSSSGGGKMTPTDARCKVRIKIWIWSF

SEQ ID NO: 22584 - DNA, 646 bp, Panicum virgatum
  misc_feature: Ceres CLONE 1822412
  misc_feature: Encodes the peptide sequence at SEQ ID NO. 22585
agactactgctgctactagcacagcgctgaaaccagcggcggcgagctcgagagagaaagagagagagctccccgtcaggaggcgatggcaactatggtgctcctgctgctcttgctggccatggcgttcagaggatcagaaacatgaggcatcaactagaggtatcccgtacccctgtcagtcctcagcactgtcaagactcgagacgttttcgccgaatcagacaacctgcgacctcattgtccaaacattcctttcctgttcctatcgatcgatcgatgaagctcgtttgccagtatgcagaacatcaataaggtttgtgcttgtcccgtgtgtggcatggatgcagacggctcgtggtgcgtgtgccggccggacgcgacggacgcggcgctgcagaggacgctggactacgcgtgcgggcacggcgcggactgcgccgccgtgctcccgacgggcccgtgctacagccccacctcggtgcgcgcgcactgctcctacgccgccaacagctacttccagcggaacagccaggccaacggcgccacctgcgacttcggcggcaccgccaacctcaccgacacggacccgagctctggaacctgcaaataccctgcgactccgagcgaggcgggggcaagcggc

SEQ ID NO: 22585 - protein, 115 aa, Panicum virgatum
  misc_feature: Ceres CLONE 1822412
  misc_feature (20)..(105): Pfam Name: X8 Pfam Description: X8 domain
  misc_feature: SWISSPROT Homolog: EC 3.2.1.39 Glucan endo-1,3-beta-D-glucosidase
  misc_feature: Useful for making plants with altered alkaloid content
  misc_feature: Useful for making plants with altered carbohydrate content
  misc_feature: Useful for making plants with altered cell wall content and/or composition
MQNINKVCACPVCGMDADGSWCVCRPDATDAALQRTLDYACGHGADCAAVLPTGPCYSPTSVRAHCSYAANSYFQRNSQANGATCDFGGTANLTDTDPSSGTCKYPATPSEAGAS

SEQ ID NO: 22586 - DNA, 1636 bp, Panicum virgatum
  misc_feature: Ceres CLONE 1822419
  misc_feature: Encodes the peptide sequence at SEQ ID NO. 22587
cgctggctcccaatccccatggtcggccccaagcccaaggccaaccggatgtgcaaatccaagagcgccgtcgccaccatcgcctccacctcctcctctaccacggccgccgccgccgccgccgccgccaccccgacgaaccaccgctcgccgcgcgcgaccgccaccagctcctaccctggcgccaactcctactccacctcctactccaccgactcctcctccgcggcctccctcgccgcgcttcgcgattccctctcggagctgccgctcctcttcaccttcaacgacctcgccgccgccaccgccaaattctccgcctcgcaccgcctcgtccccgccgcgccctcctcctcgaattccttccgctgctcgctccggggccacccagccgcggtcttccgccgcccgctccgccgcgacgcgcgcgaggtcaccacgcgcctcgctgtcctcggccactgccaccacgccgccatcgcgcgcctcctcggcgccgccgcgtcgcccgaccgccccacgctcttcctcgcctacgagctcgtccccgatgccgccccgctctccgcgctgctccggaaccccaagaacccgtccttcaccccgctcgccacctggcactcgcgcctccagctcgccgccgacgtctgcgacgcgctctactacgtccacctccaggcggacaccatccacaaccgcctctcggcgtcctccgtcctcgtctgcggcgacgggcccctcccccgcgccaagatcgcccatttcggcgccgccgacctcgccggcgagctcccggtcgaagagtctaggggcaacagcagcagctccggggcgcaccgccaccgcagcaggcgcatcgagggcaagcgcgggtacatggcgccggagctcgtggcgggcggcccgccgtcgcggcgctccgacgtgttcgcgctgggcgtggtgctgctggagctggtgtccgggcaggagccggtgcggtacgagatggtgaaccgggggggcacgggcgagtacgagaggacgtcgctgatcgagaccgcggaggccgcggcggcggagggcggcggggagggggtgcgccggtgggtggaccgcaggctgagggactcgttccccgtggacgcggcggagtcgctcaccgcgctggcgctgcggtgcgtggccaaggatcccctggcgcgcccggacatgtcgtgggtggccggcaaggtgtccaagctgttcctcgaggcgcaggagtgggcggccaggttccgtgtccccaccgacatctccatctccatcgcccccaggtgaggtggtggtggtggtggttcccgacgccggcgacggctgccagattttgctcatcttgccatgattgattagcgggtgctagagttgagatactactgatagaaagatggcagtgtgctgtagaggtgttccgaccaccgctgagcaagaactcgaattgattgattgttaatctgggaggagtttagggtttacataatactccactacagtagattctagtgctttgtttttttcctcttgttcttattgttgatgtacagaggagtgacatacagacatactagtaagtattcagacaccataaaaaaagtaggtattcaaacagagattctgc

SEQ ID NO: 22587 - protein, 426 aa, Panicum virgatum
  misc_feature: Ceres CLONE 1822419
  misc_feature (116)..(402): Pfam Name: Pkinase_Tyr Pfam Description: Protein tyrosine kinase
  misc_feature: SWISSPROT Homolog: EC 2.7.11.1 Non-specific serine/threonine protein kinase
MVGPKPKANRMCKSKSAVATIASTSSSTTAAAAAAAATPTNHRSPRATATSSYPGANSYSTSYSTDSSSAASLAALRDSLSELPLLFTFNDLAAATAKFSASHRLVPAAPSSSNSFRCSLRGHPAAVFRRPLRRDAREVTTRLAVLGHCHHAAIARLLGAAASPDRPTLFLAYELVPDAAPLSALLRNPKNPSFTPLATWHSRLQLAADVCDALYYVHLQADTIHNRLSASSVLVCGDGPLPRAKIAHFGAADLAGELPVEESRGNSSSSGAHRHRSRRIEGKRGYMAPELVAGGPPSRRSDVFALGVVLLELVSGQEPVRYEMVNRGGTGEYERTSLIETAEAAAAEGGGEGVRRWVDRRLRDSFPVDAAESLTALALRCVAKDPLARPDMSWVAGKVSKLFLEAQEWAARFRVPTDISISIAPR

SEQ ID NO: 22588 - DNA, 412 bp, Panicum virgatum
  misc_feature: Ceres CLONE 1822459
  misc_feature: Encodes the peptide sequence at SEQ ID NO. 22589
acaagcgacaacacccggtgcgcctctccttccccgtctccggccgttgcctcccccgtctccggctgcgccgccggcggtctcaccgcgaatcggagccgacaagatccgcccagcggatctcgtatcgggtcgttggatttgcgcgctgcggtggaaggttcagcggttgctcgatcccgaggcgagagggaagagatggggctcacgttcaccaagctgttcagccggctgttcgccaagaaggagatgcggatcctcatggtggggctcgacgccgccggaaagaccaccatcctctacaagctcaagctcggcgagatcgtgaccaccatcccccccatcggattatttgttgaaactgcggagtaccagaacatcctcttcattgtctgggaggtaggggggcagg

SEQ ID NO: 22589 - protein, 71 aa, Panicum virgatum
  misc_feature: Ceres CLONE 1822459
  misc_feature (5)..(71): Pfam Name: Arf Pfam Description: ADP-ribosylation factor family
  misc_feature: Useful for making plants with altered alkaloid content
  misc_feature: Useful for making plants with altered lignin content
  misc_feature: Useful for making plants with modulated nitrogen use efficiency
  misc_feature: Useful for making plants with altered terpenoid content
MGLTFTKLFSRLFAKKEMRILMVGLDAAGKTTILYKLKLGEIVTTIPPIGLFVETAEYQNILFIVWEVGGQ

SEQ ID NO: 22590 - DNA, 695 bp, Panicum virgatum
  misc_feature: Ceres CLONE 1822466
  misc_feature: Encodes the peptide sequence at SEQ ID NO. 22591
atcccaacccaattcccagtttcccacacgcctgctgccgcggccccaaatctagtagcacggccgccgcggcttctgaggcggcaccggcgcttccggcgatggcctcctccaactccagctccgccgccgccgccgcctcggccgctgacgggggcgacgacctcgatcagctcctcgacagcgcgctcgacgacttcaccagcctcgatctatccgccgccgccgctcccaaaagcagcggcagcgaggcctccgcgtcggcgtcggggtcggggtcgggtgccaaggggccggtgcttgggctggggctggggctgccggaccccaaggccccgaagcggcgcggggcgaaggcgccgccgccgccgccgccgaggggcgagtgcgcgaaggaggcgctcgagaagctcacgcgcgagacgcgggaggcggtgcgcgggctcgagacggccaccgggggtgtcccgtcgctgggcgacgaggccatgatggaggagttcgtcaagcagttcgaggagttcgcaggggcgcaggatatggactctattgttgaaacaatgatgcagcaacttttgtccaaggaaattcttcatgagcctatgaaagacattgtggaaaaatatccaaaatggcttgaggataacaaagataaaataagcaaagaagaatatgagcgttacaacaatcagctc

SEQ ID NO: 22591 - protein, 197 aa, Panicum virgatum
  misc_feature: Ceres CLONE 1822466
  misc_feature (30)..(197): Pfam Name: Pex19 Pfam Description: Pex19 protein family
MASSNSSSAAAAASAADGGDDLDQLLDSALDDFTSLDLSAAAAPKSSGSEASASASGSGSGAKGPVLGLGLGLPDPKAPKRRGAKAPPPPPPRGECAKEALEKLTRETREAVRGLETATGGVPSLGDEAMMEEFVKQFEEFAGAQDMDSIVETMMQQLLSKEILHEPMKDIVEKYPKWLEDNKDKISKEEYERYNNQ

SEQ ID NO: 22592 - DNA, 1102 bp, Panicum virgatum
  misc_feature: Ceres CLONE 1822479
  misc_feature: Encodes the peptide sequence at SEQ ID NO. 22593
accggcgaattccatttctcgcttcgcttgcttccacaactcgctttcttcatcttccccctctctttcctcgcctctcggtaaccgccgtagccaagaacctgacctcaccttctcctacggcggcgccggcggctggttctgcgccggcgtcgcgtgagatggaagactgcggcggcgtcgcggccggagtcgtcggcggggggagctgcggcaagaagccgttcctgctggcgcggtcgctgacgtatcaccaccatcaggggcaccggccggcggcggcgtcgtcggccaagtggcggcggcaccagctcgcggacgagccgcgcgcgcagcggccgcaggcggtggtgctctacacgacgtcgctgcggggcgtgcggcgcacgttcacggactgctccgcggtgcgcgccatcctgcgggggttccgcgtcgccgtcgacgagcgggacgtgtccatggatgcctccttccgcagggagctccaggcgctgctcgccgtgcgcggccgcgccttctctctcccgcagctgctaatcggcggccgcctcgtcggcggcggggacgaggtgcggcacctgcacgagaccggtcagctccggcggctcctcgacggcgccgcgggccaagacccggccttcgtctgcgacgcctgcggcggtgtccgcttcgtcccctgcaccggctgcggcggcagccgcaaggtcttcgtcgaggaggaggaccgcgtcgtccgctgcggcgagccggcgagtgcaatgagaacggattggtacgctgcgctaactgctgttcttgatcgccaacagacacgatcgtccattcgcgctgctaattgaatgattagaggttgtagaatcaacaaaaaagaaagagcctggcgtgggaattgtgtgtatccgattattttgaagatcggatttgcttctcatggagaacgaggacatgttgttcttgactccttgctgcaaaattgccatatggtgatggtgattcgagaataagaaccgggcttttatatatgtatatgatgtacttatgaaagattgacactgttgttagtgcaattaatgtaaatactaaagtttggggggtgctc

SEQ ID NO: 22593 - protein, 226 aa, Panicum virgatum
  misc_feature: Ceres CLONE 1822479
  misc_feature (64)..(132): Pfam Name: Glutaredoxin Pfam Description: Glutaredoxin
MEDCGGVAAGVVGGGSCGKKPFLLARSLTYHHHQGHRPAAASSAKWRRHQLADEPRAQRPQAVVLYTTSLRGVRRTFTDCSAVRAILRGFRVAVDERDVSMDASFRRELQALLAVRGRAFSLPQLLIGGRLVGGGDEVRHLHETGQLRRLLDGAAGQDPAFVCDACGGVRFVPCTGCGGSRKVFVEEEDRVVRCGEPASAMRTDWYAALTAVLDRQQTRSSIRAAN

SEQ ID NO: 22594 - DNA, 694 bp, Panicum virgatum
  misc_feature: Ceres CLONE 1822485
  misc_feature: Encodes the peptide sequence at SEQ ID NO. 22595
cagcaaaaatcgaacgcccgagcccaaacccgaccccggcgaccggcgtgcgtgggccgtgggcggacggagcgagcgagcgagagagtcggcggcggtgaccggaggggcggcgagatggcgaaggggttcgcgtcgtacctggcgatgaagacgggcccggaggccggggacgcgtcggcggcggcgaaggcgctcatcgacgccgacctgcgggagatcggcgtcgccgcgcggaagctcgccaaccacgccttcgtcctcggcggcgggctcggcttcggcacctccttcctcaagtggctcgccttcctcgccgcagtgtacctcttgatattggaccgcacaaactggaagaccaacatgatgacggccctcttggttccctacgtgttcttcacactacctcatgttctgttttctctgataagaggagaggttggaaaatggattgcaattgttgcagttattctgcggctcttcttcccacgccacttcccaggtatcattgttcgtttttctcattatgatgtccatatcaaaattcctggatagttgttacttctccccttcttttctttgtcatcctttttgtgaaggtgactaaatttttacatggatgtcacaacaatgtttcatcctgtgcaccagattggttagagctgcctggtgccatcatcctgctcacagttgt

SEQ ID NO: 22595 - protein, 145 aa, Panicum virgatum
  misc_feature: Ceres CLONE 1822485
  misc_feature (9)..(145): Pfam Name: WCOR413 Pfam Description: Cold acclimation protein WCOR413
MAKGFASYLAMKTGPEAGDASAAAKALIDADLREIGVAARKLANHAFVLGGGLGFGTSFLKWLAFLAAVYLLILDRTNWKTNMMTALLVPYVFFTLPHVLFSLIRGEVGKWIAIVAVILRLFFPRHFPGIIVRFSHYDVHIKIPG

SEQ ID NO: 22596 - DNA, 740 bp, Panicum virgatum
  misc_feature: Ceres CLONE 1822499
  misc_feature: Encodes the peptide sequence at SEQ ID NO. 22597
aaagatacttgagagtgagagggagagagagaaggaaagatgggtgaccaacacatctagagagagtgagcgagggcgggggagaggggcggtgaaaactctctccaaaagcaccaaaaagacctcgccccaagggtacgatcgcataacaagcatctctttggttaaaacaagccagattccaggtgagcgagagagaacttgctttatagccagagggagaaagagagaggagaaggagggcgagagtaaggaagatggggcgcgggaaggtggagctgaagcggatcgagaacaaaatcagccggcaggtgacgtttgccaagcgcaggaacggcctgctcaagaaggcgtacgagctctcgctgctgtgcgacgctgaggtcgcgctcatcatcttctccggccgcggccgcctcttcaagttctccagctcgtcatgcatgtacaaaacacttgagagataccgcacctccaattacagctcacaggaaataaaaactccattggatggtgaaatcaactaccaggattatttgaagttgaagacatgagttgaatttcttcaaactacacaaagaaatattcttggtgaggatctgggtccacttatgatgaaggagcttgagcagcttgagaaccaaatagagatatccctgacacatatcacgacaagaaagaatcaaatgttacttgatctgctctttgatctgaaaagtaacgagcaagaattacaggac

SEQ ID NO: 22597 - protein, 98 aa, Panicum virgatum
  misc_feature: Ceres CLONE 1822499
  misc_feature (9)..(59): Pfam Name: SRF-TF Pfam Description: SRF-type transcription factor (DNA-binding and dimerisation domain)
  misc_feature: The sequence is a functional homolog of SEQ ID NO 4 in US patent 7057087
  misc_feature: Useful for making plants with modulated biomass
  misc_feature: Useful for making plants with modulated flowering time
  misc_feature: The sequence is a functional homolog of SEQ ID NO 30 in the 10/666,642 US patent application
  misc_feature: The sequence is a functional homolog of SEQ ID NO 36 in the 10/666,642 US patent application
  misc_feature: The sequence is a functional homolog of SEQ ID NO 60 in the 10/412,699 US patent application
  misc_feature: The sequence is a functional homolog of SEQ ID NO 28 in the 10/666,642 US patent application
  misc_feature: The sequence is a functional homolog of SEQ ID NO 1360 in the 10/666,642 US patent application
  misc_feature: The sequence is a functional homolog of SEQ ID NO 22 in the 10/666,642 US patent application
  misc_feature: The sequence is a functional homolog of SEQ ID NO 707 in the 10/666,642 US patent application
  misc_feature: Useful for making plants with altered alkaloid content
  misc_feature: Useful for making plants with altered terpenoid content
  misc_feature: Useful for making plants with modulated phosphate use efficiency
  misc_feature: The sequence is a functional homolog of SEQ ID NO 2 in US patent 7273968
  misc_feature: The sequence is a functional homolog of SEQ ID NO 6 in US patent 7279615
  misc_feature: The sequence is a functional homolog of SEQ ID NO 46 in the 10/666,642 US patent application
  misc_feature: The sequence is a functional homolog of SEQ ID NO 428 in the 10/666,642 US patent application
  misc_feature: The sequence is a functional homolog of SEQ ID NO 892 in the 11/435,388 US patent application
  misc_feature: Useful for biocontainment applications
  misc_feature: The sequence is a functional homolog of SEQ ID NO 1362 in the 10/666,642 US patent application
  misc_feature: The sequence is a functional homolog of SEQ ID NO 199 in the 11/479,226 US patent application
  misc_feature: The sequence is a functional homolog of SEQ ID NO 34 in the 10/666,642 US patent application
  misc_feature: The sequence is a functional homolog of SEQ ID NO 58 in the 10/412,699 US patent application
  misc_feature: The sequence is a functional homolog of SEQ ID NO 164 in the 10/666,642 US patent application
  misc_feature: The sequence is a functional homolog of SEQ ID NO 642 in the 11/435,388 US patent application
  misc_feature: The sequence is a functional homolog of SEQ ID NO 730 in the 10/666,642 US patent application
  misc_feature: The sequence is a functional homolog of SEQ ID NO 1364 in the 10/666,642 US patent application
  misc_feature: The sequence is a functional homolog of SEQ ID NO 1728 in the 10/412,699 US patent application
  misc_feature: The sequence is a functional homolog of SEQ ID NO 14 in the 10/666,642 US patent application
  misc_feature: The sequence is a functional homolog of SEQ ID NO 32 in the 10/666,642 US patent application
  misc_feature: Useful for making plants with altered lignin content
  misc_feature: The sequence is a functional homolog of SEQ ID NO 203 in the 11/479,226 US patent application
  misc_feature: The sequence is a functional homolog of SEQ ID NO 40 in the 10/666,642 US patent application
  misc_feature: The sequence is a functional homolog of SEQ ID NO 122 in the 10/666,642 US patent application
  misc_feature: The sequence is a functional homolog of SEQ ID NO 406 in the 10/412,699 US patent application
  misc_feature: The sequence is a functional homolog of SEQ ID NO 1368 in the 10/666,642 US patent application
  misc_feature: The sequence is a functional homolog of SEQ ID NO 422 in the 11/435,388 US patent application
  misc_feature: The sequence is a functional homolog of SEQ ID NO 1961 in the 10/412,699 US patent application
  misc_feature: The sequence is a functional homolog of SEQ ID NO 1884 in the 10/412,699 US patent application
  misc_feature: The sequence is a functional homolog of SEQ ID NO 352 in the 10/374,780 US patent application
  misc_feature: The sequence is a functional homolog of SEQ ID NO 384 in the 10/225,066 US patent application
  misc_feature: The sequence is a functional homolog of SEQ ID NO 946 in the 10/412,699 US patent application
  misc_feature: The sequence is a functional homolog of SEQ ID NO 42 in the 10/666,642 US patent application
  misc_feature: The sequence is a functional homolog of SEQ ID NO 1243 in the 11/479,226 US patent application
  misc_feature: The sequence is a functional homolog of SEQ ID NO 1420 in the 10/666,642 US patent application
  misc_feature: The sequence is a functional homolog of SEQ ID NO 1814 in the 10/412,699 US patent application
  misc_feature: The sequence is a functional homolog of SEQ ID NO 570 in the 10/412,699 US patent application
  misc_feature: The sequence is a functional homolog of SEQ ID NO 2199 in the 10/666,642 US patent application
  misc_feature: The sequence is a functional homolog of SEQ ID NO 1460 in the 10/666,642 US patent application
  misc_feature: The sequence is a functional homolog of SEQ ID NO 938 in the 10/412,699 US patent application
  misc_feature: The sequence is a functional homolog of SEQ ID NO 1701 in the 10/412,699 US patent application
  misc_feature: The sequence is a functional homolog of SEQ ID NO 919 in the 10/666,642 US patent application
  misc_feature: The sequence is a functional homolog of SEQ ID NO 1366 in the 10/666,642 US patent application
  misc_feature: The sequence is a functional homolog of SEQ ID NO 1730 in the 10/412,699 US patent application
  misc_feature: The sequence is a functional homolog of SEQ ID NO 207 in the 11/479,226 US patent application
  misc_feature: The sequence is a functional homolog of SEQ ID NO 64 in the 10/412,699 US patent application
  misc_feature: The sequence is a functional homolog of SEQ ID NO 1702 in the 10/412,699 US patent application
  misc_feature: The sequence is a functional homolog of SEQ ID NO 715 in the 10/666,642 US patent application
  misc_feature: The sequence is a functional homolog of SEQ ID NO 1732 in the 10/412,699 US patent application
  misc_feature: The sequence is a functional homolog of SEQ ID NO 44 in the 10/666,642 US patent application
  misc_feature: The sequence is a functional homolog of SEQ ID NO 66 in the 10/412,699 US patent application
  misc_feature: The sequence is a functional homolog of SEQ ID NO 729 in the 10/666,642 US patent application
  misc_feature: The sequence is a functional homolog of SEQ ID NO 2191 in the 10/666,642 US patent application
  misc_feature: The sequence is a functional homolog of SEQ ID NO 2193 in the 10/666,642 US patent application
  misc_feature: The sequence is a functional homolog of SEQ ID NO 122 in the 10/225,066 US patent application
  misc_feature: The sequence is a functional homolog of SEQ ID NO 234 in the 10/374,780 US patent application
  misc_feature: The sequence is a functional homolog of SEQ ID NO 1886 in the 10/412,699 US patent application
  misc_feature: The sequence is a functional homolog of SEQ ID NO 2146 in the 10/374,780 US patent application
  misc_feature: The sequence is a functional homolog of SEQ ID NO 948 in the 10/412,699 US patent application
  misc_feature: The sequence is a functional homolog of SEQ ID NO 1470 in the 10/666,642 US patent application
  misc_feature: The sequence is a functional homolog of SEQ ID NO 284 in the 10/666,642 US patent application
  misc_feature: The sequence is a functional homolog of SEQ ID NO 1468 in the 10/666,642 US patent application
  misc_feature: The sequence is a functional homolog of SEQ ID NO 282 in the 10/666,642 US patent application
  misc_feature: The sequence is a functional homolog of SEQ ID NO 1969 in the 10/412,699 US patent application
  misc_feature: The sequence is a functional homolog of SEQ ID NO 1949 in the 10/412,699 US patent application
  misc_feature: The sequence is a functional homolog of SEQ ID NO 2195 in the 10/666,642 US patent application
  misc_feature: The sequence is a functional homolog of SEQ ID NO 2197 in the 10/666,642 US patent application
  misc_feature: The sequence is a functional homolog of SEQ ID NO 2064 in the 10/374,780 US patent application
  misc_feature: The sequence is a functional homolog of SEQ ID NO 572 in the 10/412,699 US patent application
  misc_feature: The sequence is a functional homolog of SEQ ID NO 816 in the 10/225,066 US patent application
  misc_feature: The sequence is a functional homolog of SEQ ID NO 1971 in the 10/412,699 US patent application
  misc_feature: The sequence is a functional homolog of SEQ ID NO 2232 in the 10/374,780 US patent application
  misc_feature: The sequence is a functional homolog of SEQ ID NO 232 in the 10/225,068 US patent application
  misc_feature: The sequence is a functional homolog of SEQ ID NO 310 in the 10/225,066 US patent application
  misc_feature: The sequence is a functional homolog of SEQ ID NO 1965 in the 10/412,699 US patent application
  misc_feature: The sequence is a functional homolog of SEQ ID NO 14 in the 10/374,780 US patent application
  misc_feature: The sequence is a functional homolog of SEQ ID NO 328 in the 10/225,066 US patent application
  misc_feature: The sequence is a functional homolog of SEQ ID NO 34 in the 10/286,264 US patent application
  misc_feature: The sequence is a functional homolog of SEQ ID NO 468 in the 11/435,388 US patent application
  misc_feature: The sequence is a functional homolog of SEQ ID NO 68 in the 10/412,699 US patent application
  misc_feature: The sequence is a functional homolog of SEQ ID NO 1967 in the 10/412,699 US patent application
  misc_feature: The sequence is a functional homolog of SEQ ID NO 1973 in the 10/412,699 US patent application
  misc_feature: The sequence is a functional homolog of SEQ ID NO 1963 in the 10/412,699 US patent application
  misc_feature: The sequence is a functional homolog of SEQ ID NO 2 in US patent 7049489
  misc_feature: The sequence is a functional homolog of SEQ ID NO 216 in the 10/225,066 US patent application
  misc_feature: The sequence is a functional homolog of SEQ ID NO 2454 in the 10/374,780 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: Useful for making plants with modulated nitrogen use efficiency
MGRGKVELKRIENKISRQVTFAKRRNGLLKKAYELSLLCDAEVALIIFSGRGRLFKFSSSSCMYKTLERYRTSNYSSQEIKTPLDGEINYQDYLKLKT

SEQ ID NO: 22598 - DNA, 1244 bp, Panicum virgatum
  misc_feature: Ceres CLONE 1822501
  misc_feature: Encodes the peptide sequence at SEQ ID NO. 22599
acccaacacaagaaatgaaccagttcctcccctcccagcaatcggcgctcaccatggactccgcgggcagcacggccgccaccgccgcgcccgcgcccaacggcgccgcagaccgcgccgcggccatcgacgacgacgacggcgtccccgaggtagccgcctgcatttcgtcgatgatcgaccgcgggggcagcgtcgagagccaccgcctcttcctggcgcgccgcaccacgctggagatgctccgcgaccgcgggtacagcgtcccggaggaggagctcgcgcgcaccctcccggagttccgcgcctggtgggccgacaagcccgagctcgaacgcctcgccttctccactactctcgcctccgacccgtccaacaaggtgaaagttgtgttctgtcgaccggaacctgtcaaaattgcagttatccgggagatttatagtggagtcaaagaagacaacttgtctagactgattctgatattgcagagcaaaataatgtctagagccaaagaatctattaaggagatcttcccatttaaagtcgatacattccaggttaggttttgtctaatattgttggatgctcttcacatttcgttcggtttctgtaagtaaagaactttggactctatttgcagcattgtgtctttcatcttgtaaatttgatattttgttgttttatcttatattaatatttgtatccaaaccaatgtgctcctccaatggtagatcacggaattactggtgaacattactaagcatgtcctgaagcccaagcatgaggtgttgactgcagaagagaaggccaagctcctgaaggaatataatgtggtggattcacagttgcctcgcatgctggagactgatgctgttgctcgctaccacggccttggcaagggagctgttgttaaagttacatatgacagcgagcttactgggaaccatgtgacgtacaggtgtattttctgagggggcatgggtttccgcggatgatgtttctcgtaagcggttagtaaaataacttcgcggcagatgatactgcccttctgtaaaaataacttctcggcagatgatactgcccttctaggccagtgtaagcactctattatgtaggatgaggttatctgtaactgtaaggtgttggtaaaaattgcctcgcagcaaagttactaccctaccaggcgattatattatcctagtgatacttgtctccagtctaatcttataaacattaacaaaact

SEQ ID NO: 22599 - protein, 187 aa, Panicum virgatum
  misc_feature: Ceres CLONE 1822501
  misc_feature (42)..(133): Pfam Name: RNA_pol_Rpb5_N Pfam Description: RNA polymerase Rpb5, N-terminal domain
MDSAGSTAATAAPAPNGAADRAAAIDDDDGVPEVAACISSMIDRGGSVESHRLFLARRTTLEMLRDRGYSVPEEELARTLPEFRAWWADKPELERLAFSTTLASDPSNKVKVVFCRPEPVKIAVIREIYSGVKEDNLSRLILILQSKIMSRAKESIKEIFPFKVDTFQVRFCLILLDALHISFGFCK

SEQ ID NO: 22600 - DNA, 1366 bp, Panicum virgatum
  misc_feature: Ceres CLONE 1822521
  misc_feature: Encodes the peptide sequence at SEQ ID NO. 22601
atttttcgtctcgcttttcccgttggccgaacaggttcgatccaaagaaacagaggggtgcagaagcgagccctcgcctcgtcggagcggagatgctgccgtcggcgtcggcgacagggtacaccgccggcgacgtctactcggcgcgcgagatgttccatcccttccacatctgatttcttgcggcggcagagcgcaggaactggttggattggatcgagctgctgtaggtgggcgggcgtttgggtctgggagccgaatccggagaggcggagagggatgagctttagctccgtgagagctgcagggcatggaggcgaagtggaggaggcgcgggccatgccggcggaggtgagctgggagatgctcgacaagtcgcgctttttcgtactcggcgccgcgctcttctccggcgtctccgcggcgctctacccggccgtcgtcctcaagacgcgcctccaggtcgcgccgccgccgcaggccgcggccgcagccgccgcggcggctatactccggcgcgacgggccccgggggttctaccgcggcttcggcgtgtccctcgcaggcacggtacccgcccgcgcggtctacatggcggcgctcgagaccaccaagagcgccgtgggctccgccgcgctccgcctcggcgtcgcggaaccggcggccaacgcggcggcctcggccgcgggcggcgtctccgccgccgtcgcggcacaggtcgtctggacgcccgtcgacgtcgtcagccagcgcctcatggttcagactgctccagccgccgccgcccactaccgcggtggcgccgacgcgttccggaagatcctgctcgcggacggcgtgcgcggcctgtaccgcggcttcggcgtctcggtgctcacctacgcgccctccagcgccgcgtggtgggcctcctacgcgacggcgcagcggctcctctggcgcgcggtcgaccccgcgcaccacgacagccgcggggccgcgatggccgtgcagggcgcgagcgccgccgcggcggggggcgcggccgcgctggtgaccatgccgctggacaccgtgaagacgcgcctgcaggtgatgggcgccggggcccgagcgccgacgctcgcggccgcggcgcgcgacctagtgcgcgtgggagggtgggccgcgtgctaccgcgggctcgggccgaggtgggcatccatgtcgctgtcatcagccaccatggtcaccgcctacgagttcttgaagcggctctcggccaaggaaggctccctctgagctccggtctccatcatggcagcgaacggatgatccttgtacatggtccaaacgcgttcatctgttgggtttccctgcgccgacggcgatgatgatgaaaattttt

SEQ ID NO: 22601 - protein, 326 aa, Panicum virgatum
  misc_feature: Ceres CLONE 1822521
  misc_feature (130)..(223): Pfam Name: Mito_carr Pfam Description: Mitochondrial carrier protein
  misc_feature (234)..(324): Pfam Name: Mito_carr Pfam Description: Mitochondrial carrier protein
  misc_feature (34)..(119): Pfam Name: Mito_carr Pfam Description: Mitochondrial carrier protein
MSFSSVRAAGHGGEVEEARAMPAEVSWEMLDKSRFFVLGAALFSGVSAALYPAVVLKTRLQVAPPPQAAAAAAAAAILRRDGPRGFYRGFGVSLAGTVPARAVYMAALETTKSAVGSAALRLGVAEPAANAAASAAGGVSAAVAAQVVWTPVDVVSQRLMVQTAPAAAAHYRGGADAFRKILLADGVRGLYRGFGVSVLTYAPSSAAWWASYATAQRLLWRAVDPAHHDSRGAAMAVQGASAAAAGGAAALVTMPLDTVKTRLQVMGAGARAPTLAAAARDLVRVGGWAACYRGLGPRWASMSLSSATMVTAYEFLKRLSAKEGSL

SEQ ID NO: 22602 - DNA, 728 bp, Panicum virgatum
  misc_feature: Ceres CLONE 1822525
  misc_feature: Encodes the peptide sequence at SEQ ID NO. 22603
acaaactcatttcaaaccctcttcttagtttgcctcccaaaaaaaaaacacttagcgcccctcctcgcggcaacacgatgctcaccacagcacacagccggcagcatcatcacgccttcgagaagagccctagcagccacatgaagaacctcgacaggaagctgcagcaggccatgagcaatgcgaccagcaagtacatgcagaggatctaccctctgggcatccagaggagcagctccaacctcacattgtcgtcgctctccctgtcgcagaactccaacgactcctcgctcagcagctccaactccagctgggagcccaaggtgccgcttctgtatggcggcaccttcagcccctggggcgatgtgctggtgtctctggagatgaggagagaggaggacgacaaggccagcgaccacgacgttgaagggggtgaggacttcgattgcagcgagccggggagcttgcataggtgcagctggatcaccaagaacagtgatgaggcgtacgttcagttccacgacgagtgctggggcgtccccgtgtacagcgacaaatttcagttcttcatcccggccatctccgtggtgatttgcagccgcctcttcgagcttctgtcgctgtccgggatgctcatagactacaactggaccgagatactcaagaggcgagacatgtacagggaggtgttcgccgacttcgaccccagcacggtggccaagatggac

SEQ ID NO: 22603 - protein, 216 aa, Panicum virgatum
  misc_feature: Ceres CLONE 1822525
  misc_feature: SWISSPROT Homolog: EC 3.2.2.20 DNA-3-methyladenine glycosylase I
MLTTAHSRQHHHAFEKSPSSHMKNLDRKLQQAMSNATSKYMQRIYPLGIQRSSSNLTLSSLSLSQNSNDSSLSSSNSSWEPKVPLLYGGTFSPWGDVLVSLEMRREEDDKASDHDVEGGEDFDCSEPGSLHRCSWITKNSDEAYVQFHDECWGVPVYSDKFQFFIPAISVVICSRLFELLSLSGMLIDYNWTEILKRRDMYREVFADFDPSTVAKM

SEQ ID NO: 22604 - DNA, 1249 bp, Panicum virgatum
  misc_feature: Ceres CLONE 1822534
  misc_feature: Encodes the peptide sequence at SEQ ID NO. 22605
gcgaccgttgtctttaagctcgcactgcgcgcaagccactgccaccgccgggcgccgccatcctccgcctccactctgccagtgccctgccctcctccccttttctcgagcccgggtcgccgtcttcgccgccgcttcgccagatcccgtcccgcgacgcggcgcggaatcccgtggcggtcccggcttgctgggggaggatgggcagcgccagcgctttcgtcatcaggtggatcaacttcttcaccatgatactggcattattggtggtgggtttcggattctggatgagcacccacaacgatgagtgcaggcggtccttgaccatccctgtcatagctctgggaggagtgatctttctcatatcgctcatcggattccttggtgcttggaagaacatttcttgcttgctttggacatacctaatcacgctgtttgtggtcttggtggcaatcatggtgttcacggtgcttgcgtttatcataaccaatacaggaactggccatgttgtttctggggctagatataaagagtaccgtcttcaagattacagctcctggtttgtcaaacagctcaataacacggagaaatggactcacctgagaagttgccttgtcaagtcagatgactgcaataatctgtcaaaaagatacaagactctgaaacaatacaagcttgcagaacttactcccatggaatctggctgctgccgcccaccagcagagtgtgggtacccagctctgaacgcctcctatttcgatctgagctatcatccagcaagcaccaacattgactgcaaactgtacaagaacgcacgctctgtcaggtgctacgactgtgattcttgcaaagctggggttgcacagtacatgaagaccgagtggcgtgtggtcgcaatcttcaatgtgatattgttcatcatcctgtcgttcgtgtactttgtgggctgctgcgcgcggcggaacgctggaggtagcaatgcaaaaggtagtggaaggtgaaagaaacactctgtgggctgttgcggcggaatgatggaggtagcaatgcaaaaggtttgtggaaggtgaaataaaacacttcgaggtgaagcgcttggccatccgatgtggaagctagatctagctttagcacccctgtaaaattgttccatcaaattcctttgatgaaaattatctgctgtgtggtgatattctctgttgcaaatgggttgcaaacatctcgttgataaaaattcattttgcctcgg

SEQ ID NO: 22605 - protein, 266 aa, Panicum virgatum
  misc_feature: Ceres CLONE 1822534
  misc_feature (4)..(242): Pfam Name: Tetraspannin Pfam Description: Tetraspanin family
MGSASAFVIRWINFFTMILALLVVGFGFWMSTHNDECRRSLTIPVIALGGVIFLISLIGFLGAWKNISCLLWTYLITLFVVLVAIMVFTVLAFIITNTGTGHVVSGARYKEYRLQDYSSWFVKQLNNTEKWTHLRSCLVKSDDCNNLSKRYKTLKQYKLAELTPMESGCCRPPAECGYPALNASYFDLSYHPASTNIDCKLYKNARSVRCYDCDSCKAGVAQYMKTEWRVVAIFNVILFIILSFVYFVGCCARRNAGGSNAKGSGR

SEQ ID NO: 22606 - DNA, 646 bp, Panicum virgatum
  misc_feature: Ceres CLONE 1822537
  misc_feature: Encodes the peptide sequence at SEQ ID NO. 22607
acactataatgcctgcggttgggtcgatcattagccgcgcgctggggctccccacatccctctctgctggcctcatcctgctgggatgctgtcctggaggaactgcgtccaatgtggtgactttagttgctcaaggggatgttccattatccatcgtgatgactgtctgcagcactcttgctgcagtgttccttacacctctgctaacgaaaattctagctggtgcttacattcctgtggatgctgtcaagctttctctcagtactttgcaggttgttgttgccccaattctattaggttcttctatacaaacagcatttccatcagtagttcaatttgttactccttttgcacctctgatggcagtcttggcttcatcgcttctggcttccagtgtcttctctgagaattttgtacggctaagatccacaattgctgatgcatcttctgtgaacggagacttcttctctggggatatcagagttgtcatgctctctgtcatcttgctgcattttgctggcttctttgttgggtatgcagcagctgctattggtggcttcaaagaaaaacaaaggagagcaatatcaattgaggtaggaatgcaaaattcatccttgggggtagtgctagcagctgcacatttctc

SEQ ID NO: 22607 - protein, 214 aa, Panicum virgatum
  misc_feature: Ceres CLONE 1822537
  misc_feature (1)..(140): Pfam Name: SBF Pfam Description: Sodium Bile acid symporter family
TIMPAVGSIISRALGLPTSLSAGLILLGCCPGGTASNVVTLVAQGDVPLSIVMTVCSTLAAVFLTPLLTKILAGAYIPVDAVKLSLSTLQVVVAPILLGSSIQTAFPSVVQFVTPFAPLMAVLASSLLASSVFSENFVRLRSTIADASSVNGDFFSGDIRVVMLSVILLHFAGFFVGYAAAAIGGFKEKQRRAISIEVGMQNSSLGVVLAAAHF

SEQ ID NO: 22608 - DNA, 1469 bp, Panicum virgatum
  misc_feature: Ceres CLONE 1822564
  misc_feature: Encodes the peptide sequence at SEQ ID NO. 22609
gaaaaaataatcgttttccctttcttccgaagtcctcttctccccgtcgcttcgccgtgccgcagcagggaagggaggaggcttccccgcgaaggtcgccatgatctcgccggagaggagcccgtcgcagagcccgcggtcgccggcggcggcggtggcgggggcgccgttcctgtcgatctccgtcacggatcccgtcaagatgggcaccggcgtgcaggcctatatctcctaccgcgtcatcaccaagaccaacttgcctgaatttgagggaccagagaaaattgttattcgtcgctatagtgattttgaatggttgcatgataggcttgctgagaggtacaaaggcatttttatacctccccttccagagaagaatgctgttgagaaattccgttttagcaaggagttcattgaattgcggcgtcaagctctggacttattcgttaacaggatagcttcacatcctgaactcaagcaaagtgaagtcttgagggtatttttgcaggcagatgaagagaaaatggatagggcaaggtcttatgagactggcatttttaagaaaccagcagatttcttacagatgtttaaggatgtacagtcaaaagtcagtgatgttgttctgggaaaagaaaagccggtggaggaatgtactcctgaatatgagaagcttaaaaattacatatttgagctagaaaatcatttagcagaggcacaaaaacaagcataccgtcttgtgaaaagacacagagaacttggacaatctttggcggagttcggaaaggcgattaagcttttgggtgcttgtgaaggagatgtgttggaaaaggtgttttctgaagttggttccaagtcagagatgttgtcaataaaactgcaaagagaggcagacaaccttctctttaactttgaagaaccgttgaaagattatgtccgtgctgtccaatcaataaaagctactatgatggatcgtgccaatgcttttaggcagcactttgatttggatcaggagaggaagtataaagagcttaaccttgaaaaattgaagttcatgaaccccgagaagtatgccgaagcagaatcagagtttagagggttgaaagcagatagcgaggaggctacaaagaagtttgaacacatagttcgactaatgaatgaggaactcgctcgtttccaagagcaaaaaacagctgatatcggacttgcattccatgaatttgccaaagggcaggctaagctagcgaaagacattgctgatgcgtggcgcggcgtcattccaaagctggaagcttgtttgacatcataagtgtgattcatgtttcctcgtgatgtttgagataggggttcacacttggttgagttttaggctgtttttcccggcctgttttgacactgattcctgtatacttaaaagtgatgtttggagatgatacagctattagattcagtcagacatcatttcttcctgt

SEQ ID NO: 22609 - protein, 401 aa, Panicum virgatum
  misc_feature: Ceres CLONE 1822564
  misc_feature (22)..(138): Pfam Name: PX Pfam Description: PX domain
  misc_feature (163)..(394): Pfam Name: Vps5 Pfam Description: Vps5 C terminal like
  misc_feature: SWISSPROT Homolog: EC 2.7.11.1 Non-specific serine/threonine protein kinase
MISPERSPSQSPRSPAAAVAGAPFLSISVTDPVKMGTGVQAYISYRVITKTNLPEFEGPEKIVIRRYSDFEWLHDRLAERYKGIFIPPLPEKNAVEKFRFSKEFIELRRQALDLFVNRIASHPELKQSEVLRVFLQADEEKMDRARSYETGIFKKPADFLQMFKDVQSKVSDVVLGKEKPVEECTPEYEKLKNYIFELENHLAEAQKQAYRLVKRHRELGQSLAEFGKAIKLLGACEGDVLEKVFSEVGSKSEMLSIKLQREADNLLFNFEEPLKDYVRAVQSIKATMMDRANAFRQHFDLDQERKYKELNLEKLKFMNPEKYAEAESEFRGLKADSEEATKKFEHIVRLMNEELARFQEQKTADIGLAFHEFAKGQAKLAKDIADAWRGVIPKLEACLTS

SEQ ID NO: 22610 - DNA, 1207 bp, Panicum virgatum
  misc_feature: Ceres CLONE 1822571
  misc_feature: Encodes the peptide sequence at SEQ ID NO. 22611
gtgagctactaataacacgccgcagaggatccggcccgtttcgctttcccaatcgcgagaggaggtcgggggcgttcgccgttgccgaccatgtcgcagcagccggcgccgccgccaccgtatcggccgtacaggcaggtgcgggcggcgacgccccacacacgcgcggtctcctgcgtgcgcttctccccctgcgggcggctccttgcgacggcgtccctcgacgggacggtcgcgctgctctccccgtcctcgctcgccgtggtcgccgtcctgcgcggccacaccgacggcgtctccgacctgtcctgggccacggagtcgttctacctctgcaccgcctccgacgaccgcaccctccgcatctgggacatccgccccgtcctcgccggcggcgcccaggccgaccccgccgccgaccgctgcgtccgcgtgctcagggggcacaccaacttcgtcttcagcgccaacttcaacccgcagaccagctcgcaggtcgcctccggggggttcgactgcaccgtgcgcatctgggacgtcaagagcggccgatgtacccgcgccatcgacgcgcactccgagcccgtcacctccgtgcacttcattagggacggctcgatcattgtgtcgggaagccatgacgggagctgcaagatttgggacgccaagactggggcttgcctcaagacggtcatcgacgacaagaagcccgccgtgtcattctccatgttctcccccaatggcaagttcatcctcgtcgccacgctcgatgactcactgaaactatgcaactttgctaccggcaagttcttgaaggtatacagtggacatgtgaacagagtatactgcatccagtctgcgttttccattacaaatgggaagtacattgtcagtggatcagaagacaactgtgtgtacatttgggatctgcaagggagaaatatccttcagaaactggaaggccatactgacacggtcatctctgtgtcctgccatccaacagagaacaagattgcttccggtggccttgataatgataggactgtgagactatgggttcaagacagctgatgaacttgcaaaacaaaaattgtagggataagtagctcgtgtgaactttgctcaaactgaaagcagcacttgtcatctcattgagaaatctgttggcttcccttgggtcggtatgatatatttgtgtagatttatg

SEQ ID NO: 22611 - protein, 326 aa, Panicum virgatum
  misc_feature: Ceres CLONE 1822571
  misc_feature (110)..(149): Pfam Name: WD40 Pfam Description: WD domain, G-beta repeat
  misc_feature (153)..(191): Pfam Name: WD40 Pfam Description: WD domain, G-beta repeat
  misc_feature (56)..(94): Pfam Name: WD40 Pfam Description: WD domain, G-beta repeat
  misc_feature (238)..(279): Pfam Name: WD40 Pfam Description: WD domain, G-beta repeat
  misc_feature (14)..(52): Pfam Name: WD40 Pfam Description: WD domain, G-beta repeat
  misc_feature: SWISSPROT Homolog: EC 2.7.11.7 [Myosin heavy-chain] kinase
MSQQPAPPPPYRPYRQVRAATPHTRAVSCVRFSPCGRLLATASLDGTVALLSPSSLAVVAVLRGHTDGVSDLSWATESFYLCTASDDRTLRIWDIRPVLAGGAQADPAADRCVRVLRGHTNFVFSANFNPQTSSQVASGGFDCTVRIWDVKSGRCTRAIDAHSEPVTSVHFIRDGSIIVSGSHDGSCKIWDAKTGACLKTVIDDKKPAVSFSMFSPNGKFILVATLDDSLKLCNFATGKFLKVYSGHVNRVYCIQSAFSITNGKYIVSGSEDNCVYIWDLQGRNILQKLEGHTDTVISVSCHPTENKIASGGLDNDRTVRLWVQDS

SEQ ID NO: 22612 - DNA, 679 bp, Panicum virgatum
  misc_feature: Ceres CLONE 1822588
  misc_feature: Encodes the peptide sequence at SEQ ID NO. 22613
gcccaactccccccccgagccgcctgctctgcagagtcctcgcgcccccctctcaaggcgaggccgcccagtcccagagcccgccgccgcgcttccggcggcgaggaacccggtattttgagtttcgctgtccagcgcagctatgtccatgttcgccgagatcttcgggaagcccgaggagcaggctaactccaatgcgggggccactctggacaagttaaatgagactcttgatatgctggacaagaaagaagaggtgcgggagaagaaagcggctgctgagcttgacagggcgaaggagttctcaaaagcaacaaataaaagagcggctattcagtccttgaagaggaaaaaactttgtgaactacagatcgagcagctaggacatttccagctgaaaatccatgatcagatgatcatgctagaagcagctaaagcgacgacagagactgttgatgcatcgaggactggagctgccgctatgaaagcactgcaaaaagcaacaaatattgatgatgtcgacaagactatggatgaaattaacgaccagactgaaaacatgatacaaagtcgagatgctttatcagctcctcttggagcttctgctgatttcgatgaggatgaactggaagcggaacttgaagaactggagggagcagagtcggaatctcagcttctg

SEQ ID NO: 22613 - protein, 178 aa, Panicum virgatum
  misc_feature: Ceres CLONE 1822588
  misc_feature (21)..(178): Pfam Name: Snf7 Pfam Description: Snf7
MSMFAEIFGKPEEQANSNAGATLDKLNETLDMLDKKEEVREKKAAAELDRAKEFSKATNKRAAIQSLKRKKLCELQIEQLGHFQLKIHDQMIMLEAAKATTETVDASRTGAAAMKALQKATNIDDVDKTMDEINDQTENMIQSRDALSAPLGASADFDEDELEAELEELEGAESESQL

SEQ ID NO: 22614 - DNA, 712 bp, Panicum virgatum
  misc_feature: Ceres CLONE 1822592
  misc_feature: Encodes the peptide sequence at SEQ ID NO. 22615
gtgcgctgcggccgggtcggatctgagacgagcaatacccatcttcatccacgcacaccccgcctcctccctccggatcggatcggatccgcccgaccaccccgcgccgccgccgccgccgcagtgagcatcccgccctgccgcagatcagataagatggccgcagttgacaccttcctctttacctcggagtctgtgaatgagggacaccctgacaagctctgcgaccaggtctcagatgccgttcttgatgcttgccttgctgaggacccagacagcaaggttgcttgcgagacctgcaccaagactaacatggtcatggtttttggtgagatcaccaccaaggccaacgttgactacgagaagattgttagggagacctgccgcaacatcggtttcgtgtctgcagatgttgggcttgatgctgacaactgcaaagtgcttgtgaacattgagcagcagtcccctgatattgctcagggtgtgcatggccacttcacaaagcggcctgaggagattggagctggtgaccagggacacatgttcgggtatgcaactgatgagaccccagagctgatgcccctcagtcatgtccttgccaccaagcttggtgctcgtctcactgaggtgcgcaagaacgggacctgcccctggctcaggcctgatgggaagacccaggtgactgttgagtaccgcaatgagggtggtgcct

SEQ ID NO: 22615 - protein, 185 aa, Panicum virgatum
  misc_feature: Ceres CLONE 1822592
  misc_feature (5)..(104): Pfam Name: S-AdoMet_synt_N Pfam Description: S-adenosylmethionine synthetase, N-terminal domain
  misc_feature (119)..(185): Pfam Name: S-AdoMet_synt_M Pfam Description: S-adenosylmethionine synthetase, central domain
  misc_feature: SWISSPROT Homolog: EC 2.5.1.6 Methionine adenosyltransferase
MAAVDTFLFTSESVNEGHPDKLCDQVSDAVLDACLAEDPDSKVACETCTKTNMVMVFGEITTKANVDYEKIVRETCRNIGFVSADVGLDADNCKVLVNIEQQSPDIAQGVHGHFTKRPEEIGAGDQGHMFGYATDETPELMPLSHVLATKLGARLTEVRKNGTCPWLRPDGKTQVTVEYRNEGGA

SEQ ID NO: 22616 - DNA, 1524 bp, Panicum virgatum
  misc_feature: Ceres CLONE 1822611
  misc_feature: Encodes the peptide sequence at SEQ ID NO. 22617
actctctccacccccgagctcgtcgtcgccaatccacccatcaactcccagatctccccccgtctcgctcgcctcgcgctcgccgcggatgtcctcgtcggcgcgcttcgacctccgggcctcgtcgcagcagctgcaggctccggcgtcgcacgccggcatgagcgacgggggcgcgttcgcgaatgcggggaacctggagcactgcgcccggtacctcaaccagacgctcgtcaccttcggattcccggcctcgctcgacctcttcgccaccgatccggtctcgattgcaagaacgtgcaactgcatctatgcattgctgcagcagcgccagagggacattgagttcagggagtctacaaatgatctgcggcagcgtatgcagtctgatacttcacggctggaagccaagattgaaagaatggatgctcaattagcagccaaagatcgggagctagccacacttactcgaacggaggcgaaaaacactgcagctttgaaatctcagattgataagctgcagcaagaacgtgatgaatttcagaaaatggttataggaaatcagcaagtacgcactcagcaaatccatgaaatgaagaagaaagagaaggaatacataaaattgcaggagaagctaaaccaggtattaatggagaagaaaaaggagtcatcccgttctggaatcgaaataatgaacttattgcagaaagaaggacggcaacgtggaacttggagtggaaaaaagaatgacaatgattattacaaaatgattgttgatgcatatgaagtgaaaaagcaagaactgatgcaggagaattctgatttacgggcactcttgcgttcaatgcagatggacatgcgtgagttcctcaatgctccgaatggatcatcacagcctactgttgctgctaatggaagaaaagaggcagggtctcagtccccactaggtggcaagacggatgtctttgacctgccctttcacatggcaagagaccagatagaagagagtttgcgcacaaaaatggcttcaatcaaggcacgaatgacccaacttcaagatgctcaaaaaggtgctgaagtgacctctgaggctaccgagcgtgagcttgagctcgaagctcagctggttgaagcaaggagcatcattcaagagcaggcctccatcatgtccaagcacttcaccaagtctgataagccaaggaggcatagtggtctggatggcgagcgagaggcgtctgctgaggtgtgaaaatgtgcccgtggcaaggataatgtcacgcaagaacctcttttttagcaagcactcaggtagtatgttgcaggataacgccttcctggcatggtagcctgagtctaggcaccgtcgatgtagtatgatacgcaggagcatcacctccagtgcatggctaacctggttcaccttgactagttacgtgtagcgaaaatgtaattgtaatccagcggtttgaattatggcagtgtagctaccttgcatccctggaagaaatggaccttttggacggc

SEQ ID NO: 22617 - protein, 386 aa, Panicum virgatum
  misc_feature: Ceres CLONE 1822611
  misc_feature: SWISSPROT Homolog: EC 2.7.11.1 Non-specific serine/threonine protein kinase
MSSSARFDLRASSQQLQAPASHAGMSDGGAFANAGNLEHCARYLNQTLVTFGFPASLDLFATDPVSIARTCNCIYALLQQRQRDIEFRESTNDLRQRMQSDTSRLEAKIERMDAQLAAKDRELATLTRTEAKNTAALKSQIDKLQQERDEFQKMVIGNQQVRTQQIHEMKKKEKEYIKLQEKLNQVLMEKKKESSRSGIEIMNLLQKEGRQRGTWSGKKNDNDYYKMIVDAYEVKKQELMQENSDLRALLRSMQMDMREFLNAPNGSSQPTVAANGRKEAGSQSPLGGKTDVFDLPFHMARDQIEESLRTKMASIKARMTQLQDAQKGAEVTSEATERELELEAQLVEARSIIQEQASIMSKHFTKSDKPRRHSGLDGEREASAEV

SEQ ID NO: 22618 - DNA, 691 bp, Panicum virgatum
  misc_feature: Ceres CLONE 1822614
  misc_feature: Encodes the peptide sequence at SEQ ID NO. 22619
cattgatcttccagcgattgattctgacaaaactgtgatggtgacattcaagcatgatgacaagttacaagaaaatgcggaatgtggcttccagtgtgcgcttctctatactactgtatatgggcaaagaaggatccgagtcataaacctctcactttcatgcacaagtttgcttagcgaccttttccggtatgctgatttggagacacaatttgcatgcttcctgaagcaagctgctaatggcatcccgacatctccactaccccgtattcgggatgaagcaacaaatacatgcataaatattctgcaatcttaccgcaaacactgtgcgtctgtaacctcatcggggcaattgattctcccagaggctctaaaactgctgccgttgtatactttagcattggtcaaaagtgtaggcttgagaaccgatgggtgtttggatgagcgttcctattggatgtccattgtctcctccatttctgtagtactagctgttccgttggtcttccctagattgattcctatccatgatctcacatcaagggctgatgatgatacccttatacccagttcccttatgctaagtagtgaaaatgtacaagaggatggggtctatttattggaaaacggagaggatggtctaatttatgtaggaaatatggtaaatccggccacactggaacaaatattt

SEQ ID NO: 22619 - protein, 229 aa, Panicum virgatum
  misc_feature: Ceres CLONE 1822614
  misc_feature (67)..(168): Pfam Name: Sec23_helical Pfam Description: Sec23/Sec24 helical domain
  misc_feature (1)..(55): Pfam Name: Sec23_BS Pfam Description: Sec23/Sec24 beta-sandwich domain
IDLPAIDSDKTVMVTFKHDDKLQENAECGFQCALLYTTVYGQRRIRVINLSLSCTSLLSDLFRYADLETQFACFLKQAANGIPTSPLPRIRDEATNTCINILQSYRKHCASVTSSGQLILPEALKLLPLYTLALVKSVGLRTDGCLDERSYWMSIVSSISVVLAVPLVFPRLIPIHDLTSRADDDTLIPSSLMLSSENVQEDGVYLLENGEDGLIYVGNMVNPATLEQI

SEQ ID NO: 22620 - DNA, 719 bp, Panicum virgatum
  misc_feature: Ceres CLONE 1822618
  misc_feature: Encodes the peptide sequence at SEQ ID NO. 22621
ctgacttgtccaccatatcctctcccgagccttgccgttcgttccgctagaattctatccagagaagagaccaccctgctttcgcctccgagcacgtacagctctctgcttcggtctcatcgcgcggaagacctccctgcttcgttctgccttcagctcggccgatcatcatggggttcccgctggtgagctacgtcctcgccgtgcccaagccggtcgtcgtcttctgcaagatgctcagcgtcatcagggacgccttcctgctgatgctcgccgtcctggggctctgccccttcccgtacgacgacggctcgccccgccgggcggacgggccgaagccagaggaggtgaagggccggctccccgccgtggagtacggcgagctcgtggccgagcggctggtggtggcgtccccgggcggcggcgggcacgcggcgtgccgcggcgaggaggacgcggcggcggcggcggcggcctcgccgacgtgcatcgtgtgcctggagaatgtggaggcggggcacgaggtgcggcggctgggcaactgcgcgcacgccttccaccgcggctgcatcgaccggtggatcgacctcggccgggcgacgtgcccgctgtgccggtccgacctgctgccgcgcccgcggggccgggcccggctgggccggctcgccagcctcctcacgcgcgtttggtgagcggtcctcttggagggcagttttgtc

SEQ ID NO: 22621 - protein, 173 aa, Panicum virgatum
  misc_feature: Ceres CLONE 1822618
  misc_feature (106)..(148): Pfam Name: zf-C3HC4 Pfam Description: Zinc finger, C3HC4 type (RING finger)
MGFPLVSYVLAVPKPVVVFCKMLSVIRDAFLLMLAVLGLCPFPYDDGSPRRADGPKPEEVKGRLPAVEYGELVAERLVVASPGGGGHAACRGEEDAAAAAAASPTCIVCLENVEAGHEVRRLGNCAHAFHRGCIDRWIDLGRATCPLCRSDLLPRPRGRARLGRLASLLTRVW

SEQ ID NO: 22622 - DNA, 954 bp, Panicum virgatum
  misc_feature: Ceres CLONE 1822626
  misc_feature: Encodes the peptide sequence at SEQ ID NO. 22623
agcttcttccctcaccaaacctcaagtcttgccggttgccgccgctgcagtttcgtacaggcagcttacacaccggccggccggaggcgtgcaaatcaggatcggagcttggaggatgggagactaccacaggatccacccggtgacggtgggctctccgccgccgccgtccgcgccgccggagcatgccaggggcaagaaacccagccacgaccagctgcagctgccggtcacggcgccgctgcccccgccgccgcgtcgcagcaggcggcgccacagccgctgctgccggtgcgtgtgctggaccctgctcgccgtcgtcatcctcgccgtcgcgctcgccgccacggcgggcatcctctacctcgtgttccggcccaagatccccagcttccgcgtggaccggctcaccgtcacccggttcgacgtcaacgccacgacgatgacggtgaccgacgcgttcgacgtcgacgtgaccgccaccaaccccaacaagcgcatcggcatctactacgacgggggcgacgtcgcggccttcttcaacggcacgcagctgtgccgcggcgacttccccacgctgtaccaggggcaccggaccaccgtgcagccgcgcatcacgctcaccggagagacgcggctggacagcgccgtcgctgcgcagctgctgcggcaacggcaagacgggtttgtgccattgacggtgcgcgcccgtgttccgatccgcataaagtttggagccattaagctatggaagatgacagggaaggctgattgcaactttgtggtcgataatctccaggcaggcactcagcttcgaatccgatccaacagttgcagttttaagcttaagatctaggcatcttttgctcatcattatattacttcattttttttccacgcgccgtgtacagtgcattagctatcaataagaaagattatatatatctccgatac

SEQ ID NO: 22623 - protein, 246 aa, Panicum virgatum
  misc_feature: Ceres CLONE 1822626
  misc_feature (83)..(220): Pfam Name: Hin1 Pfam Description: Harpin-induced protein 1 (Hin1)
MGDYHRIHPVTVGSPPPPSAPPEHARGKKPSHDQLQLPVTAPLPPPPRRSRRRHSRCCRCVCWTLLAVVILAVALAATAGILYLVFRPKIPSFRVDRLTVTRFDVNATTMTVTDAFDVDVTATNPNKRIGIYYDGGDVAAFFNGTQLCRGDFPTLYQGHRTTVQPRITLTGETRLDSAVAAQLLRQRQDGFVPLTVRARVPIRIKFGAIKLWKMTGKADCNFVVDNLQAGTQLRIRSNSCSFKLKI

SEQ ID NO: 22624 - DNA, 732 bp, Panicum virgatum
  misc_feature: Ceres CLONE 1822644
  misc_feature: Encodes the peptide sequence at SEQ ID NO. 22625
acgcctgcgacgcccccaacgcacgctgagttgagctctttctcgttttccggcggcggcggagatggcggcgaacctggaggacgtgccgtcgctggatctgatgcacgagctgctccgccgcatgaagtgcagctccaagcccgacaagcgcctcatcctcatcggaccacccggctctggaaagggaactcagtctccccttattaaggatgaatattgcctgtgccatttagccactggtgatatgctgagggctgcggtggctgcaaagactcctctaggaatcaaagctaaagaagctatggacaagggagagcttgtttccgatgacttggttgtggggatcattgatgaagccatgaagaaaccctcatgccagaaaggtttcatccttgatggcttccctagaactgtcactcaagcacagaagcttgatgagatgttggcaaagcaaggtgctaatgttgacaaggtcctgaacttcgcaattgatgatgctatattggaagaacggattactggtcgctggatccacccagcgagtggtaggacttaccatacaaaatttgcacctccaaaggctccgggagttgatgatgtcactggagagccattgattcagaggagagatgatacagctgaggtcttgaagtcaaggcttgaagccttccacagacaaactgaggctgtgattgattactactcccagaagggcttagtggcgaactt

SEQ ID NO: 22625 - protein, 222 aa, Panicum virgatum
  misc_feature: Ceres CLONE 1822644
  misc_feature (33)..(219): Pfam Name: ADK Pfam Description: Adenylate kinase
  misc_feature (155)..(190): Pfam Name: ADK_lid Pfam Description: Adenylate kinase, active site lid
  misc_feature: SWISSPROT Homolog: EC 2.7.4.3 Adenylate kinase
MAANLEDVPSLDLMHELLRRMKCSSKPDKRLILIGPPGSGKGTQSPLIKDEYCLCHLATGDMLRAAVAAKTPLGIKAKEAMDKGELVSDDLVVGIIDEAMKKPSCQKGFILDGFPRTVTQAQKLDEMLAKQGANVDKVLNFAIDDAILEERITGRWIHPASGRTYHTKFAPPKAPGVDDVTGEPLIQRRDDTAEVLKSRLEAFHRQTEAVIDYYSQKGLVAN

SEQ ID NO: 22626 - DNA, 719 bp, Panicum virgatum
  misc_feature: Ceres CLONE 1822654
  misc_feature: Encodes the peptide sequence at SEQ ID NO. 22627
acaccacaatccgagcgacgcctacgctctctgctctcgccatggacgccgcggagaggaggctcgcccgcgtcgccgcccacctcgcgccgtcgtcgttcccggtcacgcacgccgccgcgcccccgctcgtgcctgctcccaccgcggcgtcctcgtcatcctcctcgtcgtcgcccgcgggggacagctacaggcgcgtgcacggcgaggtgtcggcggagcccccggaatggcgcgcggcgacggacgagtccggcaaggagttcgtcgacatcatctacgagaaggccgtcaatgagggcatcgccaagatcaccataaaccgcccggataggaggaacgcgttccgcccgttgaccgtgaaggagctcatgcgcgcgttcaacgatgccagagacgacagttcgattggagtcatcattctaacagggaagggaactaaggccttctgtagcggtggtgaccaggcgttaagagattctgatggatatgttgacttcgatagctttggccgcctcaacgttctggacctccaggtgcaaatccgccgtcttccaaagcctgttattgccatggttgctggttatgctgttggtggtgggcatgttttgcatatggtgtgtgacataacaatcgcagcagacaacgcaatatttgggcagacaggacccaaggttggaagctttgatgctggctatggatctttcataatgtcc

SEQ ID NO: 22627 - protein, 225 aa, Panicum virgatum
  misc_feature: Ceres CLONE 1822654
  misc_feature (90)..(225): Pfam Name: ECH Pfam Description: Enoyl-CoA hydratase/isomerase family
  misc_feature: SWISSPROT Homolog: EC 4.1.3.36 Naphthoate synthase
MDAAERRLARVAAHLAPSSFPVTHAAAPPLVPAPTAASSSSSSSSPAGDSYRRVHGEVSAEPPEWRAATDESGKEFVDIIYEKAVNEGIAKITINRPDRRNAFRPLTVKELMRAFNDARDDSSIGVIILTGKGTKAFCSGGDQALRDSDGYVDFDSFGRLNVLDLQVQIRRLPKPVIAMVAGYAVGGGHVLHMVCDITIAADNAIFGQTGPKVGSFDAGYGSFIM

SEQ ID NO: 22628 - DNA, 363 bp, Panicum virgatum
  misc_feature: Ceres CLONE 1822699
  misc_feature: Encodes the peptide sequence at SEQ ID NO. 22629
gcatcccattccccttccttccagaggagagagagagagaagaaaagataagctcagctcggctcaggctcaggctcagctcgcaagcaagtggagatgcggagcccacgaggagcagcagcagccgggcgctgcggcgcccaggagcacgtcgacctgatcccgggcctccccgacgacgtcgccgtcgactgcctggcgcgcgttccccacgcgtcccaccgcgcgctccgccgcgtctgccgcggctggcgcagcgccgccgccaagccggccttcgcctcggcgcgcgccgccgcgggcgcccccgaggacctcgcctcccccctgccgttcggccccccctccgccgccgacaacgac

SEQ ID NO: 22629 - protein, 88 aa, Panicum virgatum
  misc_feature: Ceres CLONE 1822699
  misc_feature (20)..(67): Pfam Name: F-box Pfam Description: F-box domain
MRSPRGAAAAGRCGAQEHVDLIPGLPDDVAVDCLARVPHASHRALRRVCRGWRSAAAKPAFASARAAAGAPEDLASPLPFGPPSAADN

SEQ ID NO: 22630 - DNA, 723 bp, Panicum virgatum
  misc_feature: Ceres CLONE 1822712
  misc_feature: Encodes the peptide sequence at SEQ ID NO. 22631
cccacctcgccccttgcaagttcatagcacacctcgcggcggcggcgcccgagaccggcggcgggcggcggagacagcatcagccatggtgcatgtcagcttctaccgcaactatggtaaaactttcaagaagccaaggcgtccgtatgagaaggagcgccttgatgctgagctgaagctggtaggtgagtatggcctgaggtgcaagcgtgagctgtggcgtgtgcagtatgccctcagccgcatccggaatgctgcgagggagctcctcacccttgatgagaagaacccccgccgtatcttcgagggtgaagcactcctgcgccgcatgaaccgctatggcctcctcggtgagggccagaacaagcttgattatgttcttgcgctcactgttgagaacttccttcagcgtcgccttcagaccattgtcttcaagaatggcatggcaaagtccatccatcatgctcgtgtgctcatcaggcaacgccacattaggtataccataacatttctaaaccttgtgattatgtttgtaatgcatttgcttgagatggctagtgtgatggaatgtgtacggattattgtgaagttagggtcgaatgccaatttcttatgtcattgttcgacagttttaagtgccattgcaaaccaaactatctcttgttctgtttgtgttttgggccatgtgatgagaaaccttatgccactcacgacggtcgtctg

SEQ ID NO: 22631 - protein, 212 aa, Panicum virgatum
  misc_feature: Ceres CLONE 1822712
  misc_feature (7)..(108): Pfam Name: Ribosomal_S4 Pfam Description: Ribosomal protein S4/S9 N-terminal domain
MVHVSFYRNYGKTFKKPRRPYEKERLDAELKLVGEYGLRCKRELWRVQYALSRIRNAARELLTLDEKNPRRIFEGEALLRRMNRYGLLGEGQNKLDYVLALTVENFLQRRLQTIVFKNGMAKSIHHARVLIRQRHIRYTITFLNLVIMFVMHLLEMASVMECVRIIVKLGSNANFLCHCSTVLSAIANQTISCSVCVLGHVMRNLMPLTTVV

SEQ ID NO: 22632 - DNA, 1474 bp, Panicum virgatum
  misc_feature: Ceres CLONE 1822717
  misc_feature: Encodes the peptide sequence at SEQ ID NO. 22633
gttctcgcccccttgctcgccgcgctccgatcggcgttccccccaatcccgcgcggaggagagcagggggcctccggggccctcgcgcgcggcgacctcgtggcgctcctgcgcggctgcttctcgttcgggtcggcggggcggaggcggcccaaggcctcgcccttgccctccccgccgcgcctgaccgcatcggcggccgcggccgcggcggcagcggacgacggggccaagatgaagggcctcttcaagtcgaagccgcggacgcccgtcgacgtcgtgcggcagacgcgggagaacctcgtccacctcgatctcaactccggctcccggggcggcgacgccaagcgcgaggagaagatggcagagcttagcaaaaatatcagggaattgaagtctattctatacggcaatggtgaatcggagcctgtaacagaagcatgtgtgcaactgacccaagaattcttcagggagaacaccttacggctgttaatcatacatcttccaaaactaaatctggagactaggaaagatgctactcaagttgttgcaaacttgcaaagacagcaagtatcctcaaagatagttgcgtctgagtaccttgagtcaaataaggatctcttggacatcttaatttcagggtatgaaaatatggacattgctttacattatggtgctatgttgagggaatgtattcgccaccaaagcattgcaaggtatgttttagagtcagaacacatgaagaagttctttgactatatacagcttccaaattttgacatagcttctgatgcttctgcaacctttaaagaactactgacaaggcataaagcaaccgtggctgaatttctcaccaataattatgattggttctttgaagaattcaacactaggttgctatcatcgaccaactacataacgaaaaggcaagctatcaagttgttgggagatatgcttctggataggtcaaatgctgcagtcatgatgcgctatgttagttccaaagacaatcttatgattctgatgaatctcttaagggattcaagcaaaaatattcaaattgaggcatttcacgtgttcaagctatttgctgcaaataaaaacaaaccggctgaggttgtaaacatactggtcactaataggagcaagcttcttcgcttttttgctggattcaagattgacaaagaggacgagcaatttgaagcagacaaggagcaggtcattaaagaaatatcggcactttgagtgtctcagaatgtaattagtcattgtgatgaattttcttttcttaagaaaggaagtgcatgtgtaataacaatcctctgtatttttatgttggatttagcggaacaatatgaccaagttggtgttgtattcttccgtaaaaatgtgataatctctatagattgtgtggttcttcatgcacatttttttatagatgtgcatccatgttataaaatagatttaattgcac

SEQ ID NO: 22633 - protein, 336 aa, Panicum virgatum
  misc_feature: Ceres CLONE 1822717
  misc_feature (1)..(336): Pfam Name: Mo25 Pfam Description: Mo25-like
MKGLFKSKPRTPVDVVRQTRENLVHLDLNSGSRGGDAKREEKMAELSKNIRELKSILYGNGESEPVTEACVQLTQEFFRENTLRLLIIHLPKLNLETRKDATQVVANLQRQQVSSKIVASEYLESNKDLLDILISGYENMDIALHYGAMLRECIRHQSIARYVLESEHMKKFFDYIQLPNFDIASDASATFKELLTRHKATVAEFLTNNYDWFFEEFNTRLLSSTNYITKRQAIKLLGDMLLDRSNAAVMMRYVSSKDNLMILMNLLRDSSKNIQIEAFHVFKLFAANKNKPAEVVNILVTNRSKLLRFFAGFKIDKEDEQFEADKEQVIKEISAL

SEQ ID NO: 22634 - DNA, 1280 bp, Panicum virgatum
  misc_feature: Ceres CLONE 1822728
  misc_feature: Encodes the peptide sequence at SEQ ID NO. 22635
ctcacaccatcccagcgcgaaccagacagcagcaggtggtgccaagcagcagctagcaagcaagctagctagctgttctgcatacagcctagctgaagctcctcctcccttcctggcttctgcgagcatggccgccgcgctcttctccttcagggccgcggcgctcgccgcgctcctcgtcgccgtgatggccgcctgcggcgcccgcggccagctgcagcccagcaacgcctccgccgactcccaggagagatccttgctgtcctacagcggcggctggatcccggccaaggccacctggtacggcgcgcccaccggcgcaggccccgacgacaacggcggcgcgtgcgggttcaagcacaccaaccagtaccccttctcctccatgacgtcgtgcggcaacgagcccatcttcaaggacggcaagggctgcggctcctgctaccagattcggtgcgttaagagcaaccaccctgcctgctccggcgtgccgcagacggtggtcatcaccgacatgaactactacccggtggccaagtaccacttcgacctcagcggcacggcattcggctccatggccacctacggcctcaacgacaagctccgccacgccgggatcatcgacatgcagttcaggagggtgccgtgcaacttccccgggctgacgatcaacttcgtcatccagcgcgggtccaaccccatgtacctggcggtgctggtcgagttcgaggacaaggacggcgacgtggtgcaggtggacatcatgcagcacaactccggctactgggagccgatgcacgagtcgtggggatccatctggaggatcgaccccaaccgcccgctcaagggcccctactccctgcgcatcaccaacgagtccggcaagcagctcatggccaagaacatcatccccgacaactacatccccaacaccaactaccgctcctacgtccagtactgacaccccgtcgatccatcagctatcactgcgcgtgagtgagctctccgatccagcaccggctcaagggctctctctcgctcattatagtggccggccgccgttggcaattgcgctgaggatttttcacctcggttcattccattgctggtgtgtttaattgtggtgtgtcctgaatgaaggtgcgtgggaaattagaggaggcaagaatcaacgagtgctctcccgcccactgtcactctaccattaccagtgtgtaaccaaaaaattatatatggctataaatgatacagtactacgtgtgctgctatactatttaacc

SEQ ID NO: 22635 - protein, 277 aa, Panicum virgatum
  misc_feature: Ceres CLONE 1822728
  misc_feature (181)..(262): Pfam Name: Pollen_allerg_1 Pfam Description: Pollen allergen
  misc_feature (88)..(169): Pfam Name: DPBB_1 Pfam Description: Rare lipoprotein A (RlpA)-like double-psi beta-barrel
  misc_feature: Useful for making plants with altered carbohydrate content
MAAALFSFRAAALAALLVAVMAACGARGQLQPSNASADSQERSLLSYSGGWIPAKATWYGAPTGAGPDDNGGACGFKHTNQYPFSSMTSCGNEPIFKDGKGCGSCYQIRCVKSNHPACSGVPQTVVITDMNYYPVAKYHFDLSGTAFGSMATYGLNDKLRHAGIIDMQFRRVPCNFPGLTINFVIQRGSNPMYLAVLVEFEDKDGDVVQVDIMQHNSGYWEPMHESWGSIWRIDPNRPLKGPYSLRITNESGKQLMAKNIIPDNYIPNTNYRSYVQY

SEQ ID NO: 22636 - DNA, 273 bp, Panicum virgatum
  misc_feature: Ceres CLONE 1822734
  misc_feature: Encodes the peptide sequence at SEQ ID NO. 22637
ttttcccctcttctccccgccgaacaacccccagtccctgataatctcgcacttgccttccccccgggcgggcctggggctcccggcagcgacgtccttcctcccctcgggcctctccgcggcgaaggagggggccgtgaaggaatcggcgttcctgggtgttcgtctcgcggatggcctcaacctggagaccagcgctctggggcagcgcggcaagagggggagcacgtcggggggcctcccgcgcgcaaaaggcgggggggtcctccccgt

SEQ ID NO: 22637 - protein, 90 aa, Panicum virgatum
  misc_feature: Ceres CLONE 1822734
  misc_feature: SWISSPROT Homolog: EC 1.3.1.33 Protochlorophyllide reductase
FPLFSPPNNPQSLIISHLPSPRAGLGLPAATSFLPSGLSAAKEGAVKESAFLGVRLADGLNLETSALGQRGKRGSTSGGLPRAKGGGVLP

SEQ ID NO: 22638 - DNA, 722 bp, Panicum virgatum
  misc_feature: Ceres CLONE 1822763
  misc_feature: Encodes the peptide sequence at SEQ ID NO. 22639
actcctgttgcggctgcggctgccgctggactcgtcgcgcctctcctccacctccctcctttccccacctccctctccagacagctcacgtactacccaagaaacagagcaaggccatctcggcaagatcaatccaggatcggagttcagagatgatggatgctgccgagcacaacgtgatcgggatcgcggcggagcccgggaggccctgctgcgtcgagtgccgcaccaccgcgacgcccatgtggcgcggcgggccgacggggcccaggtcgctttgcaatgcgtgcgggatccggtacaggaagaagaggaggcaagagctaggtcttgacaacaacaggaaaccacaacaaaaccagcagccgccgcaacagccacaacatcaagatcacagtcatgcaccgagtgcagtcagtgacaacaaaagtagcggcctgcaagtggtgaagaaacggagggtcctgatgggagtggaggaggccgcaatcctgctcatggccttgtcctcctcatccaggtccacactgctacatggctaggatctcaacaccacccaaaggctgctgctcaatgtgtacatacaaacctgatacaggacacaaagcacaacacgggccacccaatggtttccaagccaaccatgtaactttctcggattatcaggctggaaggcttctttcgggatgaagctgatgttgaaagggctggatttgtttttt

SEQ ID NO: 22639 - protein, 128 aa, Panicum virgatum
  misc_feature: Ceres CLONE 1822763
  misc_feature (20)..(55): Pfam Name: GATA Pfam Description: GATA zinc finger
MDAAEHNVIGIAAEPGRPCCVECRTTATPMWRGGPTGPRSLCNACGIRYRKKRRQELGLDNNRKPQQNQQPPQQPQHQDHSHAPSAVSDNKSSGLQVVKKRRVLMGVEEAAILLMALSSSSRSTLLHG

SEQ ID NO: 22640 - DNA, 1866 bp, Panicum virgatum
  misc_feature: Ceres CLONE 1822805
  misc_feature: Encodes the peptide sequence at SEQ ID NO. 22641
actgccccagtgctgcagtgcatcagcctagctgttccctgacgacaggtggtagccgtcggcttgtagtaggtgagccggcgcgcgcgtgcgagtgatcgagctgcaagaatggccgggggcgggttcgccgtggcggccgcggcgccgtccgccgactacggcggccgcgtgaccttctccgtcgtcgtcacctgcctcatggcggcgtccggcagcctcatcttcggctacgacatcggcatctcggggggcgtcacggccatggagtccttcctgtccgccttcttcccgggggtgctgcgccggatggccgcggcgcggcgggaccagtactgcgtctacgacagccacgccctcacggcgttcacctcctcgctctacctggccgggctggccgcctcgctcgtggccagccgcgtcaccagggcggtcgggaggcaggccgtcatgctcgccggcggcgcgctcttcttcgccggcgcgtcagtgaacgccgccgccgtcaacatcgccatgctcatcgtcgggcgcatgctgctcggcttcggcatcggcttcaccaaccaggcggcgccggtgtacctggcggagacggcgccgcccaagtggcggggcgccttcacgacggggttccagctcttcctcagcatcggcaacctggcggccaaccttgtgaactacggcacctcgcgcgtctccacctggggctggcgcctctcgctcggcctggccgcggcgcccgccgccgtcatcctcgccggggcgctgctcatcccggacacgcccagcagcctcgtcgtgcgcggccgcgcggaggaggcccgcgccgcgctccggcgcgtcaggggtcccaaggccgacgtggacgccgagctggaggacgtggcccgcgccgtcgaggcggcgcgcgcccacgaggagggcgcgttccggaggatcctccggcgggagcaccgccaccacctggcgatggccgtggcggtgccgctgttccagcagctcacgggggtcatcgtcatcgccttcttcgcgcccgtgctgttccagacggccggcttcggcagcgacggcgcgctcatgggcgccgtcatcctcggcgccgtgaacctgggctccacgctcgcctccaccgccaccgtcgaccggtacggccgcaggccgctgttcctgaccggcgggttcgtcatgatcgtctgccaggtcgccgtggcgtggatcatgggctcgcagatcggcggcgacggcgagtccgcgatggcgaggccctactccctggcggtgctggcgctgacgtgcgtgttctcggcatcgttcgggtggtcgtgggggccgctgacctgggtgatccccggcgaggtattccccgtggagatccggtcggcggggcagggcatcagcgtggccgtcaacctcggcgccacgttcctgctcacgcagacgttcctctccacgctgtgcgcgctcaagtacgccaccttcatctactacgcggcctgggtcgccgtcatgaccgccttcgtggtggcgttcctgccggagaccaagggggtgccgctcgaggccatgggcgccgtctgggagcgccattggtactggggccggttcgtgcagccgccaaccaagatcgacgaggaaccctgatgggaactgacggaagatgcaacgcttcttgtttgtggcggtgacaaacttcctcggacttgttctgtttgtgaatggcttcagtttgtttctttgtgtgttcgtcatcggaggaagacttgtgtatcaactaaaaacgaaattaagtacatattctatttcttttttgtgatttttgtaatgggtattgccagtggatggacgttccccatcggatggtcg

SEQ ID NO: 22641 - protein, 510 aa, Panicum virgatum
  misc_feature: Ceres CLONE 1822805
  misc_feature (28)..(490): Pfam Name: Sugar_tr Pfam Description: Sugar (and other) transporter
  misc_feature (21)..(442): Pfam Name: MFS_1 Pfam Description: Major Facilitator Superfamily
MAGGGFAVAAAAPSADYGGRVTFSVVVTCLMAASGSLIFGYDIGISGGVTAMESFLSAFFPGVLRRMAAARRDQYCVYDSHALTAFTSSLYLAGLAASLVASRVTRAVGRQAVMLAGGALFFAGASVNAAAVNIAMLIVGRMLLGFGIGFTNQAAPVYLAETAPPKWRGAFTTGFQLFLSIGNLAANLVNYGTSRVSTWGWRLSLGLAAAPAAVILAGALLIPDTPSSLVVRGRAEEARAALRRVRGPKADVDAELEDVARAVEAARAHEEGAFRRILRREHRHHLAMAVAVPLFQQLTGVIVIAFFAPVLFQTAGFGSDGALMGAVILGAVNLGSTLASTATVDRYGRRPLFLTGGFVMIVCQVAVAWIMGSQIGGDGESAMARPYSLAVLALTCVFSASFGWSWGPLTWVIPGEVFPVEIRSAGQGISVAVNLGATFLLTQTFLSTLCALKYATFIYYAAWVAVMTAFVVAFLPETKGVPLEAMGAVWERHWYWGRFVQPPTKIDEEP

SEQ ID NO: 22642 - DNA, 695 bp, Panicum virgatum
  misc_feature: Ceres CLONE 1822836
  misc_feature: Encodes the peptide sequence at SEQ ID NO. 22643
aatgcccaagcccaaggcagtaccataaccgacgcgagagtcgagacgcgagagaagaggggagcgagaaggcttcgccggggcaggatcgttgcggccacgaaagatgtcttactcaagaggatcgaggtatgaatctcgctcaccttacaggagaagcagctattcaaggtacagaagtcgctctaggagtgtggactcaagtgatgctgaaaaccctgggaacaacctgtatgtaactggtctatcagctcgtgtaactgaccgagatctggagaagcacttttctactgagggagagctgattgatgcgagcgttgtgcaagatccttggacaagggaatcacgagggtttggttttgttaccatggctactgttaaggaggcagatcgctgcatcaaatatctggaccgttctgttttggaaggtcgtgtcataactgttgaaaagattttgttgacagcaacagggtagatgttggtagctgctctgcaacaaactcatacaacctaacaccaaatcatgccacctcaaccaaaggcaaaaagaagacgaggtagaacgccaacacctgggaagtatcttggtacaaaatcatcacgaggacggaggtattcaccaagctactcacctgttcggagggaccgttacagttcacaatattcacctgatcgtgaacggtcttattctcctt

SEQ ID NO: 22643 - protein, 122 aa, Panicum virgatum
  misc_feature: Ceres CLONE 1822836
  misc_feature (42)..(113): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered lignin content
MSYSRGSRYESRSPYRRSSYSRYRSRSRSVDSSDAENPGNNLYVTGLSARVTDRDLEKHFSTEGELIDASVVQDPWTRESRGFGFVTMATVKEADRCIKYLDRSVLEGRVITVEKILLTATG

SEQ ID NO: 22644 - DNA, 647 bp, Panicum virgatum
  misc_feature: Ceres CLONE 1822837
  misc_feature: Encodes the peptide sequence at SEQ ID NO. 22645
accggacgcatccatctccttcctcctttacttcctcggttcctcccctctcccgcatcgtgacgtcagcagccatggtgaaggcctaccccacggtgagcgaggactacctcaaggcggtcgagaaggccaagcgcaagctccgcggcctcatcgccgagaagaactgcgccccgctcatgctccgcctcgcctggcactccgccggcaccttcgatgtctccaccaagaccggggggcccttcggcaccttgaagaaccccgctgagcaggtgcacggagccaacgccggtctcgacatcgccgtcaggctgctcgaacctattttttatcagttccccatcctatcctacgctgatttctaccagcttgctggggtcgtggccgtggaggtcaccggcggccctgaggtccccttccacccagggaggcaggacaagcctgagcctccaccggaaggccgccttcctgatgccacccaaggttctgaccacctcaggcaggtgttctccacacagatgggtttgagcgaccaagacattgttgcgctttctggtggtcacaccctgggaagatgccccaaggataggtctggctttgagggagcctggacttcccaccctttgatctttgaccactcttaactt

SEQ ID NO: 22645 - protein, 189 aa, Panicum virgatum
  misc_feature: Ceres CLONE 1822837
  misc_feature (19)..(189): Pfam Name: peroxidase Pfam Description: Peroxidase
  misc_feature: SWISSPROT Homolog: EC 1.11.1.11 L-ascorbate peroxidase
  misc_feature: Useful for making plants with modulated heat sensitivity
  misc_feature: Useful for making plants with modulated water use efficiency
  misc_feature: Useful for making plants with altered carbohydrate content
  misc_feature: Useful for making plants with altered cell wall content and/or composition
MVKAYPTVSEDYLKAVEKAKRKLRGLIAEKNCAPLMLRLAWHSAGTFDVSTKTGGPFGTLKNPAEQVHGANAGLDIAVRLLEPIFYQFPILSYADFYQLAGVVAVEVTGGPEVPFHPGRQDKPEPPPEGRLPDATQGSDHLRQVFSTQMGLSDQDIVALSGGHTLGRCPKDRSGFEGAWTSHPLIFDHS

SEQ ID NO: 22646 - DNA, 709 bp, Panicum virgatum
  misc_feature: Ceres CLONE 1822860
  misc_feature: Encodes the peptide sequence at SEQ ID NO. 22647
acacacacacccccctgatccgctctgctttgctgcttcctttcgaccgcgccaagccacaccaatggcggcgcgcgctctattgatgctgcgggaggcctccccgtgggcgctggccggcgcggcggcggccgtggcgctgctgtggctggtggcctggacggcggagtgggcctggtggacgccgcggcggctcgaccgggccctgcgggcccagggcctcaagggcacccggtaccgcatcttcaccggcgacctttgggagaacgtccggatcaaccgggaggctcgcaccaagccgctgccgctcggctgccacgtcatcgccccacgcgtgcagcccatgctccacagggccatcaaggaatacgggaaaatgtcgttcacctggttcggtccaataccgagggtgatgataccagacacggagttagtcaaagagattttgtctaacaagtttggccactttggtaaaccaaggagtacccgtatcgggaagctgctagccaatggggttgtcaatcatgagggcgagaagtgggcaaaacacaggagaattctcaatcctgccttccaccatgagaagataaagcggatgctgccggtattttccacttgttgcgccgaaaccattactaaatgggaggattcaatgccttccgaggggtctttggaggtttttgcccaccaaaaataacagaaggatgcg

SEQ ID NO: 22647 - protein, 210 aa, Panicum virgatum
  misc_feature: Ceres CLONE 1822860
  misc_feature: SWISSPROT Homolog: EC 1.3.3.9 Secologanin synthase
MAARALLMLREASPWALAGAAAAVALLWLVAWTAEWAWWTPRRLDRALRAQGLKGTRYRIFTGDLWENVRINREARTKPLPLGCHVIAPRVQPMLHRAIKEYGKMSFTWFGPIPRVMIPDTELVKEILSNKFGHFGKPRSTRIGKLLANGVVNHEGEKWAKHRRILNPAFHHEKIKRMLPVFSTCCAETITKWEDSMPSEGSLEVFAHQK

SEQ ID NO: 22648 - DNA, 1656 bp, Panicum virgatum
  misc_feature: Ceres CLONE 1822868
  misc_feature: Encodes the peptide sequence at SEQ ID NO. 22649
gcgccccgtcgccatgaccgcgagcgaatccgccaccaccgccatgtgacaaaggttggctacaggaataggaggagaatacaatatccgctcccatataatcctccccacgtcgccgtgctcgctctgcgcgtccaccagccccgcaacccgagccagcgcgacgaagccggggggcgatcgctccagcgccgccggcgatctcaccccccgggagccgccggcggtacccccacccttccgccgcctcgctgatccctcaggtctaagtagtttgtttggctctgtgagttatccaaggttgcaccggaaagatgagtaccactaatcgttatcaacccatcaagtcaaccaagcctgttgtaggcaaagcaaaaaaattgaaggatctcatgctaaaaagtgacaataggatatgtgctgattgtagcgcacctgatcccaaatgggcgtctgctactattggagtatttctttgcttaaaatgtggagatgttcatagggcacttggacctgacatttcaaaggttttatctgtaactttggatgattggtccgatagtgatattgactctatgcttgaggttggtgggaactcatatgcaaattcaatttatgaggcttttcttccaaaagatcaccccaaacctaaaccagattcaacgatggagtatagaacaaaattcataagagctaagtatgagactcaagattttttgaagccaagtttgcgcatttcttcgagatcatcttttaaatctaccacttctacaaggagtgtggatagcagtttctctagcacttcaagaaaggatgtctctgaagatacgagagaatttgttggtgagctgaacattaccgtggtgaaaggtactaacttggccgtccgagatatgctaacaagtgatccatatgttgttttatcacttggagcgcagagagatcaaacaacggttaaaccgagtgatctgaatccagtatggaatgaggtgcttaagatatctgtacctcgaaatcatggacctctaaaactcgaagtatatgaccatgatacattctctgccgatgatatcatgggtgaagcagagatagatctccagccaatgatcacagctgtcatggcctttggagatacttcacgccttggcgacatgcagattggaaggtggttcatgaccaaagataacgccctggttaaagatagcactgtgaatgttgtcgggggcaaggtaaaacaggaggtgcacctaaagctgcagaacgtagaatcaggtgagttggagttagaactggaatgggtcccgatctagactaccaatgataccttaccttacctgatcgttgtctaaaagcctaccctcaagatgcatcgatattcttcacttgagctgaatgccttgaaagctatccacttgctggtcttggacctttacgctggatagcttggatctgtaaaaatgtcattgtagaatatcctggtgtaactgttggatatactcgcggcctttcatttttgtctttggtcattcgttatgccttgtaaagtactctcgattgttgttgtattgtcccattgaaaggacttgtgtgttataagagatgacaattactggtagtgaattcttgtcctaaatgccatgttggtgccttgtaagc

SEQ ID NO: 22649 - protein, 331 aa, Panicum virgatum
  misc_feature: Ceres CLONE 1822868
  misc_feature (21)..(142): Pfam Name: ArfGap Pfam Description: Putative GTPase activating protein for Arf
  misc_feature (179)..(258): Pfam Name: C2 Pfam Description: C2 domain
  misc_feature: SWISSPROT Homolog: EC 3.1.1.4 Phospholipase A(2)
MSTTNRYQPIKSTKPVVGKAKKLKDLMLKSDNRICADCSAPDPKWASATIGVFLCLKCGDVHRALGPDISKVLSVTLDDWSDSDIDSMLEVGGNSYANSIYEAFLPKDHPKPKPDSTMEYRTKFIRAKYETQDFLKPSLRISSRSSFKSTTSTRSVDSSFSSTSRKDVSEDTREFVGELNITVVKGTNLAVRDMLTSDPYVVLSLGAQRDQTTVKPSDLNPVWNEVLKISVPRNHGPLKLEVYDHDTFSADDIMGEAEIDLQPMITAVMAFGDTSRLGDMQIGRWFMTKDNALVKDSTVNVVGGKVKQEVHLKLQNVESGELELELEWVPI

SEQ ID NO: 22650 - DNA, 650 bp, Panicum virgatum
  misc_feature: Ceres CLONE 1822869
  misc_feature: Encodes the peptide sequence at SEQ ID NO. 22651
atcgggaatattcatgggcggtttgagccggaaaattctaccaaagaggccttattgattggatctcatatggacactgttattgatgctggaatgtatgacggatcattgggtattattagtgcaatctctgccttgaaggttttgaaaattactgggaaactgcaaaggctaactagaccagtcgaggtcattgcattcagcgacgaggagggtgttaggttccagacaacttttctgggaagcgccgctgtagctggtacactacctgaatcaattttacaagtatcagacaagagtggcactacagtccaagatgttctgaaaataaattcttttgaggctactgctgctgctattactcaaaccaggtacaagccagagtcagtggggagctatgttgaggtacacatggagcaaggccctgtcctagaagctctccgttatccgcttggtgttgtaaaaggaattgcaggccagacgcgattaaaggtaatagtagatggttcacaagggcatgctggcacggttccaatgaaattgcggcgtgatccgatggttgcagctgcagagctggttgtgactctggagcgcctctgcaaagagcccaacaagctgctgacctacgacgaggagtgcggctgcttcac

SEQ ID NO: 22651 - protein, 216 aa, Panicum virgatum
  misc_feature: Ceres CLONE 1822869
  misc_feature: SWISSPROT Homolog: EC 3.5.3.9 Allantoate deiminase
IGNIHGRFEPENSTKEALLIGSHMDTVIDAGMYDGSLGIISAISALKVLKITGKLQRLTRPVEVIAFSDEEGVRFQTTFLGSAAVAGTLPESILQVSDKSGTTVQDVLKINSFEATAAAITQTRYKPESVGSYVEVHMEQGPVLEALRYPLGVVKGIAGQTRLKVIVDGSQGHAGTVPMKLRRDPMVAAAELVVTLERLCKEPNKLLTYDEECGCF

SEQ ID NO: 22652 - DNA, 707 bp, Panicum virgatum
  misc_feature: Ceres CLONE 1822886
  misc_feature: Encodes the peptide sequence at SEQ ID NO. 22653
aaaaatattttactccctctttctctctccctgtctgctcccctttctcctcccctcgccgtcagggagcttcgccgccgccgccgccgccgcagctccgtctcttcgccgcggacgcagctgtgactttagacaattgttggaacatcaagtgccgatggctggtgccgacataattgatgattctgctgcgagcagcagtgggttgggtgatgaggatcgcggtgtctctggtgattcgctttctgtgtggcgatcctgcgagcagcttgataatgggatcccatcaacttcccctcccttttgggacaccgatggtgatgatgatgatcctgggaccagacctttggatttatttgggcaatatacttggagaatagaaaacttttcaaaggagaagaagagagaaatgaaaagcgaaccttttgaagctggtggttacgagtggtatattctagtttaccctcaaggatgtgatgtctccaaccacttgtcattgtttctttgtgttgctaatcatgaaaaactcctcccaggatggagccattctgcacaatttactatagccgtgggcaaccttgatccaaaaaaaaataaatattcagacaccttacacagattctggaagaaggaacatgattggggatggaaaaagtttatggagttgtcaaagattcgagatggttttcttgttgacgatgttcttg

SEQ ID NO: 22653 - protein, 183 aa, Panicum virgatum
  misc_feature: Ceres CLONE 1822886
  misc_feature (74)..(183): Pfam Name: MATH Pfam Description: MATH domain
  misc_feature: SWISSPROT Homolog: EC 3.1.2.15 Ubiquitin thiolesterase
MAGADIIDDSAASSSGLGDEDRGVSGDSLSVWRSCEQLDNGIPSTSPPFWDTDGDDDDPGTRPLDLFGQYTWRIENFSKEKKREMKSEPFEAGGYEWYILVYPQGCDVSNHLSLFLCVANHEKLLPGWSHSAQFTIAVGNLDPKKNKYSDTLHRFWKKEHDWGWKKFMELSKIRDGFLVDDVL

SEQ ID NO: 22654 - DNA, 1121 bp, Panicum virgatum
  misc_feature: Ceres CLONE 1822932
  misc_feature: Encodes the peptide sequence at SEQ ID NO. 22655
aaaccccctcttcctcctcgccgctcacctccactccgccatggccttcgtctccgtctccgtctccgcctccgcatccgccaccctcctcatctccgtcccgtccaccggacgcgccggcgccggcgcatgcgccttcccgcagccccggcggaccctcctggccccgctgcacgcggcgaagggcgccaagtcggtgccggtggaggtggtgatggagagcaaggtcaaggggaagaaaaagaaggggtccggcgccgggaacctccccggagcgctcgatgtcgagatcagggaggcgcaggagtacctcaacagtgacgagcaggaacctgttccagacaacttcccttttgaaatccttgatgaagatggtatgagcgtggttattttgaaaagggactacaaggatgagaagattgaggtcgttgtcagcatgcctaatttagaagggggtcctgagtttgatgatgaggatggtgagggcgacggtgagagtgctgacaaggatgatgatgaagaagaagatgagagtgctggagatagtagcatttctttgaaggttgtagtctccaaagcctctggcccgaagcttgagttcacctgcacagccttccgtgaggagatcaccatcgatgatatgctgatagtagagaaagcagatgatgatggagaagagaagttcccatacgagggccctgaattcacggagctccctgtgaatgtgcagaaaggcctgttcaagtacctggagcaacggggtatcacgctgtcagctaccaactacatgcacgactacatggtgaccaagcaggcccaggagtacatccggtggatgaggaagctgaaggatttcgtccagcaatgaggaacagcaacgtgaattggcaacattgttttggtagcagcctcgccttagtgtgttagaggaaaattacaattacgcaaagcttatgactccctaaaggagagggaaagatgtatctgtctcatttaatctgtatcagctggcgaatcaggagcatgtagatttctagttgcattgttgcatttcaagaaaattaagaattactggttacttctagctttagctgtttaccatttctgtgctgcttctctgg

SEQ ID NO: 22655 - protein, 275 aa, Panicum virgatum
  misc_feature: Ceres CLONE 1822932
  misc_feature (80)..(273): Pfam Name: MAM33 Pfam Description: Mitochondrial glycoprotein
MAFVSVSVSASASATLLISVPSTGRAGAGACAFPQPRRTLLAPLHAAKGAKSVPVEVVMESKVKGKKKKGSGAGNLPGALDVEIREAQEYLNSDEQEPVPDNFPFEILDEDGMSVVILKRDYKDEKIEVVVSMPNLEGGPEFDDEDGEGDGESADKDDDEEEDESAGDSSISLKVVVSKASGPKLEFTCTAFREEITIDDMLIVEKADDDGEEKFPYEGPEFTELPVNVQKGLFKYLEQRGITLSATNYMHDYMVTKQAQEYIRWMRKLKDFVQQ

SEQ ID NO: 22656 - DNA, 652 bp, Panicum virgatum
  misc_feature: Ceres CLONE 1822948
  misc_feature: Encodes the peptide sequence at SEQ ID NO. 22657
agggagaagcctcctccagcagggaacagaacaagggaagcaaggagaaccccagaacagaaagaggccgcgaggagccgcggggttcccgtcttccaaaacgaagcatctccgggacgccggggaacggggccgaacagggagggaagaaggggcacccagaagccgcccagggggggggccccctgaagaatcccgacaagaaggggcagttcccgctctcgcaccgggggggggtcgcgccgctcacgccctgccgctcctaccggaacctggcccaaccccccgccgcgttggactacccgcagcgcgccacccggggggggctcctcctcggcgaaggcacggggggctccccccccgcgcaagggtacccggaaaaccccgggatctggacgcccgaacaaggccaggggtggaaacccctcctccaccccctccaccggaagggcgggatcttcttctggcagaactgggacggcgggagggtctccaccaaccagctcccgcctggacggcaggcgcccatctccagcacggacaggcagaattcccccgacccccaatcctggaaggggtactccaagccgcgccgggtggggaacgaagaaattcggggggtcgtccaccaattccagcctggcgcgcggaa

SEQ ID NO: 22657 - protein, 216 aa, Panicum virgatum
  misc_feature: Ceres CLONE 1822948
  misc_feature: SWISSPROT Homolog: EC 1.3.1.42 12-oxophytodienoate reductase
  misc_feature: Useful for making plants with modulated water use efficiency
GEASSSREQNKGSKENPRTERGREEPRGSRLPKRSISGTPGNGAEQGGKKGHPEAAQGGGPLKNPDKKGQFPLSHRGGVAPLTPCRSYRNLAQPPAALDYPQRATRGGLLLGEGTGGSPPAQGYPENPGIWTPEQGQGWKPLLHPLHRKGGIFFWQNWDGGRVSTNQLPPGRQAPISSTDRQNSPDPQSWKGYSKPRRVGNEEIRGVVHQFQPGAR

SEQ ID NO: 22658 - DNA, 647 bp, Panicum virgatum
  misc_feature: Ceres CLONE 1822953
  misc_feature: Encodes the peptide sequence at SEQ ID NO. 22659
ctccctccgcctgcttcctgtccaacttttctcccccaatcttcctcgcaatccccgtagcctccccgcgagcatcgaccatgtcggcctactgcggaaagtacaaggatgagctcatcaagaatgctgcctacattggcacccctggaaagggtatccttgcagctgatgagtccactggcaccattggcaagcgtctttccagcatcaacgttgagaacatcgaggagaaccgccgtgccctccgtgagctcctgttctgctgccctggtgcccttcagtacataagtggtgtgatcctcttcgaggagaccctgtaccagaagattaaggatggcaagcccttcgttgatgtcctcaaggagggaggcgttctccctggcatcaaggtcgacaagggcaccattgaggttgctggcactgacaaggagaccaccacccagggccatgatgaccttggcaagcgctgtgccaagtactacgaggccggtgcccgctttgccaagtggcgtgctgtcctcaagattggccccaacgagccatcgcagcttgccattgacctgaatgctcacggtcttgctcgctatgccatcatctgccaggagaatggtctggttccgattgtggagcctgagatcctcatcgat

SEQ ID NO: 22659 - protein, 188 aa, Panicum virgatum
  misc_feature: Ceres CLONE 1822953
  misc_feature (11)..(188): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature: Useful for making plants with modulated phosphate use efficiency
  misc_feature: Useful for making plants with modulated biomass
MSAYCGKYKDELIKNAAYIGTPGKGILAADESTGTIGKRLSSINVENIEENRRALRELLFCCPGALQYISGVILFEETLYQKIKDGKPFVDVLKEGGVLPGIKVDKGTIEVAGTDKETTTQGHDDLGKRCAKYYEAGARFAKWRAVLKIGPNEPSQLAIDLNAHGLARYAIICQENGLVPIVEPEILI

SEQ ID NO: 22660 - DNA, 513 bp, Panicum virgatum
  misc_feature: Ceres CLONE 1822957
  misc_feature: Encodes the peptide sequence at SEQ ID NO. 22661
cgaagcttctcgaccgcctcctctcctcctcacatggccggcgacgcgaaggccgaggcggcgcgggcgaggccggagtcctcgcaggaggaggaggaggactggaaggaggccgagggggacgtcgccgaggtcgaccgcgccccccccaatggcgccggcgaggggcaggtgcccacggaccgcccgatccgggtctacccccacggcatctacgacctcttccacttcggccacgcccggtcgctcgagcaggccaagaacctgtttccaaacacatatcttcttgtcggatgctgccatgatgagttgacccacaaatacaaaggaagaactgtcatgactgaggatgagcgatatgactcacttcgtcattgcacgtgggttgacgaagtcattcctgatgctccatgggtggtgtcagaagaattcttggataagcataacattgattttgttgctcatgattctctgccgtatgctgatgctagtggagctggtaaagatgtttat

SEQ ID NO: 22661 - protein, 159 aa, Panicum virgatum
  misc_feature: Ceres CLONE 1822957
  misc_feature (55)..(156): Pfam Name: CTP_transf_2 Pfam Description: Cytidylyltransferase
  misc_feature: SWISSPROT Homolog: EC 2.7.7.15 Choline-phosphate cytidylyltransferase
MAGDAKAEAARARPESSQEEEEDWKEAEGDVAEVDRAPPNGAGEGQVPTDRPIRVYPHGIYDLFHFGHARSLEQAKNLFPNTYLLVGCCHDELTHKYKGRTVMTEDERYDSLRHCTWVDEVIPDAPWVVSEEFLDKHNIDFVAHDSLPYADASGAGKDV

SEQ ID NO: 22662 - DNA, 673 bp, Panicum virgatum
  misc_feature: Ceres CLONE 1822980
  misc_feature: Encodes the peptide sequence at SEQ ID NO. 22663
agaccaccgagctgaaactagagaggcagccaggcagagatagcgtgttcatcaggcggcagcaaggcaagaacctccaagaagggaaccaggaaaccaaggaggaagagggagagatcagagatggcggcaagggctgtgtccacctccacccttgcggcaccagccacgatggtgctggccgcggcggtcctcctggccggcggcgcgtcggcgcagtcgccgccgtcgtctccggcgagccagtgcacatcggtgctggtgagcctgtcgccgtgcctgaactacatcgccgggaacgagtcgaccgcgccggcgtcgtgctgcacgcacctgggccaggcggtgcgcaccgacccacaatgcctgtgcgtggcactgagcacggaccctgcgtcgctggggctcagaatcaaccgcaccctcgcgctgggcctccacaccgcctgctacgtcacctcccccgactacatcagcatctgggcgctcatggcccctacgtcagcggcgcgagaatgtgtcacctgctgatcttagcctggggccgaagctcttccacctccaagtcgcactggagcatttcaaaggctggaagatcccagaaaacctgaccagcgtccatgcctacacccaggcacttttcagccgcgaatcttttgtgaagactaagcca

SEQ ID NO: 22663 - protein, 135 aa, Panicum virgatum
  misc_feature: Ceres CLONE 1822980
  misc_feature (42)..(118): Pfam Name: Tryp_alpha_amyl Pfam Description: Protease inhibitor/seed storage/LTP family
MAARAVSTSTLAAPATMVLAAAVLLAGGASAQSPPSSPASQCTSVLVSLSPCLNYIAGNESTAPASCCTHLGQAVRTDPQCLCVALSTDPASLGLRINRTLALGLHTACYVTSPDYISIWALMAPTSAARECVTC

SEQ ID NO: 22664 - DNA, 1195 bp, Panicum virgatum
  misc_feature: Ceres CLONE 1822981
  misc_feature: Encodes the peptide sequence at SEQ ID NO. 22665
taggggctagggttaccctccaccccaatcccatcgtccgttccgatccggttcgatcccccgccgcccaagccttcgccgctcatccatgtcccaccacgacggcagcaagccttaccagccgcgccgggggcccgagcggcccccgcagccggcggacgaggtcgccgcgccgccccccgccgccgctgccccggcggtggaccacctcgccgcggtggccgccgaggcggaggcgctgaaccgctacaccgagcatcagcagcagcagcagcagcagcagcttcaggggcacgaacagattggggaggaagaggacgacgatgacgaggaggaagatgaggtggaggacgacgaggacgagcaggaggggcaggacggcggcgtcggcggggagcacgtccccatggacgcggatgctgctgccgctgccgcggctgctgccagcgctcagatggacccgcacgcggcgatggtgcctggggccgtgccgcccatggcgcccaaccagctcaccctctctttccagggcgaggtctacgtgtttgattccgtctcgcctgataaggttcaagccgttctcttactgcttggaggaagggagctgaacaacccaggactgggcaacgcgtcgtcctctggagcatacagtaagaggttgaattatcctcatcgggtggcatcgttgatgaggtttagggagaagcggaaggagcggaactttgataagaagatccggtactctgtaaggaaggaagttgcacttaggatgcagcgcaatcgaggtcagtttacatcttcaaaaccaaagcctgaagaaatatcagcatcagaaataatgactgcagatggctccccgaattgggggtcagtggaaggccgacctccatccgctgccgaatgccatcactgtggtactagtgcaacagctacacctatgatgcgtcgtggacctgacggacctagaacgttatgcaatgcttgtggcctcatgtgggcaaataagggtctgctgagggacttgtcaaaaggtcctgggcctcttcaagctgtgcaatcagcacctgttctagatggtggtaatggaagtgtcatagggaatcctggtggtggtgggctagagaatcctgcatcagcgatggccaatggccatgagtcatcaatgtgaccggagtagctgtgcatattcagcgat

SEQ ID NO: 22665 - protein, 359 aa, Panicum virgatum
  misc_feature: Ceres CLONE 1822981
  misc_feature (196)..(240): Pfam Name: CCT Pfam Description: CCT motif
  misc_feature (272)..(309): Pfam Name: GATA Pfam Description: GATA zinc finger
MSHHDGSKPYQPRRGPERPPQPADEVAAPPPAAAAPAVDHLAAVAAEAEALNRYTEHQQQQQQQQLQGHEQIGEEEDDDDEEEDEVEDDEDEQEGQDGGVGGEHVPMDADAAAAAAAAASAQMDPHAAMVPGAVPPMAPNQLTLSFQGEVYVFDSVSPDKVQAVLLLLGGRELNNPGLGNASSSGAYSKRLNYPHRVASLMRFREKRKERNFDKKIRYSVRKEVALRMQRNRGQFTSSKPKPEEISASEIMTADGSPNWGSVEGRPPSAAECHHCGTSATATPMMRRGPDGPRTLCNACGLMWANKGLLRDLSKGPGPLQAVQSAPVLDGGNGSVIGNPGGGGLENPASAMANGHESSM

SEQ ID NO: 22666 - DNA, 736 bp, Panicum virgatum
  misc_feature: Ceres CLONE 1822986
  misc_feature: Encodes the peptide sequence at SEQ ID NO. 22667
acgattcaaaccagcatcgtcagagatgtcagaggaacagaaacacaacatgaaacttttacagagctcatcccagtcccaggtggagctctgctagggtctccaggcgtgtgtgccatgtgctgctggtgctcctgcctggagtgcatccataacatccctcccctcaacctcctcttcctccacttgtcctccgacccagctctcccggctggagaagaaggcgcagccgtctccatggcctccatctcggttcccgacccggtccctcccgccaccgaagacgccgagaacattaggaaagcggtgcaaggatggggcacggacgagaaggcgctgatcgagatactgggccaccggacggcggcgcagcgcgccgagatcgccgtggcctacgagggtctctacaacgagacgctcctcgaccggctccactccgagctctccggcgacttccggagcgcgatgatgctgtggaccatggacccggcggcgcgtgacgccaagctcgctcacaaggccctgaagaagaagggcgaccggcacgtgtgggtgctcgtcgaggtcgcctgcgcgtcgtcgccggaccaccacgtcgccgtcaggaaggcctactgcgccgcctactcggcgtccctcgaggaggacgttgccgcctgcccgctctacaaggacccccctcagcagttcttggtgcggctcgtgagctcctaccggtactccggcgagctcgtcg

SEQ ID NO: 22667 - protein, 206 aa, Panicum virgatum
  misc_feature: Ceres CLONE 1822986
  misc_feature (55)..(120): Pfam Name: Annexin Pfam Description: Annexin
  misc_feature (127)..(195): Pfam Name: Annexin Pfam Description: Annexin
MCCWCSCLECIHNIPPLNLLFLHLSSDPALPAGEEGAAVSMASISVPDPVPPATEDAENIRKAVQGWGTDEKALIEILGHRTAAQRAEIAVAYEGLYNETLLDRLHSELSGDFRSAMMLWTMDPAARDAKLAHKALKKKGDRHVWVLVEVACASSPDHHVAVRKAYCAAYSASLEEDVAACPLYKDPPQQFLVRLVSSYRYSGELV

SEQ ID NO: 22668 - DNA, 745 bp, Panicum virgatum
  misc_feature: Ceres CLONE 1823005
  misc_feature: Encodes the peptide sequence at SEQ ID NO. 22669
aacaaacgcggccgcctcgccctcgccttacttctctcctccccctcttccccgccccgccgccacttctcccaccactcttcgccaccgcgccgccgccgcgaagaaggcgaagcggcaccggaaggagaagaagcgaagcgaggcccttccccgcccgtgcccgacgaggcaagccggatccggaagcgagggaagagaaagagagagcggcgcgaggatgccgacggtgacctgcaacgcgtgcaacgcggagttcgacgacgaggagcagcaaaggctccactaccgctccgagtggcaccgctacaacctcaagcgcaaggtggctggagttcctggtgtgaccgaagctctgtttttggctagacaagctgctttagcggaggggaacaagcctgcaagcacccctatgctttacagttgtgctctctgtggcaaggagtacaggagcacaaaagctcatgcacagcatcttaactcgcgatcacatcttatgagatcctctcaggagcccaatgcctcaattgctggaattactatagtcaagccacttcctgagcgagttccacgtagagctccatctgcagtagaggaagatgaagatgaggaggaagagtgggttgaagttgacccaaatgagatggagttggctgatgagtctacttcaaacatgcaagtagatgagcagtcatcccaatcagatgatgacatggatgatcttgaagagttggatatctcgtct

SEQ ID NO: 22669 - protein, 174 aa, Panicum virgatum
  misc_feature: Ceres CLONE 1823005
  misc_feature: The sequence is a functional homolog of SEQ ID NO 512 in the 11/479,226 US patent application
MPTVTCNACNAEFDDEEQQRLHYRSEWHRYNLKRKVAGVPGVTEALFLARQAALAEGNKPASTPMLYSCALCGKEYRSTKAHAQHLNSRSHLMRSSQEPNASIAGITIVKPLPERVPRRAPSAVEEDEDEEEEWVEVDPNEMELADESTSNMQVDEQSSQSDDDMDDLEELDIS

SEQ ID NO: 22670 - DNA, 610 bp, Panicum virgatum
  misc_feature: Ceres CLONE 1823011
  misc_feature: Encodes the peptide sequence at SEQ ID NO. 22671
ttctttttgctgagtggtaccacgttgatacaatggttaagatgacattcttcgatgagaatacccgcagttggtggactccaattactggtggtgcaaatatacctgcacttaatgaacttctggcaccctttggcattgctttgggggacaaaatacttactggtgacttctcgatcaatggtgagcagacccactatgcttctggaactgatatagtacaatttccagcgggcggtttcttgcatagcttccagctccaggaaaactcgaagtctgtgcaggatcacataggatttttagatgcagaaaactccgaggaaaaaaacaagctatcctcaattcttggaatgatggaagcaggagaaggaaggattgcagtctatggtgattcaaattgtcttgacagtagtcacatggtaacaaactgctattggcttttgagaaaaatattggagttcactggcaatagattgaaagatcctgtccttttctcaaaggccgcacagttaaagtttccagtttttgagaatatccatcagccatcacgtagatcagatgtaaacttttcaacgtactcagcagtcgttggcaaggaattgatctgtca

SEQ ID NO: 22671 - protein, 202 aa, Panicum virgatum
  misc_feature: Ceres CLONE 1823011
  misc_feature: SWISSPROT Homolog: EC 3.4.21.112 Site-1 protease
LFAEWYHVDTMVKMTFFDENTRSWWTPITGGANIPALNELLAPFGIALGDKILTGDFSINGEQTHYASGTDIVQFPAGGFLHSFQLQENSKSVQDHIGFLDAENSEEKNKLSSILGMMEAGEGRIAVYGDSNCLDSSHMVTNCYWLLRKILEFTGNRLKDPVLFSKAAQLKFPVFENIHQPSRRSDVNFSTYSAVVGKELIC

SEQ ID NO: 22672 - DNA, 712 bp, Panicum virgatum
  misc_feature: Ceres CLONE 1823021
  misc_feature: Encodes the peptide sequence at SEQ ID NO. 22673
gacttgtcatgtcgtcgtcgcccacgccggcggcgtcggccgttccaggctcggcggcagcgccgcacgtcgtcgtcgttgaggactgcttcggcgtcgtgcagctgctcagcgacggcacggtgaggcggtccacggactactcggtgctcccactcgtgggcggcgtgccgtcggacctgcccgtggagtggaaggacgtcgtctacgacgacacgcacggcctccggctgcggatgtaccggcccaccaccaccggcgggggaggggtgaacaagaagctgccggtgctcgtgtacttccacggcggcggcttctgcatcgccagcttcgaggtgatcaacttccatgccggtgcgctccggctcgccgccgagctcccggcgctcgtgctctccgccgactaccgccttgcgcccgagcaccgcctccccgctgcgctcgacgacgccgagaccgtcttctcctggctccgtgctcaagccactgcgtcccccgctgccgacccgtggctcgccgagtcggccgactttggccgggtgttcgtcagcggcgactcggccggcggcaacatctcgcaccacatctcggtgcggcacggctcgggaaggctccccctcggccccctccggctcgccgggtgcgtgatgctctggccctacttcggcggcgaggagccgacgccgtccgaggcggcgtccccgcccggcga

SEQ ID NO: 22673 - protein, 234 aa, Panicum virgatum
  misc_feature: Ceres CLONE 1823021
  misc_feature (95)..(234): Pfam Name: Abhydrolase_3 Pfam Description: alpha/beta hydrolase fold
  misc_feature: SWISSPROT Homolog: EC 3.1.1.3 Triacylglycerol lipase
MSSSPTPAASAVPGSAAAPHVVVVEDCFGVVQLLSDGTVRRSTDYSVLPLVGGVPSDLPVEWKDVVYDDTHGLRLRMYRPTTTGGGGVNKKLPVLVYFHGGGFCIASFEVINFHAGALRLAAELPALVLSADYRLAPEHRLPAALDDAETVFSWLRAQATASPAADPWLAESADFGRVFVSGDSAGGNISHHISVRHGSGRLPLGPLRLAGCVMLWPYFGGEEPTPSEAASPPG

SEQ ID NO: 22674 - DNA, 1114 bp, Panicum virgatum
  misc_feature: Ceres CLONE 1823035
  misc_feature: Encodes the peptide sequence at SEQ ID NO. 22675
accaatccgcgattccttacacgctaaggcgtcgacctccagctcttcttcttccatccttcaccgcgacgccggcgagaccagcggcgcccagatctctgctcttttccgctgagcttgctctagcagacatgaggaagtcgagcagcaccggcgcccatgtcatcggggtcccggtcacctccaaggcgttcgggatagaggcggcggcttccaccagggatccgtcgtcgttcaggaagggcaacggcgaccacctcgctgtctcgctcacgcaccccagcccgtatgcgtctttcggctacaaccacagcagcaagggccaggtggtccactgggtcagcaagctgagcaggcgggcgcagggcttcagggagcatgtgaccttgggcccgaagctgtcggagacggtgaaagggaagctaagcctgggcgcgcggatcctgcaggccggcggcgtcgagcgcgtgttccggcaggccttctccgccgacaagggcgagcggctggtcaaggcgctgcagtgctacctctacacgacgggcggccccatcgccgggatgctcttcgtgtccaccaggaaggtcgccttccgcagcgaccgccccatcacggtgagctcgcccaggggcgacacggcgcgggtcacctacaaggtggtggtcccgctccggcggatccgcgaggtgcggcccagcgagaacgccgacaggccggaggagaagtacatccgcgtcgccacggtggacggcttcgagttctggttcatggggttcgtcagcttccagcggtcgtggaggtgcatgcagcaggccgtctcggagctacagtgaccgcgcggcctgggtggtgaggaggaggaggtccggtgcatgtatggctgccctgtcggcacgacgagaagaggatgctacggcctgcgtcgccatcttttgttgcgaggtagccgtgtagctaaaggttgccccaataatctaagccggggcaattgagttccttccgcgtacgatttggatcaactttgtgttgctcgaagcggttgcgtgaagcatggaccgggaaattaaccatttatgcatgttgttgttgaatggaagagctcgccttttttttt

SEQ ID NO: 22675 - protein, 233 aa, Panicum virgatum
  misc_feature: Ceres CLONE 1823035
  misc_feature (112)..(190): Pfam Name: GRAM Pfam Description: GRAM domain
MRKSSSTGAHVIGVPVTSKAFGIEAAASTRDPSSFRKGNGDHLAVSLTHPSPYASFGYNHSSKGQVVHWVSKLSRRAQGFREHVTLGPKLSETVKGKLSLGARILQAGGVERVFRQAFSADKGERLVKALQCYLYTTGGPIAGMLFVSTRKVAFRSDRPITVSSPRGDTARVTYKVVVPLRRIREVRPSENADRPEEKYIRVATVDGFEFWFMGFVSFQRSWRCMQQAVSELQ

SEQ ID NO: 22676 - DNA, 2341 bp, Panicum virgatum
  misc_feature: Ceres CLONE 1823050
  misc_feature: Encodes the peptide sequence at SEQ ID NO. 22677
agggcggacgagcagtagccactggaagattctcgcggccccaacgctccccgaaccggcgatggggcgggaggcgacgaagctcgacgccgagcagcagcagctcctgctgcgccgctgccgccggctcttcaccgccgaagagcgctcgttccacatggatcggcgctcgcaggccgcctccgccctccgcgctgccgtcgccgacgtgctctcccgcttcctcggcacctacacggacgaaacccttgcggagtacattgtaattttaatctgtaatggaaaacatcaatatcaagcgcgtgacgacttggaggcctttcttggtgatgacagtgcaaaatttgttgcatggctttggagttatctgagcaaacaggctgtgacatcagctaataattgtaactttgaacttgggatggacaatgagattgagaacttgaatgacaagagaaatcttcttgttgtgaaagcccaccatggggatgctcatgatgtaaactcaaagatctcagtaccagaaacataccatggtcttcataagcttgattcaactacaggacgaaatgtgcctctgcggtgtatcagctccactgttataatttctcctgaaaaattgcgcagcgatcagtgcatttgggagaatcagcatcacaagaatggtcaaaacgcagcaagcagcagaagcttctctgaaaggactacacaaatattaatgcaagagcacctcggaagaaatgcttctacaagatggttgcctgaggctgtgggaatcgatgatggaagagtaccagtgtccctgaaacgacgtcgcaatgtctgggataggctagggaagcctgttgtagaagatcgtgttttagttagacaagctcatggcatatctgttcaaaatggagtacataagatgcccaagttgatggtggctgagcatgaacaaagatacgatgtcatctcaaatgcacaaaatgaaacaggttccagaaaattcaccaatggctttacagatgtcaacacattgcaaggacaacagcatgcggggaagccaaatagaagcaggcttattggccggctaagttttggtaaaggaaatgtgtttcatggtgatatgggacgcaataatcatcaagatagagatgttatcagccagaagtctagtttgtcattgccaatcaaaagcattcaatcccaaagtttggatgagttcacatgtgacatgaaggactcacctgctgctgtttctgagcccacatgtaatatattcaaaccatcaaaaggtcatgtgttggcttccaaaaagttgcctccactaactatgcagagaaattcagaaactgaagtattgcatcgtgagcaagttagcagccctgcacagtcaaagactccatcgtctgtacatgaagatggtaacagttgcaggaacaagcctgtgaaagaagaaattttggatgtcaaactaaagctcaagcaaatggaacaagacgtcctcaagcttcgttcccagcaggcacagataaacaatggaaagcaaggagccctatcattaggcccccatgctaattcggaagaagatgctgactccagaactattttcgtcagaaatgtacattttgcggcaacaaaggaagcattgtcaatgcatttcatgaagtgtggcactgtgcttaaggttaacattttgacagatgccattactggccaacctaaaggggctgcatatattacatttgctgacagggaatctattgagaaggctgtatctttgaatgggacatcatttctcaccagagtactcactgtaatgcataaagctgatgcacctccaggatttttggcatctattcaacaggctgggggctctatgcctgtgcagccatggaagtcgccaccgctcaagaaagtgtcaaccccaaaggccactggttaccatctccagtggaaacgcgaccagtctgtgttggagaaatcccctgccagctgcgccaccaactgattatcaaatttgggaatacaagaaaatcacacttgcgctacatctgcttgcaatgccaatgcacacagcttcgcacgagggtgaccatatggtttataacagattaaagaaagaatgtttttctttggtatctgttaatgttcctggcaggttttttcagaggcggattcatgagatgagataggtttttcccgcagccaaatataaaggccccagtatcggatatgctgtagttccatgaaaccttcgacctctgaatgatggctgccgttccagtgacatgaaatgtaattacatttcgggaacttaacataagtctgaaaatatagagaagcaaagcttgggttt

SEQ ID NO: 22677 - protein, 643 aa, Panicum virgatum
  misc_feature: Ceres CLONE 1823050
  misc_feature (510)..(580): Pfam Name: RRM_1 Pfam Description: RNA recognition motif. (a.k.a. RRM, RBD, or RNP domain)
MGREATKLDAEQQQLLLRRCRRLFTAEERSFHMDRRSQAASALRAAVADVLSRFLGTYTDETLAEYIVILICNGKHQYQARDDLEAFLGDDSAKFVAWLWSYLSKQAVTSANNCNFELGMDNEIENLNDKRNLLVVKAHHGDAHDVNSKISVPETYHGLHKLDSTTGRNVPLRCISSTVIISPEKLRSDQCIWENQHHKNGQNAASSRSFSERTTQILMQEHLGRNASTRWLPEAVGIDDGRVPVSLKRRRNVWDRLGKPVVEDRVLVRQAHGISVQNGVHKMPKLMVAEHEQRYDVISNAQNETGSRKFTNGFTDVNTLQGQQHAGKPNRSRLIGRLSFGKGNVFHGDMGRNNHQDRDVISQKSSLSLPIKSIQSQSLDEFTCDMKDSPAAVSEPTCNIFKPSKGHVLASKKLPPLTMQRNSETEVLHREQVSSPAQSKTPSSVHEDGNSCRNKPVKEEILDVKLKLKQMEQDVLKLRSQQAQINNGKQGALSLGPHANSEEDADSRTIFVRNVHFAATKEALSMHFMKCGTVLKVNILTDAITGQPKGAAYITFADRESIEKAVSLNGTSFLTRVLTVMHKADAPPGFLASIQQAGGSMPVQPWKSPPLKKVSTPKATGYHLQWKRDQSVLEKSPASCATN

SEQ ID NO: 22678 - DNA, 1480 bp, Panicum virgatum
  misc_feature: Ceres CLONE 1823058
  misc_feature: Encodes the peptide sequence at SEQ ID NO. 22679
ccaagtcaccagcgcacgcaaaggtacacgcacaggcacgcacacctcttctccctcgcagcctcgcttcgcgtccctcctcttctcttctcttctcttgtccgtcgcgtcagaaatcaggaggcacaagagaaaagaatccaagaggctttgtttgatcaagaaccgtcgaggagaatcgaaaagtgcagccttttaccggttcgcttcgattccgtcagctgcaactgcaggaaccgcgacgacgacgacgccgagaggtctcccctcttccgacggcacggccaccgaggcggcgccaccgcgatgggttctctggcgctgaggtgtagtaacccgccgccgcccttctccaagtcgccgggttccctgctgctgctctccaagtcgctcaccctctactgctgagctgagccaccccttcggttgctgtctctcggctcatgggcgccgtggcctcgtcggcgagaggggggcggggaggtgaggggacggtgctgggggatttgccggagagctgcgtcgcggaggtgctgctcaggctcgacccaccggagatctgccggatggcgcggctcagccgcacgttccgaggggccgcgtccggggacggcgtctgggagtccaagctgccgaggaactacgctcgcctcctcgccgttgcagccgccggcgatggaggagagcggcaggccgccgccgccgccgcgcttgaggcggagtcactgcccaagaaggaggtgtacgcgcggctctgccgccggaatcgcttcgatggcggcaaaaaggagttctggctggacaagggtggtcgaggtgtctgcatgtcaatctcgtccatggcgctttcaataacgggtattgatgatagacgatattggaacttcattcccaatgatgaatcaagatttcacactgttgcttatctctcacaaatttggtggttcgaagtcagaggggaggttgaattctgcttcccagaaggtacatatagcctattttaccgcgttcatctaggccgaccattcaagcggcttggacgacgggtttgtagctcagagcacatccatggctgggacataaagccagtccgcttccaaatgtcaacttctgatggacagcaagctcagtccaagtgctatttaaccgatcccggtgtctggatcaatcaccatgtcggggacttcgtcgtgaaggactcaagcaaaccgacaaacatccggtttgcgatgattcagatagactgcacacacacgaaaggaggcctctgtgtggattcagtggtggtgaaaccgcagtacctcacgcagaaaaaatcgcctcggtgttatgtgtagtggtgttgatatacttagagatacacatatgctctggagttttgttctttatacaaaagtgcagttgcaattacaaagtattttccagccctgtaatgtaactgaagggataagagatttttagctcctcttgtccctctagg

SEQ ID NO: 22679 - protein, 297 aa, Panicum virgatum
  misc_feature: Ceres CLONE 1823058
  misc_feature (17)..(64): Pfam Name: F-box Pfam Description: F-box domain
MGAVASSARGGRGGEGTVLGDLPESCVAEVLLRLDPPEICRMARLSRTFRGAASGDGVWESKLPRNYARLLAVAAAGDGGERQAAAAAALEAESLPKKEVYARLCRRNRFDGGKKEFWLDKGGRGVCMSISSMALSITGIDDRRYWNFIPNDESRFHTVAYLSQIWWFEVRGEVEFCFPEGTYSLFYRVHLGRPFKRLGRRVCSSEHIHGWDIKPVRFQMSTSDGQQAQSKCYLTDPGVWINHHVGDFVVKDSSKPTNIRFAMIQIDCTHTKGGLCVDSVVVKPQYLTQKKSPRCYV

SEQ ID NO: 22680 - DNA, 2810 bp, Panicum virgatum
  misc_feature: Ceres CLONE 1823063
  misc_feature: Encodes the peptide sequence at SEQ ID NO. 22681
gccaccagaggccctgtgactccgccgccgcggcagctagggcacgggctcccggcgactgggtgtctctcgccgcaggccccgtcgaatggatcgccggcagttaggtcgtcacaatccatagagtaggggcaggcaacgccgtccccagcaggagcagcaggcagcagtccgcacggcagcatcgcggcacgcgcagctctcgcgagtgcgacggtgccggcgcatctgttgccgccgccgccgcctgtccggctggttcgcggtgcgccgtgcgcccgcgtcggcagaccgccggctgccggaggcacggatccctcctcgctcgcgaagtcgcctctcgccggctcgcccgtcgtcgcctcgtcggcagctcgtagattggttcctcttcggctccgtggccgcgtgcgcgccgtcccggaaggcatcaggctgtcttccactgtcagaggccaccttgaatctgcgtccattgtaattgactcctcttctgctgctggaggtgcagatccatccagacttggactgctcttctcatctctgggacctgacgttgccataggttctatttgcacctgagaagtgaactaattcaagttgttggtacactcattggatggtttaagaaagggcctggaagccttgtgtggataacatttgtgttaaggctgttaagcttgggaaccgattcggtaatcagcacaatggagtgcaacagagaagaggccttgaaggccagggaaattgctattaagaagttggaaaacaaagattttgttggtgctaaaaggattgcccttaaagcacagagaatttttccacagcttgagaacataccccagctgttaactgtctgtgaagtacattgtgcagcagaagcaaagataaacgggatgttggatttctatggaattctccaagtggaagggacagcggatgagatgaccataaagaagcaatatcgtaagcttgtcctctcacttcaccctgataaaaacagttatgttggtgcagaatccgctttcaagtttgttgcagaagcatactcaacattgtctgatcgagcaaaacgatatgcatatgacatcaaatggagggttgcttctaaagctgcaccaaagcaggctacacaaccgacacaggctgcagaaccaacacgggctacacaaccgaaacaggctgccaaaccaaagcaggccgccaaaccaaagcaggctgccaaaccaaaaccggctactcaacctaatctggctgaggaaacaaatcaggctacacagccaatgcaggcgacagaaccaaaacagaccaatcaaccgaagcagtctacagaagcaatgaagactacagagccgattaacaaaaatgatgcagataaaagtagcacggcaggatatggaacatcaggttcaccaaccactgataagtggactttctggactgtgtgcacccactgtaaaacaaaatacaagtactacggtaacattctgaatcgtcagatccgctgtcagaactgcaggcagaatttttttgcaaacaacataaataaagaagatgtgcctcctctattctcatcgaaagcagccaatggtgctgcgcaacagggctgtgttcccactcaacaaggctgttctactaatttctcttctagagagaaccaacaggcaaggcctgtgatgaatggagcacaatatggtgaacaaatgaagagcggttcaaaaccaagtggtgagggtatgtttaatcatacagagacaagtgaacaagggggggatacatcagcagagccaggtgctgcagggatccctagtccacggagatcttctaggagaaaagcatttattgatgccaacaacattctgaattctccaaagaaaaagagtcggacaataaaagattggttctcaaatgctgcccccagttctaataaagtgtttgatgataatgctgcccatgctgatggaccggctagtgaacctcatgtctccagcaaaacaaataaccaagagaaaggttgtaccgtcaatgaaagcaatcaaatgaattacaaagaagctcatgatacagctgctgagaagccttgcaatgctgggggcttcacgtaccctgatccagaattttataactttgatatgttcaggagtgtcaatctgtttgcagttgatcagatatgggcactttatgatgaccaagatgccatgccgagatattatgctagaataagacgtcttgatactaccagcttcagagttaagttcacttggctggagcatgatgcagtgaatgatgaggagtacgaatggactgataataacctgcctgttgcttgtgggaactataccctaggaaagacagaggtgtcacaagatcccctcatgttttctcacattgtttcatcatgggtgcaaggcaaaaaaaggggttcttatgtaatacatccaagtaaaggtgaggtatgggctctttataaaggctggagtatgcagtggacctcagatgcagataatcatagatcttatgagtacgaagttgtggaggtcctttcaaacttcacaatggaaactggtgtcactgttgtccccttggtcaaggttgaaggttttgtgagtctttttgcaaaagcaaaggacaaatcatcatttgttataccatcaagcgaactacttcgattttctcacagcatcccatttttcagaacaaggggtaatgagaaggttggcgtcccatctggatttcttgaactagatgctgtatcacttcctagtaacctggatgtagcatttccaccagttgctcttgactcttgtgtg

SEQ ID NO: 22681 - protein, 700 aa, Panicum virgatum
  misc_feature: Ceres CLONE 1823063
  misc_feature (66)..(127): Pfam Name: DnaJ Pfam Description: DnaJ domain
MECNREEALKAREIAIKKLENKDFVGAKRIALKAQRIFPQLENIPQLLTVCEVHCAAEAKINGMLDFYGILQVEGTADEMTIKKQYRKLVLSLHPDKNSYVGAESAFKFVAEAYSTLSDRAKRYAYDIKWRVASKAAPKQATQPTQAAEPTRATQPKQAAKPKQAAKPKQAAKPKPATQPNLAEETNQATQPMQATEPKQTNQPKQSTEAMKTTEPINKNDADKSSTAGYGTSGSPTTDKWTFWTVCTHCKTKYKYYGNILNRQIRCQNCRQNFFANNINKEDVPPLFSSKAANGAAQQGCVPTQQGCSTNFSSRENQQARPVMNGAQYGEQMKSGSKPSGEGMFNHTETSEQGGDTSAEPGAAGIPSPRRSSRRKAFIDANNILNSPKKKSRTIKDWFSNAAPSSNKVFDDNAAHADGPASEPHVSSKTNNQEKGCTVNESNQMNYKEAHDTAAEKPCNAGGFTYPDPEFYNFDMFRSVNLFAVDQIWALYDDQDAMPRYYARIRRLDTTSFRVKFTWLEHDAVNDEEYEWTDNNLPVACGNYTLGKTEVSQDPLMFSHIVSSWVQGKKRGSYVIHPSKGEVWALYKGWSMQWTSDADNHRSYEYEVVEVLSNFTMETGVTVVPLVKVEGFVSLFAKAKDKSSFVIPSSELLRFSHSIPFFRTRGNEKVGVPSGFLELDAVSLPSNLDVAFPPVALDSC

SEQ ID NO: 22682 - DNA, 796 bp, Panicum virgatum
  misc_feature: Ceres CLONE 1823063-R
gggacatttaaaatccgcaactggaggatcaagtacaacacgactgatccattctctcatgtagtagtagatactcaagttggttcaaaacggcactttgaaattcacccacaagtaggggagatttgggcgctctacaacaattggttacctggctgggttccttcaagcaaggatacttgtgaatatgccattggtgagatcactgagcgcactgacgctaccacaaaagtcctatttctcactcaggtcgatggttacagaactatattcaagccagacagtgagaggagtatccttgacgtgcctacaaaagacgacatacggttttctcatcggataccttctttccgtctaacgaaggaaaagggaagcaagctctgtggcttctatgagctggatccagcttctattcctgatcctttcctctctgtgagcaccctctgacttgcagaagctcaattcggctgccctgaagcaactaagattaattagttccagttaactgaagtgggcgatcagttctattgtatatgtttatgcacgttcatgcgccaggcaactgtgattttgggcgaaaccttgatatatgttccagctcataggccttcatcttatgcccgtctaatgttgatgcctgtgaatctgtaacctatttgttggtagtgtctttgcctgcaggcgagggcagtggcccctctgttatcagctgccaaacagctccgcgcaatgtatgctgtctctcaaatcctcaactgtaaacttaggactatcaattttatttgccattgttgct

SEQ ID NO: 22683 - DNA, 1813 bp, Panicum virgatum
  misc_feature: Ceres CLONE 1823077
  misc_feature: Encodes the peptide sequence at SEQ ID NO. 22684
gactgcgatccagttccaagctcgcatctccgctgcttgcatctgcaggcgcgagacataggccggttggcagcatcagtgctgcggcgctccctgcccctactatacccctctgccgtgagcggcgcagcgtttgcagcaccagcgctcgcccatctgcctttcagcgattggaagccatcgactacgagcttttccaagggtgcagcaacgatgagcacgacctacatgcccctgctcgctgtgaagagccctgtgcccagcgacatcgacatcgcacagtctgtggagcccgtgcacattgccaagattgcagagaccctgggactgctggagagcgagtatgagctgtatggcatcaccaaggccaaggtcaagctgtccgcgcgggacaggctcaaggatgcgccaagcggcaaatacgtggtggttgccggcatcacccccacccccttgggcgagggcaagtccaccaccactgttggactgtgccaggccctgggtgcctacctcaagcgcaaggttgtgacctgcatccgtcagcccagccagggccccaccttcggcatcaagggcggagcagcaggtggcggttacagccaggtcattcccatggaggagctgaacctgcacctgacgggtgacatccacgccatcaccgccgccaacaacctgctggctgcggcgctggatgcccgcatgttccacgaacgtgcgcagagcgacgacgcgctgttcaacaggctgtgccctgcggacaagcagggcaagcgcaagttcgcgcccgtcatgctgcgtcgcctgaagaagctgggcatcgacaagaccgaccccgacacgctgacacccgaggagaagggccgctttgcgcgcctggacgttgaccctgactccatcacctggcgaagggtcatggacactaacgacaggttcctgcgcaacatcaccgttggccagggcaaggaggagcgcggccaggagcgtgccacgggctttgacatcaccgtcgcctctgagatcatggcggtgctggcgctggcctctgatgtaaccgacatgcgggagcggctggggcgcatggtcatcggcaactcgcgcgcaggtgaccccgtcactgccgacgacctgggcgtgggcggcgcgctgactgtgctgatgaaggacgccatcatgcccactctcatgcagactctggagcagacgcctgtgctggtgcacgcggggccgttcgccaacatcgcacacggcaattcttccgtcattgccgaccagatcgcgctcaagctggtgggagagagcggcttctgtgtgactgaggccggtttcggcgctgacattggcatggagaagttcatgaacatcaagtgccgtgccagtggcctgacgcccgactgcgccgtcattgttgcgactgtccgtgcgctcaagatgcatggtggcggccctcaggttgtggcaggcactccgctgcaccacgactacctcaccgagaacgttgagctggtgaccaagggctgctgcaacgtggcgcgccacatccagaatgcccgtgcctacggcatccccgtcgtggtggccatcaaccagttcgcctcggacacgcccgcggagctcaaggcggtgcaggaggcggccctggcggcaggtgctgacgctgccgtcatttgcaaccaccacgggctgggcggtgccggtgcaacggacctggctgaggcggtggtggctgcatgcgagaagcccagcaacttcaagttcctgtacgacgccagcctgcccatcaaggccaagatcgagatcatcgccaaggagtgct

SEQ ID NO: 22684 - protein, 533 aa, Panicum virgatum
  misc_feature: Ceres CLONE 1823077
  misc_feature (15)..(532): Pfam Name: FTHFS Pfam Description: Formate--tetrahydrofolate ligase
  misc_feature: SWISSPROT Homolog: EC 6.3.4.3 Formate--tetrahydrofolate ligase
MSTTYMPLLAVKSPVPSDIDIAQSVEPVHIAKIAETLGLLESEYELYGITKAKVKLSARDRLKDAPSGKYVVVAGITPTPLGEGKSTTTVGLCQALGAYLKRKVVTCIRQPSQGPTFGIKGGAAGGGYSQVIPMEELNLHLTGDIHAITAANNLLAAALDARMFHERAQSDDALFNRLCPADKQGKRKFAPVMLRRLKKLGIDKTDPDTLTPEEKGRFARLDVDPDSITWRRVMDTNDRFLRNITVGQGKEERGQERATGFDITVASEIMAVLALASDVTDMRERLGRMVIGNSRAGDPVTADDLGVGGALTVLMKDAIMPTLMQTLEQTPVLVHAGPFANIAHGNSSVIADQIALKLVGESGFCVTEAGFGADIGMEKFMNIKCRASGLTPDCAVIVATVRALKMHGGGPQVVAGTPLHHDYLTENVELVTKGCCNVARHIQNARAYGIPVVVAINQFASDTPAELKAVQEAALAAGADAAVICNHHGLGGAGATDLAEAVVAACEKPSNFKFLYDASLPIKAKIEIIAKEC

SEQ ID NO: 22685 - DNA, 349 bp, Panicum virgatum
  misc_feature: Ceres CLONE 1823077-R
gccgctgcgctcgagacagtccggtcgtcgcgtcgccattgctagccctaaattaatcactagcaaatcaagcagggtcctgattagccccccattataataacctcgtccatccgtcgccgtcacagtgagtgctgcatgctgggcattttttttttttgcgacacatccttcccatgtgttgcttggtgttcttcctttttgggactggtcgtgctgcatcgaccggtcgcccccctttggtcccttgcgtgcagtggcctctcgtgcgctagtagcttgctgcctccttattatttgcggtgtgattcgagtaaagtaattagtcaatggaaaaacagattaaatg

SEQ ID NO: 22686 - DNA, 668 bp, Panicum virgatum
  misc_feature: Ceres CLONE 1823080
  misc_feature: Encodes the peptide sequence at SEQ ID NO. 22687
agtttcacgcacgcgtgcgcgggcgggcgggcaagcgctagagaagaaagccggggcggcgcggcgagcgagcggcccaccaccgccgaccgatcgactgcctccttcgctttgccatttttgcttaattggtcggggagcggcggagggatcggccggccaggatggtgcgggggaagacggagatgaagcggatagagaacgcgacgagccggcaggtgaccttctccaagcgccgcaacgggctgctcaagaaggcgttcgagctctccgtgctctgcgacgccgaggtcggcctcatcgtcttctccccgcgcggcaagctctacgagttcgccagcgcctccagcctccagaaaacaatcgaccgctataagtcatatacaagagaaaatctcagtaacaaggctatacaacaacaggatatacaggtgaagttctacagtataatatgtatgaccttccaggtttgatcaagaaaaggcacgagttacacctactgctatcccatttcaatagatggttattttttttaacttttctatttgagttgttttttatttagaatgtactcaatttgctcgtttcagattctattagtttgcatgtggctgatttatttactgaacccatctttgactactgcatcttcaattaatacggataag

SEQ ID NO: 22687 - protein, 102 aa, Panicum virgatum
  misc_feature: Ceres CLONE 1823080
  misc_feature (9)..(59): Pfam Name: SRF-TF Pfam Description: SRF-type transcription factor (DNA-binding and dimerisation domain)
  misc_feature: Useful for making plants with modulated flowering time
  misc_feature: The sequence is a functional homolog of SEQ ID NO 1368 in the 10/666,642 US patent application
  misc_feature: The sequence is a functional homolog of SEQ ID NO 422 in the 11/435,388 US patent application
  misc_feature: The sequence is a functional homolog of SEQ ID NO 1364 in the 10/666,642 US patent application
  misc_feature: The sequence is a functional homolog of SEQ ID NO 1728 in the 10/412,699 US patent application
  misc_feature: The sequence is a functional homolog of SEQ ID NO 164 in the 10/666,642 US patent application
  misc_feature: The sequence is a functional homolog of SEQ ID NO 642 in the 11/435,388 US patent application
  misc_feature: The sequence is a functional homolog of SEQ ID NO 122 in the 10/666,642 US patent application
  misc_feature: The sequence is a functional homolog of SEQ ID NO 406 in the 10/412,699 US patent application
  misc_feature: The sequence is a functional homolog of SEQ ID NO 919 in the 10/666,642 US patent application
  misc_feature: Useful for making plants with modulated biomass
  misc_feature: The sequence is a functional homolog of SEQ ID NO 30 in the 10/666,642 US patent application
  misc_feature: The sequence is a functional homolog of SEQ ID NO 4 in US patent 7057087
  misc_feature: Useful for biocontainment applications
  misc_feature: Useful for making plants with altered alkaloid content
  misc_feature: Useful for making plants with altered lignin content
  misc_feature: Useful for making plants with altered terpenoid content
  misc_feature: The sequence is a functional homolog of SEQ ID NO 28 in the 10/666,642 US patent application
  misc_feature: The sequence is a functional homolog of SEQ ID NO 707 in the 10/666,642 US patent application
  misc_feature: The sequence is a functional homolog of SEQ ID NO 14 in the 10/666,642 US patent application
  misc_feature: The sequence is a functional homolog of SEQ ID NO 1362 in the 10/666,642 US patent application
  misc_feature: The sequence is a functional homolog of SEQ ID NO 199 in the 11/479,226 US patent application
  misc_feature: The sequence is a functional homolog of SEQ ID NO 34 in the 10/666,642 US patent application
  misc_feature: The sequence is a functional homolog of SEQ ID NO 58 in the 10/412,699 US patent application
  misc_feature: The sequence is a functional homolog of SEQ ID NO 32 in the 10/666,642 US patent application
  misc_feature: The sequence is a functional homolog of SEQ ID NO 1468 in the 10/666,642 US patent application
  misc_feature: The sequence is a functional homolog of SEQ ID NO 282 in the 10/666,642 US patent application
  misc_feature: Useful for making plants with modulated phosphate use efficiency
  misc_feature: The sequence is a functional homolog of SEQ ID NO 2 in US patent 7273968
  misc_feature: The sequence is a functional homolog of SEQ ID NO 6 in US patent 7279615
  misc_feature: The sequence is a functional homolog of SEQ ID NO 1360 in the 10/666,642 US patent application
  misc_feature: The sequence is a functional homolog of SEQ ID NO 22 in the 10/666,642 US patent application
  misc_feature: The sequence is a functional homolog of SEQ ID NO 2191 in the 10/666,642 US patent application
  misc_feature: The sequence is a functional homolog of SEQ ID NO 730 in the 10/666,642 US patent application
  misc_feature: The sequence is a functional homolog of SEQ ID NO 1732 in the 10/412,699 US patent application
  misc_feature: The sequence is a functional homolog of SEQ ID NO 44 in the 10/666,642 US patent application
  misc_feature: The sequence is a functional homolog of SEQ ID NO 66 in the 10/412,699 US patent application
  misc_feature: The sequence is a functional homolog of SEQ ID NO 2189 in the 10/666,642 US patent application
  misc_feature: The sequence is a functional homolog of SEQ ID NO 428 in the 10/666,642 US patent application
  misc_feature: The sequence is a functional homolog of SEQ ID NO 892 in the 11/435,388 US patent application
  misc_feature: The sequence is a functional homolog of SEQ ID NO 2193 in the 10/666,642 US patent application
  misc_feature: The sequence is a functional homolog of SEQ ID NO 1470 in the 10/666,642 US patent application
  misc_feature: The sequence is a functional homolog of SEQ ID NO 284 in the 10/666,642 US patent application
  misc_feature: The sequence is a functional homolog of SEQ ID NO 1243 in the 11/479,226 US patent application
  misc_feature: The sequence is a functional homolog of SEQ ID NO 1420 in the 10/666,642 US patent application
  misc_feature: The sequence is a functional homolog of SEQ ID NO 1814 in the 10/412,699 US patent application
  misc_feature: The sequence is a functional homolog of SEQ ID NO 570 in the 10/412,699 US patent application
  misc_feature: The sequence is a functional homolog of SEQ ID NO 1460 in the 10/666,642 US patent application
  misc_feature: The sequence is a functional homolog of SEQ ID NO 938 in the 10/412,699 US patent application
  misc_feature: The sequence is a functional homolog of SEQ ID NO 46 in the 10/666,642 US patent application
  misc_feature: The sequence is a functional homolog of SEQ ID NO 203 in the 11/479,226 US patent application
  misc_feature: The sequence is a functional homolog of SEQ ID NO 40 in the 10/666,642 US patent application
  misc_feature: The sequence is a functional homolog of SEQ ID NO 42 in the 10/666,642 US patent application
  misc_feature: The sequence is a functional homolog of SEQ ID NO 1701 in the 10/412,699 US patent application
  misc_feature: The sequence is a functional homolog of SEQ ID NO 2232 in the 10/374,780 US patent application
  misc_feature: The sequence is a functional homolog of SEQ ID NO 232 in the 10/225,068 US patent application
  misc_feature: The sequence is a functional homolog of SEQ ID NO 310 in the 10/225,066 US patent application
  misc_feature: The sequence is a functional homolog of SEQ ID NO 2195 in the 10/666,642 US patent application
  misc_feature: The sequence is a functional homolog of SEQ ID NO 2199 in the 10/666,642 US patent application
  misc_feature: The sequence is a functional homolog of SEQ ID NO 729 in the 10/666,642 US patent application
  misc_feature: The sequence is a functional homolog of SEQ ID NO 1702 in the 10/412,699 US patent application
  misc_feature: The sequence is a functional homolog of SEQ ID NO 715 in the 10/666,642 US patent application
  misc_feature: The sequence is a functional homolog of SEQ ID NO 2064 in the 10/374,780 US patent application
  misc_feature: The sequence is a functional homolog of SEQ ID NO 572 in the 10/412,699 US patent application
  misc_feature: The sequence is a functional homolog of SEQ ID NO 816 in the 10/225,066 US patent application
  misc_feature: The sequence is a functional homolog of SEQ ID NO 1453 in the 10/374,780 US patent application
  misc_feature: The sequence is a functional homolog of SEQ ID NO 1454 in the 10/374,780 US patent application
  misc_feature: The sequence is a functional homolog of SEQ ID NO 1366 in the 10/666,642 US patent application
  misc_feature: The sequence is a functional homolog of SEQ ID NO 1730 in the 10/412,699 US patent application
  misc_feature: The sequence is a functional homolog of SEQ ID NO 207 in the 11/479,226 US patent application
  misc_feature: The sequence is a functional homolog of SEQ ID NO 64 in the 10/412,699 US patent application
  misc_feature: The sequence is a functional homolog of SEQ ID NO 1949 in the 10/412,699 US patent application
  misc_feature: The sequence is a functional homolog of SEQ ID NO 1110 in the 10/225,066 US patent application
  misc_feature: The sequence is a functional homolog of SEQ ID NO 166 in the 10/374,780 US patent application
  misc_feature: The sequence is a functional homolog of SEQ ID NO 1812 in the 10/412,699 US patent application
  misc_feature: The sequence is a functional homolog of SEQ ID NO 568 in the 10/412,699 US patent application
  misc_feature: The sequence is a functional homolog of SEQ ID NO 1945 in the 10/412,699 US patent application
  misc_feature: The sequence is a functional homolog of SEQ ID NO 1947 in the 10/412,699 US patent application
  misc_feature: The sequence is a functional homolog of SEQ ID NO 2 in US patent 7049489
  misc_feature: The sequence is a functional homolog of SEQ ID NO 1951 in the 10/412,699 US patent application
  misc_feature: The sequence is a functional homolog of SEQ ID NO 122 in the 10/225,066 US patent application
  misc_feature: The sequence is a functional homolog of SEQ ID NO 234 in the 10/374,780 US patent application
  misc_feature: The sequence is a functional homolog of SEQ ID NO 1056 in the 10/225,066 US patent application
  misc_feature: The sequence is a functional homolog of SEQ ID NO 1882 in the 10/412,699 US patent application
  misc_feature: The sequence is a functional homolog of SEQ ID NO 350 in the 10/374,780 US patent application
  misc_feature: The sequence is a functional homolog of SEQ ID NO 944 in the 10/412,699 US patent application
  misc_feature: The sequence is a functional homolog of SEQ ID NO 1955 in the 10/412,699 US patent application
  misc_feature: The sequence is a functional homolog of SEQ ID NO 1953 in the 10/412,699 US patent application
  misc_feature: The sequence is a functional homolog of SEQ ID NO 1967 in the 10/412,699 US patent application
  misc_feature: The sequence is a functional homolog of SEQ ID NO 1965 in the 10/412,699 US patent application
  misc_feature: The sequence is a functional homolog of SEQ ID NO 1963 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
MVRGKTEMKRIENATSRQVTFSKRRNGLLKKAFELSVLCDAEVGLIVFSPRGKLYEFASASSLQKTIDRYKSYTRENLSNKAIQQQDIQVKFYSIICMTFQV

SEQ ID NO: 22688 - DNA, 701 bp, Panicum virgatum
  misc_feature: Ceres CLONE 1823098
  misc_feature: Encodes the peptide sequence at SEQ ID NO. 22689
gaaaaaaaaacacaggcgcagtgctcgccccgcttttcatggcgtgagcgccggggcaaggcaaagccgcctcctgcctctcctgccacctgagcgccgttacgggggcgccccgcaacggaacggacaggtgcggtcaacccaccccgccccaccaggcaccaccgccggggcggataaacaaacccagcgcccccggctcactgtcctcttcattcggttcctcttcctcctccctcccctgcccctcctcctcgtctccccttccccgcctgctcttcgcgtgcgccgcggcggccgtggcccgtggaggacggacagcccgggggacgctcggggctcgtgccgggcgcactgatctgcggcctgcgtgtccccggtggcgggccgggccagcatcggcttcgaggaatgagcagattgtagcagctgtttcttctgcatatgcactttgtattgttgatatcatttcaaaggaggccatagtctcctggattttgtatgccttgttatctggaattggttaccgtagatgtcatttcgtagcatcgtccgtgatgttagggatggcttcggtagcttgtccagacgcagctttgacgtgaccctcgcaagcatttatggccttaccgggcatcacaaaaggaggacccagagctcatcgcatgaactcgatgactcgccttccataatccgagaag

SEQ ID NO: 22689 - protein, 56 aa, Panicum virgatum
  misc_feature: Ceres CLONE 1823098
  misc_feature: The sequence is a functional homolog of SEQ ID NO 130 in the 10/225,068 US patent application
  misc_feature: The sequence is a functional homolog of SEQ ID NO 2896 in the 10/374,780 US patent application
MSFRSIVRDVRDGFGSLSRRSFDVTLASIYGLTGHHKRRTQSSSHELDDSPSIIRE

SEQ ID NO: 22690 - DNA, 1317 bp, Panicum virgatum
  misc_feature: Ceres CLONE 1823099
  misc_feature: Encodes the peptide sequence at SEQ ID NO. 22691
gtaggatgtcagagttcccgagtccacggctgcacacgtcgctgcttcctctccactcccaccccgcgcctgcctccaaccccgggccccctccagtctcgccgccatgcctccggccgccgccgtcgccttcctctcccccgccgtcgcggtgtccagccgcgcgcttccgctccggcgggcgaggcacctcgccgtccgcgccgtcgcctcccctcccgcctccaagtccaagcccgccccgccgccctccaagactgggaggtgggagtggaaatttgaggataaacctataaatatttactatgaggagcatgagcaggattcttctgaggatgtgaagaacatcctcatgatccctacaatctcagatgttagcacggtggaggaatggagagtggtcgccaaagatattgttgggcgaaaaggagagctaggctaccgtgctaccattgtcgattggcctggtcttggttactcagataggccatcactgaactataatgctgatgtcatggagagtttcctggttcagctagtaaattcaccgaatagtccggtggcaaatgcagatgatgaactaataattgttggaggtggtcatgcggcaacaatagcagttcgtgcagctggtaagggccttatcagaccatctgctgttgctgctgttgcacctacatgggctggaccccttcccatcgtatttggccgaggttctgatatggaaacaaggtatgggcttctacgaggaacactgagggctccagccatcggctggatgatgtacaacgttctggtgagcaacgagaagtctatccagtctcagtacaagtcccacgtctacgccaaccctgacaacgtgacgccggacatcatcgagagccgatatgagttaaccaaaaggaaaggtgcgcggtatgtccctgccgcgttcctgacaggcctcctcgatcctgtccagtcaagggaggaattcgtgcagttgtttgccaagttggacggagatgtacctgttctgatggtgtcgacgcttaacgcccccaagaggtcgaaggctgagatggaggctctcaagagcgctaaaggcgtgaccaaattcgtggaggttcccggtgctcttctgccgcaggaagagtacccattggcagttgcggaggagctctacagcttcctgcaagaatcattcaccgcgagaagatgaatgtgggtttgcgcaatcacgcggaagccagattcaagtcccacactttgtgagtaaattcatggacctgctatggtgtactggagcttttagcaacaataaagcagcatctcact

SEQ ID NO: 22691 - protein, 364 aa, Panicum virgatum
  misc_feature: Ceres CLONE 1823099
  misc_feature (112)..(354): Pfam Name: Abhydrolase_1 Pfam Description: alpha/beta hydrolase fold
MPPAAAVAFLSPAVAVSSRALPLRRARHLAVRAVASPPASKSKPAPPPSKTGRWEWKFEDKPINIYYEEHEQDSSEDVKNILMIPTISDVSTVEEWRVVAKDIVGRKGELGYRATIVDWPGLGYSDRPSLNYNADVMESFLVQLVNSPNSPVANADDELIIVGGGHAATIAVRAAGKGLIRPSAVAAVAPTWAGPLPIVFGRGSDMETRYGLLRGTLRAPAIGWMMYNVLVSNEKSIQSQYKSHVYANPDNVTPDIIESRYELTKRKGARYVPAAFLTGLLDPVQSREEFVQLFAKLDGDVPVLMVSTLNAPKRSKAEMEALKSAKGVTKFVEVPGALLPQEEYPLAVAEELYSFLQESFTARR

SEQ ID NO: 22692 - DNA, 568 bp, Panicum virgatum
  misc_feature: Ceres CLONE 1823100
  misc_feature: Encodes the peptide sequence at SEQ ID NO. 22693
aaaaaaaacatccccgacacatcggactccaccacgaattacagcaccgccgccgccgcgccccctgcttcccaagccatctcatggcagcgtcggcctcttccctcctggccgccccaccatcctcgtcatgcgcggccgtctctccccggctccgccgtggagctcacgccgccgcctccgttccttcgacgtcggcgccactcctgcgcttccatccgcgcttccccggcgagggtgcataggagcagcatcaaagccaacgccagcgtcgctcccgcgatgcagcctccggcgaactccatggactctacgagtggtccacgtccacctccgctaccgaagctactcgatctacatcggcgcaggcctcctcaaaaagacgaacatgctgcagaggcatgttaacaggaagagggttctagaggagaccaacacgaccgtcgcaccactatacctagacaaggtgacctgcgcactcacacagaacaacccaaacgtatcactggagagcgtgatcctgccggacggcgagaaatacaaagatatgggcacgatgatgaaggtg

SEQ ID NO: 22693 - protein, 145 aa, Panicum virgatum
  misc_feature: Ceres CLONE 1823100
  misc_feature: SWISSPROT Homolog: EC 4.2.3.4 3-dehydroquinate synthase
MRGRLSPAPPWSSRRRLRSFDVGATPALPSALPRRGCIGAASKPTPASLPRCSLRRTPWTLRVVHVHLRYRSYSIYIGAGLLKKTNMLQRHVNRKRVLEETNTTVAPLYLDKVTCALTQNNPNVSLESVILPDGEKYKDMGTMMK

SEQ ID NO: 22694 - DNA, 510 bp, Panicum virgatum
  misc_feature: Ceres CLONE 1823107
  misc_feature: Encodes the peptide sequence at SEQ ID NO. 22695
taagaatggcatccatggagaaacccatctccctcgaggcgtggaacgcccagcggctagcaccgcgtggtgagcaccaagtacatgcaccgcgaactcggtggatccgcctgctcaccgacaacgactgcctactgcagatatgcaccgaggccaagaccatcctctccgtccactacatcctggcgctcattggcaaccggcgcaacgctgtcatcgggcagatcaccgaggagtggggggaggtgctcttctcggccctcatcgcgcgacggcgggacggctttcatcaacgtggccgtcggctagaacaacctcgacgtcgacgctgcaaacaggaagggcatcgccctcagccacacgcccctcgtcctcccccagaccacggctgagctcgccgcctccctctcgctggcggcatccacgacgatctcggagacgtaccagttcatgacggctggcctatgcgacggatgcctcccgcccctgttcattgcctacctgctcaag

SEQ ID NO: 22695 - protein, 125 aa, Panicum virgatum
  misc_feature: Ceres CLONE 1823107
  misc_feature: SWISSPROT Homolog: EC 1.1.1.29 Glycerate dehydrogenase
MEKPISLEAWNAQRLAPRGEHQVHAPRTRWIRLLTDNDCLLQICTEAKTILSVHYILALIGNRRNAVIGQITEEWGEVLFSALIARRRDGFHQRGRRLEQPRRRRCKQEGHRPQPHAPRPPPDHG

SEQ ID NO: 22696 - DNA, 1457 bp, Panicum virgatum
  misc_feature: Ceres CLONE 1823137
  misc_feature: Encodes the peptide sequence at SEQ ID NO. 22697
gacgcccagaagccaagccgcagggcagcactcaacgcggcaatagcttccctgcgaagcccccacggtcagcaggatcccagctccggcgtgagcgcagcctccaggacgccgcccgtatttataccttcctttcttccccagctccgagcctccgagcagcggaatccggcaaagcatccgtacccgcaccgcgtcacgcttcccccgctttataatactcgctccccttcgcccccccggctcagcctctctcggtttccgaagcaaccccgccgctccggcctccgcctcccccgcctccaatggcgctgccctacctggaggccgtgctgtgctttatgattctcatgtacatatttgagacatatcttgacatccgtcagcatagagccctcaagttgccaactttgccaaaacccctggtgggagtaattagtgatgaaaagttcaaacgttccagagattatagccttgacaaaagctacttccattttgttcatgagcctgtgactatattaatggataccacaatactgtactataaagttcttccctggttttggaagagatctggagaattagttacaaaggttggtttgaatgctgagaatgagactatacacacccttgcattcttagctggtgccatggtttggtcacagattacagacttgccattctctctttattcaacttttgtcatagaggctcgtcatggttttaacaagcaaactatttggctcttcattagggatatggtcaaaggaattttactatccatgatattgggcccaccaatcgtggctgctatcatctacatagtgcagattggaggaccttacctggccatatatctctggggttttatgtttgtattagctctcctgatgatgacaatataccccatcgtgatagctcctctgttcaacaagttcacacctcttcctgaaggagtactcagggagaaaatagagaagttggcagcttcactcaaatttcctttgaaaaagcttttcgtggtagatgggtctaccagatcaagccacagtaatgcttacatatacggttttttcaagaacaaacgcatagtactctatgacacgttaattcagcagtgcagtaatgaggataagatagtttctgttattgcacatgaacttgggcactggaaactcaatcatactgtctattcctttatagctgtccagttgcttatgtttctgcaatttggaggatatactctagtaaggaactccaaagatctttttgaaagttttggtttcgaggatcagccaataataattggattgatcattttccagcacaccataatacctcttcaataccttctgagcttttgcctgaaccttgtcagcagagcatttgaattccaggctgacgcctttgctaagaaccttggatatgcccctcagctccgagcagcccttgttaaa

SEQ ID NO: 22697 - protein, 383 aa, Panicum virgatum
  misc_feature: Ceres CLONE 1823137
  misc_feature (226)..(382): Pfam Name: Peptidase_M48 Pfam Description: Peptidase family M48
  misc_feature: SWISSPROT Homolog: EC 3.4.24.84 Ste24 endopeptidase
MALPYLEAVLCFMILMYIFETYLDIRQHRALKLPTLPKPLVGVISDEKFKRSRDYSLDKSYFHFVHEPVTILMDTTILYYKVLPWFWKRSGELVTKVGLNAENETIHTLAFLAGAMVWSQITDLPFSLYSTFVIEARHGFNKQTIWLFIRDMVKGILLSMILGPPIVAAIIYIVQIGGPYLAIYLWGFMFVLALLMMTIYPIVIAPLFNKFTPLPEGVLREKIEKLAASLKFPLKKLFVVDGSTRSSHSNAYIYGFFKNKRIVLYDTLIQQCSNEDKIVSVIAHELGHWKLNHTVYSFIAVQLLMFLQFGGYTLVRNSKDLFESFGFEDQPIIIGLIIFQHTIIPLQYLLSFCLNLVSRAFEFQADAFAKNLGYAPQLRAALV

SEQ ID NO: 22698 - DNA, 411 bp, Panicum virgatum
  misc_feature: Ceres CLONE 1823137-R
cccttgtggaaaggctgcagctctggaagatccggacagcaaaaaagaagactaactggaacccatcagagcttacgttgttcttgaagagcaaaaccctgacccccgcgtgaggtttccatatggatttccctgccgcgcacaaggcaccgattcagtgtttgaatgctgagagtattgtcgaagttctgtaaaagcgttcagcacaagcgggcatacagcgtatcagggggtatggatggaaatgggtcgggtcgacccactgggtagttgacctgacccacaaaaatagggtcaatgggttataggagccgaccctaaattccaaaatgggtcaataaagccagaacctattgacccaatggatattatgggtcgacccacttgttatattaatgctctttttattag

SEQ ID NO: 22699 - DNA, 2045 bp, Panicum virgatum
  misc_feature: Ceres CLONE 1823144
  misc_feature: Encodes the peptide sequence at SEQ ID NO. 22700
aggccagcctccccatctccagccttcacactcccccacccacccccgccagcagaccaccaaccccagtccccggcggcggccattgccgattgcccgcatccgcatccacgcacactgcgggagggagccagccggtagcctgccctgcccaggatcggagatgacgctgttgtgcgtgccgctggtggcgcggacggtggaggagatggtggccgacgcggcggccgccgcggccgcgggcgccgacctcgtcgagatccgactcgacttcatccaggggttccgcccccgcgagcaccttccgcaactgctacgcggctgcacactcccggccctcgtcacctaccgacctacctgggaaggaggccaatatgaaggtgatgacaccacaagattcgacacactacgtttatcaatggaactaggtgtagactatgttgatgttgaactgaaggtcgccgacaaattcatgagctttatttctggcaataagccagacaaatgtaaacttattgtttcttcgcataattatgaacatactccgtcctgtgaggagcttgcaaatcttgtggctagaatacaagcagttggagctgacatagtgaaagttgcaacaactgctaaggatattgtcgatgtatcacggatgttccaagtgatggttcactgccaagtgcctatgattggactcgtaatgagtgaaagaggtttaatgtcacgggtgttagcgtcaaagtttggtggatatcttacatttgggatactaaattctgcaaaaacatcagcacctggacaaccaacagttgaagaattactggatgtttacaatataaggtgcataggacctgatacaaaggttcttggtcttatagccaacccagtaaagcagagcaagagcccaattctgcacaataaatgccttcaatacgttggatataatgctgtttatcttccacttcttggagataatcttgctagttttctcgagacatattcatctccagacttttcaggatttagttgctctcttcctttcaaagtggatgctgtacagtgctgcaatgaacatgatccagttgctcagtcaataggagcaattaacactataattagaagacctgatggcaaattagtggggtacaatacagactacattggagcaatatctgctattgaggatggtattggaggtccagggtccaaggatgctgccatctcaccgttggctggtaggcttattgttgttgtaggtgctggaggtgctggtaaggcaattgcttatggggccaaggagaagggtgcaagggtagttgtagcaaatcgtacctatgaaaaggcagtaattcttgccaatgcaattggaggtcaggccctgagattagcagacctggaaactttcaggcctgaagaagggatgatccttgccaatgcaacatcattggggatgcaaccaaatattgatgggactcctattccaaagaaagcactgagtttctacgatgtggtattcgatgctgtatatgccccaaaggttactcggcttctacgagaagcagaagaatgtggtgttaaagttgttagtggtgtggaaatgtttattagacaagccatgggtcaatttgaacatttcaccggtggtatagaagctcctgaaagtctaatgcgggaaatagcagcgaaatacacctagaaggttcttttaagtattaccatttcatttcaatcttgcaatcattgagggttaaatacttaacatgttaatggtgaaaaaacggctatgataaatattcgcccaaattttctcagggctgagtgataaaatgttttgagataactgcccagttttgcactcatggaagacttcgctgttttattgttaaatttggcagacttgtctgcacatggaagattacattgacatgatatatagtgttcattcttgtttgcaatagaggaattgcaaaaataaagcgtcagtttggaacctacattacgatgacccaggaataaaatatgcatcaagcaatgattcagttggcttc

SEQ ID NO: 22700 - protein, 509 aa, Panicum virgatum
  misc_feature: Ceres CLONE 1823144
  misc_feature (4)..(221): Pfam Name: DHquinase_I Pfam Description: Type I 3-dehydroquinase
  misc_feature (236)..(316): Pfam Name: Shikimate_dh_N Pfam Description: Shikimate dehydrogenase substrate binding domain
  misc_feature (344)..(462): Pfam Name: Shikimate_DH Pfam Description: Shikimate / quinate 5-dehydrogenase
  misc_feature (227)..(509): SWISSPROT Homolog: EC 1.1.1.25 Shikimate dehydrogenase
  misc_feature (3)..(217): SWISSPROT Homolog: EC 4.2.1.10 3-dehydroquinate dehydratase
MTLLCVPLVARTVEEMVADAAAAAAAGADLVEIRLDFIQGFRPREHLPQLLRGCTLPALVTYRPTWEGGQYEGDDTTRFDTLRLSMELGVDYVDVELKVADKFMSFISGNKPDKCKLIVSSHNYEHTPSCEELANLVARIQAVGADIVKVATTAKDIVDVSRMFQVMVHCQVPMIGLVMSERGLMSRVLASKFGGYLTFGILNSAKTSAPGQPTVEELLDVYNIRCIGPDTKVLGLIANPVKQSKSPILHNKCLQYVGYNAVYLPLLGDNLASFLETYSSPDFSGFSCSLPFKVDAVQCCNEHDPVAQSIGAINTIIRRPDGKLVGYNTDYIGAISAIEDGIGGPGSKDAAISPLAGRLIVVVGAGGAGKAIAYGAKEKGARVVVANRTYEKAVILANAIGGQALRLADLETFRPEEGMILANATSLGMQPNIDGTPIPKKALSFYDVVFDAVYAPKVTRLLREAEECGVKVVSGVEMFIRQAMGQFEHFTGGIEAPESLMREIAAKYT

SEQ ID NO: 22701 - DNA, 3134 bp, Panicum virgatum
  misc_feature: Ceres CLONE 1823147
  misc_feature: Encodes the peptide sequence at SEQ ID NO. 22702
acccaaccaaagcgcaggcagtgtctggctcactctactatcagcagtaacttcgtgcacacaccgcctcctcgccaatccgcacctaaatccggcgtgccgggcgcgagcaaggaaggaatccccgttgcggggaaggaatcgccgccgccggtgggtagctcctcgggctgggattgcaggaggtcgcgaccgggctgtttctggctcgtgcccggatcttggggagagggacgcgcggcgcctcgccgcgacggatccgatgcttagtcgaccgggtcgtgatcagcggttccattccagggtttacaagtaaagttttcccaacagttatgaattagctacacaatataagatggcaactgaggtcaatcaaaacttttttgcatggtcacaggaggaaacttctgtgcaggatatttcgcagggaacatcgcaagtgtttggtcatggttccatatcttttggaagatttgacttggaatcattagaatgggagaagtggtctgtatttgccaatgacaggcatcatgaagagtttggaaagttcaatggattggttgctaagaagaaggcatactttgaagaatactttaagaggattagggagctcaaggctttacagcagcaaaaccagcaaactgaacttcatctggagtacggtggtcatagcagcaattctagtcaaacaggagaacatggaccagctgcacaccatggagctcctactgaatctggaacatttgttgatgattccatggagcaggcaacaactgcaaacacatttgagcatggaattgaatgcaatggttatcatgagaatgggagcttagttaatgaaatttcggcgccagctcattcttcaccagttggcggcttgcagcaaattggcaaacaaatgagagatgttagtggtgaaatggatatgttgaagcaacattctaattccagccaaaatgatcctggaatggctcatgagattataataagtccttcaaaaatagttccaaagactatcaagatcactcctagtaatgtttctgatcacacaattgttactaagggacctggttcaggtaaacccagtgtgataaaccagatggcaaagtcagaaaatattcagtcattgcgaagaccaagagaagcaaccaacaatttggttggcaccacagcaagaagtgtcattacaggtttaagaagaccttcctcggcagcatcacaacggccctcaatcagagaacggcgacctgtcaccagagatgcttcaaggaaacctgctgaagtacccaccccatgccgcccttctatttctgaaagacgccctgccaccagagagtcagcaataaagcatgccagcaatgctaccccatgtcgaccttctaccatggacaggcgcaatatgaccaaagaatcagcactaaagcaatgcaacattgctacttcacgtcgaccttctactgctgacaggcgctctatgaccaaagagtcagtaccaaagctatccaacattgctactcatcgaccttctactgctgacagatgccctatgaccaaagaatcagcaccaaagctatccaacattgccactccacgtcgaccttctactgctgacaggcgccctgtcatcaaagagtcaacaccaaagctatccaacatttctacaccacatcgaccttctactgctgataggcgcactatcaccaaagagtcatatccaaagcatttcaacattgctagcccatgtagaccttctactggcgaaaggcgcactagcacaagagatatgaccacaaaacatgctggtattgcacccttatgtctgctacctgctgtcaaacaacatcgtatcactagagagggtgcacagaagcatgctgatgttgtcactctgtgccatccttctactgcagagaggcgccccattgttagcgatgttgcaccaaagcatgtcattgtagctccaccatgcaggccttctactaccgagaggtgccccattgctagagatgttgcactgaagcatgattcacctcacaggccttctaccgctgagaggcgccccatttctagagatattgaaccaaagcatgctctgcctcacaggctttctactgctgagaaacgtccttgtaccaatgagattgcaaggaagcaaactgatgttgccatctcatgttgccctttgactccagatagatgcctcaccaaaaaaagtgacaattccaccccacgacgcccttctactggagaaaggcgccctataaccaatatcactacaatgaatccggatccaaaaacacctatcgggtcaagaacaatgcctaactattcaaagggtgctatggtcacagaaggtactcccaaaaaggcaataactaccagtgttgctaaaagtagcttgctggaaaacataagctatgtgaaagaaagggtggaatttcaagtggatgggaagcaaaagtcaagcccttttaacctgcctccaaggaaaatgctgacttccaatgttagagctgaccggggtctggaaaatttgagaaagccaaacaaggagggtttgtgtgagggagtccgggctcaagcgtataaatcaaataacgtggctccactgactagaagtttaaagacaagggctcctgcgcctccaccacctcctcctccaccacgtggaccatcttgcactgagaggaggccgtcgaatgccaacaattcccctgctggtggaaggaagccaaaggcctcaactccacactggcactaacacagtatctaggatgatcctgcaacataactctgaagcgaaaatgaaacactgacgttacctagaagctacaaccaatgaaccaagctagcaatgctgatgttatctttcgttttttacaagcactcttgtcacctgtgttagaataaccgtagtagtgtatgtagctaatcagtccgctaatgtctaattgcttcgaagttgtaccatcccggatttaactagggcattgtatatacctggaataattggagctttagctgaagaatatcgacccggaaattatccccaggatttgcaggtaacatgttcttgaatcttaacggatgtccatacggagtccggatctaccaattgatagtttactgtctgc

SEQ ID NO: 22702 - protein, 801 aa, Panicum virgatum
  misc_feature: Ceres CLONE 1823147
  misc_feature: SWISSPROT Homolog: EC 2.7.7.6 DNA-directed RNA polymerase
MATEVNQNFFAWSQEETSVQDISQGTSQVFGHGSISFGRFDLESLEWEKWSVFANDRHHEEFGKFNGLVAKKKAYFEEYFKRIRELKALQQQNQQTELHLEYGGHSSNSSQTGEHGPAAHHGAPTESGTFVDDSMEQATTANTFEHGIECNGYHENGSLVNEISAPAHSSPVGGLQQIGKQMRDVSGEMDMLKQHSNSSQNDPGMAHEIIISPSKIVPKTIKITPSNVSDHTIVTKGPGSGKPSVINQMAKSENIQSLRRPREATNNLVGTTARSVITGLRRPSSAASQRPSIRERRPVTRDASRKPAEVPTPCRPSISERRPATRESAIKHASNATPCRPSTMDRRNMTKESALKQCNIATSRRPSTADRRSMTKESVPKLSNIATHRPSTADRCPMTKESAPKLSNIATPRRPSTADRRPVIKESTPKLSNISTPHRPSTADRRTITKESYPKHFNIASPCRPSTGERRTSTRDMTTKHAGIAPLCLLPAVKQHRITREGAQKHADVVTLCHPSTAERRPIVSDVAPKHVIVAPPCRPSTTERCPIARDVALKHDSPHRPSTAERRPISRDIEPKHALPHRLSTAEKRPCTNEIARKQTDVAISCCPLTPDRCLTKKSDNSTPRRPSTGERRPITNITTMNPDPKTPIGSRTMPNYSKGAMVTEGTPKKAITTSVAKSSLLENISYVKERVEFQVDGKQKSSPFNLPPRKMLTSNVRADRGLENLRKPNKEGLCEGVRAQAYKSNNVAPLTRSLKTRAPAPPPPPPPPRGPSCTERRPSNANNSPAGGRKPKASTPHWH

SEQ ID NO: 22703 - DNA, 1664 bp, Panicum virgatum
  misc_feature: Ceres CLONE 1823162
  misc_feature: Encodes the peptide sequence at SEQ ID NO. 22704
actactgccactctgttcacgattccacttcaaaaccttgaggccacacgctttgtaaactctgatcatcatggagaacaaggcaggaacagaggagccccttctcctggcgcggcccgagaacacggccgcggcggaggccaagcggctgctgcggctggcggggcccctggtggccagctgcatcatgcagaatgccgtccagctggtgtccgtcatgttcgtcggccacctcggtgagctgcccctcgccggcgcctccctggccagctccctcgccaacgtcaccggcttcagcctgctctgcggcatggtgagcgcgctggacacgctgtgcgggcaggccttcggggcgaggcactacggcctcctcggcgtgtacaagcaacgcgccatgctggtgctcgggctcgcctgcgtcccgatcgccgtcgtctgggccaacgccggccggatccttatcctcctcggccaggatcacgacatcgccgaggaagctggcgcctactcgcggtggctcataccgtgcctcgtccctttggtcccgctcgtgtgccacatccggttcctgcagacgcagagcatcgttgtgccagtgatggccagctccggcgtcacgtcactgagccacgtcttcgtgtgctgggcgctggtgttcaaggccggcttggggagcaaaggcgctgcgctgagcaatgccatctcctactgcgtcaacctggccatgctcgctctctacgtcaggctgtcaggcgcgtgcaagaggacatggacaggattctccaccgaggctttcaatgagctgcgccggttcactgagctcgccatcccatcggcgatgatggtctgcttggagtggtggtcatttgaactactcgtgttgctctctggccttctgcccaatcctaagcttgaaacctcagtattgtcgatatgtctcaacactggttcgttgctgttcatgataccatttggtctctctacagccataagcacacgagtttcgaatgaacttggcgctggtcagccccacgcagcgaagctggcaactcgagtagtaatgtgcatcgccatgtctgccggcttgattctagcctctaccatgattctgctacgcaatgtctggggctatatgtacagcaatgaacctgaagttatcacatacattgcaaaaatgatacctgttctcgcgatatcgttcttcacagatgggcttcacagttctctatccggagtactgactggatgcggtgagcagaaggtcggcgctcgtgttaatctcggtgcgttctacttggccggcgttcccatggccgttttccttgcatttgttccccatcttaacggaatgggtctttggcttggtattgtctgtggcagcctcaccaagcttgtgttgctcatgtggatcacactgcggataaactgggagaaagaggcaacgaaggcaaaagaaacggtattcagttcatctcttcccatagcatgatggtgttatgtgtaactggacaaataacagtgcaacggcgccatcgcagctgcagacaaatcatcccactgcgcacaaggaaattaacagacatttgagatatattttctctaagttaattagcaaataatcattttatgctttattaaatttgaaagtttgcagggttttcctt

SEQ ID NO: 22704 - protein, 472 aa, Panicum virgatum
  misc_feature: Ceres CLONE 1823162
  misc_feature (254)..(417): Pfam Name: MatE Pfam Description: MatE
  misc_feature (33)..(193): Pfam Name: MatE Pfam Description: MatE
MENKAGTEEPLLLARPENTAAAEAKRLLRLAGPLVASCIMQNAVQLVSVMFVGHLGELPLAGASLASSLANVTGFSLLCGMVSALDTLCGQAFGARHYGLLGVYKQRAMLVLGLACVPIAVVWANAGRILILLGQDHDIAEEAGAYSRWLIPCLVPLVPLVCHIRFLQTQSIVVPVMASSGVTSLSHVFVCWALVFKAGLGSKGAALSNAISYCVNLAMLALYVRLSGACKRTWTGFSTEAFNELRRFTELAIPSAMMVCLEWWSFELLVLLSGLLPNPKLETSVLSICLNTGSLLFMIPFGLSTAISTRVSNELGAGQPHAAKLATRVVMCIAMSAGLILASTMILLRNVWGYMYSNEPEVITYIAKMIPVLAISFFTDGLHSSLSGVLTGCGEQKVGARVNLGAFYLAGVPMAVFLAFVPHLNGMGLWLGIVCGSLTKLVLLMWITLRINWEKEATKAKETVFSSSLPIA

SEQ ID NO: 22705 - DNA, 1238 bp, Panicum virgatum
  misc_feature: Ceres CLONE 1823165
  misc_feature: Encodes the peptide sequence at SEQ ID NO. 22706
cattctcttctagtagtcttcttctccctcctccctcctgcagccccctggccacctccattcctgcgctcccgaccagacacggacaggccttctctttttggatcctttgcgcccttctctctctctctctgcgattcattcgcggcagctcgtcagagcgaaatccaccgccgctgctctcggcgcgatgtcgtcggccgccgtgagcgcagcctcttcttgccccgccaagcccgagaaggaggaggaggtggagcagccgcggcttccgccgcaggggagggaggggtgcagctccgccgccgccgcaggggagccggagccggagcaggagcggcgcgtggccgccgcggtggaccggaagctcagagaggcgtcgctgtgcgccagcaccgccaccgaggaggagacggaggaggacgacgacgaggaggaggcggcggcggaggccaaggacggcgtcgagctcggccccagggtcagcatcagggagcagctcgacaaggacaaggacgacgagagcctgaggcgatggaaggagcagctcctgggcagcgtggatttgagctccgtcggagagacgctggagccggacgtgaagatcacgggcctgtccatcctgtcccccggccggccggacatggtgctgccgctgccgccggagcccaagagcaaggagccctggttcacgctcaaggagggcagcgcatacaggctcaagttcaccttcgccgtcgccggcaacatcgtctccggcctccgctacaccaacaccgtctggaagaccggcatcagggtggacagcaccaaggagatgctgggcaccttcagcccccaggccgagccctacacctacctgacgcccgaggagaccaccccgtcggggatctttgcccggggatcatactcttcaagaacaaaatttctcgacgacgatcgcaagtgctacctggagatgaactacacctttgacatccgacgggattggccgtcaagctgatgagcagcgtgctttttcaatccctgactgattatctgcttgaattgggggtacaagctttggttctcgtcttctcgaggtcccaagctgttgccatggcttaataacttgatgacaaactctgatgtgtgttcgattacagctctgctagtcagctggtagcttctgttcggttctttcagttctgggtagcgcgccttggatgttttgtcgcagaagctgtactgttgtagcc

SEQ ID NO: 22706 - protein, 270 aa, Panicum virgatum
  misc_feature: Ceres CLONE 1823165
  misc_feature (56)..(269): Pfam Name: Rho_GDI Pfam Description: RHO protein GDP dissociation inhibitor
MSSAAVSAASSCPAKPEKEEEVEQPRLPPQGREGCSSAAAAGEPEPEQERRVAAAVDRKLREASLCASTATEEETEEDDDEEEAAAEAKDGVELGPRVSIREQLDKDKDDESLRRWKEQLLGSVDLSSVGETLEPDVKITGLSILSPGRPDMVLPLPPEPKSKEPWFTLKEGSAYRLKFTFAVAGNIVSGLRYTNTVWKTGIRVDSTKEMLGTFSPQAEPYTYLTPEETTPSGIFARGSYSSRTKFLDDDRKCYLEMNYTFDIRRDWPSS

SEQ ID NO: 22707 - DNA, 582 bp, Panicum virgatum
  misc_feature: Ceres CLONE 1823182
  misc_feature: Encodes the peptide sequence at SEQ ID NO. 22708
acgtgaaccagagtgctagctgcagccaggatgtacgtaaaggaagtggatgcaccggtagcggccaaactgacatcaatacgaatacaatggttgccctggaaagtggtaacgaaagtggtgtccagaactgctataataatgggttggatagtgaccggtctcgccgtgaagctgccttgatgaagtttcgcatgaaaaggaaagatagatgcttcgagaaaaaggttagataccatagcaggaaaaagcttgcagagcaaagaccgagagttaaggggcagtttgtgagccaaaagctgaaatcagctacaacagtggatgcggaaactgactcatgactgttgatttgtaactgtgattttgattctacccttccaatcccaggtgagggcaattggagcggtagagattgaaggctagcagaagttttcctctccatggttagcctgtgtgtacaagtcggttgtttgttggcattcaagccatattttgtaaaggactccttcaaattgacaaatgtccaggaaaaaatgaaatagacgcaaataccccagattttgtttcaaaaaaaaaaaaaaa

SEQ ID NO: 22708 - protein, 112 aa, Panicum virgatum
  misc_feature: Ceres CLONE 1823182
  misc_feature (56)..(100): Pfam Name: CCT Pfam Description: CCT motif
VNQSASCSQDVRKGSGCTGSGQTDINTNTMVALESGNESGVQNCYNNGLDSDRSRREAALMKFRMKRKDRCFEKKVRYHSRKKLAEQRPRVKGQFVSQKLKSATTVDAETDS

SEQ ID NO: 22709 - DNA, 548 bp, Panicum virgatum
  misc_feature: Ceres CLONE 1823186
  misc_feature: Encodes the peptide sequence at SEQ ID NO. 22710
gcgctgacacgcatcattaattccggaggggaaacgcacgcggtatccatccagtggctggctgggtagcgggggcgcagccgcgcaggtgcaggcgggcgagcgagctcggccatggcgagcgcgatgaacggtggcggcggcggcggggcgctgaagcggatgggcccgctgcgggtgcagtactacatcgtgatgggcgcggtggcggcggccgtggtgctggccacgctgcgctacatgccgggccccgccgccgccgccaccagcagcgtggtccggccgggcgcctcctccgcggcggcggcccccggcgccgaggcggaggcacaggcggatgacggggtggcggcggagagggagaagaggaagaataatggggacggggcggtgctgttcaacttttgcgactccaaccgcgacactgacggcgtggcggcagtgatgcggatccgcatcgcgccgcctgacggccgggcctacttcctccaccccacggggaggctaccctacggccgcgtcatcgtccacctaacctgcgatagcct

SEQ ID NO: 22710 - protein, 144 aa, Panicum virgatum
  misc_feature: Ceres CLONE 1823186
  misc_feature: SWISSPROT Homolog: EC 3.2.1.51 Alpha-L-fucosidase
MASAMNGGGGGGALKRMGPLRVQYYIVMGAVAAAVVLATLRYMPGPAAAATSSVVRPGASSAAAAPGAEAEAQADDGVAAEREKRKNNGDGAVLFNFCDSNRDTDGVAAVMRIRIAPPDGRAYFLHPTGRLPYGRVIVHLTCDS

SEQ ID NO: 22711 - DNA, 1537 bp, Panicum virgatum
  misc_feature: Ceres CLONE 1823190
  misc_feature: Encodes the peptide sequence at SEQ ID NO. 22712
aattggatgcaaccttttccattcctagctatggcttcgccgtcgaacacgagccatgcaaccctgtgctgaaactatgccgttatcgtctctctcctccctcctcatcctcggccaccacccgccgcgctcgctcctgccaactgcaaaccgcccgccgccacacctccgcctcctcctcgctccgttcacacgccgccgcgccttcgcctgccagccgctcgccgcggccacggacgggatggctgctgcggccgcggcggcgtcgccccccactctgctcgagcacatgggccaggccggcgcggccgctgacctcaccgtcctcgtggcacacatccagagcgcgtgcaagcgcatcgcggccctcgtggcgtcccccggcaacgccgagctgtcgcgggccaaggccgggggcggggctgtggcggccgggcgtgacgcgcctaagccgctcgacgaattgtcgaatgatatcatcctttcatcggtcaaaagttctggaaaggttgcagtgcttgcgtccgaagaaaacgatcagcccatttggatatccgatgacggtccatatgttgttgttaccgatccgcttgatggttctcgtaacattgaggtctccatacctacgggaacaatatttgggatatataataggctggtggagctcgaccatctgcctttggaggagagagctcagctcaattcgctgcagagtggaactcgccttgtcgctgctgggtatgtcctttactcatctgccaccatcttgtgtatcagcttcggtgcaggtactcatgccttcacattggattgatcaactggagaattcattcttacacatccgtccctccaaataccgcctagaggacagatatattccgtgaatgatgcacggtattttgattggcctgagggcctaaggaagtacattgacacaatcagacaaggcaaaggacagcacccgaagaagtactcagcacgctatgtttgctcactggttgctgatttccaccggatgctcatatatggtggagtagctatgaacccaagggatcatttgcggttggtttatgaggcaaatcctctcagtttccttgctgagcaggctggtggtagagggtcagatggcaagaacagaatcctctcgattcagcctgtgaagctgcaccagaggttgccattgttcttggggagcatggaggacatgcttgagttggaaagctatggagatgtccaacagaaggttaatcctggatatgaagtttagcgatatgtaaaattattcagattttcaggtgttgtagcaatacaataaggtaaagcacgtgtggcaataagaagggcgggcctggtgcagcggtagagcctaccgtctgtaaccggaaggtcccgggttcgagccccagcctctgcacattcgtgtgggtaaggcttggggcttaaagacaacccttccccagaccccgcacagtgcggaaagtctacggcactgggtacgcccttttttttaaagcacatgtggcaatcctgtctttgc

SEQ ID NO: 22712 - protein, 245 aa, Panicum virgatum
  misc_feature: Ceres CLONE 1823190
  misc_feature (62)..(245): Pfam Name: FBPase Pfam Description: Fructose-1-6-bisphosphatase
  misc_feature: SWISSPROT Homolog: EC 3.1.3.11 Fructose-bisphosphatase
MPLSSLSSLLILGHHPPRSLLPTANRPPPHLRLLLAPFTRRRAFACQPLAAATDGMAAAAAAASPPTLLEHMGQAGAAADLTVLVAHIQSACKRIAALVASPGNAELSRAKAGGGAVAAGRDAPKPLDELSNDIILSSVKSSGKVAVLASEENDQPIWISDDGPYVVVTDPLDGSRNIEVSIPTGTIFGIYNRLVELDHLPLEERAQLNSLQSGTRLVAAGYVLYSSATILCISFGAGTHAFTLD

SEQ ID NO: 22713 - DNA, 669 bp, Panicum virgatum
  misc_feature: Ceres CLONE 1823197
  misc_feature: Encodes the peptide sequence at SEQ ID NO. 22714
acgtacgacaccaaccgaccacttgagttccacgacgtcacccgatcccaaccgcaagggcgcgccgccgcaatgccgacgctcggcatcgcgccgctgctcgacgcctgcttccgccgccgcttcgccgcggcgggcctcccacaggcatccgtgcccctcgacggcggcgccaccacggtccactgctggcgcttcccgccgggcaccgacggaggcaccgacgcgcgccccgtcctggtactcctccacggcttcggccccccggcgacgtggcaatggcggcgccaggtgatcccgctctcccgccggttccgcctcgtcgtcccggacctcctcttcttcggcggctcgtccacgtcggcggtcgcacgcgtctccgaggaccaccaggccgaggcggtggcgaagctcatggcggccgtggtgccgcccggggcggcgcgcgtgtcagtggccggcacgagctacggcgggttcgaggcgtaccacgtggcgaggctgctgggccccggcgcggtggggcgggtggtgatcgccagctccgacctgctcaaggccgacaccaacgaccgcgcgctgctccgccgcggcggcgcggagcgtgtcgaggacgtgatgctgccgcgctccgccgagcggatgcggcggctgctgcagatcgcgtac

SEQ ID NO: 22714 - protein, 198 aa, Panicum virgatum
  misc_feature: Ceres CLONE 1823197
  misc_feature: SWISSPROT Homolog: EC 6.6.1.1 Magnesium chelatase
MPTLGIAPLLDACFRRRFAAAGLPQASVPLDGGATTVHCWRFPPGTDGGTDARPVLVLLHGFGPPATWQWRRQVIPLSRRFRLVVPDLLFFGGSSTSAVARVSEDHQAEAVAKLMAAVVPPGAARVSVAGTSYGGFEAYHVARLLGPGAVGRVVIASSDLLKADTNDRALLRRGGAERVEDVMLPRSAERMRRLLQIA

SEQ ID NO: 22715 - DNA, 407 bp, Panicum virgatum
  misc_feature: Ceres CLONE 1823201
  misc_feature: Encodes the peptide sequence at SEQ ID NO. 22716
ccgtgctctctcagaggtgggttggcttctcctccccctcttacctagtcctcggctctagggttttagtgggaagggagatggcggcggcggatgtggagtaccgctgcttcgtcggcggcctcgcctgggccaccgacaacgcgtccctccagcaggccttcgcctcctacggcgacgtcctcgactccaaggtcatccccgaccgtgagaccgggaggtcccgcgggttcggcttcgtctcctcctcctccgagcagccgatgctggacgccgccgccttccggaatcccgatggcatccgcagccgcgcacccagcctccctctcccccacggcccgcgctgccacccgggccgccgccgcgtcagtcgcctcccccccgcccagatggggcctcgcttcgcc

SEQ ID NO: 22716 - protein, 108 aa, Panicum virgatum
  misc_feature: Ceres CLONE 1823201
  misc_feature (10)..(81): Pfam Name: RRM_1 Pfam Description: RNA recognition motif. (a.k.a. RRM, RBD, or RNP domain)
  misc_feature: Useful for making plants with altered lignin content
  misc_feature: Useful for making plants with modulated nitrogen use efficiency
  misc_feature: Useful for making plants with modulated flowering time
  misc_feature: Useful for making plants with altered alkaloid content
MAAADVEYRCFVGGLAWATDNASLQQAFASYGDVLDSKVIPDRETGRSRGFGFVSSSSEQPMLDAAAFRNPDGIRSRAPSLPLPHGPRCHPGRRRVSRLPPAQMGPRF

SEQ ID NO: 22717 - DNA, 2272 bp, Panicum virgatum
  misc_feature: Ceres CLONE 1823204
  misc_feature: Encodes the peptide sequence at SEQ ID NO. 22718
agccatcagccccgcccgggatccttgtcccattctgctccagcctcgccgtccgtccccgcggtctcgccggcggccgggcccccgtcgtcggtcgtcacggacgagaccgcctccaggctcacgcggtcaccggccagcgcgggcggagccacctcgcctggccgcgccgaagggcaggcgtcgcgccagagccgcccgctgccgcccccctctgccggtgccggcgggagtgcagatccatccgggctcgggttcatttccgctggtcctggtttggtttccagctcggttagtagttgtaaaccgaggattctgccagtacaaatgccgatctgtagctgtgaacagacaatcaatgagtttgagacattaacacgcgatcgcgatgctggacgcgtgcagcaggatacactaagaaagatcctcgagttgaacgctgatgctgaatatctgaaccactatggcctcaatgggagggcggatgtagagagctacaaatcttgcatccccctgtgcgttcacagcgatgttgagccatatatccaaaggattgctgatggtgatacctcaccactgctcactgggaagcccgtcacttccctgtctctcagttctgggacaacacagggaaagcccaagttcttgccatttaatgatgaattgcttgagaccacacttcaaatattccagacttcttatgcatttaggaaccgtgaatatcccataggcaaaggaaaagccttgcagtttatctatggtagcaagcaagtgataacaaaaggtggcatccttgctacaactgcaacaacaaacttgtacaggaggtcacgttacaaggaagggatgaaggatatccagtctcagtgctgcagtcctgatgaagttgtttttggccctgacttccaccagtccttatattgtcacttgctctgtgggttaatatactctgacgaagtccatcaggtgttctcaacatttgctcacagcttagtccatgcatttcaaacatttgaggaggtttgggaagatttatgtgctgacataagagatggtgttctctcaaagaaagttacagtgccatcgattcgtgaagctgttacgaagatcctgaagcccaaccctgaacttgctgagtcgatccacaggaagtgtattggcttgagcaactggtatggtgtaatcccagcactctggccaaatgcaaagtatgtctacggcatcatgacaggatcaatggaaccatatcttaagaaattaagacattatgctggccacttaccactgataagcgcagactacggtgcatctgagggatggattggcgctaatataaaccccacactgccacctgaacaggtgacatatgctgtgcaccctcagactggttatttcgagttcattcctttggaaaaaccaaaaggacaggagttggagaacagtgcatcaattcattacatagaatcagatccagttggcctgactgaagtcaagatcggcaaaatctatgaagttgtaataactacctttggaggtctgtaccggtacaggctaggagatattgtgaaggtagcaggcttccacaactcaacacctgagctccagttcatctgccgcagaagcctagtcctgagcatcaacatcgacaagaacactgagaaagatctccaactggctgttgaggaggcaggaaagctcttggaagcggagaagctggaaattgtggattttactagctttgtggagaagtctagtgatcccggtcgctatgtcatcttctgggagctgagctctgatgcgagcgaggatgtcttacgaagctgtgcaaattgcttggatctagcctttgttgatgcgggctacgtgggttcaaggaagattaggaccattggcccccttgagctacggattcttaagaagggaacctttgaggagatcctagattacttcctgagccttggtggtgctgtgagtcagttcaagacgcctcgattcgtcaacccgttgaacatcaaggtactgcagatactaagtaggaacaccaccaaaagttacttcagtaccgcctatgggctgtgacaaaaaaggaaatgctgctagttccatgtaattatcttttcttccatgttctgttttagtcttcagataaagaaaacaatctgttttagtctcttgccataatactacatattctagtgctgctggtggctagaatctctgtaaatccacatgcagttgtaccaagaggtatcagaaaaagtgaagttgctgc

SEQ ID NO: 22718 - protein, 583 aa, Panicum virgatum
  misc_feature: Ceres CLONE 1823204
  misc_feature (8)..(567): Pfam Name: GH3 Pfam Description: GH3 auxin-responsive promoter
  misc_feature: Useful for making plants with modulated light quality sensitivity
MPICSCEQTINEFETLTRDRDAGRVQQDTLRKILELNADAEYLNHYGLNGRADVESYKSCIPLCVHSDVEPYIQRIADGDTSPLLTGKPVTSLSLSSGTTQGKPKFLPFNDELLETTLQIFQTSYAFRNREYPIGKGKALQFIYGSKQVITKGGILATTATTNLYRRSRYKEGMKDIQSQCCSPDEVVFGPDFHQSLYCHLLCGLIYSDEVHQVFSTFAHSLVHAFQTFEEVWEDLCADIRDGVLSKKVTVPSIREAVTKILKPNPELAESIHRKCIGLSNWYGVIPALWPNAKYVYGIMTGSMEPYLKKLRHYAGHLPLISADYGASEGWIGANINPTLPPEQVTYAVHPQTGYFEFIPLEKPKGQELENSASIHYIESDPVGLTEVKIGKIYEVVITTFGGLYRYRLGDIVKVAGFHNSTPELQFICRRSLVLSINIDKNTEKDLQLAVEEAGKLLEAEKLEIVDFTSFVEKSSDPGRYVIFWELSSDASEDVLRSCANCLDLAFVDAGYVGSRKIRTIGPLELRILKKGTFEEILDYFLSLGGAVSQFKTPRFVNPLNIKVLQILSRNTTKSYFSTAYGL

SEQ ID NO: 22719 - DNA, 1783 bp, Panicum virgatum
  misc_feature: Ceres CLONE 1823216
  misc_feature: Encodes the peptide sequence at SEQ ID NO. 22720
acaatagagtgcgagccgacctcctccccatctctctctactctctctctctaccgctcctcgtgacgtcgcgtgcccacgtctcccacgccccctgtccctactcctcctcctcctccagatccggtctccccagccgccgccgatgtccgaagatctagcgggatcccgccgctggcggtgcgacctcggcggcgatgaccgctggctgtcgggggccgccggcgacgaccacttcgaccgcctccccgacgcgctcctcctcgtcatcttcaaccgcatcggcgacgtcaaggcgctcggccgctgctccatcgtctcccgccgcttccacgagctcgtccccctcgtcgactccgccctcgtccgcgtcgactgcgtcatccccgacgagcccccctcctcctcctcgccgtccgcgccgtcctcccccacggcctccgtacgcgcccgcggggtcttctcgcagattgcgcgcatcgtgctcggcggcatcgtgaagcccatccaggcgctcggccagatcctctcacctgcccactctgcctccggcttttcagcatcctccgcttcctcgtcgtcatccttccccccatcttcgacgtcgtactcgccgttgcctcctggggacgtgtcacaccactcgccctcggaggtgctccgctccttcaaggagctccgccaccttcgcattgagcttccggcgggtgagcttggcacggacgacggcgtgatgctcaagtggaaggctgacttcgggtccacgctcggcagctgcgtcatcctcggcgcatcctcggcctcgccgtcccctgctggctcagatggcgcgagcacagctccctctgttgacagtggccgcagcgagcctgaggaatgtgacgattcaggaagcatcccggaatccttctatacaaatggggggctgaggctgcgggtggtgtggataatcagctcgctgattgcagcagcagggaggcattacttgctgcagccaatcgttgctgaccacacaacgctggaaagattggacctgacggatgcagatgggcagggagtgctcaccatggacaagtgccaactgcaggagctgcgggtgagaccggtatcatcatctgcggcctcacaccggaccctcatgccggagcttagcatgtggctgtggtacgcaccatgcattgagctgcctggggggttggtgctaactggtgcgactttggtagccatcaagccgagcgaggaggcaacaagggacatggtagggaatggggctgctacggcagcctgggttttagatgcattcgaggagccatacagaacagcagcgaggatgcttctcaagcggaggacttacacccttgagatgaattcattctaatccatagaggaggtggcattttggaagcttcatatatgagaggatgttatacctacaagggtcatttctggctgcctttttataccccaatctgcactattctggatgtgttccaattgtgttggatgcattcctttccatgctgaggatctgccagcattcaagcaagaacatggatggaaatgaagagaatccgggcgttaatttatcgatgctggagtagagaggcaaagccattgttgagctggtgtttgctctgagggaactcccttatcactgagatcagatgtggtgacatagataaattttttttcttatatgtatccacatcaaggaactaaccttatgtaatttctgctttggatcgcactgcttatttgcataatagcatccgatgtgccctgt

SEQ ID NO: 22720 - protein, 410 aa, Panicum virgatum
  misc_feature: Ceres CLONE 1823216
  misc_feature: Useful for making plants with modulated low light sensitivity
  misc_feature: Useful for making plants with modulated nitrogen use efficiency
MSEDLAGSRRWRCDLGGDDRWLSGAAGDDHFDRLPDALLLVIFNRIGDVKALGRCSIVSRRFHELVPLVDSALVRVDCVIPDEPPSSSSPSAPSSPTASVRARGVFSQIARIVLGGIVKPIQALGQILSPAHSASGFSASSASSSSSFPPSSTSYSPLPPGDVSHHSPSEVLRSFKELRHLRIELPAGELGTDDGVMLKWKADFGSTLGSCVILGASSASPSPAGSDGASTAPSVDSGRSEPEECDDSGSIPESFYTNGGLRLRVVWIISSLIAAAGRHYLLQPIVADHTTLERLDLTDADGQGVLTMDKCQLQELRVRPVSSSAASHRTLMPELSMWLWYAPCIELPGGLVLTGATLVAIKPSEEATRDMVGNGAATAAWVLDAFEEPYRTAARMLLKRRTYTLEMNSF

SEQ ID NO: 22721 - DNA, 729 bp, Panicum virgatum
  misc_feature: Ceres CLONE 1823224
  misc_feature: Encodes the peptide sequence at SEQ ID NO. 22722
gcatatctatctctcccaagctgcaatttcacactgcaatagctaggaatcaaaatatagagccttgcagcccttgctctcgcctaagttgtctagctagctagttttgagtagcgtcgttgttatacttgctactacctagagctagctaacaatggccgccgcacctgcacgcaccttctccgtgcgctccgtggagcctcttcccgtttcagcttcgctggcggcaaccagaaacaacgaccagcgaggccgcccccgtggccgttccatcatcgcttcggcggcggcgtcgaaaacgctgctgcccagtgattttgacctccagctccagattctgcaggaacgtaggaacagcgcccgggagatgatggccaccatcgacaacctcaagcgcctctgcatcgaccactacttccaggaagagatccaaagcgccatgggcgcgtgcttggatctcatccacagcgatgatctcttcgatgcgacacttgcattcaagctcgtgagagaggccggccatgatgtttcagcagatgatgttctacggaggttcactgacgacaccggcgagttcaagcttgctcttatcaaagacatcagagggctcctgagcctccacgacatgtcacacctggacatgggagaggagccatcactgcacaaggcaaaggagttctcaagccagcaccttgcatctgccatcaggtacctggagtcagggcttgc

SEQ ID NO: 22722 - protein, 191 aa, Panicum virgatum
  misc_feature: Ceres CLONE 1823224
  misc_feature (51)..(191): Pfam Name: Terpene_synth Pfam Description: Terpene synthase, N-terminal domain
  misc_feature: SWISSPROT Homolog: EC 4.2.3.13 (+)-delta-cadinene synthase
MAAAPARTFSVRSVEPLPVSASLAATRNNDQRGRPRGRSIIASAAASKTLLPSDFDLQLQILQERRNSAREMMATIDNLKRLCIDHYFQEEIQSAMGACLDLIHSDDLFDATLAFKLVREAGHDVSADDVLRRFTDDTGEFKLALIKDIRGLLSLHDMSHLDMGEEPSLHKAKEFSSQHLASAIRYLESGL

SEQ ID NO: 22723 - DNA, 1687 bp, Panicum virgatum
  misc_feature: Ceres CLONE 1823250
  misc_feature: Encodes the peptide sequence at SEQ ID NO. 22724
aaggcccgaacctgaggaagaggggaagcagaagcgagggtgccgtgacgtcgggaacgagaagcggcgacggagaagcgaggcgagcgagcttacaaatacagcgccgccgccctcccacaatgcccgccccgcccgcctcagatcccaaaccctaaccctaggcggccgtccaggggcccctaaccgccgccggtggccggcgggcggcgcgatcgggaccagccgacgcgggagcagcgccgaggcgccgtcaggaaggagaggaaaaaaggcggggagcccgaagccctagccgtgcggccgaggcgcggatcggggaagggagtggagtggaggggggcggaaggttgaggggtgggcgaagcgagatgccgggcgacgctgcgacctcgccggcgccgccgccttcgccagcgtcctcgtcctcgcagcaccaccaccaccaccagggccccgcttccgcccgcgggctcctgtgccacgccgtcgccggcgcctccgccggtgtggtggcggcgacgttcgtgtgcccgctcgatgtcatcaagacgaggttccaggtgcacggctgtcccaagctagccacaggcacagttggaggtagtgtaattattgggaccttacaacagattgctcaacgggaaggttttcggggaatgtatcgtggcctctccccgactattctggcgctattgccaaactgggcggtctattttactgtatatgagcagctcaaaagcctgctttcttccaatgatggaagtcaactctctttaggggcaaatgttgttgctgcatcatgtgcaggagctgcaacgagtattgtaacaaatccactttgggttgtcaagacaagatttcagacccaaggaataagagccgggccaatcctgtataaaggtactcttgctgccttgagaagaatagcacatgaggagggcatacgcggactataccgtggtctggtccctgccttggttggtgtcagtcatgttgctattcagttccctgcatatgagaagattaaagcttatctggcggagcgagataatactactgttgaagcattgagttttggtgatgttgctgttgcttcatctctggctaaagtagctgcatcaactatgacatatcctcatgaagttgttcgttcaaggctgcaagatcagggagcacactcggaggctagatacaaaggtgtaatagactgcatcagaaaggtttattacaaagagggtgtggctggctactaccgtggatgtgccacaaatctgttccggacaacccctactgcagtgataactttcaccagctttgagatgatccatcggttcctccttgatctactccctcctgcacctgagccgcacatccaaccactgaagcattgaccatacaataaccgtaccctgtccatgctgccaatggaaattaggaagcccagtaagtaaccatccagcaatgctgtttaccaagtcctcttgcccgtgtaaaagagagaattctttttcccggatatgcaacaggtagctgccattcaaaagttgaaacttatagtgtaggggcggggattaacatctttgtatgtaatagattcgttagcatgcatttgggaggtatatgtggtgatgtgggtatgttgtcttgatgatgatgaaaaagaaaagaatttttccttcgaatc

SEQ ID NO: 22724 - protein, 340 aa, Panicum virgatum
  misc_feature: Ceres CLONE 1823250
  misc_feature (135)..(227): Pfam Name: Mito_carr Pfam Description: Mitochondrial carrier protein
  misc_feature (235)..(327): Pfam Name: Mito_carr Pfam Description: Mitochondrial carrier protein
  misc_feature (34)..(130): Pfam Name: Mito_carr Pfam Description: Mitochondrial carrier protein
MPGDAATSPAPPPSPASSSSQHHHHHQGPASARGLLCHAVAGASAGVVAATFVCPLDVIKTRFQVHGCPKLATGTVGGSVIIGTLQQIAQREGFRGMYRGLSPTILALLPNWAVYFTVYEQLKSLLSSNDGSQLSLGANVVAASCAGAATSIVTNPLWVVKTRFQTQGIRAGPILYKGTLAALRRIAHEEGIRGLYRGLVPALVGVSHVAIQFPAYEKIKAYLAERDNTTVEALSFGDVAVASSLAKVAASTMTYPHEVVRSRLQDQGAHSEARYKGVIDCIRKVYYKEGVAGYYRGCATNLFRTTPTAVITFTSFEMIHRFLLDLLPPAPEPHIQPLKH

SEQ ID NO: 22725 - DNA, 1541 bp, Panicum virgatum
  misc_feature: Ceres CLONE 1823256
  misc_feature: Encodes the peptide sequence at SEQ ID NO. 22726
gagtagtagttatgaaagacatggagatccatagtaagcatccgctcttgttcctgctgtgtgcttctgcaatagtagcgaagtccacccaactagaatcgcctcacagaaattcttattctccatcctacaatccacagccacaggacttccccagcgaacacctttaccatgcatacgttgtcatccagcgcttcaagaacaccatctcatgcgaccccaggaaaatcaccgccacctggattggccaggacatatgtggtgaggggagctaccgtggcttctactgtacaacgccatctaagaatggcgcaaaccttacggtcaccacaatcgatttcaacggttttggtctatgtgccccaaagctaaaaggcttcatcgaccagttccccgatcttgcgatcttccaggcaacctccaacaacttgagcggtgacattccccgacttagccccgacgtgtacagccttcaagtcaaagacgatctcaaaagctcgaaattggagcagtttgacgcgcggaagcattgtatttatggcagagtactcttcataatgggtaagttattttgtagtaataaggtcctccagaaggaggtagaagtctccgatgtcacggatgctaagggtcttctccttagcaacaacaaactgtctggtgcacttccggcagaccttggcttctccgagttcaactacctcgccatcgccaacaacaagatcaccggaccaatcccacagtcaatcgagcacctgcaagactccctcttcgagctcctcctcctcaacaaccagctctccggctgcctcccccgcgagctcggcatgctccacaaggcggccgtcatcgacgccggcatgaaccagctcaccggcccgatcccgtcatccttctcctgcctcagcagcgtcgagcagctcaacctcgccgggaaccgcctctacggcccggtgcccgacgtgctctgcaagctcgccgggcccgccggccgcctcgccaacctcacgctgtccggcaactacttcacctccgtcgggccggcgtgcgcggcgctgatcaaggacggcgtgctggacgtgaagaacaactgcatcccgggcctcgccgaccagaggcgcccggcggagtgcgcggcgttccagagccagcccaagacgtgcccggcggtgagcacccagcaggtggcgtgccccgccgcagctgccgcgggcgcggcggcgccgggggagaggaaggctagggactactccagctacgtgacctacgctactctgcatgagtgatgagcaacctcagctcggcatgcagtaggagacagatcgtctcggtggcgtttacttgttctttgtattattatgtagtaccccgtgtgtgtgttggtgtgattgtgattgttgtctattttctccgcacgtacgttgctgcccaggttgctgtcacacctagatctatctttgtatccatttgagtgaaaaattgttgttgttgttgtaaagttttatctgtcatggacgttcgatatattgcttaaatttcgt

SEQ ID NO: 22726 - protein, 421 aa, Panicum virgatum
  misc_feature: Ceres CLONE 1823256
  misc_feature: SWISSPROT Homolog: EC 2.7.11.1 Non-specific serine/threonine protein kinase
MEIHSKHPLLFLLCASAIVAKSTQLESPHRNSYSPSYNPQPQDFPSEHLYHAYVVIQRFKNTISCDPRKITATWIGQDICGEGSYRGFYCTTPSKNGANLTVTTIDFNGFGLCAPKLKGFIDQFPDLAIFQATSNNLSGDIPRLSPDVYSLQVKDDLKSSKLEQFDARKHCIYGRVLFIMGKLFCSNKVLQKEVEVSDVTDAKGLLLSNNKLSGALPADLGFSEFNYLAIANNKITGPIPQSIEHLQDSLFELLLLNNQLSGCLPRELGMLHKAAVIDAGMNQLTGPIPSSFSCLSSVEQLNLAGNRLYGPVPDVLCKLAGPAGRLANLTLSGNYFTSVGPACAALIKDGVLDVKNNCIPGLADQRRPAECAAFQSQPKTCPAVSTQQVACPAAAAAGAAAPGERKARDYSSYVTYATLHE

SEQ ID NO: 22727 - DNA, 729 bp, Panicum virgatum
  misc_feature: Ceres CLONE 1823297
  misc_feature: Encodes the peptide sequence at SEQ ID NO. 22728
acctccaccatcgtagtagcaaagctagcccacttttccttgacttgacccgcgcgcgcggcgtcagctcccgcctctccgccgagaagccggacggagctctttttttaaaggcagcagcccaaccaaacccttctccttcgagaggtcgccgaggagagctgcgcctgcgagggaggaggaggagcttcggaggggaagccatgctggaccatctcgtcgggcttgtgagggtgcgcgtgctcaggggggtgaacctcgccatccgcgacctccgatctagcgacccctacgtcgtcgtccgcatcggcaagcagaggctgaggacgaaggtggtcaagaagaacaccaacccggaatggaacgaggaactcaccctctcgattgaagaccctgcacatcctgtcagactggtatgcatgcatccccttccgtctcatttccccctttctttcctgaatccgttatcttgtttttttttctttttacccctactcctccttcgaactcttaagaaagaaattcagaaccatgcatgagtagcacaaggaattagtttactgctccaccttgcacacatgacatttttattataagttatacattattaccgggctttctcgatattttcagtttgtacttgtagttgtacgaagcattccatagccttctttgctatgtggtaaacaaaacatgtctctccagatatagtgatttcatatgctagct

SEQ ID NO: 22728 - protein, 111 aa, Panicum virgatum
  misc_feature: Ceres CLONE 1823297
  misc_feature (9)..(86): Pfam Name: C2 Pfam Description: C2 domain
MLDHLVGLVRVRVLRGVNLAIRDLRSSDPYVVVRIGKQRLRTKVVKKNTNPEWNEELTLSIEDPAHPVRLVCMHPLPSHFPLSFLNPLSCFFFFLPLLLLRTLKKEIQNHA

SEQ ID NO: 22729 - DNA, 697 bp, Panicum virgatum
  misc_feature: Ceres CLONE 1823300
  misc_feature: Encodes the peptide sequence at SEQ ID NO. 22730
aggcattcctactcccagcttctgccctcctctcttcgttctctctcgtctcctcttctcgatcgagcgctcgatctgcggccctgttgttgacctgcgaaacgccggcctgagacgtcgaagggggcgtggtgaccagcagatggatccatggatcagcagccagccttctctgagtcttgacctgcacgtcggcctgccgccgctcagccgccaccaggcgccggtcgccttggccaagcccaaggtgctcgtcgaggagaacttcctgcagcctctaaagaaagaaccagaggtcgcggccctcgagacggaactccagcggatgagccaggagaaccggcgcctggccgaggcgctcacggcggtggccgccaagtacgaggcgctgcggagccagtacacggagatggtcgccgcgggcgccgccaccaccaccggcccgtcctccgcgtcggagggcgggtcggtgtcgccgtcgcggaagcgcaagacgagcgagagcctggacaccgcggcggcggcgccgggcgcgcagcagcacccgcacggcctgcacggcgggcagcacccgggcgccgcggcgccgccggaccagatggagtgcacctccggcgagccgtgcaagcgcatccgggaggagtgcaagcccaaggtgtcgaagctgtacgtgcacgccgacccgtcggacctgagc

SEQ ID NO: 22730 - protein, 184 aa, Panicum virgatum
  misc_feature: Ceres CLONE 1823300
  misc_feature: The sequence is a functional homolog of SEQ ID NO 1200 in the 10/374,780 US patent application
  misc_feature: The sequence is a functional homolog of SEQ ID NO 1395 in the 10/412,699 US patent application
MDPWISSQPSLSLDLHVGLPPLSRHQAPVALAKPKVLVEENFLQPLKKEPEVAALETELQRMSQENRRLAEALTAVAAKYEALRSQYTEMVAAGAATTTGPSSASEGGSVSPSRKRKTSESLDTAAAAPGAQQHPHGLHGGQHPGAAAPPDQMECTSGEPCKRIREECKPKVSKLYVHADPSDL

SEQ ID NO: 22731 - DNA, 1676 bp, Panicum virgatum
  misc_feature: Ceres CLONE 1823310
  misc_feature: Encodes the peptide sequence at SEQ ID NO. 22732
accgtccctgccagcatcccacctcgaaccccgctcggtaaccaccgcgcaggcaggcaggcagacaggcaggcagccaccaccatgggagaagggaagaaggccgccgccaaggacggcgccgccggcggcgacaagaagaaggagaaggacgcaggggccgcgccggcggggccggggcccatcgtgctcaaggtcgacttgcattgcgccgggtgcgcgggcaaggtccgcaaggccatcaagcgcgccccaggggtggagaccgtgacggcggacatggcggcgggcaaggtggtcgtcaccggccccgcggacgccgcggagctcaaggagcgcatcgaggccagggccaagaagcccgttcagatcgtctccgccggcgccggcgcgcccaagaaggacaaggacaaggagaagaaggcggacggcggcggcgagaagaagccggacaaggagaagggcggcggcggcggcggagacaagaaggccgcccacgaagcccgctcgtcgccgtgcgccacttcctctgcggccggggcgcccctcctctcttcaagcctggtgccgccctccacgccggtggagaggaagaggccgtccccctcgcatcaccttcccccaactcgacgcgggctcgtcgcgcctccctcccgccactcgacgccggctccggcgcgagaccccacggcccgccggctccgagaccgcggcgcctccaagctccccaccgcccgacttggacagatccactgaggtgccgggtggatgcgccaccctctccgtaattccaatcgttgcacgcctcatctgtatcgtcctcgctccagctgctggcgccctcgacctcgaggggtacctctagcttcatcccagtttcgcaccagggtcaccttcgacacctccgatgtcaatgggccctcaccaacgaaatttaccttggtgcccacgaagccggcaaggatgcagaactaggctgtattgaaccaaaacaattgataaggaggttcctacactgttatcaaagaggtctccatactatgccatcgaatatgcaaaagtctattactaaatgtatgttgggacgtgccaatctgtgtgaccctgatgagatcagatgctcaccgaggtgtctttcctcctaaaatttggcaccaagatgcgcagaagaaggggaagatgaattagccaagcattttctcctgcagggaagcatgtggggccatggtggcagcattggccatggtggcagcattggcagttctgatgctgttgcaatttggtagggcaaaataagatagtaatattttattaataagagagatcaatttatgtgtaaataaataaataaatttatggcagtcacgcacacattgctttgttatgttttcctttctttacggataggatatttgaatctaggatacatgaagctgatgcgtgttttcaattgatctactgatagcgatagaagcaagcagcagagaagcatgctcggtccatgtagctaactgcatcaggacctgctaggtaggaggaatctcgatatattcttgtgtttgtaatactgtatgatcaagcaaacatgatttctttactttatatacttgcatagcatacttccattgtacgtgtatgaccctttcctaactcaggtatgctttttcatttgatcc

SEQ ID NO: 22732 - protein, 223 aa, Panicum virgatum
  misc_feature: Ceres CLONE 1823310
  misc_feature (34)..(96): Pfam Name: HMA Pfam Description: Heavy-metal-associated domain
MGEGKKAAAKDGAAGGDKKKEKDAGAAPAGPGPIVLKVDLHCAGCAGKVRKAIKRAPGVETVTADMAAGKVVVTGPADAAELKERIEARAKKPVQIVSAGAGAPKKDKDKEKKADGGGEKKPDKEKGGGGGGDKKAAHEARSSPCATSSAAGAPLLSSSLVPPSTPVERKRPSPSHHLPPTRRGLVAPPSRHSTPAPARDPTARRLRDRGASKLPTARLGQIH

SEQ ID NO: 22733 - DNA, 1507 bp, Panicum virgatum
  misc_feature: Ceres CLONE 1823329
  misc_feature: Encodes the peptide sequence at SEQ ID NO. 22734
gcttcctctccacagactactctcgcgcacgccaccggccaccgccgaccagcgccgcccaagccgcctccgttcgcctggccgggccgccggggccgagcgcgcccgtccagcttccactggtgcttagccgcctcgaattccaatctaccagtagtagcctccctccccctccgctctatcgcgatggcgtcgagtggggatgcgcccggatctaccgatgagaagaaagccccaaaacccgaaggatcatccatcgagcgccaaggggttcctccagcaggcttttcgaatcctttcgactttgcttctatgcaaaatttgctcaatgatccatctattaaggagatggcagatcaaattgcaaaggatcctgcattcaaccagatggctgagcagctacagaaaagtgctcagagtacaggagaacagggaatgcctccattggaccctcaacagtacatggaaacaatgcaaaaggtcatggaaaacccccagtttatgacaatggctgagcgtctggggaatgctcttatgcaggatcctgctatgtccagtatgctggaaacctttagtagtccatcacacaaggagcagctggaagagcgtatgtcccgcattaaggaagatccagctttgaaatcaattatagatgagttagagaatggggatcctgctgcaatgatgaagtactggaacgaccctgatactcttcaaaagattggccaggcaatgggaggtagcttcccatttggtgctggttcttctgctgaaccttctggtgctgaagaaactggggaaggtggagatgaagatgaatccatcgtccatcacacagccagtgttggtgatgacgagggtctgaagaaggcactggatggtggagcagacaaggatgaagaagactccgagggaagaagagccttacattttgcatgtggatatggggagttgaagtgtgcccaagtccttcttgaggccggtgcagcagtggatgctttggataagaacaagaacaccccgctgcattacgctgctggctatgggcgcaaggagtgcgtcgatcttctcttgaagcatggtgctgccgtcacgctccaaaacctggatgggaagacgcccatcgacgttgccaagctcaacaaccaggatgaggtcctcaagttgctcgagaaggacgccttcctttaaatcccatggctctcatagacacatagacagttggttccagtatggtcatgtttcacatctgttgactttgctttgctcggatggtcaatactcgtatcagcatttatctgttctgtaagatttgctatctggtctagctggctcttagcctgctgcaattcgtgatacagtgaagggggcagctattagaactactgccctgttatgttgtcacggtggcttgtgtacccctttctttatttccgttgttttcacgattgaaatcgggattgttaatattactctgttatatatgtttcatgccgacattgaagct

SEQ ID NO: 22734 - protein, 334 aa, Panicum virgatum
  misc_feature: Ceres CLONE 1823329
  misc_feature (275)..(307): Pfam Name: Ank Pfam Description: Ankyrin repeat
  misc_feature (242)..(274): Pfam Name: Ank Pfam Description: Ankyrin repeat
  misc_feature: SWISSPROT Homolog: EC 2.4.2.30 NAD(+) ADP-ribosyltransferase
  misc_feature: The sequence is a functional homolog of SEQ ID NO 1839 in the 10/374,780 US patent application
MASSGDAPGSTDEKKAPKPEGSSIERQGVPPAGFSNPFDFASMQNLLNDPSIKEMADQIAKDPAFNQMAEQLQKSAQSTGEQGMPPLDPQQYMETMQKVMENPQFMTMAERLGNALMQDPAMSSMLETFSSPSHKEQLEERMSRIKEDPALKSIIDELENGDPAAMMKYWNDPDTLQKIGQAMGGSFPFGAGSSAEPSGAEETGEGGDEDESIVHHTASVGDDEGLKKALDGGADKDEEDSEGRRALHFACGYGELKCAQVLLEAGAAVDALDKNKNTPLHYAAGYGRKECVDLLLKHGAAVTLQNLDGKTPIDVAKLNNQDEVLKLLEKDAFL

SEQ ID NO: 22735 - DNA, 352 bp, Panicum virgatum
  misc_feature: Ceres CLONE 1823338
  misc_feature: Encodes the peptide sequence at SEQ ID NO. 22736
agtctccttttgtcccctctgagacaccttccagcccactgccgccatggacccaggcgtaaccgtggagaacctcatcccccaagccttaacatgtgaatgtgcagaacctgaggaaattgtcattcctgctctccactaacagcgaaaccaaccttgtctgcccctctttcttcccctccatgagatcctcaaatgcaaccttaggaatcttaggtctcttgatacatctaccactgatattcttcatggatgctcttgctctttgggatcatccatccttgttggaattagatgatactaactcattgttcagccctctttctattcctcaagaaaagcggattctttc

SEQ ID NO: 22736 - protein, 56 aa, Panicum virgatum
  misc_feature: Ceres CLONE 1823338
  misc_feature: SWISSPROT Homolog: EC 2.6.1.2 Alanine transaminase
MRSSNATLGILGLLIHLPLIFFMDALALWDHPSLLELDDTNSLFSPLSIPQEKRIL

SEQ ID NO: 22737 - DNA, 570 bp, Panicum virgatum
  misc_feature: Ceres CLONE 1823349-R
  misc_feature: Encodes the peptide sequence at SEQ ID NO. 22738
agaaatagtcatctagtgtatctatctgcggtaacacgctctcttttgagttctgacacagattatgaagaacatgggtgaaatattaaaagcaagtggcgctagctatgcttcagtggtgaagacaacaatcatgttggctgatctgcaggatttcaagaaagtgaacgagatctatggcaaatacttcccagctcctgcacctgctcgctcaacctatcaagtggcagcgctgcctctaaacgccaggattgagatcgagtgcatcgccgctctctgagcatatcattcgaccagccatcgaaccatcaataagcattccaaccctgtcgatgtagttgttctctttcctgggatgcactactcttaggaatttatggtacaagtgcttagtgtcgcccatgagagatctttgtaccaattcagatcttgaaaaactggctacaataaacgttggataagtggtgtagtggcttcggtcacctcgctttccgtgtgatccatgctaatgttttttctaatgatcctgctgttcaaaagataaggttctgtttttttccctgtacgacc

SEQ ID NO: 22738 - protein, 71 aa, Panicum virgatum
  misc_feature: Ceres CLONE 1823349-R
  misc_feature (1)..(71): Pfam Name: Ribonuc_L-PSP Pfam Description: Endoribonuclease L-PSP
MKNMGEILKASGASYASVVKTTIMLADLQDFKKVNEIYGKYFPAPAPARSTYQVAALPLNARIEIECIAAL

SEQ ID NO: 22739 - DNA, 1014 bp, Panicum virgatum
  misc_feature: Ceres CLONE 1823349
acccagactctcgcctcgccccgtgctcgctcgcggttggtggtagtagtagggttctaggcttctagccatggcgtggagcgccgccgccgtctccaggttcgccgccgcctccccggccgcggcgcccgtccgcgccgccgcctcctcgctctccttcgccggggcgcgcggccgccgcttcggccccgtcgccgcgtccctctcgacctccgcgaccggtacgcttccggcttgcccccgccgtccctctctcccctataccggagtcctcctcggaggctcgcaggtttggtgttaatgtcgcctatagacgcgcggattgctcgtggtttttttggtttcctcttcgcgtagggaaatatatgatttgtaatgcgaatttggtcgaaatgctgccgcagtttgactgcagaggctgctaatcgatggctgtaaacagcaacataagcacacaaacacgcgatgttaaatgctggttagcattttctctcggtataaaaaaaaaggataaaaccgaagtgcaatcttagtcatcgtttgccaacaaaaaagctataggttgctgattcggctggatggtcagtgcgtctgacagcagcagtagccaataggcatagataaataattttattttctaacaggaaaggaaaaacagagaggtgtgctttctgttatcaagaggtttagaggattgctgagcgctgagagcaaaccacaaaaatatgtttattggcttcgtattggtcaggaacttgggatatacatggctctatgtcagaaaaattaccgtcactaaatgcaatgaagttttcattgtgccactgaaaatatttgtaatcccttatgtgtcatcgagaaccatgaaatttcacagtggcatagaggaaattcacctgaaatatctttactcagtcaaataaatgcagttaagcaagcaaaaaagtcactcacctgtcatttttgaaattttttttggacatttcacatgctatagtgacaatcccccccccc

SEQ ID NO: 22740 - DNA, 2327 bp, Panicum virgatum
  misc_feature: Ceres CLONE 1823370
  misc_feature: Encodes the peptide sequence at SEQ ID NO. 22741
gcctcgcccaccagtccaccaccgaccgtggggaggaggagcgcgccgcgagcccgcgacacaggcgcatctcgtctcccgccgccgccacttgtcgttcgtccccaccaaccccaggttcggctcggttccgtgcccgcgcgcaggtgctgcatcgcggcacggggggcggggccgtgccgtgccgtgccgtgccggggttttggtgtgggagaagggaggggaggggagcgggtggtatgctctgcgggctgcggcggcttgatcctgtgaagaaggccgaaaaagcgggcgtccccgatgcaacggctactgggggtcggcgagaggcttttggcaattggaacaaatagacgggcagccagttattcccatccgagccacagaagtgggtactacacagcggcgagggacaatggcttgtcaacaaagcgaaagattccagctgtcttctcgaggatgttctcacattacaaagtcattgtcagaaagaacagagctgaggatcataagtgcagaatcaggatgtccagaggataccgcacattctctgtggcagtggccaattcatcagcaacccagcaagcacaactggcatggaagcggctcagtcatatgtactcgtatagcggtccacggttcccgctgatgagccgagcagcctgtgctattagcctgtcctttacgaggttccatatcatccctggggtcatggctctagcttttggcaagatggcacttgcaccaccagtcctggcagactcaccatccttcatgccgagaatggatggcatcatcacaaaggcacaagatactcgccaatttctgtcatctcttgtttggtcaatctgggagggcatcactttgcttataagagcagtgcatttgactttcctattcttccctgcaactgcattagctccatttgctgacaagttcagtgttgcgttcagaagaaggtggcttagccttgtgcgccgcaccctcgaaaaggccgggccagcgttcattaagtggggccagtgggctgcaacacgccctgatctttttccaagtgatctctgtgttgagcttgcaaaacttcacagtgcagctccagcgcatggctttgcttacagcaaagctgccattgagaaggcattcagtcgtgagctttctgaaatatttgagtcctttgaggagaaccctgttgcttctggaagcattgcacaaatacatcgggctacactgaaaaatcaacatcctagaaagcatgttgcagttaaggtgaggcatcctggtgttggagaatctatcaagagagactttctactcatcaatcttgtggccaaggcttctaatatcgtccctggattgagctggctgaggctggatgagagtgttcgccagtttgcagtattcatgatgtctcaagttgatctttctagggaagctgctcatttgagtcgttttatctacaacttccgcagatggagacacgtgtctttcccgaagcccttgtatccacttgtgcatccatctgtcctagttgagacttttgaaaatggagaaagtgtctctcgttttatggatgaaatcgaagggaatgctcggatgaagaaagaccttgcgcacattgggacatatgcttttctgaagatgcttctggaggacaattttattcatgcggatatgcaccctggaaacattcttgttcgtttaaatgataacaagctttcgaggagacgatttttcagagccaagccccatattgtgtttcttgatgtaggcatgactgctgagctcacacgatctgaccgggataacttgcaacagttcttcaaggcagtagctactagagatgatcttactgctgctaagtgtacccttcagttgtcgaagaatcagagctgtccaaatccagtggcgttcactgaggaactggacaagacgtttacattctggggaactcctgaaggggatgtctttcatcctgttgaatgcatgcatcaactgcttgatacagttcgccgccacagagtcaacattgatggcaacatctgtactgtcatggttaccattttgctcctcgaggggtggcaacgcaagctggacccaggctttgatatcatgcacacattgaagactttattactagagaaggatgtcaagcaaccgattgactttttctcgtaaacaaacagtatcaggtaatcttgattcttgtaattgagtcttttgttttcgttctattttttgtctaagaaatttatagagcaattattgcacccaaggaacagatttgtagcaacaaccctgttgcaccagcatgaaaatagatttgtagc

SEQ ID NO: 22741 - protein, 624 aa, Panicum virgatum
  misc_feature: Ceres CLONE 1823370
  misc_feature (279)..(400): Pfam Name: ABC1 Pfam Description: ABC1 family
MQRLLGVGERLLAIGTNRRAASYSHPSHRSGYYTAARDNGLSTKRKIPAVFSRMFSHYKVIVRKNRAEDHKCRIRMSRGYRTFSVAVANSSATQQAQLAWKRLSHMYSYSGPRFPLMSRAACAISLSFTRFHIIPGVMALAFGKMALAPPVLADSPSFMPRMDGIITKAQDTRQFLSSLVWSIWEGITLLIRAVHLTFLFFPATALAPFADKFSVAFRRRWLSLVRRTLEKAGPAFIKWGQWAATRPDLFPSDLCVELAKLHSAAPAHGFAYSKAAIEKAFSRELSEIFESFEENPVASGSIAQIHRATLKNQHPRKHVAVKVRHPGVGESIKRDFLLINLVAKASNIVPGLSWLRLDESVRQFAVFMMSQVDLSREAAHLSRFIYNFRRWRHVSFPKPLYPLVHPSVLVETFENGESVSRFMDEIEGNARMKKDLAHIGTYAFLKMLLEDNFIHADMHPGNILVRLNDNKLSRRRFFRAKPHIVFLDVGMTAELTRSDRDNLQQFFKAVATRDDLTAAKCTLQLSKNQSCPNPVAFTEELDKTFTFWGTPEGDVFHPVECMHQLLDTVRRHRVNIDGNICTVMVTILLLEGWQRKLDPGFDIMHTLKTLLLEKDVKQPIDFFS

SEQ ID NO: 22742 - DNA, 619 bp, Panicum virgatum
  misc_feature: Ceres CLONE 1823395
  misc_feature: Encodes the peptide sequence at SEQ ID NO. 22743
atagagatagagcaccagactgaccagacagtcatctcctagcaccttgttggagcagagctcgtgggggcacgctcatggagggatccatttccagttccccaagcacaaggattgctgtggtcaccggtggtaacaaagggatcgggctagaggtgtgccggcagctggctgggaatggtgtcaccgtcgtcttaacggctagggacgaggccccccccgtgtcgctgctcttggcgactcgcagggcgaaacccggcgccgccgtccagccccgcctcgagccacctccggtggccgccgccgtcgccgacgtccgtctgggcggcggcggcggcccgcggctgtgctgaagccggccagctcgctccccctccctctctcttccctccgcactcctcccccgagctccaaaccgaggtcgcgatggctgccggcggtcggccgtcgaggccggatccggcttcccccacaccggatctgatgttccccggtgtggatctagcggtctccggcgggggtcgctggtgggcccgcaccgctgctcctccttgccggggggtccctggcgggttcccgccgccgccgcctatctctccgtctcccgcgtgggcggccc

SEQ ID NO: 22743 - protein, 91 aa, Panicum virgatum
  misc_feature: Ceres CLONE 1823395
  misc_feature: SWISSPROT Homolog: EC 1.1.1.184 Carbonyl reductase (NADPH)
MEGSISSSPSTRIAVVTGGNKGIGLEVCRQLAGNGVTVVLTARDEAPPVSLLLATRRAKPGAAVQPRLEPPPVAAAVADVRLGGGGGPRLC

SEQ ID NO: 22744 - DNA, 674 bp, Panicum virgatum
  misc_feature: Ceres CLONE 1823434
  misc_feature: Encodes the peptide sequence at SEQ ID NO. 22745
atatatccatcacaacgtgtgatcaccgtcagcatctgccgtactacgccatttcctgagcgctctcctttcgctcgagcttgcagtgaaggtcacagagatggagggcgctatccccaatccccccaacgcaaggattgcggtggtcaccggcgggaacaaagggatcgggctggaggtgtgccggcagctcgccggcgccggcgtcaccgtcgtcttgacggccagggacgagacgaggggcgcagccgccgtggagaagctcagagaagcagggctctccgatgtcatgttccatcagctggacatcaccgacgctccgagcatcgctcggttggctgatttcttgaaggctcgtttcgggaagcttgacatcctgataaataatgctgcaatcgttggtgttgagtacctcctagatcctttggatagttcaccgaccagcgaggaaaagttcagtggcatggataagcgtcagaggattgagtggctgaccagtgttgtccgggggacctacgacgctgccagagaaggcttgcagacaaactactacggtaccaagcatgttatcgaagccttactgccgctgctgcaagcctcatccgatgggagaatcgttaatgtctcatccgaatgggggctgctaaggctaatcaacaatgaggagctgaagc

SEQ ID NO: 22745 - protein, 191 aa, Panicum virgatum
  misc_feature: Ceres CLONE 1823434
  misc_feature (12)..(190): Pfam Name: adh_short Pfam Description: short chain dehydrogenase
  misc_feature: SWISSPROT Homolog: EC 1.1.1.184 Carbonyl reductase (NADPH)
MEGAIPNPPNARIAVVTGGNKGIGLEVCRQLAGAGVTVVLTARDETRGAAAVEKLREAGLSDVMFHQLDITDAPSIARLADFLKARFGKLDILINNAAIVGVEYLLDPLDSSPTSEEKFSGMDKRQRIEWLTSVVRGTYDAAREGLQTNYYGTKHVIEALLPLLQASSDGRIVNVSSEWGLLRLINNEELK

SEQ ID NO: 22746 - DNA, 736 bp, Panicum virgatum
  misc_feature: Ceres CLONE 1823435
  misc_feature: Encodes the peptide sequence at SEQ ID NO. 22747
aaaaagtcccctccacgggccgccgcgccgagcgagcagcgagccgccaccgccgcacgacgggatggcgtcgacgccggagccggaggacgggagggagctctacgcgctgctccacctctcgccggacgcctccgacgaggaaatccgcagggcgtatcgccagttcgcgcaaatctaccaccccgacaagtaccaggacccccagatgaaggaagtagcaactgaaaatttccaacgaatacgcgatgcatatgagatactatctgatgagaacaaaagacagatttatgacatctatggtatggaaggtttaaattctggcctggaacttggtcccaaactaactaaaccagaggaaattagagaacagttggaacgactgcggcggcgcaaggaggaagaaaaatttctcgttcatgctcgacccaatggctcaatcattgctaatttctcggtgccacaatatttagacggtgatggcatcatgaaaggaatgggaatgtctagtgaagttgagttgccagtgtccaagcaaaatactgtcattgttggcgggaatctggttgtcaatggctcagctggaactggagcagcaagcactgtgctgcggcaccagttatcttctgtttcccatattgattttatggcaacagctggactacgctctgttattggcatgcagacatttcgtcaaatttcaccacattctacagcaacttctggatttgctgtt

SEQ ID NO: 22747 - protein, 223 aa, Panicum virgatum
  misc_feature: Ceres CLONE 1823435
  misc_feature (12)..(77): Pfam Name: DnaJ Pfam Description: DnaJ domain
MASTPEPEDGRELYALLHLSPDASDEEIRRAYRQFAQIYHPDKYQDPQMKEVATENFQRIRDAYEILSDENKRQIYDIYGMEGLNSGLELGPKLTKPEEIREQLERLRRRKEEEKFLVHARPNGSIIANFSVPQYLDGDGIMKGMGMSSEVELPVSKQNTVIVGGNLVVNGSAGTGAASTVLRHQLSSVSHIDFMATAGLRSVIGMQTFRQISPHSTATSGFA

SEQ ID NO: 22748 - DNA, 1148 bp, Panicum virgatum
  misc_feature: Ceres CLONE 1823469
  misc_feature: Encodes the peptide sequence at SEQ ID NO. 22749
acctacccccctcctccagttccgatctacttccgcttctcctgagcacacagcacaaacagagcagagggcgctgatggcgatggcggcggcgctgcgggtggcggccgcggacgcggtggtgacgttcctgtgggtgctgtgcgtctccacgctgggggcctcgacggcggcggtgacgtcctacctgaagctgcagggggtccagtacgcgctgctggtcaccgtctccctcctctccgccctgctcttcgtcttcaacatcctctgcgacctcctcggcggcgccagcttcaaccccaccggcgtcgcggccttctacgccgccggagtcaccagcccctccctcttcgccgtcgcgctccggttccctgcgcaggccgccggcgctgtgggcggcgctcttgccatctcggagctgatgccggcgcagtacaagcacatgctcggggggccctcgctcaaggtggatccccacaccggcgcagtcgccgaattagtgctcactttcgtcatcaccatggctgtgctctggatcatcgtcaagggcccccgcaaccccatcatcaagacatggatgctctccatctccaccgtttgcctcgtcctctccggggcagcctacactggcccgtccatgaatcccgccaatgcatttggttgggcatatgtcaacaatcgccacaacacttgggagcagttctatgtgtactggatatgcccctttattggtgccgtccttgctgcatggatcttcagggctttgttcctggcaccgccacctaagcccaaggccaagaaagcatgatgaatatcacttggtcatggtctcgtggatgccagatctggagaaaccaacattagttgctagaaatagaggaaccgaaagaattagttcctcgtgtattcagttacctcagtttcctagaatgttggtttaaattgattgatgtggtaaccacgttgctcgtgccattgataattttattgtaaggtgccctttgtgatgcaacggcattgcctgtttgttgctacaacagtgatatgaatagagggataaaagtatgtaagagcaactccagcaatagtccctaaattagacccttcaaatgctaaatgggggttgcctctattttttaggggctttc

SEQ ID NO: 22749 - protein, 243 aa, Panicum virgatum
  misc_feature: Ceres CLONE 1823469
  misc_feature (1)..(227): Pfam Name: MIP Pfam Description: Major intrinsic protein
MAMAAALRVAAADAVVTFLWVLCVSTLGASTAAVTSYLKLQGVQYALLVTVSLLSALLFVFNILCDLLGGASFNPTGVAAFYAAGVTSPSLFAVALRFPAQAAGAVGGALAISELMPAQYKHMLGGPSLKVDPHTGAVAELVLTFVITMAVLWIIVKGPRNPIIKTWMLSISTVCLVLSGAAYTGPSMNPANAFGWAYVNNRHNTWEQFYVYWICPFIGAVLAAWIFRALFLAPPPKPKAKKA

SEQ ID NO: 22750 - DNA, 1074 bp, Panicum virgatum
  misc_feature: Ceres CLONE 1823475
  misc_feature: Encodes the peptide sequence at SEQ ID NO. 22751
taaaaaccctcgctgctccccccgccttgctcaccaagatgctccgccgcgccgcccccaccgcggccgccatctgccgccgggcggcctccacctcggcgtccccttcctcaaccgcggcggccacggcggcggcctcctcctccgccgtgaactccatcctcctccgctcgctcaaggagcactacctcgaggtctccaagatggcgccgccgcccaagaccagcccgcccaagcccttcaccatcgtcaagggctccctggaccaggcatcgggccccgtgctgcgccgcgagtacggcgactcgggggaggagatctccatctccgtcgcaaggctcgccaacatcctgccccccgacgccgacgccgactccgactccgacgccgccggcggggacggcggtatgaccgcttccatcagccagctcttactccacgtcgacatctccaagcccggggcaggcaagtcgctgcagttcctttgcgggctgtacccggacgccgttgggatccattcggtctgcctcaggtcgaaggacgccgagtcgtgggaaggaaacatggcttcaaagggtggtgaagagtaccgggggcgcatcttccaagagttggatgagaaagttcgggatgcactccatcattacattgaagcccgtgggataaatgagaagctcttcccttttctacaagcttggctttatgtaaaggaccaccgcaacctcatacgctggttcaagagtgtgggcacattcatcagtgagccaaagccatagtaagatgtcaagcactccatgttgaatatcatctgaaatgcggatgcaattgccaggatggagaatagtgctaggataaagtgaacaattgcatagtagtgccaacgaggagttttttttttgcttcttttcagttcttgttccccatggggattagaggatgaggatgccacttgcgtgcttaacgtgttggggtggtggttgcttgagttgtcattattccttggctttgctgcccaatcctgctgaggtggttgtcagattctcaatcattcaagctccacacttggaccaccgg

SEQ ID NO: 22751 - protein, 245 aa, Panicum virgatum
  misc_feature: Ceres CLONE 1823475
  misc_feature (42)..(240): Pfam Name: MAM33 Pfam Description: Mitochondrial glycoprotein
MLRRAAPTAAAICRRAASTSASPSSTAAATAAASSSAVNSILLRSLKEHYLEVSKMAPPPKTSPPKPFTIVKGSLDQASGPVLRREYGDSGEEISISVARLANILPPDADADSDSDAAGGDGGMTASISQLLLHVDISKPGAGKSLQFLCGLYPDAVGIHSVCLRSKDAESWEGNMASKGGEEYRGRIFQELDEKVRDALHHYIEARGINEKLFPFLQAWLYVKDHRNLIRWFKSVGTFISEPKP

SEQ ID NO: 22752 - DNA, 1328 bp, Panicum virgatum
  misc_feature: Ceres CLONE 1823484
  misc_feature: Encodes the peptide sequence at SEQ ID NO. 22753
aggaaggatcctaccaaacctaccaactcctcctccatcgatcgcccgcgcaaaggggaaacctaaaaactaactctcgccattcgccaactagctagctttctctctccgcttcggcgccgctgcggctccaccgcgttcgagcgagaggtttcgtgaagaaaccagatagtagcgtcgaggaactgatcgtcgatcgtgaagacgatgaccgtggtcgacgccgtgtccgcgggcgccggcgacgccgccgccgcggtgccgcagccggcggggaacgggcagaccgtgtgcgtcaccggcgcggccgggtacatcgcgtcgtggctcgtcaagctgctgcttgagaaggggtacactgtcaagggcaccgtcaggaacccagatgacccgaagaacgcgcacctcaaggcgctggacggcgccgccgagcggctcatcctctgcaaggccggcacggtgcggcgggtggtgttcacgtcctccatcggcgccgtgaccatggaccccaaccgcggggccgacgtggtggtcgacgagtcctgctggagcgacctcgacttctgcaagaaaaccaggaactggtactgctacggcaaggcggtggcggagcaggcggcgtgggaggcggcgcggcagcgcggcgtggacctggtggtggtgaacccggtgctggtggtgggcccgctgctgcagccgacggtgaacgccagcatcgcgcacatcctcaagtacctggacggctccgcccgcaccttcgccaacgccgtgcaggcctacgtcgacgtccgcgacgtcgccgccgcgcacctccgcgtcttccagagccccgccgcctccggccgccacctctgcgccgagcgcgtcctccaccgcgaggacgtcgtccgcatcctcgccaagctcttccccgagtaccccgtccccaccaggtgctccgacgaggtgaacccgcggaagcaggcgtacaagtttacgaaccagaagctccgggacctggggctggagttccggccggtgagccagtcgctgtacgacacggtgaagagcctccaggagaagggccacctgccggtgctcgccgacgagcaggcgccggaggccgcccccggcgccgaggcgcagcagggcgggatcgccatccgtgcgtgaggtccaggccgatggcgccacgaatgaacagaatgcaagcgatgttcatatactgcccctgatgtgtaacccaagtagtatttgttgcctgtctgatgtccctagcaagacttgaaacgtcgtgctcgtccttgtgaactacatggtgggtgaataaatatggttaatgttcgttc

SEQ ID NO: 22753 - protein, 314 aa, Panicum virgatum
  misc_feature: Ceres CLONE 1823484
  misc_feature (28)..(217): Pfam Name: Epimerase Pfam Description: NAD dependent epimerase/dehydratase family
  misc_feature: SWISSPROT Homolog: EC 1.1.1.219 Dihydrokaempferol 4-reductase
  misc_feature: Useful for making plants with altered carbohydrate content
  misc_feature: Useful for making plants with altered cell wall content and/or composition
  misc_feature: Useful for making plants with altered lignin content
MTVVDAVSAGAGDAAAAVPQPAGNGQTVCVTGAAGYIASWLVKLLLEKGYTVKGTVRNPDDPKNAHLKALDGAAERLILCKAGTVRRVVFTSSIGAVTMDPNRGADVVVDESCWSDLDFCKKTRNWYCYGKAVAEQAAWEAARQRGVDLVVVNPVLVVGPLLQPTVNASIAHILKYLDGSARTFANAVQAYVDVRDVAAAHLRVFQSPAASGRHLCAERVLHREDVVRILAKLFPEYPVPTRCSDEVNPRKQAYKFTNQKLRDLGLEFRPVSQSLYDTVKSLQEKGHLPVLADEQAPEAAPGAEAQQGGIAIRA

SEQ ID NO: 22754 - DNA, 632 bp, Panicum virgatum
  misc_feature: Ceres CLONE 1823485
  misc_feature: Encodes the peptide sequence at SEQ ID NO. 22755
gagtggaagcgccctgcctaaggaagaaacgacagagaaaggaggagagagaggaggagcggtggagggcgagcaagatgacagacatcatcagcatccacatcggccaggccgggatccaggtccgccacggctgctgggagctcgattgcctcgagcaccgcctcgagcccgatggcaccatgcccagcgatacctcggctggcgacgcacatgatgccttcaacaccttcttcagcgagaccggctctggcaagcatgtgccgagggccatctttgtccaccttgagcccactgtcatcgaggaggtgcgcactggctcgtaccgccagctctttcacccggagcagctaatctccgggaaggaggatgcggctaacaactttgcccgtggccactacacggctgggaaggagattgccgatctgtgcctcgaccgagtgcgcaagctagcacacaattgcactgcgctgcagggatttttggtgttcaatgctgttggtggcggtactggctctggacttggttcactgctgttggagcgcctctcggttgattatggggagaagtccaagctcggcttcaccatttatccttccccacaggtgtccacagctgctgtagagccatac

SEQ ID NO: 22755 - protein, 184 aa, Panicum virgatum
  misc_feature: Ceres CLONE 1823485
  misc_feature (49)..(184): Pfam Name: Tubulin Pfam Description: Tubulin/FtsZ family, GTPase domain
  misc_feature: Useful for making plants with altered cell wall content and/or composition
MTDIISIHIGQAGIQVRHGCWELDCLEHRLEPDGTMPSDTSAGDAHDAFNTFFSETGSGKHVPRAIFVHLEPTVIEEVRTGSYRQLFHPEQLISGKEDAANNFARGHYTAGKEIADLCLDRVRKLAHNCTALQGFLVFNAVGGGTGSGLGSLLLERLSVDYGEKSKLGFTIYPSPQVSTAAVEP

SEQ ID NO: 22756 - DNA, 1213 bp, Panicum virgatum
  misc_feature: Ceres CLONE 1823513
  misc_feature: Encodes the peptide sequence at SEQ ID NO. 22757
gctgctctgttttattattgccgctcccatcccgccatgtcctctgcctctctctcatctcgagcctcctcttcctcagcctccgacgacgctgttagctgagagctagggaggcctggtctccgccggccagccagtcatgctggtgcgctgcgcctgcgaccgccgcgtccaccgcgccaacaagctcgccgacaagcaccgccgcatcccgctcacccacccctccgccgacgactccgccgccgccgcgccgctctgcgacgtctgcaaggagcggaggggcctggtgttctgcgtggaggaccgcgccatcctgtgcaccgactgcgacgaccccatccacagcgccaacgacctcaccgccaagcacagccgcttcctcctcgtcggggcgaagctctccgccgggctcgtcgaccaggcgcccccctcccctgatgacggctgccggggcagcggctctgacaagccacacgacgtcgccgccatctgcgcgccgcaggcgcagggctcctgcacggccaagagcttggctcctgattgcagcaacatctacggcggcggcagcagcatctccgactacctcaccaacatctgccccggctggcgcgtcgacgacctcctcttcgacgacgccgcgttctccgccgcctcggagaccaggtgcgacgagcacgagcaggtcccgtccctggacgccgacctcttcgacgtgattgccggccggccggggaagcgcggcgtgctgggcctcgacaaggtgcctgctgctgctgctgcctccattgcggtcccgacggcggccaagcagcaggggcgcgtgagggagaggcactggaactgcgacagcgacagcgacgtgttcgcagtgccggagatctcgcagccgccgccggccaagaaggcgcggccgccggcgccgactttctggtgcttctgatcgagctgcaccattccggccgccgtgctagctcgatcgcgtgggcacttcttcgttactactgtgtacccatgtgtgtgagcttgctgttactgtgctgtttacctcgtacttaccactactagcagtgcaccatcccagtcaaactcggtgcagtttatggccatgagagatatcgttatcgtactataaaaacttgtaattgtcatgtgtgcaacctagctagctacttggtcatgtcacaattaattgaatgtgttgatgatcgcg

SEQ ID NO: 22757 - protein, 267 aa, Panicum virgatum
  misc_feature: Ceres CLONE 1823513
  misc_feature (36)..(83): Pfam Name: zf-B_box Pfam Description: B-box zinc finger
  misc_feature: The sequence is a functional homolog of SEQ ID NO 1024 in the 10/666,642 US patent application
  misc_feature: The sequence is a functional homolog of SEQ ID NO 1646 in the 10/374,780 US patent application
  misc_feature: The sequence is a functional homolog of SEQ ID NO 1672 in the 10/412,699 US patent application
MLVRCACDRRVHRANKLADKHRRIPLTHPSADDSAAAAPLCDVCKERRGLVFCVEDRAILCTDCDDPIHSANDLTAKHSRFLLVGAKLSAGLVDQAPPSPDDGCRGSGSDKPHDVAAICAPQAQGSCTAKSLAPDCSNIYGGGSSISDYLTNICPGWRVDDLLFDDAAFSAASETRCDEHEQVPSLDADLFDVIAGRPGKRGVLGLDKVPAAAAASIAVPTAAKQQGRVRERHWNCDSDSDVFAVPEISQPPPAKKARPPAPTFWCF

SEQ ID NO: 22758 - DNA, 1283 bp, Panicum virgatum
  misc_feature: Ceres CLONE 1823514
  misc_feature: Encodes the peptide sequence at SEQ ID NO. 22759
cgagccgccgagagcccgagacatcgatggcactgtccaccctaatcagcgccctcttcgccgccgccgtctggtgcgccgcctacctcgccgccgccatctcctccgcgttctaacccgccgcccctcgcccagctccccgctcctattctgcaccctcgcctcctgctctcgaaaccctactccaaactcccccctccgctccgccgcactcgcgccgccatggggtacgcgcagctcgtcatcggccccgccgggagcggcaagtcaacttattgctccagtttgtacgaccattgccagaccgtgggcaggtcaattcatatagtcaatctggatcctgctgcagagcatttcaactatcccgtagatatggatatcagggagctgatttcgttggatgatgttatggaggattttggaatgggaccaaatggtggccttatctactgcatggagcatcttgaagatagtttggatgattggttggatgaacagctagagaactatttggatgatgactatcttgtgtttgattgccctggccagattgaactattcactcatgttccagttctgcgcaactttgtcgaacatctgaaacggaaaaatttcaatgtttgtgctgtgtaccttcttgattcgcagtttgtcagtgatgtaaccaaatacatcagtggttgcatggcttctctttctgctatgattcagcttgaacttcctcatgtcaacatcctttcaaagatggatctggtctccaacaaaaaagatattgaagagtatctagacccgaatgcgcaggttcttctgtcacagttgaatcgacagatggcaccccggtttggcaagttgaacaagtctttggctgaactggttgatgattacaacatggttaatttcataccacttgacttgagaaaggagagcagcatacaatatgtgctatcctacatcgactcctgcatccagtacggggaagatgctgacgtgaaggttagggacttcgatcctcctgaggacgacgactagctatttgatgcttttgaaactgcaaacgactaggtggtcgtgtcttctgtcttgtggtgaacccttggtttctgagtaggcgttcatgtggtgtctacttgatctctgtagatgaaacaatgcgaactcctgtacgttatatatacctgattctgcttgtatgcctgacaactagttgctgcttgcaagaaaatcccattctggagttgttggaacaccagaagtgaaaactacctcactgaggctgtttttgt

SEQ ID NO: 22759 - protein, 268 aa, Panicum virgatum
  misc_feature: Ceres CLONE 1823514
  misc_feature (7)..(250): Pfam Name: ATP_bind_1 Pfam Description: Conserved hypothetical ATP binding protein
MGYAQLVIGPAGSGKSTYCSSLYDHCQTVGRSIHIVNLDPAAEHFNYPVDMDIRELISLDDVMEDFGMGPNGGLIYCMEHLEDSLDDWLDEQLENYLDDDYLVFDCPGQIELFTHVPVLRNFVEHLKRKNFNVCAVYLLDSQFVSDVTKYISGCMASLSAMIQLELPHVNILSKMDLVSNKKDIEEYLDPNAQVLLSQLNRQMAPRFGKLNKSLAELVDDYNMVNFIPLDLRKESSIQYVLSYIDSCIQYGEDADVKVRDFDPPEDDD

SEQ ID NO: 22760 - DNA, 1765 bp, Panicum virgatum
  misc_feature: Ceres CLONE 1823519
  misc_feature: Encodes the peptide sequence at SEQ ID NO. 22761
agaggcaccaccgcagcagccaccaccaccaccaccaccacgaggatgatgtcggcagcagtaaagcttccttgttgcatcgccctgcagtcgaattcgaagagcgacagtggaagctacctacgctacgtccacgagagcggggagaactacaagcggctgcagatcaacggtaaggacgccaacagcccctacaccaggtacgatgtggaagcgtcgctgctccaccaaggtctggtgcacatccgatgccgctacaaccgcaagtactgggtgcctcgtcggcggggcgacggctggtggatcgtcgccgacgccgacgagcgggaagaagacctgaccaggcccaactgcacgctgatcaaaccgatcattggtgtcaccacccgcaccaccggtggtgatggcggtgaagcggaatcagtgatgaccgtcaggttcgtccacgcggggcagcagcttgggaagggcgcgcgcatgatcatgaccacgccgtcgacgaaagaaggcggcgagggcaacagtactagcgccagaggtgcctatatgcgcgtcgtcggcgacgttgtcgaagccgagcacaagggcgccgtcgaagatgtaggcttcaccgtcctcaacctgtccaagagcaagaggaacctgcctaaatttgtggtgttcaggcaagctcaggacgagaggtacctgagtgcggtcgtggtcgataaccaacttttcctccagttcaactcgggggacatgggtgacccaaacgtgacacatgagatcgtccagatggacgacggagcatcagtccgcatacgcaacgtcggccgcaacgcgttctgggatcttacacccaacgactggatccgaccggctgtgggctccatagtcgggcaggatacccgtgtaaggttcgaggtcaccgaggtgatggacttcttcgcgatccgcagcgtgctcaacggccgcttctgccggagcgacgccggcggcggtggcggcgtggcgcgaggcctacgcgccgtcgacgggaacatcaccacgggagctcggatcgtggtggaggaggccattctgcaccgcgagatctacggcatcgagtacgacctccgcgattcgagggtgtacgccaccaacgtcctgaccatggccaccacgtcggccgccaacgacacctccaccgcgcacaccaagaggctgaggctcttctacgaggagacggaggcggccacctgggacaccactctcgaggtgaagctcggctacaacgccaccatgagggcgggtttccccaagctgggcctcggcgcgacggccagcatctccgcggagttcttcgggtccttcaactggggcgagagcgtcgagacgacggtgaagcatgaggtcgagtacgaggtcgcggtgccccccatgaccaaggtcacagtgcgcctcctcgcgaccaagagcgctgtcgacgttcccttccggtacctgcagcgggacatcatgctggacgggagcacgcgggaggcggcatacgacgacggtcggttcactggcgtcaacagctatgacttccacttcgagaccgtggaggaggagctgccagaaaggaagaagcataacagggcctcttgatcggtctcgattttcgatcatatttgattatcaatatactagtatatatcacgcatggcatgaataatgtacgacgacgtactgcagcactactttgcatctatgtactgctagcttactcctcttaataaaaacgtgcccagtcacggtccgc

SEQ ID NO: 22761 - protein, 520 aa, Panicum virgatum
  misc_feature: Ceres CLONE 1823519
  misc_feature (5)..(150): Pfam Name: Agglutinin Pfam Description: Agglutinin
MSAAVKLPCCIALQSNSKSDSGSYLRYVHESGENYKRLQINGKDANSPYTRYDVEASLLHQGLVHIRCRYNRKYWVPRRRGDGWWIVADADEREEDLTRPNCTLIKPIIGVTTRTTGGDGGEAESVMTVRFVHAGQQLGKGARMIMTTPSTKEGGEGNSTSARGAYMRVVGDVVEAEHKGAVEDVGFTVLNLSKSKRNLPKFVVFRQAQDERYLSAVVVDNQLFLQFNSGDMGDPNVTHEIVQMDDGASVRIRNVGRNAFWDLTPNDWIRPAVGSIVGQDTRVRFEVTEVMDFFAIRSVLNGRFCRSDAGGGGGVARGLRAVDGNITTGARIVVEEAILHREIYGIEYDLRDSRVYATNVLTMATTSAANDTSTAHTKRLRLFYEETEAATWDTTLEVKLGYNATMRAGFPKLGLGATASISAEFFGSFNWGESVETTVKHEVEYEVAVPPMTKVTVRLLATKSAVDVPFRYLQRDIMLDGSTREAAYDDGRFTGVNSYDFHFETVEEELPERKKHNRAS

SEQ ID NO: 22762 - DNA, 685 bp, Panicum virgatum
  misc_feature: Ceres CLONE 1823520
  misc_feature: Encodes the peptide sequence at SEQ ID NO. 22763
atcctatccaccccggcaagtgtccagcgagaggcagagcaggtcacctcagcgcgacgcctgtgtgatgcttgagcgggtgattgacaactggtggctggcgagggagtcggcgtcggcggtgatgggcctctggagctggccgtgggggcggcagggcccctcgggcttcggctcggcctccaccgccgaggaggtcaccgccggcgtcgacgccaccaatctcaccgccatcgtcacaggagcaacaaacgggattggaaaggaaacagctagagttctagctctgaggggagcgaatgtgatcataccagcaaggacactagagagtggccagaaggtgaaagagagcctcgcagatcaggtcccgagctccaagctgcatgtcatggagatggacctgagctctctcagctctgtccgcaactttgcgcagtccttcaactcgtcgcataagcacctgaacatcctcataaacaatgcagggattatggcctgcccgtaccagttatccgaggatgggattgagctgcagtttgcaacgaatcatgttggccatttcttgctgacaagtctcctacttgacaagatgaaatcaaccgccagagagactggtgtgcaaggcaggatcataaacgtgtcttctgtcgcgcataaaagaagtgatggtacatgctttgagctg

SEQ ID NO: 22763 - protein, 205 aa, Panicum virgatum
  misc_feature: Ceres CLONE 1823520
  misc_feature (53)..(202): Pfam Name: adh_short Pfam Description: short chain dehydrogenase
  misc_feature: SWISSPROT Homolog: EC 1.3.1.33 Protochlorophyllide reductase
MLERVIDNWWLARESASAVMGLWSWPWGRQGPSGFGSASTAEEVTAGVDATNLTAIVTGATNGIGKETARVLALRGANVIIPARTLESGQKVKESLADQVPSSKLHVMEMDLSSLSSVRNFAQSFNSSHKHLNILINNAGIMACPYQLSEDGIELQFATNHVGHFLLTSLLLDKMKSTARETGVQGRIINVSSVAHKRSDGTCFE

SEQ ID NO: 22764 - DNA, 672 bp, Panicum virgatum
  misc_feature: Ceres CLONE 1823525
  misc_feature: Encodes the peptide sequence at SEQ ID NO. 22765
tcgccgcttttcgccatttccgggacccggagggtgtgctccagccttccaggccgccgcgatggtgggaggcggcaagccgctgggggacagcgtgttcgcgggccacgtggccgccggcgcggctgcgatcagcgcctccgccgtcgccgtgcaccccctcgacacggtgaagaccctcatccagctgggggcggcggggcagaagcagaagatggggctccggcaggtggtggaccggcttatggccgcctccggccctgcagggttttacagtggaatcggatggtctataatgggaaaacttcctggattgggagcacgttttgggacctatgaacttttaacagctttctataaagatggaagggaggacaactatgtctattattctgaggctatgttggctggcatagctgctggtgctgtagaggcttttttctgcgcaccttttgaacttttcaaactccgaaaccaagttagctctgtgataccttcaagacctgtgggccctgcaaatgttgcacaagaatcatttccactactttccaaactgttgcctggatatgttcctgacatgagggtgtggagcaacaccatgaaccttttatctgatctttctccaaagcatcccgacatgttgggtgccctaaagcagcacccatggatgct

SEQ ID NO: 22765 - protein, 203 aa, Panicum virgatum
  misc_feature: Ceres CLONE 1823525
  misc_feature (12)..(102): Pfam Name: Mito_carr Pfam Description: Mitochondrial carrier protein
MVGGGKPLGDSVFAGHVAAGAAAISASAVAVHPLDTVKTLIQLGAAGQKQKMGLRQVVDRLMAASGPAGFYSGIGWSIMGKLPGLGARFGTYELLTAFYKDGREDNYVYYSEAMLAGIAAGAVEAFFCAPFELFKLRNQVSSVIPSRPVGPANVAQESFPLLSKLLPGYVPDMRVWSNTMNLLSDLSPKHPDMLGALKQHPWM

SEQ ID NO: 22766 - DNA, 631 bp, Panicum virgatum
  misc_feature: Ceres CLONE 1823529
  misc_feature: Encodes the peptide sequence at SEQ ID NO. 22767
aaaccaaacacccctccgccgctcccaccaactccccccgatctcggccatggcggcgggggagggcgccggcgccggcgcggaaatggacgcgctcatccggcggctgaggctccaccaggcggggccatccctgtacgaccccgcaccggcggcgaccccgtggccgacggaggcggcggcggcgagctcttccggccgcggagggccgccgtgctcgtatgcctcttccggggcgccgcaggcgagctccgcgtcatcctcaccaagcgctcgtccacgctctccgcccattccggtgaagtttctttgccaggaggaaaggccgaggagggtgatgcaaatgatgcagcaacagcattaagggagtcaagagaggagattgggcttgatccatctctggtcacagttgttgcatctcttgaacacttcttgtccaagcatcttctggtagttgttcctgttattggcatactgtcagacatacaagtgtctatacctgttctaaatgttgctgatgtggatgaaatatttgatgtgcccctggagatgttcctcaaggttagtaactttgtgttcttgtgatgctaagatttatcgatggtaactgtaaccaccttctgcaatttag

SEQ ID NO: 22767 - protein, 194 aa, Panicum virgatum
  misc_feature: Ceres CLONE 1823529
  misc_feature (68)..(194): Pfam Name: NUDIX Pfam Description: NUDIX domain
KPNTPPPLPPTPPDLGHGGGGGRRRRRGNGRAHPAAEAPPGGAIPVRPRTGGDPVADGGGGGELFRPRRAAVLVCLFRGAAGELRVILTKRSSTLSAHSGEVSLPGGKAEEGDANDAATALRESREEIGLDPSLVTVVASLEHFLSKHLLVVVPVIGILSDIQVSIPVLNVADVDEIFDVPLEMFLKVSNFVFL

SEQ ID NO: 22768 - DNA, 684 bp, Panicum virgatum
  misc_feature: Ceres CLONE 1823531
  misc_feature: Encodes the peptide sequence at SEQ ID NO. 22769
cccagacaaatggattgaactcctgaagcaaagtgatgaatattggaaaatgggtgatatcgtgcacaccttaacaaatagaagatggctagaaaagtgtgtcacttatgctgaaagtcatgatcaagctctagttggtgacaagacaattgcattctggttgatggataaggatatgtatgatttcatggctctggacaagccttcaacgcctcgcattgatcgtgggatagcattacacaaaatgattaggcttgttacaatgggtttaggaggtgaaggctatctaaatttcatgggaaacgagtttggtcatcctgaatggatagattttccaagaggtcctcaaagtcttccaaatggctccgtcattcctggaaataactatagctacgataaatgtcgtcgtagatttgaccttggagatgcagattatcttaggtatcatggtatgcaagagtttgatcaggccatgcagcatcttgaggaaaaatatgaattcatgacatcagaccaccagtatgtatcacggaaacatgaggaggataaggtgataatctttgaaagaggaaatttggtatttgtgttcaacttccactggagcaatagctattttgactaccgcgttggttgtttcaagcctgggaagtacaagattgtcttagattctgatgatggcctctt

SEQ ID NO: 22769 - protein, 227 aa, Panicum virgatum
  misc_feature: Ceres CLONE 1823531
  misc_feature (174)..(227): Pfam Name: Alpha-amylase_C Pfam Description: Alpha amylase, C-terminal all-beta domain
  misc_feature: SWISSPROT Homolog: EC 2.4.1.18 1,4-alpha-glucan branching enzyme
PDKWIELLKQSDEYWKMGDIVHTLTNRRWLEKCVTYAESHDQALVGDKTIAFWLMDKDMYDFMALDKPSTPRIDRGIALHKMIRLVTMGLGGEGYLNFMGNEFGHPEWIDFPRGPQSLPNGSVIPGNNYSYDKCRRRFDLGDADYLRYHGMQEFDQAMQHLEEKYEFMTSDHQYVSRKHEEDKVIIFERGNLVFVFNFHWSNSYFDYRVGCFKPGKYKIVLDSDDGL

SEQ ID NO: 22770 - DNA, 717 bp, Panicum virgatum
  misc_feature: Ceres CLONE 1823532
  misc_feature: Encodes the peptide sequence at SEQ ID NO. 22771
aagctaagcaagctactcaatcaacaagagttaatattgctcgctaatcagctctcaactaaaattcgactagctaggctagctataggtcccctccccccctctgtcttctgcttctcatctcatggtgcccaaagaataatctcgtaggcttcctgtttcatccctcctgagatctccacgagcatcagcggcatcagcaggctggcaacacgcggcatggagcaccagctgttcgatgaccccttctcgagcagcatctcgtcgctggaggcggacatcttctccgccggcggccagctgccgtcgccgctgtggccggacctcgaactcgacctcgacctcgacgacgacgacatccacgacctctccgcgccggcggccaacgccacctcctcaggaggctatggctcgggcggaggctccggcggctcccacaggaagctcagccacaacgcgtacgagcgcgaccgccggaagcagctcaacgagctctactcctcgctccgctccctcctccccgacgctgaccacactaagaagctgagcatccccaccacggtctcccgagttctcaagtacatccccgagctgcagaagcaggtggacaacctggagaggaggaagaaggagctgacgaacgccaactgcaaaccaggagttctgaagacgagccagattgtaactcccattgtttctgctacctgcctcaacgat

SEQ ID NO: 22771 - protein, 165 aa, Panicum virgatum
  misc_feature: Ceres CLONE 1823532
  misc_feature (74)..(126): Pfam Name: HLH Pfam Description: Helix-loop-helix DNA-binding domain
  misc_feature: The sequence is a functional homolog of SEQ ID NO 1315 in the 10/666,642 US patent application
MEHQLFDDPFSSSISSLEADIFSAGGQLPSPLWPDLELDLDLDDDDIHDLSAPAANATSSGGYGSGGGSGGSHRKLSHNAYERDRRKQLNELYSSLRSLLPDADHTKKLSIPTTVSRVLKYIPELQKQVDNLERRKKELTNANCKPGVLKTSQIVTPIVSATCLN

SEQ ID NO: 22772 - DNA, 1592 bp, Panicum virgatum
  misc_feature: Ceres CLONE 1823542
  misc_feature: Encodes the peptide sequence at SEQ ID NO. 22773
attgtggttgtgtgtactcctacatcctcatttcatcacaccagccccgagcctcctccttctctctagtactagtacatacaagttgctagctaaagcaaggaaaattatatatattaattccaagaaatcaagcctcgatcgatctagagcctagaggaggtagggaagcagcagctagcttggcaaattgaagaaagaatatattatatataatggtggaattagcagcaggcagatcggcagccgcagcaagggaggccatggccatgaagaagaaacttgtgatgagcaggagcagcaacaagaagccggagaaagatggcagggcgacgaaaaagcagagcagggaggcggagagcccttcctacaggttagcgctcaagagcatcttctcctgcagaaacagcgggcagcagcagcaccgcgcgcccctggagacggccggcaagcggcggccgtcggtgagcggcagcagctgcgagcggaagccgccgcagagcgaggagctgcccctggagagctcgaagcagctgcagctgcagcggggtgggtcgtcgtcgtcttcttcgggcgggtcgttcaggctgaggcggctgtcggggtgctacgagtgccacatggtggtggatcccgtgagcggcggcggcagctcgtcgtccatgagggccaccacctgccccgactgcggccagatcttcgtcaggcaggagaccctgcagctccaccagtccatcacccacgcagtttgtgagcttggcgcggatgacacgagccggaacatcatcgagatcatcttccagtcgagctgggtgaagaagcagaggtgcaaggtggagcgcatcctcaaggtgcgcaacacgccccgcacgctggccgccttcgaggagtaccgcgacgccgtcaaggccaaggcggccaggcagatcaccaagcacccggcggcgcgctgctccgccgatggcaacgagctgctccgcttccactgcgcctccctggcctgcgcgctgggcctcaacggcgccacgcacctgtgcgatggcgatggcggcggctgcggcgcctgcgccatcatccgcgacggcttcgtcatcaggaacaggaacgccgccggcgtgtggacgatggcgaccagcggccgcgcgcacgacgacgcggtggagtacctggaggaggaggaggaggagcggagcagggcgatgctggtgtgccgggtcatcgcggggcgggtgaagcggcggcggcggcagccaagaataataaacgaggaggaggagggttcgtcggcggcggcggcggaggagggttcgtcgtcggcggcggcgcagcacgagcagcacgatggcgttgatgatgatgatttgcaggagttcgagtcggtggcggggtcggcgcctggggtgtactccaacctggaggagctgatggtgttcaaccccagggccatcctcccatgctttgttgtcgtctacaaggcttaagcttaatttatttatttatttatttagagttaaatacaccggcggccctcaaatttgtctgcaggtgccacttaggtccacgaactcgcaaaatcgaaatctgtcaccctg

SEQ ID NO: 22773 - protein, 405 aa, Panicum virgatum
  misc_feature: Ceres CLONE 1823542
  misc_feature (137)..(160): Pfam Name: zf-C2H2 Pfam Description: Zinc finger, C2H2 type
MAMKKKLVMSRSSNKKPEKDGRATKKQSREAESPSYRLALKSIFSCRNSGQQQHRAPLETAGKRRPSVSGSSCERKPPQSEELPLESSKQLQLQRGGSSSSSSGGSFRLRRLSGCYECHMVVDPVSGGGSSSSMRATTCPDCGQIFVRQETLQLHQSITHAVCELGADDTSRNIIEIIFQSSWVKKQRCKVERILKVRNTPRTLAAFEEYRDAVKAKAARQITKHPAARCSADGNELLRFHCASLACALGLNGATHLCDGDGGGCGACAIIRDGFVIRNRNAAGVWTMATSGRAHDDAVEYLEEEEEERSRAMLVCRVIAGRVKRRRRQPRIINEEEEGSSAAAAEEGSSSAAAQHEQHDGVDDDDLQEFESVAGSAPGVYSNLEELMVFNPRAILPCFVVVYKA

SEQ ID NO: 22774 - DNA, 430 bp, Panicum virgatum
  misc_feature: Ceres CLONE 1823564
  misc_feature: Encodes the peptide sequence at SEQ ID NO. 22775
tatggcgctcatcactactgtctctcactatgacgacctcgacgagcagaccctggaccacatggtttatgacttctgtgcgtcttgcgccaacaaccggctcaccctcccggaaaaccgccccgccttctctggacttttgtttccacccccggccccgattgctgtctcccattttcccgtgtgcgacaccccttccagctaccccttttctctgcctattctggtggctccctctgcttcggcccgactgccccctacagaaaggcaggttgcttcgacccgagctgcgactgctggcggaaccatgatctagtttgtcttcatggtcatctggtgctatatgaagaaattcactcccgacgaccacgactccgtttctttccactttccctcctgcaggaccggaaattactacaacaacttgccg

SEQ ID NO: 22775 - protein, 104 aa, Panicum virgatum
  misc_feature: Ceres CLONE 1823564
  misc_feature: SWISSPROT Homolog: EC 1.1.3.15 (S)-2-hydroxy-acid oxidase
MALITTVSHYDDLDEQTLDHMVYDFCASCANNRLTLPENRPAFSGLLFPPPAPIAVSHFPVCDTPSSYPFSLPILVAPSASARLPPTERQVASTRAATAGGTMI

SEQ ID NO: 22776 - DNA, 1144 bp, Panicum virgatum
  misc_feature: Ceres CLONE 1823574
  misc_feature: Encodes the peptide sequence at SEQ ID NO. 22777
gaggacttccgtcccccgcctccgcggtgtccggtttccttctcccttctccccctctccgccgacaccagtgtgctcgtttctcctcatcgtcggtgaccttgccggcggcgacgctagccatcaaaccagtatccttcgacacgacgcttctctattcgcacccttctcttccccgcccttcactgctggtcttctgtggagtggaggtccggccgcaatcggatcgattgtttgagcggtggggttcgacggattgaacccccatggccgacgtcgagtccgcccctggcgcgggcgtgaagtctccgccttacaaggaaaccgacaacggggttctgcggttccaactcgagttggagttcgtgcagtgcctcgctaaccctacctacattcactatctagcacaaaatagatattttgaggatgaggcgttcatcggatacctcaagtacctaaaatactggcagcgcccggagtatatcaaatatataatttatccacactgccttttctttcttgagctcctccaaaacgccaatttccgcaatgcaatggcacatccagcaaacaaggagcttgctcacaggcagcaatatttcttctggaaaaactacaggaataatagactgaagcacatcctaccacgccctcctcccgaaccagctccggcgcctgcaccttcacaaggacctgcaacggtgcccctaccaccaccagtaccaacacctgtggccccacctgctcctgcaccggcatcatctatgccatctgtgccagcaggtggtgcatctgcaatgtctcctatgcagtttgtaggaactccaggcaccaatatgccgaagaccgacatgagaaatgctatgggcaacagaaagaggaagatgggttagttgaacatgttgggcagctcaacagtggacaaataggatgcaagccagaagtcgctgcctatggagcctttcaatgttcaatatttgtaggccttgcagatgtaactttagatgtcaatatgctcctgagtgactaatcatttgtgttggcgttgttttagtcaggtttttgtcacggactaaacaccgacagcaggactcatgatcttgaatgagtaatcatttgtgttggagttgatctagttgatttt

SEQ ID NO: 22777 - protein, 208 aa, Panicum virgatum
  misc_feature: Ceres CLONE 1823574
  misc_feature (22)..(124): Pfam Name: SOH1 Pfam Description: SOH1
MADVESAPGAGVKSPPYKETDNGVLRFQLELEFVQCLANPTYIHYLAQNRYFEDEAFIGYLKYLKYWQRPEYIKYIIYPHCLFFLELLQNANFRNAMAHPANKELAHRQQYFFWKNYRNNRLKHILPRPPPEPAPAPAPSQGPATVPLPPPVPTPVAPPAPAPASSMPSVPAGGASAMSPMQFVGTPGTNMPKTDMRNAMGNRKRKMG

SEQ ID NO: 22778 - DNA, 480 bp, Panicum virgatum
  misc_feature: Ceres CLONE 1823580
  misc_feature: Encodes the peptide sequence at SEQ ID NO. 22779
atccgcgctgcacttgtagacatctatccagcacatcgcagcatagatcgtgcacgctctcatgatggtcgccttggcggccgtcgccgaccgcggcggtgctcctccactacctcccgctgctccgctgcgtgcctcaccaagggaagcttccgatggcccctcatcgacgaaaccatcggcttcctccacgcgcacccgtcccacacggccggcggcttcctcaaggagcacgtggccagatacgggacgctgttcaagtcgcacctcttcggttctccggcggtggtctcctacgacgaggagctcaaccacttcgtgctgcacaacgaggaacacctgttcgagtgcagataccgcagcgccatccgcaccatcctcggcgagtcctccgcgctggtggtcaccggctagcgccaccgccagatccagatcatgtgcctccccctcgtcgcctcacacggggctcaaagactccta

SEQ ID NO: 22779 - protein, 137 aa, Panicum virgatum
  misc_feature: Ceres CLONE 1823580
  misc_feature: SWISSPROT Homolog: EC 1.14.13.77 Taxane 13-alpha-hydroxylase
IRAALVDIYPAHRSIDRARSHDGRLGGRRRPRRCSSTTSRCSAACLTKGSFRWPLIDETIGFLHAHPSHTAGGFLKEHVARYGTLFKSHLFGSPAVVSYDEELNHFVLHNEEHLFECRYRSAIRTILGESSALVVTG

SEQ ID NO: 22780 - DNA, 588 bp, Panicum virgatum
  misc_feature: Ceres CLONE 1823582
  misc_feature: Encodes the peptide sequence at SEQ ID NO. 22781
acctccgcacaaccgcgtccgcttcccccccgccacaggagatcccctgcgcccgccgcatccctgtagccgcccctgctgccgccggcgagcccgatccgcagccgccatgtcgccgtcggagccgacgcgtgaggagagcgtgtacatggcgaagctggcggagcaggcggagcggtacgaggagatggtggagttcatggagcgcgtggcgcgctcggcgggcggcgccggcggcggggaggagctctccgtcgaggagcgccacctgctggccggcgcctaccacaacgtcatccgagcccgcccggccgctcggcggatcgtctcccccctcgtgcacaaggaggatggccgcgacaagtacggactccgcgcattcgacgcgcgcctcgcatgcagcatcgccgccgccgttggctgacagcacgaagaggaacagggacagcgtggacgacccgtcgagttcgggcgacgccgacgccgacgccgacgccagcggcagggacgaggccgtcgagagcccccgccccagcgacgccttcgagttcgagggctcgtgcaggcgcatcaaggtcagcagggtct

SEQ ID NO: 22781 - protein, 104 aa, Panicum virgatum
  misc_feature: Ceres CLONE 1823582
  misc_feature: The sequence is a functional homolog of SEQ ID NO 786 in the 11/479,226 US patent application
  misc_feature: The sequence is a functional homolog of SEQ ID NO 2350 in the 10/374,780 US patent application
  misc_feature: The sequence is a functional homolog of SEQ ID NO 344 in the 10/412,699 US patent application
  misc_feature: The sequence is a functional homolog of SEQ ID NO 790 in the 10/225,066 US patent application
  misc_feature: The sequence is a functional homolog of SEQ ID NO 805 in the 11/479,226 US patent application
  misc_feature: Useful for making plants with modulated water use efficiency
  misc_feature: The sequence is a functional homolog of SEQ ID NO 789 in the 11/479,226 US patent application
  misc_feature: The sequence is a functional homolog of SEQ ID NO 809 in the 11/479,226 US patent application
  misc_feature: The sequence is a functional homolog of SEQ ID NO 801 in the 11/479,226 US patent application
  misc_feature: The sequence is a functional homolog of SEQ ID NO 797 in the 11/479,226 US patent application
  misc_feature: Useful for making plants with modulated drought sensitivity
  misc_feature: The sequence is a functional homolog of SEQ ID NO 342 in the 10/412,699 US patent application
  misc_feature: The sequence is a functional homolog of SEQ ID NO 782 in the 11/479,226 US patent application
MSPSEPTREESVYMAKLAEQAERYEEMVEFMERVARSAGGAGGGEELSVEERHLLAGAYHNVIRARPAARRIVSPLVHKEDGRDKYGLRAFDARLACSIAAAVG

SEQ ID NO: 22782 - DNA, 989 bp, Panicum virgatum
  misc_feature: Ceres CLONE 1823589
  misc_feature: Encodes the peptide sequence at SEQ ID NO. 22783
acacacaaagacccagctcgcgagcagatcgccagatcccgacgacacccgacgccgccgctcctcccgatggcgcgttccctcctcccgacatcgcccctcctcccaatggcgctcctctcctccgacggcgctccctcctcccagctcgcgatccgtttcccgacaccgctccgccgtcctctcgtcgccgatcccgtgactggcgccgcccgccgccagctgctgaccatcccccgcattcaaggcgatgccctcccgttcctgacgccgctcgctcctcccatcgccgttccgcgagtccgatccgtcctcccgtcaccgtcgatccctctctgcctgccttccgatcaggtaaaggtttggttacaatgaagggttttaacggatcatttcctaatgctgcgtcatctgctaagatatttgctgttcttgctggtgttcaaagtttggtagcctgctctttgagaaaactatgtggaaaagatgatagtttgtcttcggggatacgtgcatctcaattgaaaatattacactatcattattatcgtattttgcatgttaactagttttttcattcacatttgttatttgcaactatgaaattaacacaatgctgactccttattggaaagtacatttggaaataaaattgctagagagagaggagctcgctgctggcgcatcctggagggaggagcaaagctctgttgtcattgcaaggttgatgataatggcaagcacaacaggtcggctgggcaggaaacagattgtgacagcataaacttattccttgagttacaaagtctgtgttgtattagtgatgcgttcctcaggattgaaagtttagcctgctttattaaaaatattacattttgtaaaaactattgttcgttaggtggctagtctctgatagggtctcttttttggcaagggccatgtatctctgtatgtatgttcttttctttgtgattaaaaatattcagcag

SEQ ID NO: 22783 - protein, 65 aa, Panicum virgatum
  misc_feature: Ceres CLONE 1823589
  misc_feature: Useful for making plants with modulated salt sensitivity
MKGFNGSFPNAASSAKIFAVLAGVQSLVACSLRKLCGKDDSLSSGIRASQLKILHYHYYRILHVN

SEQ ID NO: 22784 - DNA, 675 bp, Panicum virgatum
  misc_feature: Ceres CLONE 1823591
  misc_feature: Encodes the peptide sequence at SEQ ID NO. 22785
actccagcgccttcgcccagcgcaccaacacaacaacctccgccaccgcccgcgcccgaacacttggcgcccactcgccccgccgcacgcttcgtcgctcgctctcccgctcctccggttccgccatggcgcccaagaacagcgctctcccaccctccagcgcggccaccgacggcatgatggagccgaggttccgcggcgtccgcaagcacccctggggccggtacgcggcggagatccgggaccccaccaggaaggcccgcgtgtggctcggcaccttcgacaccgccgaagccgccgctcgcgcctacgacgccgccgcgctccacttccgcgggcccaaggccaagaccaacttccccgtcgcgttcgccgcgggcgcgcacccgccgccgcccaagatgctggccgtcagccccagcagcagcaccgtggagtcctcctcccgggactcgccggccgcgtcccccgcggcggcccccgcgccgtcgctggacctgagcctcggcatcccgcccatggtggccgcccagccgttcctcttcctggacccgaggctcgcggtgaccgtggccgtgccctgccggccggccgtcgtcgccggcgccagcaaggcgacctgccgtgaagacgagcatagcgacaccgggtcgtcgtcatccgtcgtggacgcct

SEQ ID NO: 22785 - protein, 183 aa, Panicum virgatum
  misc_feature: Ceres CLONE 1823591
  misc_feature (21)..(72): Pfam Name: AP2 Pfam Description: AP2 domain
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
MAPKNSALPPSSAATDGMMEPRFRGVRKHPWGRYAAEIRDPTRKARVWLGTFDTAEAAARAYDAAALHFRGPKAKTNFPVAFAAGAHPPPPKMLAVSPSSSTVESSSRDSPAASPAAAPAPSLDLSLGIPPMVAAQPFLFLDPRLAVTVAVPCRPAVVAGASKATCREDEHSDTGSSSSVVDA

SEQ ID NO: 22786 - DNA, 1349 bp, Panicum virgatum
  misc_feature: Ceres CLONE 1823596
  misc_feature: Encodes the peptide sequence at SEQ ID NO. 22787
atccattcaccccacaccttctccgtctcgcctcccccaccgcggcaccgcctcgggcccgccgcgcctcccccccagccacgcgccctcgccgcggcggcggagatgcaggccgctgccgccttcaaccgggcagccgtcaccgcccgcccgctccatcgctccccgaggcctcctctcctccacatagccggggcggagtatggtccgggcggaaggagaggcgcgcccctgacgcggctccggtacgccgggagcctctccgtcggcgccggcgccggcggctacggcaacgagcgggttccagtgtttccaagacaacaatcatgtgatccctacaagcttctcggtgttgatcatgatgcatccgaagaagaggtccggagtgcaaggaattttcttttaaaacaatatactgggtacgaagaaagcgaagaggctattgaaggtgcttatgataagataataatgaatagctactcacaccgtaagcattccaaaatcaatcttaaaagcaagatataaaagcaagttgaagaatccccatcatgggttaaggcactgcttggatactttgaggtgccatcactggagattatttcaaggagacttgctttttttggtttcattgctggatggagcattgcaacttctgctgagtctgggcctgcatttcagcttgcgttgtcacttgtatcatgcatatacttcctcaatgacaagatgaagaaccttgttagggcattcaccacagggcttggagtctttgtgggtggctggatcttaggttctttacttgtcctagccataccagctttcttcatcccacctacttggtccattgagctccttacttcactgacggcttatgttttcatgttcttggggtgcacttacctcaagtgaaacttttcaatagttctcctatgaaattcctgctgttgtcacaaagaaaattgctcttgctgacatctccactgcaagtccaaacttcctggttcgagaaaaaaaagtccaaacttcctgatgagtgactgtctgactgagcgtgaccggccttcacatttttggtcctgagagtatattatgatcaatgcactactgtaccttaccccaggatggttcaaacttcagatacatagttttttttttagatatatacgtttttgttgccccctttagtcgtacacaagtgtattgattagtattctacccatagctagttgattaacttttttttgtacgttggtaaagcatgccattgtgtttttctacctgtttattagtgtctcataattgcaatcaagcattgctgcagcaatataatttcagtggcttgtttgtgattc

SEQ ID NO: 22787 - protein, 139 aa, Panicum virgatum
  misc_feature: Ceres CLONE 1823596
  misc_feature: Useful for making plants with altered protein content
MQAAAAFNRAAVTARPLHRSPRPPLLHIAGAEYGPGGRRGAPLTRLRYAGSLSVGAGAGGYGNERVPVFPRQQSCDPYKLLGVDHDASEEEVRSARNFLLKQYTGYEESEEAIEGAYDKIIMNSYSHRKHSKINLKSKI

SEQ ID NO: 22788 - DNA, 720 bp, Panicum virgatum
  misc_feature: Ceres CLONE 1823607
  misc_feature: Encodes the peptide sequence at SEQ ID NO. 22789
actgctatggctccaaacgacgccgctactgccgctccgtccgagccggagagcgtcggcggccggatgagcagcgaggacatggtcgccacgaggccgctcctctcgtcgccctccccctccccctccccctccgcagcctccgcagcgccggtgcaggagagcatagaggagctggatcggaagtacgcgccgtacacgcggcgggacgcgtacgggccgatgggcctcgggcccgtgggcgcgctggaggcgttccggctggctttcgcggcggtcgtgctcgtcccactccgggtcgtggcaggcatgctcgtcctcgtggtctactacctcgtgtgccgcgtgtgcacgctgcgggtggaggaggagcgggagggcggcgaagggcacggatacgcgcggctggaggggtggaggcgggagggggttgtgcggtgcggccgcgcgctcgctcgcgccatgctgttcgtcttcgggttctactggatcccggagtacgactgccgcttcgccgatgccgaggatgggcatgcggaccagtctaaagaaatggaaaggcctggggctattgtatctaatcatgtttcttatgtggatattctttatcatatgtcggcctcttttcccagttttgttgctaagagatcagtagccagattgcccctagttggtctcataagcaaatgtcttggatgcatttttgttcagcgggagtct

SEQ ID NO: 22789 - protein, 237 aa, Panicum virgatum
  misc_feature: Ceres CLONE 1823607
  misc_feature: SWISSPROT Homolog: EC 2.3.1.23 1-acylglycerophosphocholine O-acyltransferase
MAPNDAATAAPSEPESVGGRMSSEDMVATRPLLSSPSPSPSPSAASAAPVQESIEELDRKYAPYTRRDAYGPMGLGPVGALEAFRLAFAAVVLVPLRVVAGMLVLVVYYLVCRVCTLRVEEEREGGEGHGYARLEGWRREGVVRCGRALARAMLFVFGFYWIPEYDCRFADAEDGHADQSKEMERPGAIVSNHVSYVDILYHMSASFPSFVAKRSVARLPLVGLISKCLGCIFVQRE

SEQ ID NO: 22790 - DNA, 1594 bp, Panicum virgatum
  misc_feature: Ceres CLONE 1823612
  misc_feature: Encodes the peptide sequence at SEQ ID NO. 22791
ccagatcgccaaccgaaccgcctgagcccgcggccgcacgcctccacccccgaagccgccagccgacgaccacgatcggcggcggcgcccgggtgcggcggcgcctcggctcccctgatccccccttcgggaatggacggccaggctccacctcccctcgacgccgtggcgcgcgagccactcgcagtcgccgacgagctcccgccgccgccgccgcctcctctcgaggtggaggacgtgctacccccaaccccaagtatgggcggccaggctccgcctctcgacggcgtcgcgccgggtctgctcgccgtgtccgacgagctgccgcctcctccttcgccgacgggcgaggtggaggactccctacccgtcgcgcccgacaccgtcaacgccgccacttcgggggtgcccgaggctggcacaggtggcgttgagctcaccgacgagctccgtgaccagatcgtcaagcaggtggagtactatttcagtgatgagaatcttcctaccgacgagttcctgttgaaatgtgtgaagaagaacaagaagggctttgttcctattgagactatcgcatcatttagaaggatgaagaaactcattcaagacctctcagtaattgcagctgcactcaggacatcaccaaagctggttgtaagtccagatgggaaaagggtcaggaggtttggtccattgccacagaatgtactgaaagattcaaagaaaagcacagttttggtggaaaatctacctccagatttctccatggagagtctacaggaaaagttcagtacagttggcaaagttgtgaacataacaattaatgatccagaattagtgaaagaatcttctactgctaagaagccggccttcattttaagtagtaaggttcatgcccttgttgagtatgaagcaattgaggccgctgagaaggctgttactaccttaagtgacgagagcaactggagaactgggatgaaagtcaggcttctgtcaaagggatcaggaaaacatagcaaatcgtcaaaagaaaatcaggatacagtttccaaaaagaacattcagaatcagcatggaaaagaagaccagcaagcagccttggaaaagaacagcacctgtgactcagtggagggtactaaggacaaggaaaatttgaactctgctttcaccactgagagtgaacagcaacaccaaaagccaaatcctaaaggagggcgaaaaggccagtacaaaggtcacggtcagattcagcaaaatacaaacaaacaaggttctgagtcattaaacaagcctattcctggaccaagaatgccagatggaacaaagggctttacaatggggcgtggtagaactcttccactacagaaatctgaaaaggctgaagagtagagctacccgaagatgcctgttaaaaacctaactgaagaaccgtgaagacatacgttttgtacaaaaaaaaactcgcgcgagaatatctgagctgttttctgcatgagagatgaagcacaaaacaaaaggaatgatttgtacagaacttcagttttgtgttggatcttaatacactcgttcgatcatccgttctgggaaatttggtttc

SEQ ID NO: 22791 - protein, 417 aa, Panicum virgatum
  misc_feature: Ceres CLONE 1823612
  misc_feature (110)..(169): Pfam Name: La Pfam Description: La domain
MDGQAPPPLDAVAREPLAVADELPPPPPPPLEVEDVLPPTPSMGGQAPPLDGVAPGLLAVSDELPPPPSPTGEVEDSLPVAPDTVNAATSGVPEAGTGGVELTDELRDQIVKQVEYYFSDENLPTDEFLLKCVKKNKKGFVPIETIASFRRMKKLIQDLSVIAAALRTSPKLVVSPDGKRVRRFGPLPQNVLKDSKKSTVLVENLPPDFSMESLQEKFSTVGKVVNITINDPELVKESSTAKKPAFILSSKVHALVEYEAIEAAEKAVTTLSDESNWRTGMKVRLLSKGSGKHSKSSKENQDTVSKKNIQNQHGKEDQQAALEKNSTCDSVEGTKDKENLNSAFTTESEQQHQKPNPKGGRKGQYKGHGQIQQNTNKQGSESLNKPIPGPRMPDGTKGFTMGRGRTLPLQKSEKAEE

SEQ ID NO: 22792 - DNA, 626 bp, Panicum virgatum
  misc_feature: Ceres CLONE 1823621
  misc_feature: Encodes the peptide sequence at SEQ ID NO. 22793
tgcagcagcccctccctcaccatccccagcagcaggagcaccaccaccaccaccaccatgacgccggccaccacgagcacgaggcgccgacgcaccatctcctcgctccccctccccccggcctcgtcagccccttcctccacgacttcggcggcgccatggccgcgccgccaatgctggccggcggcggcctcggcaagcgcatgtatcctgacggcgcgggcgacgacggtaacctgcagcacgcggcggcggatccgcagcagcaggacggtggtgccgccgcgtcggacgacgaggaaggctccgccaaggcggacggcgggtgcggcggggagcggaagcggcggctgagcgtggagcaggtgcgcacgctggagcggagcttcgaggtggccaacaagctggagccggagcggaaggcgcagctggcccgcgcgctggggctgcagccccggcaggtggccatctggttccagaaccggcgcgcgcggtggaagacgaagcagctggagaaggactacgacgcgctccgccgccagctcgacgccgcccgcgccgagaacgacgccctcctcgcccacaacaagaagctccacgctgagatcagggcgctcaagggagcg

SEQ ID NO: 22793 - protein, 207 aa, Panicum virgatum
  misc_feature: Ceres CLONE 1823621
  misc_feature (113)..(167): Pfam Name: Homeobox Pfam Description: Homeobox domain
  misc_feature (168)..(207): Pfam Name: HALZ Pfam Description: Homeobox associated leucine zipper
  misc_feature: The sequence is a functional homolog of SEQ ID NO 577 in the 11/479,226 US patent application
QQPLPHHPQQQEHHHHHHHDAGHHEHEAPTHHLLAPPPPGLVSPFLHDFGGAMAAPPMLAGGGLGKRMYPDGAGDDGNLQHAAADPQQQDGGAAASDDEEGSAKADGGCGGERKRRLSVEQVRTLERSFEVANKLEPERKAQLARALGLQPRQVAIWFQNRRARWKTKQLEKDYDALRRQLDAARAENDALLAHNKKLHAEIRALKG

SEQ ID NO: 22794 - DNA, 678 bp, Panicum virgatum
  misc_feature: Ceres CLONE 1823645
  misc_feature: Encodes the peptide sequence at SEQ ID NO. 22795
gagatgttcgagacaaatgtggacaatgagtctttggtagcattatgcaagctggtcgacaggtacttggctgaagttgtctctgatccaaatctgccagtttcaagcttcgtggatctggcgacctccatgcctgaatctgccagaacatcacacgatggattatacaccgctatcgatgtatttctgaagctgcatcccggcctacccaagacggagaagaggaagatctgcagcctgatggacgtgaagaagctctccaagggggcgtgtatccacgcggcgcagaacgaccggctcccgctccgcgtggtggtccaggtcctcttcttcgagcagctccgcgccgcgggagccgcggcggccgccgctccagtgcccaacggcagcatggcgcggtgcatggcgcgcctggcggaggaagaggaggacgacgactggaaggacgggcgcacgcagcaggagcccccgacacccggcgcgctgaagaagcagctggggagcctgaagctggcggcggccgaccatggcgcgggcgacgacggccggcgcctggtggcgcgcagcagcagcgtggccaaccagagcagccggctgtcgctgtcgtcgcggtcgcggaggatcttcgacaagctgtgggtcggcggcgcgaagctccccggggagggccccgccggc

SEQ ID NO: 22795 - protein, 225 aa, Panicum virgatum
  misc_feature: Ceres CLONE 1823645
  misc_feature (1)..(91): Pfam Name: NPH3 Pfam Description: NPH3 family
EMFETNVDNESLVALCKLVDRYLAEVVSDPNLPVSSFVDLATSMPESARTSHDGLYTAIDVFLKLHPGLPKTEKRKICSLMDVKKLSKGACIHAAQNDRLPLRVVVQVLFFEQLRAAGAAAAAAPVPNGSMARCMARLAEEEEDDDWKDGRTQQEPPTPGALKKQLGSLKLAAADHGAGDDGRRLVARSSSVANQSSRLSLSSRSRRIFDKLWVGGAKLPGEGPA

SEQ ID NO: 22796 - DNA, 1356 bp, Panicum virgatum
  misc_feature: Ceres CLONE 1823660
  misc_feature: Encodes the peptide sequence at SEQ ID NO. 22797
acgcctccaaaaccccttctcgccacggcggccaaggggcaaggggccttgctccaagccctccaaactgcgccgcggaaggcattgcagtggactcctgagcaggggaagtggtctctaccatgggcaactcttgcgttgcaggcgcttctcctgcacctctgagaaagacccatgatccagatttcaaatggaagttttacggtttctcagctttacttgataggggggctgtatcagctaattctgctccttttcacttctgtggatacagttggttcctgcacgtgatcccaaagcataaaaagtctggtgataagattccatacgttgctctatgcctttgcgtaaaccaaaacatcttaaagccaggttgcaccttgagtgcagttttcgagttgtcaatatacaaccattcaaaagggacttaccgtggatgtaaagctagctaccacttccatgtcaagcagacgcactcagagagaaaatgcttgattcctcttgacgaagtactgaaatcatctgattttctggttgatgatagctgtgtctttggtgtgaggatattaaaggcggatgtttcttcgcaaaataagcctattgtgattccaaagaagcctatcacagttcagaacatcttcctccagaagaagggattcatcaaaggaacctacacctggaccatgaacaacttccttgacatgaagctcccagtcctttctcctgaatttgatgttggcggacaaaaatggcacatcaacatgcatccacttggtgaccaatatagcaccaattcgctttcgctgtacttatacctgcatgatcagaagaagctccctctcgagtctggaatgatgattgaactgactctatccatcctggaccagaagcatgggaaacactacacagttacaggtcgcttcgtgtttgcaaccaacgcaaagaatggctggggatggtccaacttcattccactgaagacactcatggacccatccagaggctatcttgtgggatcaaactgcattctgaaggcagatgccactatcattgggtcatccaatgacggctagaccttttttgatgacctctgaaaggaaaaattcttttgcacacttggaacaattgtccgtgatgcctatatggtgtctatgctggtataaatggctgaatcgtgatcttattatgcatgtttatgaactgatgagctctaggggttgagaaactctagaaggttggtgtgcactatgtgtgcattagtggcagacaatagctcaaaatggatgattttagtatcttggtttgtgtgccgtacatgttgggttcctgttatatatcgctttgttttggcgtggc

SEQ ID NO: 22797 - protein, 316 aa, Panicum virgatum
  misc_feature: Ceres CLONE 1823660
  misc_feature (188)..(309): Pfam Name: MATH Pfam Description: MATH domain
  misc_feature: SWISSPROT Homolog: EC 3.1.2.15 Ubiquitin thiolesterase
MGNSCVAGASPAPLRKTHDPDFKWKFYGFSALLDRGAVSANSAPFHFCGYSWFLHVIPKHKKSGDKIPYVALCLCVNQNILKPGCTLSAVFELSIYNHSKGTYRGCKASYHFHVKQTHSERKCLIPLDEVLKSSDFLVDDSCVFGVRILKADVSSQNKPIVIPKKPITVQNIFLQKKGFIKGTYTWTMNNFLDMKLPVLSPEFDVGGQKWHINMHPLGDQYSTNSLSLYLYLHDQKKLPLESGMMIELTLSILDQKHGKHYTVTGRFVFATNAKNGWGWSNFIPLKTLMDPSRGYLVGSNCILKADATIIGSSNDG

SEQ ID NO: 22798 - DNA, 1222 bp, Panicum virgatum
  misc_feature: Ceres CLONE 1823669
  misc_feature: Encodes the peptide sequence at SEQ ID NO. 22799
aaatcctcctcctcctcctccgcccctccactcccctcgtcgcctcctccccggccatcttcttcttcttctcctcttccccaccaacgccaaaacccagcaaacccacactcactcaatggaggtctccaccaagcagctcctccccatgcctcatcagcaggaccccaactccccttcctcttccacctcctcgtcgtcctcctcctccacctcaccgtctcacccccaccaccgtgcgcagccccacaacctcccaccgtcgccccggcccatcccgcgcaccatcgacaccaccccgttccccaccaccttcgtccaggctgacaccacgtcctttaagcaggtcgtccagatgctcaccggcgccgagcagcccaccaagaacgacgcgacgacggcggcggcggcgccagcgggcaacggcggcggtggccaggcggctggcgggccgtgccggcccaagaagccgtctttcaagctgtacgagcggcggagcagcatgaagaacctcaagatgatcgcgccgctggcgatgggcccgccgccgtcgccgcggagggcggcgccggagatcctctcgccgagcgtgctggacttcccgtccctgaggctcagcagcccggtgacgccgctgaccggggaccccttcaaccgctcgccggcgtcgacgtcgtcctccgaggaggccgagcgcgcggccatcgccgagagggggttcttcctccacccgtccccgaggggcgccgagccgccgcgcctgctcccgctcttccccgtcacctcgccccggatggccgcccccgccgcggcgccgtccgagtgatccggcccgagatcgatcccgcctccgctccgatcgccggcgcccgcctctaccatagctactacccctgtactactacaaccatcgccgtatcctcccttcacctctggtcttgtaaggtgcttgctttgctctgctcttgttcttgatcgacgctgctgcgcgtctgctgctgccgtagtttttgctcccttcttgaaaggaagaggggagtttgttctttttcttcctttcggagcggcgactggcgagcagacgagcagtgatcgtacgaaccgagcctggagacgcacgcgccaggctcgattactcgatcgctcgtcgcctccgaaatgaagagatgggtggatgaattagtaaattaattatcaattaatgaaaattaatctcgagctt

SEQ ID NO: 22799 - protein, 235 aa, Panicum virgatum
  misc_feature: Ceres CLONE 1823669
  misc_feature (60)..(90): Pfam Name: VQ Pfam Description: VQ motif
MEVSTKQLLPMPHQQDPNSPSSSTSSSSSSSTSPSHPHHRAQPHNLPPSPRPIPRTIDTTPFPTTFVQADTTSFKQVVQMLTGAEQPTKNDATTAAAAPAGNGGGGQAAGGPCRPKKPSFKLYERRSSMKNLKMIAPLAMGPPPSPRRAAPEILSPSVLDFPSLRLSSPVTPLTGDPFNRSPASTSSSEEAERAAIAERGFFLHPSPRGAEPPRLLPLFPVTSPRMAAPAAAPSE

SEQ ID NO: 22800 - DNA, 721 bp, Panicum virgatum
  misc_feature: Ceres CLONE 1823675
  misc_feature: Encodes the peptide sequence at SEQ ID NO. 22801
ctctcggactctctccctggctctttcttccctgtcggcgacgactgggcgagcggcggcgccgtttgtcacgtcttcgccaagccttttgccggcgacgagcatcccccaggctgagataagttgaagcaaagttcaaggcaaaatgttttacggtggatatgcgtaccatggcaatacgtttgagcaaacgtaccgttgttatccagcatccttctttgataagccacacctggaaggtggtgacaaagtaataatgccaccatctgcccttgattgcctggcttccctccacatcgagtacccaatgctatttgaactgcacaatgatgcaactcaacggatttcacactctggtgttttggagtttgtggcagaagaaggcatgatcatcatgccctactggatgatgcaaaacatgcttcttcaagagggtgacactgtccgtgtgaaaaacgccacacttcccaagggtacatatgtgaagttgcaacctcacacaactgattttctggacatctcgaatccaaaagccatcctggagaaaactctgagaaatttctcctgtttaactacgggagacagcatcatggtggcttacaacaacaaacagtattatattgatattgttgaaacaaagcctgcttcagctgttagcattattgagacagactgtgaagtggattttgctcctccccttgactacaaagaccctgagaac

SEQ ID NO: 22801 - protein, 191 aa, Panicum virgatum
  misc_feature: Ceres CLONE 1823675
  misc_feature (10)..(184): Pfam Name: UFD1 Pfam Description: Ubiquitin fusion degradation protein UFD1
MFYGGYAYHGNTFEQTYRCYPASFFDKPHLEGGDKVIMPPSALDCLASLHIEYPMLFELHNDATQRISHSGVLEFVAEEGMIIMPYWMMQNMLLQEGDTVRVKNATLPKGTYVKLQPHTTDFLDISNPKAILEKTLRNFSCLTTGDSIMVAYNNKQYYIDIVETKPASAVSIIETDCEVDFAPPLDYKDPE

SEQ ID NO: 22802 - DNA, 1080 bp, Panicum virgatum
  misc_feature: Ceres CLONE 1823685
  misc_feature: Encodes the peptide sequence at SEQ ID NO. 22803
aaatcacctcctcacggcactgccttgtcgcgaagcaaccgcagcggcttctccgtccccgagctcagccgctctctcttcctcccctcctccgaatcgcgctcgtcctgctgtagtggtaggcggccggcgacgagagatttctctgtacgatgagctggaggattcctctcttcggctctcagcagcagcaaacagacccaaatttccaggacatacctacgcaatcttggtaccctccatcggtggtaggctcatcttcacgtccatccacacctacctcttctagtgctagcccacatcaaagagcttcagatcatcctcagtcttcatcccgtgggcaaccatctcccgctgaggctgcagtgataattgctcgtttgaaggataagagtattgaggagttacagaggttattgaaagacaaagaggcatacaatgcattctttaattcacttgatcaagttaaaacccagaacaatgtacgtgacgagcttagaaaggagacgttgcaacttgcaagggaaaatttagaaaaggagcagcggatttcagagctccggaatcagtgcacaataataagaaccacagaactggctgctgctctagacaggctaactgatttggagaggcaaaaggatgatattatgaggtcctattcccctgccgcgctgctcgacaagctccaaacatcaatggcaaagctggacgaggagtccgaggagctgcaccagaagttcctggagaaggacatcgacctgcctacctttgtgcagaagtacaagaagctccgcaccacctaccaccagcaggcgctgcttcatctcgcctgccagacatcactgcgctgacatccgtccgtggtcagtctgccagacagatgatcgcggcaaccttgttgtatacctgctcgcccattcttttcctacactctgcttgaccctgtttttgagtgcagcgtgcgtgggctttgccacacatcaaacggagactgcatgtatagttatgtttgaaacgttttacctaggttgccgagtgaccaggttggacttatacgaggtaatcaaacccatttgcccc

SEQ ID NO: 22803 - protein, 232 aa, Panicum virgatum
  misc_feature: Ceres CLONE 1823685
  misc_feature (77)..(222): Pfam Name: Mod_r Pfam Description: Modifier of rudimentary (Mod(r)) protein
MSWRIPLFGSQQQQTDPNFQDIPTQSWYPPSVVGSSSRPSTPTSSSASPHQRASDHPQSSSRGQPSPAEAAVIIARLKDKSIEELQRLLKDKEAYNAFFNSLDQVKTQNNVRDELRKETLQLARENLEKEQRISELRNQCTIIRTTELAAALDRLTDLERQKDDIMRSYSPAALLDKLQTSMAKLDEESEELHQKFLEKDIDLPTFVQKYKKLRTTYHQQALLHLACQTSLR

SEQ ID NO: 22804 - DNA, 633 bp, Panicum virgatum
  misc_feature: Ceres CLONE 1823697
  misc_feature: Encodes the peptide sequence at SEQ ID NO. 22805
aaccacccaacctaacctctcgccgcagcagccagcaacagcaacgacgagaacgcgtaaacgagggagagcctcccgcgattacgaagagcccaggaacgccgaagcagcgaagcgccgaggaaggaagggagcaacagccatggggctcgactactactagatcctgggcgtcgacgagggtgccaccgacgacgacctcaagaaggcctaccgcacgctcgccatgaagtggcaccccgacaagaaccccagcaacaagaaggaggccgagaacaagttcaagcagatctcggaagcatacgaggtcctgagcgaccctcagaagcgcgcggtgtacgaccagtacggagaggaggggctcgaggggcaggtgccgccgccgggcgccggcggggcggaccccgggggtgccaccttcttctccacgggcggcgacgggccgacgacgttccggttcaacccgcgcaacgcggaggacatcttcacggagttcttcggcgggtccagccccttcggcaggctgggtggcggcggaatggggggaggaatgcccggcatgcggaccggtgggacgaggttctcctcgtccatctatggggatgatatattcggctcggcgttcggcggcgg

SEQ ID NO: 22805 - protein, 135 aa, Panicum virgatum
  misc_feature: Ceres CLONE 1823697
  misc_feature (1)..(39): Pfam Name: DnaJ Pfam Description: DnaJ domain
MKWHPDKNPSNKKEAENKFKQISEAYEVLSDPQKRAVYDQYGEEGLEGQVPPPGAGGADPGGATFFSTGGDGPTTFRFNPRNAEDIFTEFFGGSSPFGRLGGGGMGGGMPGMRTGGTRFSSSIYGDDIFGSAFGG

SEQ ID NO: 22806 - DNA, 1353 bp, Panicum virgatum
  misc_feature: Ceres CLONE 1823706
  misc_feature: Encodes the peptide sequence at SEQ ID NO. 22807
agagtccgcctccgcggctccgccctaaccaacaaacagcagcgcatgcactcggcggccacctcagacctcaccgcccttttccttccccgtttcgccgtcgtcgcatccgcttgtgctttgccggagttggagatgccatcgaccacctgtgcactccattgagcagggatcgagttgcccaaattgtggtgattgaagctgtcccaagttccaagcctatacaatgcagggcatctctatatgtggttctgttgcctcaccccatggagcaaattgcagaagggcttgtgttgcaaggaacagtctgaggctgccatatgagattaatgcagtaagccatggagctttctcatgccactggcgcatgcataaactccacataaagatcaatggcagaagaatgaatgctacagtaagaactaatgctagatggttgtttggaggagacgggcgtagcagcgatgcaaggctggagcgcagtgagtctgctaatgaagatatcttgatcttctacttccagatggatttacagacccgaatactatatgcattgaatatagaacaatttgatgtggcaaaacaattgagggaaaaactcactgagattgaaacggagataattaggcaacgtgaagctaaacgaggttcatcaaagactgaagctcaagacaaagctctgaatcttttacgtgtacgtgcagacttgcagaaagctattgacagtgaaaactatgctgtggcagctggtctgcgtgatgaaatcgccaaacttgaggccgaatctcttgcagtatctgctaaagctcttgcttatcaaaatgtgaagtatgcgtttcgactagggcagaaagtacgtcataatgtacatggatatagaggagtgatatgtggcatggatcctgtatgctgtgaatccaagtcatggatggagacagcaaatgtggagaagctgtctaaaggtccaaatcaaccattttatcaggtcctggttgacgtatacgttgatccagaactacttgtcgcatatgtggcagaagaaaatctttcagcagctgaagaatcagagaaaggaaggtttgatcacccctacattgaatttctattctatggtgaggacacggctggggacttcatccctatcaaacaactccgtgagaagtatgaccagccacgctatgaagcttctggagatgaaaatgacgacgatggcgacacaagtagctgaagggcgagcgccttcatgtagctgaagttgttttggaaccattctgattcaccaccaaccgagatgtgaattattgaggtatctggtacaactgcagatggcatatggtatgcaatgcaaccatc

SEQ ID NO: 22807 - protein, 333 aa, Panicum virgatum
  misc_feature: Ceres CLONE 1823706
  misc_feature (201)..(308): Pfam Name: YccV-like Pfam Description: Hemimethylated DNA-binding protein YccV like
MQGISICGSVASPHGANCRRACVARNSLRLPYEINAVSHGAFSCHWRMHKLHIKINGRRMNATVRTNARWLFGGDGRSSDARLERSESANEDILIFYFQMDLQTRILYALNIEQFDVAKQLREKLTEIETEIIRQREAKRGSSKTEAQDKALNLLRVRADLQKAIDSENYAVAAGLRDEIAKLEAESLAVSAKALAYQNVKYAFRLGQKVRHNVHGYRGVICGMDPVCCESKSWMETANVEKLSKGPNQPFYQVLVDVYVDPELLVAYVAEENLSAAEESEKGRFDHPYIEFLFYGEDTAGDFIPIKQLREKYDQPRYEASGDENDDDGDTSS

SEQ ID NO: 22808 - DNA, 651 bp, Panicum virgatum
  misc_feature: Ceres CLONE 1823710
  misc_feature: Encodes the peptide sequence at SEQ ID NO. 22809
aaaaaaaactccgctccatttccgatccaccgcgctgggccgctggtcatcgttgccctcgccgccgtcgtgcccagagactgggaccttcaaagagcaacaggactcatggaggctggacacgcaggaaacggttctgcagcagcggcacagataaagggaagtggggatgatgcctcctgcaaaccgctgcctccttgctgcgtcaaggccaaggcaggcgtgcctgaagctgaggccaagtgccatgataccgttgtttcaggctggttcactgaaccccagtcgcgcttcggtaaaacaagcaaagtgcagtactacaacaaccctatgtggcctggagaggctcattcactgaaagtggagaagattttgtaccaagggaaatcaccttaccaaaagattttagtttttgagtcttcaacctatggaaacgttcttgtgcttgatggtatagttcagttgactgacaaggatgaatgcgcataccaggaaatggttactcaccttccactgtgctcaattccatcaccgaaaaatgttttggttgttggaggtggtgatggtggtgtactgcgggaaatagccagacatgattcagtggagactattgatatatgtgagattgatcagcttgttattgatgtttgc

SEQ ID NO: 22809 - protein, 180 aa, Panicum virgatum
  misc_feature: Ceres CLONE 1823710
  misc_feature (53)..(180): Pfam Name: Spermine_synth Pfam Description: Spermine/spermidine synthase
  misc_feature: SWISSPROT Homolog: EC 2.5.1.16 Spermidine synthase
MEAGHAGNGSAAAAQIKGSGDDASCKPLPPCCVKAKAGVPEAEAKCHDTVVSGWFTEPQSRFGKTSKVQYYNNPMWPGEAHSLKVEKILYQGKSPYQKILVFESSTYGNVLVLDGIVQLTDKDECAYQEMVTHLPLCSIPSPKNVLVVGGGDGGVLREIARHDSVETIDICEIDQLVIDV

SEQ ID NO: 22810 - DNA, 2007 bp, Panicum virgatum
  misc_feature: Ceres CLONE 1823719
  misc_feature: Encodes the peptide sequence at SEQ ID NO. 22811
atttataaggcgcggcggatgctcgatcgatctcctcctcaaagactcgctcctagatacaccggcgccaccaacagcacagctgctgcgctgcgtgcttgccatggaggccaataataatagtaagcacgggaaggcgtactccgtcgccgaggaagatgctacgactaccaataatatgatgatgaagcagaagcacctctccgacgacgaggccgccgccggcgagccggaggagaactaccgcgggtggaaggccatgccttacgtcatagggaacgagacgtgcgagaagcttggcaccatcggcaccacggccaacctgctggtctacctcaccaccgtctacggcatcaagagcgccagcgccgccacgctgctcagcctctggggcggcaccgtcaacctcgcccccgtcctcggcgccttcctcagcgactcgtacctcggccgctacgccaccatcgccctcgcctccatcgcctccttcgtcggcatgatcctcctcaccctcaccgccgccgtcccctcgctccacccgcacgccggcgcggggccctccgcctcccacatggccgtgctcctcgcctccttcgcgctgctcgccgtcggggccggcggcatccgcccctgcaacctcgccttcggcgccgaccagttcgacccccgcacgcccgccggccgccgcgggatcaacagcttcttcaactggtactacttcaccttcaccatcgccatgatggtctccgccacgttcatcatctacctccagagcaacgtcagctgggcgctcggcctcgccgtcccggccacgctcatgggcctctcctgcgcgctcttcttcatgggcacgcgcctctacgtccgcgtccgccccgagggaagccccttcaccagcttcgcccaggtcgtcgtcgccgcctaccgcaagcgccgcctgcaccgaggtccctgcgacctcttattcgacccgccgcaccggaggagcagcctcgtgtccaagatcgcctacacggaccagttcctgtgcctggacaaggccgccattctcaccgctgacgacgagctcgcggtcacggccgacggcaccacgccggcgaacccgtggcggctgtgcacggtgcagcaggtggaggaggtcaagtgcctggtgcggctgctcccggtgtggtcgtcggggatcgtctactacatcgtgctcaccaacctgggcaactacggcgtgctccaggccatgcagacggaccggcgcctcgggcggtcggggttccagatcccggcggggtccctggtggtgttcaacatgctggcgctcacggcgtggctccccgtgtacgacggcgtggtggtgccggcgctgcagcgggtgaccaagcgcgagggcggcatcacccagctgcagcggatgggcgccggcatcgtgctgtccatcgccaccatggtggcggcggcggcggtggagcggcaccggcgcgcggtgggggacgcgacgtcgtgcttcgtgctggtgccgcagcagatgctggcggggctgtcggaggcgttcgcggtgatcgggcaggtggaactgtactacaagcagttcccggagaacatgcgcagcgtggccggcgcgctgctgttcctgggcttcgccgtggccagctacgccagcgggctgatggtgacggtggtgcaccggacgacgggagggagcgacgggcggccggactggctgacgcaggacctcaaccaggggcgcgtcgacctctactatctggtgatcgcgggcatggccgccgtcaacctcgtctacttcgtggcgtgcgcgcgctggtacaggttcaaggagtcggcggaccacgccggcgccgtcgagctggaggagaaggacaaggtcgttgttgttactgatgcaggcgccgccgcacctccacctccagtatgaagctccgtaccgtacctctccgatgcttaaataatcggaaaagctaagttcgaaaattaaatgaagatgcagcgtcgatc

SEQ ID NO: 22811 - protein, 607 aa, Panicum virgatum
  misc_feature: Ceres CLONE 1823719
  misc_feature (118)..(510): Pfam Name: PTR2 Pfam Description: POT family
MEANNNSKHGKAYSVAEEDATTTNNMMMKQKHLSDDEAAAGEPEENYRGWKAMPYVIGNETCEKLGTIGTTANLLVYLTTVYGIKSASAATLLSLWGGTVNLAPVLGAFLSDSYLGRYATIALASIASFVGMILLTLTAAVPSLHPHAGAGPSASHMAVLLASFALLAVGAGGIRPCNLAFGADQFDPRTPAGRRGINSFFNWYYFTFTIAMMVSATFIIYLQSNVSWALGLAVPATLMGLSCALFFMGTRLYVRVRPEGSPFTSFAQVVVAAYRKRRLHRGPCDLLFDPPHRRSSLVSKIAYTDQFLCLDKAAILTADDELAVTADGTTPANPWRLCTVQQVEEVKCLVRLLPVWSSGIVYYIVLTNLGNYGVLQAMQTDRRLGRSGFQIPAGSLVVFNMLALTAWLPVYDGVVVPALQRVTKREGGITQLQRMGAGIVLSIATMVAAAAVERHRRAVGDATSCFVLVPQQMLAGLSEAFAVIGQVELYYKQFPENMRSVAGALLFLGFAVASYASGLMVTVVHRTTGGSDGRPDWLTQDLNQGRVDLYYLVIAGMAAVNLVYFVACARWYRFKESADHAGAVELEEKDKVVVVTDAGAAAPPPPV

SEQ ID NO: 22812 - DNA, 661 bp, Panicum virgatum
  misc_feature: Ceres CLONE 1823722
  misc_feature: Encodes the peptide sequence at SEQ ID NO. 22813
aagaaaggatttgcgagccaaccaaaaaaccaccaacccgcggcttctcccccgccgtcggcaaacgccggcctccgccgccacccgcctcagtccgttcgtccggcaaccacccgcgcgccgcccatgggctgctcctcctccctaccagccactaatgctggaggtggagggttgaacaatgtcaacagtgggagttctgatattgattcaaagaacttccgagtgaagttggtattacttggagactctggtgttgggaagagctgcatcgttcttcactttgtccgtggtcagtttgaccctacttccaaggtaactgttggtgcatcatttttgtcacaaacattggtattagaggactccacaacagtgaagtttgaaatatgggatactgctggccaagagaggtatgctgccttggcgcctctttactaccggggagctggttctgcaattgttgtctacgacataaccagtccagaatcatttaacaaagcacaatactgggtgaaggaacttcaaaaacatggtggtcctgatatgattatggctttggttggaaataaggctgatctacatgaaaatcgtattgtatcttctcaggaagcacaagagtatgcagaagagaacagtatgtctttcattgagacgtcagcag

SEQ ID NO: 22813 - protein, 178 aa, Panicum virgatum
  misc_feature: Ceres CLONE 1823722
  misc_feature (35)..(178): Pfam Name: Ras Pfam Description: Ras family
  misc_feature (35)..(150): Pfam Name: Miro Pfam Description: Miro-like protein
MGCSSSLPATNAGGGGLNNVNSGSSDIDSKNFRVKLVLLGDSGVGKSCIVLHFVRGQFDPTSKVTVGASFLSQTLVLEDSTTVKFEIWDTAGQERYAALAPLYYRGAGSAIVVYDITSPESFNKAQYWVKELQKHGGPDMIMALVGNKADLHENRIVSSQEAQEYAEENSMSFIETSA

SEQ ID NO: 22814 - DNA, 712 bp, Panicum virgatum
  misc_feature: Ceres CLONE 1823758
  misc_feature: Encodes the peptide sequence at SEQ ID NO. 22815
gcgacgcgactcgccgccgcccccgcccccgctcccgctcccgctctcgctctgcgccccctcctcctcctgctgctggtcctcctcctcgtctccgcgcccctcgctatcggagcagcggccatggccggccacgtcctcggcggcgtgaaggagaaccccgccgccgccaacagcgccgagtccgacgggctcggccgcttcgccgtcgaggagcacaacaagcgccagaacgcgctgctggagttcgtgcgcgtggtggaggccaaggagcaggtggtggccggcacgctgcaccacctcacgctcgaggccatcgaggccgggaggaagaaggtctacgaggcaaaggtctgggtcaagccgtggctcgacttcaaggagctccaggagttcgtccacaagggggacgccaccaccttcaccagcgctgacctcagcgccaagaaaggtggacatgagcctggttggcgtgaggtgcctgtggaggatcctgtggtcaaagatgctgcacaccatgctgtgaagtcaatccaagagaggtctaactccctgtttccctatgaacttcttgagattgttcgtgctaaggcacaggttgtggaagactttgcataatttgacattctgatgaagctgaagagaggcagcaaggaggagaagatcaaagccgaggtccttaagaatctggaaggtgctttcgtgctgaacc

SEQ ID NO: 22815 - protein, 205 aa, Panicum virgatum
  misc_feature: Ceres CLONE 1823758
  misc_feature (48)..(136): Pfam Name: Cystatin Pfam Description: Cystatin domain
ATRLAAAPAPAPAPALALRPLLLLLLVLLLVSAPLAIGAAAMAGHVLGGVKENPAAANSAESDGLGRFAVEEHNKRQNALLEFVRVVEAKEQVVAGTLHHLTLEAIEAGRKKVYEAKVWVKPWLDFKELQEFVHKGDATTFTSADLSAKKGGHEPGWREVPVEDPVVKDAAHHAVKSIQERSNSLFPYELLEIVRAKAQVVEDFA

SEQ ID NO: 22816 - DNA, 1753 bp, Panicum virgatum
  misc_feature: Ceres CLONE 1823783
  misc_feature: Encodes the peptide sequence at SEQ ID NO. 22817
tgcaacccaccaccacccatccgcctcctccccctcttgcctttcccttcccttcgccttaaccctcccctctcctccaccaccaccgcctcttcccctccccccgcgaggcggccgacgctcccatgcccgccggcgcccggcccgacaagcccgagccggaccgcgcggcctagcggtgctgttttctctttttggcaagccggcccgcgagggaagcgatggcgaagccgaccccggtggcctcgccggaggaggcggcggccctgcggcgccggctgaggcggctggtggccacggtggcggccgggagcgccgacgcggaggccttcgacgaggcggccgaggcgctcgccaagctcagggacgccgagctcgccccccgcaaggaccgcgctgttgccgccgccggcggtgtgggcaagggcggcgcggaggccgccgcggtcccggagcagttcctgtgccccatatcctcggagatcatgagggatcccgtcgtcctcgcctccggccagacatatgatcgtcgcttcattcaagaatggttaagtgctggaaaccgaacttgtccacagacccagcaagtcctttcaaatacaattctcatcccgaaccaccttgtcagaagcatgatctcacagtggtgcacggataatgggatcactctgccaccagttgagaaccaagatgaagatctgatcacaaataatgagcggaagacatttagtaaaatatttgagaggatcgcatcatcgtcaagtctatctgagcagagggaagctattaaagatctcaggctgctgaccaagagcaacagttcactgagagcagccattggagagaatccagattcaatctcacagatgatttccactgtatcaaacccagagctagagaacaatgcagatgttctggaagatatggtgacaactattcttaatctttcaattcatgagagcaacaagaagatcattggagatgacccattagcaccccccttcctcataagggccctacagtcaggaaccatggaggcccgcagcaatgctgcagctgccatcttcagtttgtctgctcttaacagcaacaaggtgaagattggtgaactaggcgcgatgagacctctggtggatctcctcgaacacggcagcatgatagcgaagaaagatgcagcgtcagctattttcaacctctgcatgctgcatgagaacaaatcaagggccaccaagagcggggtcatagacgtgaccctgaaggccattgctgatgactcgctcgtggacgagtccctggccatccttgccctgctgtcgggcgaccatgagacagtggaggagattggtgagaccggcggtgtggcctccatgctcggtgtcataaaggaggatcagagcaagcgcaacaaggagaatgccgtggcagtgctgttcgcggtctgcatgtacgaccgcaccaagctgcgggaggtcgtggaggatgagaacctgaacaggtccctggcctggctcgcgcagaatggcacctcgagggcgcgacggaaggctgcagggatccttgacaagatgaagagggccgtgcaccacacccactactcttgctagtgccctgcccgcaccgcccgccatggttgtgtagttatgggaataataaggggctgctggtttcttcgctgtatatataaattcggctgcatatatagctactcttggtctttggtttggtatatatgaggttacagtttcggtcttgt

SEQ ID NO: 22817 - protein, 460 aa, Panicum virgatum
  misc_feature: Ceres CLONE 1823783
  misc_feature (75)..(149): Pfam Name: U-box Pfam Description: U-box domain
  misc_feature (287)..(327): Pfam Name: Arm Pfam Description: Armadillo/beta-catenin-like repeat
MAKPTPVASPEEAAALRRRLRRLVATVAAGSADAEAFDEAAEALAKLRDAELAPRKDRAVAAAGGVGKGGAEAAAVPEQFLCPISSEIMRDPVVLASGQTYDRRFIQEWLSAGNRTCPQTQQVLSNTILIPNHLVRSMISQWCTDNGITLPPVENQDEDLITNNERKTFSKIFERIASSSSLSEQREAIKDLRLLTKSNSSLRAAIGENPDSISQMISTVSNPELENNADVLEDMVTTILNLSIHESNKKIIGDDPLAPPFLIRALQSGTMEARSNAAAAIFSLSALNSNKVKIGELGAMRPLVDLLEHGSMIAKKDAASAIFNLCMLHENKSRATKSGVIDVTLKAIADDSLVDESLAILALLSGDHETVEEIGETGGVASMLGVIKEDQSKRNKENAVAVLFAVCMYDRTKLREVVEDENLNRSLAWLAQNGTSRARRKAAGILDKMKRAVHHTHYSC

SEQ ID NO: 22818 - DNA, 400 bp, Panicum virgatum
  misc_feature: Ceres CLONE 1823797
  misc_feature: Encodes the peptide sequence at SEQ ID NO. 22819
agccgcagcatccaccgccttccggccttgctcccgccgaccgctggaccgagtcgggaagggcgggttggtgaggaggggggaacgcgcgcggagggagcacgcgcgcggatggccccagccggggggaggaaggtggcggtcgcccccgtgcaattcgcctgcaccgacgtcgatgctcagcctctccccgccctccagaggttgattcgagaaccccaccaaaaacgtgcggccattggactctttcaagaaccgctcgaagggcgctatctctgtcaacgtcagaggatgcatttccttcatggtgctctgccctataaaggcaaccctctcctccctagcatgcaccaacttgtacaggacttcgaggttgtgatccctgtcggtttctttgagc

SEQ ID NO: 22819 - protein, 96 aa, Panicum virgatum
  misc_feature: Ceres CLONE 1823797
  misc_feature: SWISSPROT Homolog: EC 3.5.1.53 N-carbamoylputrescine amidase
MAPAGGRKVAVAPVQFACTDVDAQPLPALQRLIREPHQKRAAIGLFQEPLEGRYLCQRQRMHFLHGALPYKGNPLLPSMHQLVQDFEVVIPVGFFE

SEQ ID NO: 22820 - DNA, 605 bp, Panicum virgatum
  misc_feature: Ceres CLONE 1823804
  misc_feature: Encodes the peptide sequence at SEQ ID NO. 22821
agacagacccctgcgaagccaaaacaaaacgagttccgattgatcgcatcatccttctcctccggcgacaaagaggaattagctgctgccctacagactccgaggcgcgcggcggcggcggcagcagcagcaggcagtggcgaagccaccttgactttgcctggtgcacgtgcaccatgtgcaccagggtcatttctatgctagcttcgcccctggcagcaggcgatcatcgccggtgatggcggcggcggaagaagcggtgacggcacgcgcaagcactggcggcggccccgcggctgcgacgaccagccggttcgcggcagcgtgcggcgcgctcatgcctgcacgagaggggggcccgggaagagagggcgcgcggcagcccgaggacccgcataacgatggccgcgccgtgctggaccgtcccgccgagcggctcatcctctgcgaaggcgacctcctggactaccacgccatctgccgcgacgagcagggctgccacggcgtcttccacaccgcctcccccgtcaccgacgaccccgagcaaatggtggagccggcggtgcgcggcacggagtacgtgatcagcgcggcggcggacgccg

SEQ ID NO: 22821 - protein, 122 aa, Panicum virgatum
  misc_feature: Ceres CLONE 1823804
  misc_feature: SWISSPROT Homolog: EC 1.1.1.219 Dihydrokaempferol 4-reductase
  misc_feature: Useful for making plants with altered carbohydrate content
MAAAEEAVTARASTGGGPAAATTSRFAAACGALMPAREGGPGREGARQPEDPHNDGRAVLDRPAERLILCEGDLLDYHAICRDEQGCHGVFHTASPVTDDPEQMVEPAVRGTEYVISAAADA

SEQ ID NO: 22822 - DNA, 217 bp, Panicum virgatum
  misc_feature: Ceres CLONE 1823812
  misc_feature: Encodes the peptide sequence at SEQ ID NO. 22823
cacctccgcacaaccgcgtccgcttcccccccgccacaggagatcccctgcgcccgccgcatccctgtagccgcccctgctgccgccggcgagcccgatccgcagccgccatgtcgccgtcggagccgacgcgtgaggagagcgtgtacatggcgaagctggcggagcaggcggagcggtacgaggagatggtggagttcatggagcgcgtggcgcg

SEQ ID NO: 22823 - protein, 35 aa, Panicum virgatum; identical to SEQ ID NO: 20211
  misc_feature: Ceres CLONE 1823812
  misc_feature: The sequence is a functional homolog of SEQ ID NO 2350 in the 10/374,780 US patent application
  misc_feature: The sequence is a functional homolog of SEQ ID NO 344 in the 10/412,699 US patent application
  misc_feature: The sequence is a functional homolog of SEQ ID NO 790 in the 10/225,066 US patent application
  misc_feature: The sequence is a functional homolog of SEQ ID NO 805 in the 11/479,226 US patent application
  misc_feature: The sequence is a functional homolog of SEQ ID NO 786 in the 11/479,226 US patent application
  misc_feature: The sequence is a functional homolog of SEQ ID NO 789 in the 11/479,226 US patent application
  misc_feature: The sequence is a functional homolog of SEQ ID NO 801 in the 11/479,226 US patent application
  misc_feature: Useful for making plants with modulated water use efficiency
  misc_feature: The sequence is a functional homolog of SEQ ID NO 809 in the 11/479,226 US patent application
  misc_feature: Useful for making plants with modulated drought sensitivity
  misc_feature: The sequence is a functional homolog of SEQ ID NO 797 in the 11/479,226 US patent application
  misc_feature: The sequence is a functional homolog of SEQ ID NO 342 in the 10/412,699 US patent application
  misc_feature: The sequence is a functional homolog of SEQ ID NO 782 in the 11/479,226 US patent application
  misc_feature: The sequence is a functional homolog of SEQ ID NO 793 in the 11/479,226 US patent application

SEQ ID NO: 22824 - DNA, 679 bp, Panicum virgatum
  misc_feature: Ceres CLONE 1823828
  misc_feature: Encodes the peptide sequence at SEQ ID NO. 22825
aagcccgggctttttcctccgcaacaccattgaccaccggagcgggagcgagagctcggaggggagctgaccacccgcgcgccgcggctcccgtggagatagagagcgatcgccgtcggcagctgcggcgggggaggacgagcgagctgaggatgaaggtgcagtgcgacgtgtgcgcggcggaggcggcgtcggtgttctgctgcgccgacgaggccgcgctgtgcgccgcgtgcgaccgccgcgtgcaccgcgccaacaagctcgccggcaagcaccgccgcttctcgctgctcagcccggcgccgccgtcctcgtcgtcggggcagccgccgccgccgctctgcgacatctgccaggagaagaggggcctcctgttctgcaaggaggaccgggcgatcctgtgccgggactgcgacgtgtcggtgcacacggccagcgagctgaccatgcgccacacccggttcctgctcaccggcgtgcgcctctccgccgagccggccgcctgcccgtccccgccgccgccgtcggaggacgagaacagcagcgccagcttctgctgcggcgcggccccgccgcccgcgcccgccaccagccacggcagcgacagcagcagcatctccgagtacctcaccaagacgctccccggctggcacgtcgaggacttcctgatggacga

SEQ ID NO: 22825 - protein, 175 aa, Panicum virgatum
  misc_feature: Ceres CLONE 1823828
  misc_feature (60)..(107): Pfam Name: zf-B_box Pfam Description: B-box zinc finger
  misc_feature (1)..(47): Pfam Name: zf-B_box Pfam Description: B-box zinc finger
  misc_feature: The sequence is a functional homolog of SEQ ID NO 1023 in the 10/666,642 US patent application
  misc_feature: The sequence is a functional homolog of SEQ ID NO 1645 in the 10/374,780 US patent application
  misc_feature: The sequence is a functional homolog of SEQ ID NO 1671 in the 10/412,699 US patent application
  misc_feature: The sequence is a functional homolog of SEQ ID NO 1478 in the 10/666,642 US patent application
  misc_feature: The sequence is a functional homolog of SEQ ID NO 1890 in the 10/412,699 US patent application
  misc_feature: The sequence is a functional homolog of SEQ ID NO 2148 in the 10/374,780 US patent application
  misc_feature: The sequence is a functional homolog of SEQ ID NO 454 in the 11/435,388 US patent application
  misc_feature: The sequence is a functional homolog of SEQ ID NO 676 in the 10/225,066 US patent application
  misc_feature: The sequence is a functional homolog of SEQ ID NO 1024 in the 10/666,642 US patent application
  misc_feature: The sequence is a functional homolog of SEQ ID NO 1646 in the 10/374,780 US patent application
  misc_feature: The sequence is a functional homolog of SEQ ID NO 1672 in the 10/412,699 US patent application
  misc_feature: The sequence is a functional homolog of SEQ ID NO 234 in the 10/666,642 US patent application
  misc_feature: The sequence is a functional homolog of SEQ ID NO 288 in the 10/374,780 US patent application
  misc_feature: The sequence is a functional homolog of SEQ ID NO 582 in the 10/225,066 US patent application
  misc_feature: The sequence is a functional homolog of SEQ ID NO 662 in the 11/435,388 US patent application
  misc_feature: The sequence is a functional homolog of SEQ ID NO 906 in the 10/412,699 US patent application
MKVQCDVCAAEAASVFCCADEAALCAACDRRVHRANKLAGKHRRFSLLSPAPPSSSSGQPPPPLCDICQEKRGLLFCKEDRAILCRDCDVSVHTASELTMRHTRFLLTGVRLSAEPAACPSPPPPSEDENSSASFCCGAAPPPAPATSHGSDSSSISEYLTKTLPGWHVEDFLMD

SEQ ID NO: 22826 - DNA, 668 bp, Panicum virgatum
  misc_feature: Ceres CLONE 1823834
  misc_feature: Encodes the peptide sequence at SEQ ID NO. 22827
agtgatcgcgagccgtgctgtcaccggtagcctctcctcccctcctcttcagcttgttctccgcggcggcggcgtggagcggagccggagggagaagatggtggcggtgatcagggtgcccaagaccaagcgcgccaggcgggagctcctcaagcacgcgcccaagctcgttgagaccggcaaaaagacgctggtcctccatggtaccaagactagtgctgtgttgaactctgtgttgtcagatatttaccacctgaagcgtgataatgctgtgaagttcaccaagaagaatgacagcattagaccttttgaaagtggtggagaatcttctttggagtttttctccctcaagacagactgcagccttatagtgtatggttctcattccaaaaagagacccaacaatctgattttgggaaggacgtatgaccaccacatatatgaccttgttgaagtaggagttgagaactacaaatcgatggaatcttatgtttatgataagaagctggcgccgaaacttggatcaaagcctttctttgccttcataggagaacattttgagagctcggaagacctgaagcatttgaaagaagtgctgcttgatcttttcagaggagaggttgtagagaatctaaaccttgcgggtgtagatcggatctatgtgtgca

SEQ ID NO: 22827 - protein, 190 aa, Panicum virgatum
  misc_feature: Ceres CLONE 1823834
  misc_feature (32)..(189): Pfam Name: Brix Pfam Description: Brix domain
  misc_feature: Useful for making plants with modulated biomass
MVAVIRVPKTKRARRELLKHAPKLVETGKKTLVLHGTKTSAVLNSVLSDIYHLKRDNAVKFTKKNDSIRPFESGGESSLEFFSLKTDCSLIVYGSHSKKRPNNLILGRTYDHHIYDLVEVGVENYKSMESYVYDKKLAPKLGSKPFFAFIGEHFESSEDLKHLKEVLLDLFRGEVVENLNLAGVDRIYVC

SEQ ID NO: 22828 - DNA, 1265 bp, Panicum virgatum
  misc_feature: Ceres CLONE 1823850
  misc_feature: Encodes the peptide sequence at SEQ ID NO. 22829
gttgccttgttcacctcaacaaacctttccccttcccgtcccaaccgccgacttgcctcgcgccgccggctcgccgccgtccatctggccgcccgggcgtcttcctcttctgaatctgaagtggggaagaaaaggaagagagtaaacgaggcctgccgcctgcgctgcgctgcgccccagagtatgcccttctagcacttggatatttggatggatgatgtttatggacgtatagaggtcttcccacaatactttatgccatcaaaagaagctatggagagtcctgatggtctatccacaagtaagaataacctggatacttcaccaagttcacgtggacgttcctggactcctaaacgagctaagggagctgcatctcttttgcgtttgttgtccattccccactttagatggtcgacaagcaatgaagatgaagacaagattgaattgtccagagttgaagtggagtcattacgaactgaaatagcggatgccgaggaaagagaatcccacttaaaagctcggttggaaaatatcgatgaagttttaagatatgctcgtctttctggctatctctacattagaagtcgatggacccaacttcctggggaaccacctattttagatgatgctgatgtggatgactggcttcctcgatttgttgttctgcaagggcagtgtgtgtactattatctcaaatctacagatttgagcccacaagagtcaacactgttgtgtgacattgttgaagtagggcggctcccaaactttgtgccagaagatgaaaagacaagatacgcgttttacctgttgagccgtcaaggcttgaagtttgaatgctccagtacctccgaaattcaggttgattcatgggtgagagcactgaaaagcgattgcaaattgccggatggtgctgctggtgaggatgagacgacgaagacgaggagtagccaagtagaagatgggtcgtcacggtgatcgatcggacacgggtttcgattcccagcaaaggatgctctgctcgccggatgtatgtacattacagcagagtataatttggctcgtgctggtagcaaaaaccttttgtgctagtttctgttaaaaaagttcctccattgaccgagaattagactgaatgtgtataaattactccttgtacatacatacatacatacatgtaaaggaagcagcatatgtagagaggtgcgacacagctggacatggatgtgtagatttccttgctcatcatacgaaattcttttggc

SEQ ID NO: 22829 - protein, 255 aa, Panicum virgatum
  misc_feature: Ceres CLONE 1823850
  misc_feature (116)..(230): Pfam Name: PH Pfam Description: PH domain
MDDVYGRIEVFPQYFMPSKEAMESPDGLSTSKNNLDTSPSSRGRSWTPKRAKGAASLLRLLSIPHFRWSTSNEDEDKIELSRVEVESLRTEIADAEERESHLKARLENIDEVLRYARLSGYLYIRSRWTQLPGEPPILDDADVDDWLPRFVVLQGQCVYYYLKSTDLSPQESTLLCDIVEVGRLPNFVPEDEKTRYAFYLLSRQGLKFECSSTSEIQVDSWVRALKSDCKLPDGAAGEDETTKTRSSQVEDGSSR

SEQ ID NO: 22830 - DNA, 675 bp, Panicum virgatum
  misc_feature: Ceres CLONE 1823854
  misc_feature: Encodes the peptide sequence at SEQ ID NO. 22831
atctcctcagggccatatatgttcaactactgcaactactatatatcatcacatgccatgcgtgtgtaagcaagctacttaagttgcaggcagggggccgggtctttctagtagtcctcctcttacaccagcagctggctagctagctcccacgatgactagctgcttcaacggcggcgccggctggccggagcccgtggtgcgcgtgcaggccgtgtcggacacttgcggcgctacgatcccggagcgttacgtgaagcccctgtcggagcggccgtcgctctcgccagccgccgccggtggcgccgggggcggcccgaacatcccggtggtagacctgtcaatgccggacgcggacgcgacgtccgaagccgtggcggcggcgtgccgggagtggggatttttccaggcggtgaaccacggcgtgcgcccggagctgctgcgcagcgcgcgcgcggcgtggcgcggcttcttccggcagcccgcggaggtgcgcgagcgctacgcgaactcgccggcgacgtacgagggctacggcagccgcctcggcaccgccaagggcggccccctcgactggggcgactactacttcctccacctcctgccgccgtccctcaagagccacgacaagtggccgtccctccctgcctcgctacggtacctcgatcatcgtct

SEQ ID NO: 22831 - protein, 173 aa, Panicum virgatum
  misc_feature: Ceres CLONE 1823854
  misc_feature: SWISSPROT Homolog: EC 1.14.11.19 Leucocyanidin oxygenase
MTSCFNGGAGWPEPVVRVQAVSDTCGATIPERYVKPLSERPSLSPAAAGGAGGGPNIPVVDLSMPDADATSEAVAAACREWGFFQAVNHGVRPELLRSARAAWRGFFRQPAEVRERYANSPATYEGYGSRLGTAKGGPLDWGDYYFLHLLPPSLKSHDKWPSLPASLRYLDHR

SEQ ID NO: 22832 - DNA, 671 bp, Panicum virgatum
  misc_feature: Ceres CLONE 1823864
  misc_feature: Encodes the peptide sequence at SEQ ID NO. 22833
atccctccacagcatccgtcaaggccggcggcatcaggttgtagaagcggccagcggcgcggctccttcctcgaagctgccgtgaaccccggcagtatatcaggtgggtaccctccctctcggctgcggcagaggctgagactagcagcggccgccgccaccaaccgaaccatgtcgcccaccccagcggcggcgcccagcggcgacgaggagttcacggaggtggtggtggtgcggcatggggagacctcctggaacgcctcccgcatcgtccagggacaaatggacccagatctaaatgagattggtagagagcaggccgttgtggtcgctcatcggctgtcaagagaggccaaaccagctgccatatactcttccgatttgaagcgtgctgctgagactgcagaaattatagcaaaagtttgtgatgtatcaaatttggtgctgaatgaggcactgagagaaaggcacatgggatatctccaaggcttgaagtgggatgatgctgtaaataaaaatccagatgttttcaggggctttgatatttttaaaattactgagggctctgatcctgacagcaggaaccaagaaataccaggtggtggagagagtctgaatcagttaactgagcgatgtgtctcctacttgaataagattgcccaagaacacat

SEQ ID NO: 22833 - protein, 166 aa, Panicum virgatum
  misc_feature: Ceres CLONE 1823864
  misc_feature (17)..(166): Pfam Name: PGAM Pfam Description: Phosphoglycerate mutase family
  misc_feature: SWISSPROT Homolog: EC 5.4.2.1 Phosphoglycerate mutase
MSPTPAAAPSGDEEFTEVVVVRHGETSWNASRIVQGQMDPDLNEIGREQAVVVAHRLSREAKPAAIYSSDLKRAAETAEIIAKVCDVSNLVLNEALRERHMGYLQGLKWDDAVNKNPDVFRGFDIFKITEGSDPDSRNQEIPGGGESLNQLTERCVSYLNKIAQEH

SEQ ID NO: 22834 - DNA, 1239 bp, Panicum virgatum
  misc_feature: Ceres CLONE 1823880
  misc_feature: Encodes the peptide sequence at SEQ ID NO. 22835
aaggcggacagcaggaggaggagagagagggagaagatggagggcagggaagaggagcggaagggcatcagcggcggcggcgccgccgtctcggccccgggggcgaacctgaaggacctagtgtcgagggaatactacggccacaagaagaaggtgcactctgtagcatggaactgcctaggcacaaagcttgcttcaggatcgattgatcatactgcacgtgtttggagcattgatcctcatggccattcgaaggttaaagatattgaactgaaaggccacacagatagtgtagatcagctgtgttgggatccaaatcatcctgatacagttgctactgcagctgctgacaagtctattcgtctttgggatgctcgaagtggaaaatgtcaaattattgaactaagtggagaaaacatcaacatcacatataaacatgatggttctcagatagctgttggaaacaaggaggacgaactgacgatattggatgttcgaacgttaaaagttgttaaaaaacacaaggctaattacgagatgaatgagattgcatggaataaagctggagatctattctacatcactactgggctagtgtatttacatttggcaggtttcatgtgctactaaatcagaccagtgaataatatcgatgtttccacatggtttggtgttcatgcaggacacattgaggtggttaaggatcttgagtttttgaagccctgcaaattgaatgctcatacagcagggtgttattgcatcgcaatggatccccttgataggtactttgctgttggaagtgcagattcacttgtcagtctttggaatgtcaaggagttgctatgcattagaaccttcacaaaacttgagtcgccagtaagaacggttagcttcaatcatactggagaattcattgcatatgccagtgaagaccctttcattgatattgccaatgttgagactggacgatcggttcatcagattccatgtaaagcagctatgaatagcgttgaatggaatcccaagtacaacctcctggcctacgcaggggacgacaagaacaaatacgctgatgaaggtgttttccggatattcggatttgaaacacataactgatgctgactagactcccatcatgtagttctcgtagatttacttgggatctatatgtgttgatatatttttgggcgttcaatgcaaccttgatatttattaatattatgctagcctaaactgatc

SEQ ID NO: 22835 - protein, 197 aa, Panicum virgatum
  misc_feature: Ceres CLONE 1823880
  misc_feature (73)..(112): Pfam Name: WD40 Pfam Description: WD domain, G-beta repeat
  misc_feature (27)..(65): Pfam Name: WD40 Pfam Description: WD domain, G-beta repeat
  misc_feature: SWISSPROT Homolog: EC 2.3.1.48 Histone acetyltransferase
MEGREEERKGISGGGAAVSAPGANLKDLVSREYYGHKKKVHSVAWNCLGTKLASGSIDHTARVWSIDPHGHSKVKDIELKGHTDSVDQLCWDPNHPDTVATAAADKSIRLWDARSGKCQIIELSGENINITYKHDGSQIAVGNKEDELTILDVRTLKVVKKHKANYEMNEIAWNKAGDLFYITTGLVYLHLAGFMCY

SEQ ID NO: 22836 - DNA, 585 bp, Panicum virgatum
  misc_feature: Ceres CLONE 1823892
  misc_feature: Encodes the peptide sequence at SEQ ID NO. 22837
atcgaccacacgcacgtcctcctcagacgacgaatccatcatggagctcgggtgagctatggaggatctcccaactccgctgctgctctccacctttgcggtgtccgaggacgtatgctacatcctcttcagcaggaagcgggcgggcaggaagactgcggccactgccgcccggcccgaggggctggcctgtcctaggcaacctgccccaactcggcgggaagacgccccgcacactgcacgagatgaccacggtgtacagcccgctgctgcggctgcgtttccgcagctccaacccggtggtggccagatcagcagccatagcggagcacttcctccgcgtccaccacgcttacttcagctgccgcccgccccactccagcgggaagcacatgacgtacaactaccagtacgtctcgttcgctccctacaggccccggtggcgcacgacgcggaaggtgagcgccgtgaacctcttctccgcgcgcgcgctcgacgacctccgcgccgtccaggaacgggaggccgcgctcatggtgcggtcgctcctgcggcaagggagcgacgcgctgccggtgccgctcg

SEQ ID NO: 22837 - protein, 194 aa, Panicum virgatum
  misc_feature: Ceres CLONE 1823892
  misc_feature: SWISSPROT Homolog: EC 1.14.13.21 Flavonoid 3'-monooxygenase
RPHARPPQTTNPSWSSGELWRISQLRCCSPPLRCPRTYATSSSAGSGRAGRLRPLPPGPRGWPVLGNLPQLGGKTPRTLHEMTTVYSPLLRLRFRSSNPVVARSAAIAEHFLRVHHAYFSCRPPHSSGKHMTYNYQYVSFAPYRPRWRTTRKVSAVNLFSARALDDLRAVQEREAALMVRSLLRQGSDALPVPL

SEQ ID NO: 22838 - DNA, 1091 bp, Panicum virgatum
  misc_feature: Ceres CLONE 1823910
  misc_feature: Encodes the peptide sequence at SEQ ID NO. 22839
aagtagcccagttcgccgaatgcttatctagcaacgaaaggaaattgcccgggcaacctcaaagtccggagctggtggaggagctcatcgccatctaccacccggccgagcgctgcggccccgccgacccgttgctgctgatgcaggtgacggagttctcctgcggcgggttcgtcgtggccgtgacctggaaccatggcgtcgccgacggcgtcgggatggcccagttcctgcaggccgtcggcgagctcgcgcgcgggtcgccgtcgccatcccttgctccggtcagatgggacgaatcgctcctcagcctccctcctcccaccgtccagagcaacaagccgttgggcctcgtctgcctcgacgtcaccgtcccctcgagcacgatcgagcgcatcagagctgagttccacgagcgcgccaactccaatggccgccaccggacttgcaccgagttcgaggcggtcgccaccgtgctatggcagtgccgcactcgcgcgatcgcctccaacccggatttcccggctctgctcaccttcacagctgatgtgcgcaggcatgtgaaggctaaggatggctactacggcaactgcatcgtgacgctgcgagtcatggcgacagccggcacggtggcgaaggcggacgtcaccgacctgatcgagatgatcaagcgtgccaaggatgaggtgcctgaccagctgctcgcgaagaacgacgacggctgcaatggcgacgaccagcagccagccatggatgagaagctgctcgacgagctccggtacaacctgctccacctgtccacgtggcggaacatcggcttcgagaaggtcgacttcggcggagggacgccggagagggtaatgtgctacatgcagccgtcgattcaggaatggccgtattgcgtggtgagcctgccgtgcaaagagaagggcggggccagtagtgttagtgtggtgtcggtctgtgtcaaggaggagcacgcagatgccttcttaggcgtgctagcaaggttcacgtgatttccataaatgtacgagatgaaataatcatggacccctccatttcaaataaaagattattttagcttatcc

SEQ ID NO: 22839 - protein, 338 aa, Panicum virgatum
  misc_feature: Ceres CLONE 1823910
  misc_feature (1)..(337): Pfam Name: Transferase Pfam Description: Transferase family
  misc_feature: SWISSPROT Homolog: EC 2.3.1.167 10-deacetylbaccatin III 10-O-acetyltransferase
VAQFAECLSSNERKLPGQPQSPELVEELIAIYHPAERCGPADPLLLMQVTEFSCGGFVVAVTWNHGVADGVGMAQFLQAVGELARGSPSPSLAPVRWDESLLSLPPPTVQSNKPLGLVCLDVTVPSSTIERIRAEFHERANSNGRHRTCTEFEAVATVLWQCRTRAIASNPDFPALLTFTADVRRHVKAKDGYYGNCIVTLRVMATAGTVAKADVTDLIEMIKRAKDEVPDQLLAKNDDGCNGDDQQPAMDEKLLDELRYNLLHLSTWRNIGFEKVDFGGGTPERVMCYMQPSIQEWPYCVVSLPCKEKGGASSVSVVSVCVKEEHADAFLGVLARFT

SEQ ID NO: 22840 - DNA, 705 bp, Panicum virgatum
  misc_feature: Ceres CLONE 1823921
  misc_feature: Encodes the peptide sequence at SEQ ID NO. 22841
ctgcaagactgactggggaaaagagattggctggatctatggatcagtcacagaagatattctaactggcttcaagatgcattgtcatggttggcggtccatttactgcatacctaaacgacctgcattcaaaggttctgcacctctgaatctttcagatcgtcttcaccaggttcttcgatgggctcttgggtctattgaaattttcttcagcaaccattgccctctttggtatgggtatggtggtggtttgaaatttttggaaagattttcctacatcaactccatcgtatatccttggacgtctattcctctgttggcttactgtacattgcctgccatctgtttgctgacgggaaaatttattactccagagctaaacaatgttgccagcctctggttcatgtcactttttatctgcatctttgctacgagcatcttagaaatgagatggagtggtgttggcattgatgattggtggaggaatgagcagttttgggttattggaggtgtgtcctcgcacctttttgctgtgttccaaggacttctcaaggtcatagctggtgtggatacaagcttcactgtgacatcaaagggtggtgacgatgaagagttctcagagctatatacattcaagtggacaaccttattaatacctccccacactctgctcttgttgaacttcattggtgtggttgctggtgt

SEQ ID NO: 22841 - protein, 234 aa, Panicum virgatum
  misc_feature: Ceres CLONE 1823921
  misc_feature (1)..(234): Pfam Name: Cellulose_synt Pfam Description: Cellulose synthase
  misc_feature: SWISSPROT Homolog: EC 2.4.1.12 Cellulose synthase (UDP-forming)
  misc_feature: The sequence is a functional homolog of SEQ ID NO 26 in US patent 7312377
  misc_feature: Useful for making plants with modulated biomass
  misc_feature: Useful for making plants with altered cell wall content and/or composition
  misc_feature: The sequence is a functional homolog of SEQ ID NO 6 in US patent 7285702
  misc_feature: Useful for making plants with altered carbohydrate content
  misc_feature: The sequence is a functional homolog of SEQ ID NO 2 in US patent 7049481
  misc_feature: Useful for making plants with modulated plant growth and development
CKTDWGKEIGWIYGSVTEDILTGFKMHCHGWRSIYCIPKRPAFKGSAPLNLSDRLHQVLRWALGSIEIFFSNHCPLWYGYGGGLKFLERFSYINSIVYPWTSIPLLAYCTLPAICLLTGKFITPELNNVASLWFMSLFICIFATSILEMRWSGVGIDDWWRNEQFWVIGGVSSHLFAVFQGLLKVIAGVDTSFTVTSKGGDDEEFSELYTFKWTTLLIPPHTLLLLNFIGVVAG

SEQ ID NO: 22842 - DNA, 591 bp, Panicum virgatum
  misc_feature: Ceres CLONE 1823922
  misc_feature: Encodes the peptide sequence at SEQ ID NO. 22843
ccgacgccgcgatgccgatctgcacgccgtcgtcggactcctcggcctcgtcggcctccggcggccgcgcgtggatagtccacgggctggcgctcggcgtggcggcggcggcggccgcgctcggctcgctcgtgttcctgcagccgagcgggttccgcagccgcgcggtggggatcatacccgcgcgcttctcctcctcgcgcttcgagggcaagccgctcgcgcacatcctcggcaagcccatgatccagagaacatgggaaagagttatgttagcttcttccttggaccacgttgttgtggcaacagatgatgagagaattgcggattgttgtccaggatttggagctgatgttataatgacatcagaatcatgcagaaatggatctgagcgctgctgtgacgcacttgaaaagcttgggaaacgttatgatattgttgtcaatattcaaggagatgagcctcttatcgaaccagagataatagatggtgtcgttatggcattgcagcgagctcctgatgcaatgttcagcacagctgttacttctctgacacctgaacatgcatctgatatcaatcgagttaagtgtg

SEQ ID NO: 22843 - protein, 193 aa, Panicum virgatum
  misc_feature: Ceres CLONE 1823922
  misc_feature (53)..(193): Pfam Name: CTP_transf_3 Pfam Description: Cytidylyltransferase
  misc_feature: SWISSPROT Homolog: EC 2.7.7.38 3-deoxy-manno-octulosonate cytidylyltransferase
MPICTPSSDSSASSASGGRAWIVHGLALGVAAAAAALGSLVFLQPSGFRSRAVGIIPARFSSSRFEGKPLAHILGKPMIQRTWERVMLASSLDHVVVATDDERIADCCPGFGADVIMTSESCRNGSERCCDALEKLGKRYDIVVNIQGDEPLIEPEIIDGVVMALQRAPDAMFSTAVTSLTPEHASDINRVKC

SEQ ID NO: 22844 - DNA, 696 bp, Panicum virgatum
  misc_feature: Ceres CLONE 1823953
  misc_feature: Encodes the peptide sequence at SEQ ID NO. 22845
ataccagacgcgcggcacgcgacgcgggaggaggaggagaggcaggagcggcgcggcgacatcgcgaggccagacgcaggcgccgaggaggaggaggagagaccagcgcgcggcccggccatggacaccttcttcctgtcgcacggttcgccgacgctctccatcgacgaggcgatcccggcgcggcacttcttcaagtcgtggctgccggcgagggtcgcgggggaccggccgccgcgcgccatcctcgtcgtctcgggccactgggagacggccacgccggcggtcaacgtcatccgcggcaccaacgacaccatccacgacttctacggcttccccaagcccatgtaccagctcaagtaccccgcccccggcgccccggacgtggcccttcggaccaaggagctcctggagcgcgccgggttcggccccgtgaaggaggaccacagccgcgggctggaccacggcgcgtgggtgccgctgatgctcatgtacccggccgccgacatccccgtgttccagctctcggtgcagaccgaccgcgacggcgcctaccactacaacctcggacgggcgctggcgccgctgcgggaggagggcgtcctcgtcctcggctccggcagcgccacccaccacctccgcaagatggggcccatggacgcgcccgtggcacagtgggccgtcgaattccacgcc

SEQ ID NO: 22845 - protein, 231 aa, Panicum virgatum
  misc_feature: Ceres CLONE 1823953
  misc_feature (42)..(231): Pfam Name: LigB Pfam Description: Catalytic LigB subunit of aromatic ring-opening dioxygenase
IPDARHATREEEERQERRGDIARPDAGAEEEEERPARGPAMDTFFLSHGSPTLSIDEAIPARHFFKSWLPARVAGDRPPRAILVVSGHWETATPAVNVIRGTNDTIHDFYGFPKPMYQLKYPAPGAPDVALRTKELLERAGFGPVKEDHSRGLDHGAWVPLMLMYPAADIPVFQLSVQTDRDGAYHYNLGRALAPLREEGVLVLGSGSATHHLRKMGPMDAPVAQWAVEFH

SEQ ID NO: 22846 - DNA, 1387 bp, Panicum virgatum
  misc_feature: Ceres CLONE 1823959
  misc_feature: Encodes the peptide sequence at SEQ ID NO. 22847
attcattcgaaatccctccgcctctcttctcctctctcatctcggccgcctcctcatctcgccaaccatcgccgccgcaacagggcgggatcagggcggccgtgccggtcccattccgtcccctctccagccgaggaccatataattccaagatcctgatgatggccacagctggttatattgatgattcctgttctgaggttattgatcccccaaagactgaggtactggatgttactgaactcactggcgaccatattcagcagccgccaaaaccaaatgtggtggtgtctagcagtgtgcgtgatcttctggaatgtccagtctgcttgagtgccatgtatcctcctattcatcagtgctctaatggtcatacattgtgctcaggatgcaaaccaagggttcataatcgctgtccaacttgtaggcatgaactgggtaacataagatgccttgctctcgagaaggtggctgcatctcttgaacttccatgcaagtaccagagctttgggtgctcaggcatatatccttactacagcaagctgaagcatgaatctcagtgccaatataggccttacagctgtccatatgctggatctgaatgcacagttgctggtgacattgcatacttggtaaatcacttgaaaaatgaccacaaagttgacatgcacaatggctgcactttcaaccatcgctatgtcaagccaaaccctcatgaagtcgagaatgccacctggatgcttacggtattcagctgctttggccaatacttctgcctacactttgaagcctttcagcttggcatggcacctgtctatattgccttcctgagattcatgggagatgatgcagaagcaaagaactacagctacagcctggaggtgggaggcaccgggcgcaagatgatctggcaaggggtgccacggagcatcagagatagccaccgtaaggtccgtgacagctatgacgggctgatcatccagcggaacatggctctgtttttctcaggaggggacaggaaggagctcaagctgcgggtcactgggagaatatggaaggagcagtaggataatcaggtagccctcttcgcgctgtcctgacctcctgaggtcacgaatcacattagcaagagctgtagccgcatgcaggaaccgacgtttggtattttttttaagcctgctctagtttgctattgtcttttggcttctgtagcctggtgcccggggatgatgtagcacatctcatgtaaaccaggacggtactgatgtagaattggtagagatctcttcgatttgaactgtctaggagctgccattctgtggtataggagaatctaatggcaactcatgagatgcgtatgatatgtgcttgagaattaagtatggtc

SEQ ID NO: 22847 - protein, 301 aa, Panicum virgatum
  misc_feature: Ceres CLONE 1823959
  misc_feature (95)..(294): Pfam Name: Sina Pfam Description: Seven in absentia protein family
MATAGYIDDSCSEVIDPPKTEVLDVTELTGDHIQQPPKPNVVVSSSVRDLLECPVCLSAMYPPIHQCSNGHTLCSGCKPRVHNRCPTCRHELGNIRCLALEKVAASLELPCKYQSFGCSGIYPYYSKLKHESQCQYRPYSCPYAGSECTVAGDIAYLVNHLKNDHKVDMHNGCTFNHRYVKPNPHEVENATWMLTVFSCFGQYFCLHFEAFQLGMAPVYIAFLRFMGDDAEAKNYSYSLEVGGTGRKMIWQGVPRSIRDSHRKVRDSYDGLIIQRNMALFFSGGDRKELKLRVTGRIWKEQ

SEQ ID NO: 22848 - DNA, 1235 bp, Panicum virgatum
  misc_feature: Ceres CLONE 1823961
  misc_feature: Encodes the peptide sequence at SEQ ID NO. 22849
aaaaaaaaaatccaccggcttctcgtggtctccttccaaaccctagcgccgcgccgccccgccccaccgcgccgtcgccgccgccgccgccgccgcgcgcccatggccaagtcgcggccgcccaagcggatcctcgagtcctataccatcaagggatccgacaaagtcatcaagcctggcgattgtgtgctaatgagagcatatgatgcaccaaagccaccctatgtggcaagagttgaggcaattgaggcagcaggatctcgaggcacaaatgtgagagtacgagtcagatggtattataggcctgaggagtccattggtgggaggcgtccttttcacggttccaaggaggtcttcctctctgaccactatgatgtacaaagcgctgacacgatcgaggggaagtgcaatgtccacagcttccggacttatacaaagcttgattctgtcaatgctgaggatttcttctgccgctttgagtataaatcagcgacaggcagcttcgtgcccgaccggattgctgtgttttgcaagtgtgagatgccatacaaccctgatgatcttatgatccaatgtgaggaatgttctgattggtttcaccctgcttgcattgggatgactatcaaagaagcaaagaaacttgaacattttttctgccagacttgtacagccgaaaatgggaagatggcagagaattctcatgaagctacagcacaatcagaagaaaagccagtggagtcaaaaagacggagaagatgatggccctgctgattaatctatgaaaattatgtgcggttgtacaaaagccatctgaggtctgtaatgctatttgttgtcgcagtttgtggctctgggaccccctaatgtctggcacacgctgtacatagtagcttgcaacctgatcatattgttgtattagagagcatactaggatttgcatggtagtgtcggactatcagagtatgtgtaggttatggcagcccaatgccaacatcaggtgatcaagcttctctgggcattttaggactccttcagcatccagaaataatactgccacacagctgggcctggccagtcatcgtgttcgttcttgggaaaactttgtactgtcatgtgaactttgaaattgtccatgtaatgcaagcatctcggtgtggtacctgcaaaattgttgcttggaataggaaacttgattgtaaaaagccagtaatagagaagaaaaatctccatcactc

SEQ ID NO: 22849 - protein, 218 aa, Panicum virgatum
  misc_feature: Ceres CLONE 1823961
  misc_feature (21)..(138): Pfam Name: BAH Pfam Description: BAH domain
  misc_feature (142)..(191): Pfam Name: PHD Pfam Description: PHD-finger
MAKSRPPKRILESYTIKGSDKVIKPGDCVLMRAYDAPKPPYVARVEAIEAAGSRGTNVRVRVRWYYRPEESIGGRRPFHGSKEVFLSDHYDVQSADTIEGKCNVHSFRTYTKLDSVNAEDFFCRFEYKSATGSFVPDRIAVFCKCEMPYNPDDLMIQCEECSDWFHPACIGMTIKEAKKLEHFFCQTCTAENGKMAENSHEATAQSEEKPVESKRRRR

SEQ ID NO: 22850 - DNA, 642 bp, Panicum virgatum
  misc_feature: Ceres CLONE 1823986
  misc_feature: Encodes the peptide sequence at SEQ ID NO. 22851
acccccaccgcggcgacgcatcatcatccactcccctcccaaaaccaccacctcagctcagctcattcctcccaggctcccaccactagtaccacctgatcaacgacgacgacgacgatgccgccgaggccgtggcgaccggtgctggcgtcggccaccaagtgctgcgcggcgtcacgcacgacttctccgccagcttcctgctgggcgagggcggcttcggcgccgtgtacaagggcttcgtcgacgccggcatgcgcccgggcctcgccgcgcagcccgtcgccgtgaagcagctcaacgccggcgggttccagggccaccgcgagtggctcgccgaggtcatcttcctgggccagttccggcacccgcacctcgtcaggctgctgggctactgttgcgaggacgaggagcgcctgctcgtctacgagttcatgccgcgcggcagcctcgagaaccacctcttcaggaggatctcggcgacgctgccgtggggcacccggatcaaggtggccatcggcgccgccaaggggctcgccttcctccacgccgctagcacgcccgtcatctaccgggacttcaaggcctccaacatcctgctcgactcggacttcacggcgaagctgtccgacttcgggctcg

SEQ ID NO: 22851 - protein, 129 aa, Panicum virgatum
  misc_feature: Ceres CLONE 1823986
  misc_feature (4)..(129): Pfam Name: Pkinase_Tyr Pfam Description: Protein tyrosine kinase
  misc_feature: SWISSPROT Homolog: EC 2.7.11.1 Non-specific serine/threonine protein kinase
  misc_feature: Useful for making plants with modulated drought sensitivity
  misc_feature: Useful for making plants with modulated heat sensitivity
  misc_feature: Useful for making plants with altered carbohydrate content
MRPGLAAQPVAVKQLNAGGFQGHREWLAEVIFLGQFRHPHLVRLLGYCCEDEERLLVYEFMPRGSLENHLFRRISATLPWGTRIKVAIGAAKGLAFLHAASTPVIYRDFKASNILLDSDFTAKLSDFGL

SEQ ID NO: 22852 - DNA, 846 bp, Panicum virgatum
  misc_feature: Ceres CLONE 1823986-R
  misc_feature: Encodes the peptide sequence at SEQ ID NO. 22853
gacttcgggctcgccaagatgggccccgagggcgaggacacgcacgtgacgacgcgcgtgatgggcacccacggctacgcggcgccggagtacgtgcagacgggccacctcaacttgaagagcgacgtctacagcttcggcgtcgtgctcctggagctcctcacgggccgccgcgccatggagcacgtccgcggccggagcgcgcacgccgagcagcaggtcaagctcgtcgactggacccgcccttacctcagcggcggcagccgccggctgcgctgcatcatggaccagcgcctggcggggcactactccgtcaagggcgcgcgcgccgtggcgcagctcgcggtgcagtgcacggcgccgcagccgcgggaccggccgcgcatggcagccgtcgtggaggcgctcgagcggctgcaggggctcaaggacatggccgtcagcgtcgggctctggcccgccggcgcgcccgtcgccgggaggaacgccatctccgccaagatccgcgccgaggtcaagagcgccggcgtcaacgccggctcgcgccggaggagcgcctcctccaagctgccatgatcgaattcgaatcgccatcgcgtacttgcattgtatgatcgcgcgcgcgcgggtatatagaaagattttacagttggtttagtatatatataggcgctgtatgagcaaattgagcatgagatgtggtcactggtcaggcaggcgcagaggcagatgagatcacgccctgtatcctcctccatggctgtaccatccatactgcttttggattcatcatgaagcgatcgttttgagaatacgacgatgggatcgatgcagcaggttgtccag

SEQ ID NO: 22853 - protein, 191 aa, Panicum virgatum
  misc_feature: Ceres CLONE 1823986-R
  misc_feature: SWISSPROT Homolog: EC 2.7.11.1 Non-specific serine/threonine protein kinase
  misc_feature: Useful for making plants with modulated heat sensitivity
  misc_feature: Useful for making plants with modulated drought sensitivity
DFGLAKMGPEGEDTHVTTRVMGTHGYAAPEYVQTGHLNLKSDVYSFGVVLLELLTGRRAMEHVRGRSAHAEQQVKLVDWTRPYLSGGSRRLRCIMDQRLAGHYSVKGARAVAQLAVQCTAPQPRDRPRMAAVVEALERLQGLKDMAVSVGLWPAGAPVAGRNAISAKIRAEVKSAGVNAGSRRRSASSKLP

SEQ ID NO: 22854 - DNA, 669 bp, Panicum virgatum
  misc_feature: Ceres CLONE 1823992
  misc_feature: Encodes the peptide sequence at SEQ ID NO. 22855
taaatttttgcttgtccaagctttaaaaagaaagggacatgttgtagctgttactggtgatggcacaaatgacgcccctgcattgcacgaggccgatataggtctttcaatgggcatttcggggacagaagttgctaaagaaagctctgacattataatcctggatgatgacttcacatcagttgtcaaggttgttcgttggggacggtctgtctatgcaaatatacagaaattcattcagttccagcttactgttaatgttgctgcacttgtgattaatgtggttgctgctgtgtcctctggtgatgtgcccctaaatgctgttgagcttctctgggtgaaccttatcatggacacattgggagcccttgcattagccaccgagccaccaactgacaaccttatgaagagaaatcctgttggtcgaagggaacctcttgttacaaatatcatgtggagaaacttgtttgtccaggccctttaccaaatagcagttcttcttatcttcgattttgctggagtaagaattctgcggctgcagaatgaaagccgatataatgctgagaggaaaaagaacaccttcatctttaatacatttgtgttttgccagattttcaatgagttcaatgcacgcaagcccgaggagaggaatgtcttcaaaggtgtaac

SEQ ID NO: 22855 - protein, 222 aa, Panicum virgatum
  misc_feature: Ceres CLONE 1823992
  misc_feature: SWISSPROT Homolog: EC 3.6.3.8 Calcium-transporting ATPase
KFLLVQALKRKGHVVAVTGDGTNDAPALHEADIGLSMGISGTEVAKESSDIIILDDDFTSVVKVVRWGRSVYANIQKFIQFQLTVNVAALVINVVAAVSSGDVPLNAVELLWVNLIMDTLGALALATEPPTDNLMKRNPVGRREPLVTNIMWRNLFVQALYQIAVLLIFDFAGVRILRLQNESRYNAERKKNTFIFNTFVFCQIFNEFNARKPEERNVFKGV

SEQ ID NO: 22856 - DNA, 1378 bp, Panicum virgatum
  misc_feature: Ceres CLONE 1823998
  misc_feature: Encodes the peptide sequence at SEQ ID NO. 22857
aagcgaaacccacccacccgtcgtcccctccatctccacccccatctccatcccctaggtcgcctctgctccaaccgctcctcgacttgatcacgggccgattggggccgattagagtttacgagagtgagggagaggtagggttccgctcccgcgggagatggcgcaggcggtggaggagtggtatcggcagatgcccatcatcacgcgctcctacctcaccgccgccgtcgtcaccaccgtcggctgcaccctcgacatcatctcgccctaccacctctacctcaacccgaagctcgtggtgcagcagtacgagatctggcgcctcgtcaccaacttcctctacttccgcaagatggatttggattttctgttccacatgttttttcttgcacggtactgcaagcttcttgaggagaactcatttagagggagaactgcggactttttctacatgctcttgtttggtgctactgtcctaactggcattgttctaattggagggatgataccttatgtttctgagacatttgcgagaattctgttcttgagcaattcactgacgttcatgatggtttatgtctggagcaagcacaaccccttcatccacatgagctttctgggtttgttcacctttactgctgcctacttaccttgggtccttctggggttctctatccttgttggaagcagcacatgggtggatctcttgggtatgattgctggacatgtgtactattttctggaagatgtatacccacggatgactggccgtcgacccctgaagactccatcgttcatcaaggctctgtttgctgatgacaatgttgttgtggcacgggcgcccaatgctggggttggtgcgggtgcaaggtttggcggtatgggtccagatctccaggtccaatgatgacccgagtctgcgacggatgtgggaggcggcagtttgtttatctgctcaagttgcgagattgtacaaggatcttgtgtatttatacaggctagatgagagttattgtgcataacaaaagattagtagtatctgaggcacctgagtttctcaccccttggcaaggcctaccgaaatgatttatgattgccagacagacaggccacctcatttttctggaacttgttcttgcaatggctaacatctgacctgttaggctggtactctttcatggtaccagtgtagtctaggaaactctttcaaccagagataagttcgccactttggctgtgaaaatttcattggagagttgtaatttcagaatggtgcaaaaaagaaaaaacttaacattgtggattgttgtggttgtttctttgccctcccgattctgttgtttccttgatctgaatttaactttcttgtcgtttc

SEQ ID NO: 22857 - protein, 249 aa, Panicum virgatum
  misc_feature: Ceres CLONE 1823998
  misc_feature (12)..(212): Pfam Name: DER1 Pfam Description: Der1-like family
MAQAVEEWYRQMPIITRSYLTAAVVTTVGCTLDIISPYHLYLNPKLVVQQYEIWRLVTNFLYFRKMDLDFLFHMFFLARYCKLLEENSFRGRTADFFYMLLFGATVLTGIVLIGGMIPYVSETFARILFLSNSLTFMMVYVWSKHNPFIHMSFLGLFTFTAAYLPWVLLGFSILVGSSTWVDLLGMIAGHVYYFLEDVYPRMTGRRPLKTPSFIKALFADDNVVVARAPNAGVGAGARFGGMGPDLQVQ

SEQ ID NO: 22858 - DNA, 1570 bp, Panicum virgatum
  misc_feature: Ceres CLONE 1824010
  misc_feature: Encodes the peptide sequence at SEQ ID NO. 22859
acgctgctcaggcattccaactccagctcctcttctctcttcgttctctcgtctcctcttctcaatcgagcgctcgattgttgaccttctcagctgcacgccgccctgagacatcggaggggggcgtggtgaccggcagatggatccgtggatcagcagccagccttctctgagccttgacctgcacgtcggcctgccgccgctcgccttggccaagcccaaggtgctcgtcgaggagaacttcctgcagcctctcaagaaagaaccagaggtcgcggctctcgagacggagctccagcggatgagcgaggagaacaggtgcctggccgaggcgctcacggcggtggccgccaagtacgaggcgctgcggagccagtacacgcagatggtcgccgcgggcgccaccaccaccggcccgtcctccacgtcggagggcgggtcggtgtcgccgtcgaggaagcgcaagacgagcgagagcctggacaccgcggcggcggcgccgggcgcgcagcacccgcagtacggcctgcacggcgggccgcacccgggcgccgcggcggcggcggaccagacggagtgcacctccggcgagccgtgcaagcgcatccgggaggagtgcaagcccaaggtgtccaagctgtacstgcacgccgacccgtcggacctgagcctggtggtgaaggacggctaccagtggcgcaagtacgggcagaaggtgaccaaggacaacccctgcccgcgggcctacttccggtgctccttcgcgccggcctgccccgtcaagaagaaggtgcagcgcagcgccgacgacaacaccatcctggtggccacgtacgagggcgagcacaaccacggccagcccccgccggcgccggcgcagcaggcgcacgacggcccgggcgccagcaagaacgccgccgccaagccgccgtcgccgcccaggcccgccgccccgccggcgcctcaccacccgcagctccaccaccaccaccaccaccagcagcagcagcagcagcagcagcaagacgtcgctgcggcgatgagcggcgagcccgtgggcgcggcggccgcggcggcgtcggagctgatccggcgcaacctggcggagcacatggcgatgacgctgacgagggaccccagcttcaaggcggccctcgtcagcgcgctgtccggccggatcctcgagctctcgcccaccaaggaataacaaccggggaaaaggggaacgtatcccaataccatcacacgagcttcttcttggttgctcagatttcctcgcagccatggccaaccgggcttggccttcctctgctcactgttctagcaaaacagcaagatcactggtggacgtgaggatctgcagttcggcatcagtatcaaaacgactgaagagtctgcgccgcgcatccggacatggcgcggaccgaagatcaccacggcgggtgatctgacctgaacctgattgaccggcgatggtcgagtttattagcagatcgaaaatagcacaggaaacaacatcaaactgtacaatccttgtaggcaaattattgttcgcccatttttccttgac

SEQ ID NO: 22859 - protein, 355 aa, Panicum virgatum
  misc_feature: Ceres CLONE 1824010
  misc_feature (180)..(240): Pfam Name: WRKY Pfam Description: WRKY DNA -binding domain
  misc_feature: The sequence is a functional homolog of SEQ ID NO 1200 in the 10/374,780 US patent application
  misc_feature: The sequence is a functional homolog of SEQ ID NO 1395 in the 10/412,699 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
  misc_feature (169)..(169): Xaa is any aa, unknown, or other
MDPWISSQPSLSLDLHVGLPPLALAKPKVLVEENFLQPLKKEPEVAALETELQRMSEENRCLAEALTAVAAKYEALRSQYTQMVAAGATTTGPSSTSEGGSVSPSRKRKTSESLDTAAAAPGAQHPQYGLHGGPHPGAAAAADQTECTSGEPCKRIREECKPKVSKLYXHADPSDLSLVVKDGYQWRKYGQKVTKDNPCPRAYFRCSFAPACPVKKKVQRSADDNTILVATYEGEHNHGQPPPAPAQQAHDGPGASKNAAAKPPSPPRPAAPPAPHHPQLHHHHHHQQQQQQQQQDVAAAMSGEPVGAAAAAASELIRRNLAEHMAMTLTRDPSFKAALVSALSGRILELSPTKE

SEQ ID NO: 22860 - DNA, 695 bp, Panicum virgatum
  misc_feature: Ceres CLONE 1824011
  misc_feature: Encodes the peptide sequence at SEQ ID NO. 22861
acgacttcttctggacgcacgctctcatctccgacgaggcggcggacggcatcagcaggtactgcggcaacttcagcgccggcgtgtcggactcggacaagtgcgacgcggcgatgtcggaggccgacgaggcgctgcaggacatcgacatctacaacatctacgcgcccaactgccagtccgccggcctcgtcacgccgccggtcaccgcctcgatcgagagctttgatccgtgcacggattattacgtggaggcctacctcaacgacccggacgtgcagagggcgctccacgccaacgtcacccgcctcgaccacccctggtcggcctgcagtgaagtcttgaggcgctggacagacagcgccacaacggtcctgcctatcatcacggagctcctgaacaacaacatcagggtctgtgtgtacagtggtgacaccgatgggagagtgccggtcacttccagcagatactctgtcaaccagctccagctcccagttgctgctaaatggaggccatggttcagcagcactcagggtgctggagaggtgggtggctacgtcgtgcagtacaagggcaaggaaaagggcagcctcagcctggcaaccgtgagaggagccggccatgaggtccccagctaccagccgaagcgagcgctggtgctcgttcagagtttccttgcaggcaaaccgctccct

SEQ ID NO: 22861 - protein, 230 aa, Panicum virgatum
  misc_feature: Ceres CLONE 1824011
  misc_feature (1)..(227): Pfam Name: Peptidase_S10 Pfam Description: Serine carboxypeptidase
  misc_feature: SWISSPROT Homolog: EC 3.4.16.6 Carboxypeptidase D
DFFWTHALISDEAADGISRYCGNFSAGVSDSDKCDAAMSEADEALQDIDIYNIYAPNCQSAGLVTPPVTASIESFDPCTDYYVEAYLNDPDVQRALHANVTRLDHPWSACSEVLRRWTDSATTVLPIITELLNNNIRVCVYSGDTDGRVPVTSSRYSVNQLQLPVAAKWRPWFSSTQGAGEVGGYVVQYKGKEKGSLSLATVRGAGHEVPSYQPKRALVLVQSFLAGKPL

SEQ ID NO: 22862 - DNA, 688 bp, Panicum virgatum
  misc_feature: Ceres CLONE 1824012
  misc_feature: Encodes the peptide sequence at SEQ ID NO. 22863
atctttttgaggtgatcaactcgagggaagatgttctgaggcgtctcatccgccgctgcgcctacttgaagtatgtcgaggcacggcttggggatcgaaaattgtatgctgatgagatattgaaggatggattctgtttgaacatgattgaaacaccgctctgccctctgaaggtggtcaccaacctgcaggaagctgtttgggatgctgacattgtggtcaatgggttgccatccactgagacaagggaggtgtttgaggagatcagcaagtattggaaggagaggatcagtgtaccggtaataatttccctggcaaaggggatagaagcctcattggatccaattcctcatatcattacacctactcaaatgattagttcggcaactggagttccaactgagaatatactatatcttggaggaccaaacatcgcctcagaaatttataacaaagaatacgcaaatgctcgaatctgtggatccaacaagtggaggaagcctcttgctaagtttttgaggcagccacatttcactgtctgggacaacagtgatcttgtcactcatgaggtgatgggtggcttgaagaatgtctatgcaattggcgctggaatggtggcagctttaacaaatgagagtgcaacaagcaaatctgtatattttgctcattgcacgtcagagatgatatt

SEQ ID NO: 22863 - protein, 228 aa, Panicum virgatum
  misc_feature: Ceres CLONE 1824012
  misc_feature: SWISSPROT Homolog: EC 1.1.1.94 Glycerol-3-phosphate dehydrogenase (NAD(P)(+))
LFEVINSREDVLRRLIRRCAYLKYVEARLGDRKLYADEILKDGFCLNMIETPLCPLKVVTNLQEAVWDADIVVNGLPSTETREVFEEISKYWKERISVPVIISLAKGIEASLDPIPHIITPTQMISSATGVPTENILYLGGPNIASEIYNKEYANARICGSNKWRKPLAKFLRQPHFTVWDNSDLVTHEVMGGLKNVYAIGAGMVAALTNESATSKSVYFAHCTSEMI

SEQ ID NO: 22864 - DNA, 666 bp, Panicum virgatum
  misc_feature: Ceres CLONE 1824058
  misc_feature: Encodes the peptide sequence at SEQ ID NO. 22865
gatgtgtactcgagaaactctataaatccgatcctggagaaactccagtggacatgagaaggtattcagaaaccgtgagttgatcagaacttcagaagcaatgagttacctgctcaagaccaagagggagagggaacccaccctgcgggaacatgcctcggaagaacaagcaaagataaataaggtacaggaatttctgggtgagctgccgacagagatgccggacttcttgtcggacgccaccatccgccgcttcctccatgcaagaaattggagcgtggttcaggccaccaagtctctgaaagaagctgttaaatggaggcgtcagtacaagccagaaaaaatctgttgggaagacattgctgaacgggagaatgaggtgaagagggcgtatataactgactaccttgacaaaaatgggcgtactgtgttggtagcacggccgtcagtaaagagcataacttcagcgaaggaacagatcaaacaactagtgtacaacctggaaaatttgaccatgagctcagagaataatgcaccagaaaatgttgtttgggtaatggacttccaaggatggacactatcaagtacgccatgggcaatagcccgtcaatctctggacataattcagaactattatccggggttggtagctgttgccattctttg

SEQ ID NO: 22865 - protein, 188 aa, Panicum virgatum
  misc_feature: Ceres CLONE 1824058
  misc_feature (12)..(82): Pfam Name: CRAL_TRIO_N Pfam Description: CRAL/TRIO, N-terminus
MSYLLKTKREREPTLREHASEEQAKINKVQEFLGELPTEMPDFLSDATIRRFLHARNWSVVQATKSLKEAVKWRRQYKPEKICWEDIAERENEVKRAYITDYLDKNGRTVLVARPSVKSITSAKEQIKQLVYNLENLTMSSENNAPENVVWVMDFQGWTLSSTPWAIARQSLDIIQNYYPGLVAVAIL

SEQ ID NO: 22866 - DNA, 1078 bp, Panicum virgatum
  misc_feature: Ceres CLONE 1824070
  misc_feature: Encodes the peptide sequence at SEQ ID NO. 22867
tcagttcaaagcagcagcgcctcgccatcagagacaagcacacgagctcagagaagaacaccacacgcatgaccaaccgcatcttctccgccatggcaggggaccaagcgtacatgatccgattcgacggccacttcgacgaccccacgccgagctccgccggcgcggagccgctggcgatgccgcagccgccgccgttcgcggggcgggtgatctcccccgagcaggagcaccaggtcattgtcgccgccctgctgcacgtcgtctccgggtacaccaccgcgccgccggagatcttcccgcccgccgccgcggcgtgccgggtgtgcgggatggagcggtgcctcggctgcgagtttttcggggcagagggcgccgcggcgatcgcattggacggcgcggcgagtaatgtggccggcgcgccgggcgcggcggcggcggcagggcagaggaggcggcggaagaagaagaacaagtaccgcggcgtgcgccagcggccgtgggggaagtgggcggcggagatccgcgacccgcaccgcgcggtgcgcaagtggctcgggacgttcgacaccgccgaggaggccgccaaggcctacgaccgcgccgccatcgagttccgcggcccgcgcgccaagctcaacttcccgttcccggagccgcccgcgggccacgacgaggccagcaacggcgacgcgagcgcggccgccaagtcctcggacaacacgctgtcgctgtcgccgtcgctctgcagcggggacgccgaggagcgggggcagccggcggagtggccgctgggcgggcaggaaacaggggagcagctctgggaaggcctccaggacctgatgaggctggacgaagccgagctctggttcccgccaacttcgaacgcttggaattgaaacgtgcgcgcgagtagatcctagccgttcaagtggttccaaaacgaacatcgtagcctttcattatgactttttttaccagctctgttgtaattatttgatcatagcagagttttgtaaattatgtgtagagtccaaccaactctatgaatcaggcaattttgggagcgtgcctttct

SEQ ID NO: 22867 - protein, 276 aa, Panicum virgatum
  misc_feature: Ceres CLONE 1824070
  misc_feature (135)..(186): Pfam Name: AP2 Pfam Description: AP2 domain
  misc_feature: Useful for making plants with modulated biomass
  misc_feature: Useful for biocontainment applications
  misc_feature: Useful for making plants with altered terpenoid content
  misc_feature: Useful for making plants with modulated flowering time
  misc_feature: The sequence is a functional homolog of SEQ ID NO 151 in the 11/479,226 US patent application
  misc_feature: The sequence is a functional homolog of SEQ ID NO 32 in the 10/412,699 US patent application
  misc_feature: Useful for making plants with altered lignin content
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
  misc_feature: The sequence is a functional homolog of SEQ ID NO 18 in the 10/903,236 US patent application
  misc_feature: The sequence is a functional homolog of SEQ ID NO 2211 in the 10/666,642 US patent application
  misc_feature: The sequence is a functional homolog of SEQ ID NO 78 in the 10/714,887 US patent application
  misc_feature: The sequence is a functional homolog of SEQ ID NO 78 in the 11/435,388 US patent application
  misc_feature: The sequence is a functional homolog of SEQ ID NO 164 in the 10/714,887 US patent application
  misc_feature: The sequence is a functional homolog of SEQ ID NO 164 in the 11/435,388 US patent application
  misc_feature: The sequence is a functional homolog of SEQ ID NO 32 in the 10/903,236 US patent application
  misc_feature: The sequence is a functional homolog of SEQ ID NO 16 in the 10/903,236 US patent application
  misc_feature: The sequence is a functional homolog of SEQ ID NO 2209 in the 10/666,642 US patent application
  misc_feature: The sequence is a functional homolog of SEQ ID NO 76 in the 10/714,887 US patent application
  misc_feature: The sequence is a functional homolog of SEQ ID NO 76 in the 11/435,388 US patent application
  misc_feature: The sequence is a functional homolog of SEQ ID NO 20 in the 10/903,236 US patent application
  misc_feature: The sequence is a functional homolog of SEQ ID NO 2213 in the 10/666,642 US patent application
  misc_feature: The sequence is a functional homolog of SEQ ID NO 80 in the 10/714,887 US patent application
  misc_feature: The sequence is a functional homolog of SEQ ID NO 80 in the 11/435,388 US patent application
  misc_feature: The sequence is a functional homolog of SEQ ID NO 166 in the 10/714,887 US patent application
  misc_feature: The sequence is a functional homolog of SEQ ID NO 166 in the 11/435,388 US patent application
  misc_feature: The sequence is a functional homolog of SEQ ID NO 34 in the 10/903,236 US patent application
  misc_feature: Useful for making plants with altered lutein content
  misc_feature: The sequence is a functional homolog of SEQ ID NO 1464 in the 10/666,642 US patent application
  misc_feature: The sequence is a functional homolog of SEQ ID NO 170 in the 10/225,066 US patent application
  misc_feature: The sequence is a functional homolog of SEQ ID NO 2 in the 10/903,236 US patent application
  misc_feature: The sequence is a functional homolog of SEQ ID NO 278 in the 10/666,642 US patent application
  misc_feature: The sequence is a functional homolog of SEQ ID NO 332 in the 10/374,780 US patent application
  misc_feature: The sequence is a functional homolog of SEQ ID NO 46 in the 10/225,068 US patent application
  misc_feature: The sequence is a functional homolog of SEQ ID NO 8 in the 10/714,887 US patent application
  misc_feature: The sequence is a functional homolog of SEQ ID NO 8 in the 11/435,388 US patent application
  misc_feature: Useful for making plants with altered alkaloid content
  misc_feature: The sequence is a functional homolog of SEQ ID NO 22 in the 10/903,236 US patent application
  misc_feature: The sequence is a functional homolog of SEQ ID NO 2215 in the 10/666,642 US patent application
  misc_feature: The sequence is a functional homolog of SEQ ID NO 82 in the 10/714,887 US patent application
  misc_feature: The sequence is a functional homolog of SEQ ID NO 82 in the 11/435,388 US patent application
  misc_feature: The sequence is a functional homolog of SEQ ID NO 1354 in the 10/666,642 US patent application
  misc_feature: The sequence is a functional homolog of SEQ ID NO 171 in the 11/479,226 US patent application
  misc_feature: The sequence is a functional homolog of SEQ ID NO 18 in the 10/714,887 US patent application
  misc_feature: The sequence is a functional homolog of SEQ ID NO 18 in the 11/435,388 US patent application
  misc_feature: The sequence is a functional homolog of SEQ ID NO 1954 in the 10/374,780 US patent application
  misc_feature: The sequence is a functional homolog of SEQ ID NO 8 in the 10/666,642 US patent application
  misc_feature: The sequence is a functional homolog of SEQ ID NO 8 in the 10/903,236 US patent application
  misc_feature: The sequence is a functional homolog of SEQ ID NO 1466 in the 10/666,642 US patent application
  misc_feature: The sequence is a functional homolog of SEQ ID NO 2136 in the 10/374,780 US patent application
  misc_feature: The sequence is a functional homolog of SEQ ID NO 36 in the 10/714,887 US patent application
  misc_feature: The sequence is a functional homolog of SEQ ID NO 36 in the 11/435,388 US patent application
  misc_feature: The sequence is a functional homolog of SEQ ID NO 368 in the 10/225,066 US patent application
  misc_feature: The sequence is a functional homolog of SEQ ID NO 6 in the 10/903,236 US patent application
  misc_feature: The sequence is a functional homolog of SEQ ID NO 1462 in the 10/666,642 US patent application
  misc_feature: The sequence is a functional homolog of SEQ ID NO 2134 in the 10/374,780 US patent application
  misc_feature: The sequence is a functional homolog of SEQ ID NO 34 in the 10/714,887 US patent application
  misc_feature: The sequence is a functional homolog of SEQ ID NO 34 in the 11/435,388 US patent application
  misc_feature: The sequence is a functional homolog of SEQ ID NO 364 in the 10/225,066 US patent application
  misc_feature: The sequence is a functional homolog of SEQ ID NO 4 in the 10/903,236 US patent application
  misc_feature: Useful for making plants with altered sterol content
MTNRIFSAMAGDQAYMIRFDGHFDDPTPSSAGAEPLAMPQPPPFAGRVISPEQEHQVIVAALLHVVSGYTTAPPEIFPPAAAACRVCGMERCLGCEFFGAEGAAAIALDGAASNVAGAPGAAAAAGQRRRRKKKNKYRGVRQRPWGKWAAEIRDPHRAVRKWLGTFDTAEEAAKAYDRAAIEFRGPRAKLNFPFPEPPAGHDEASNGDASAAAKSSDNTLSLSPSLCSGDAEERGQPAEWPLGGQETGEQLWEGLQDLMRLDEAELWFPPTSNAWN

SEQ ID NO: 22868 - DNA, 1451 bp, Panicum virgatum
  misc_feature: Ceres CLONE 1824074
  misc_feature: Encodes the peptide sequence at SEQ ID NO. 22869
attactttgatccgctgcgcgcggccgatcgagcctgctctagccagcagccagaggagaaagctctaggctagctacaaggaggatggggcgtgcagcgatgcgacggcggccgctgctgccggcgctgctcctcgccctggccgccgccgtcgccgtcgaggtggcccgggccgagccgcaggtgccgtgctacttcgtgttcgaggactcgctcgtggacaacgggaacaacaacgacatcgcgtcgctggcgcgggccaactacccgccctacggcatcgacttccccggcggcgcgaccggccgcttcagcaacggcctcaccaccgtcgacgctatatctcggcttctgggcttcgacgattacatccccgcgtacgccggcgccagcaacgatcagctcctcaccggcgtcaacttcgcctccgctgcagccgggatcagggacgagaccggccagcaactgggccaacggatcagcttcggcgggcagctccagaactaccaggcggcggtgcagcagctggtgagcatcctgggcgacgaggactcggcggcgagccacctgagccggtgcatcttcacggtgggcatgggcagcaacgactacctcaacaactacttcatgccggccgtctactccaccagccagcagtacacgccggagcagttcgccgacgcgctcgccgggcagtacgcgcagcagctccggacgctgtacagcctcggggcccggaaggtggcgctgatgggcgtggggcaggtcgggtgcagccccaacgagctggcgcagcgcagccccgacggcgccacctgcgcggcggagatcaacggcgccatcgacatcttcaaccggaggctcgtcgccctcgtcgaccagttcaacgcgctgcccgaggcgcacttcacctacatcaacgcctacgggatcttcgaggacatcctcagagccccgggctcgcacggcctgacggtgacgaaccgagggtgctgcggggtcgggcggaacaacgggcaggtgacgtgcctgccgttccagacgccgtgcgccaaccgggacgagtacctcttctgggacgccttccaccccacggaggcggccaacatcctcgttggccggagggcgtacagcgcggcgctgccgtccgacgtccacccggtggatcttcgcacgctcgctcagctctagctgctgtattgttttggagcagatgccgccggccacgttcgtactcatgtcgagaggagcgaagcttttagtgcgaaaattacaagcaggttacacgtttaatttcttctgtgtcactagtactcgccaaggagataaatgtgtgcatcttaactacagctatatatatatatatatatatatatatatatatatatatatatatatatatatatatatatatatatatatatatatatatatatatatatatatatat

SEQ ID NO: 22869 - protein, 368 aa, Panicum virgatum
  misc_feature: Ceres CLONE 1824074
  misc_feature (37)..(348): Pfam Name: Lipase_GDSL Pfam Description: GDSL-like Lipase/Acylhydrolase
  misc_feature: SWISSPROT Homolog: EC 3.2.1.51 Alpha-L-fucosidase
  misc_feature: Useful for making plants with modulated phosphate use efficiency
MGRAAMRRRPLLPALLLALAAAVAVEVARAEPQVPCYFVFEDSLVDNGNNNDIASLARANYPPYGIDFPGGATGRFSNGLTTVDAISRLLGFDDYIPAYAGASNDQLLTGVNFASAAAGIRDETGQQLGQRISFGGQLQNYQAAVQQLVSILGDEDSAASHLSRCIFTVGMGSNDYLNNYFMPAVYSTSQQYTPEQFADALAGQYAQQLRTLYSLGARKVALMGVGQVGCSPNELAQRSPDGATCAAEINGAIDIFNRRLVALVDQFNALPEAHFTYINAYGIFEDILRAPGSHGLTVTNRGCCGVGRNNGQVTCLPFQTPCANRDEYLFWDAFHPTEAANILVGRRAYSAALPSDVHPVDLRTLAQL

SEQ ID NO: 22870 - DNA, 221 bp, Panicum virgatum
  misc_feature: Ceres CLONE 1824074-R
tccctctctctcgcgagcgctctctctctctctctctctctatctatatatatatatatatatatatatatatatatatatatatatatatatatatatatatatatatatatatatatatatatatatatatatatatatacagggtttcttctggtttcgctaatgtaatcgaggttgtactcctcttgttgctgttcagaaaaattgcggaccagctc

SEQ ID NO: 22871 - DNA, 1660 bp, Panicum virgatum
  misc_feature: Ceres CLONE 1824092
  misc_feature: Encodes the peptide sequence at SEQ ID NO. 22872
gggccagcaatcccatcccatcccatcgaatcgacgagcgagcaaggtaggaggggggtgattcgattgattgcctggcttccctcccctcaaatcgagatcgaaatccccatgctgatgatgctaggctaggagcctcgatgagattccccttcatcaatttcagttatctgcctgcttccccttcgtccgccggggtgcgcgcgacaagtgcccccgtgcaggttcccttcacttcgcacatccaaccagctgttccgctgcctgatacgcattgccattgaccttatgatcggctacctattcccttcttcagttcttgacgagatacacctttcaagttttgaacaccgtgaaatgatcctctgatccgacatgggcctcaaggaacagcatccgcaacccaacaccactgatcaaactgatgccgtcaactcgcctactgctgatgaccactacaatccggccatcccccgtgtatcaagctgcagcactgataaggattctggcctttcactttgccgggtctgtcattgcgtcgagactgatttcagaggagagtctgccctaggtttcttgggcattgtgccgccttcgagagagccttccgccccaaggaccaacaatgatgctaccaagacttccaccagcaaggatgccatcactgggctaaaggatggaaccaatgctcccaggtttgttgagtttataagccccgagggcgagatattcgtgtgcgctactgacgtcgaatcaggccccctgcatcaacaagatcatcttgtggatctaggctgttcctgcaagaatgagcttgcccttgcgcattatgcctgtgcattgaagtggttcatcagccatggatccactgtgtgtgagatatgtggaagtattgctgcaaatgtaaggcctgacgatttcaacaaggtccttgcgtccttgaaggattatgaagctctcagggaaaggacatctactggggaactctcatacttgcagcatgtgccagacacaggtgttgacccagatgctgttgcggcaatacgaaggcagcggcttagcgagatatcatcttggttcaatcctcataactctcacatggctgtctctcaagggcatgttgatcagccgccacttagtccaagcaataattctgtactggagcatagtattgtggcagcgagacgggtgcatacaagatggaatttggagagtactggagttcttgttgctattggcctagctgtgattgttcttgcatggttggttgctccacatgttggcaaggctgctgtaattggtcttcacatgcttcttggaggtttatgcgcgttgactctagtaatatccatgagatttgttttcccgagaatccagtatgggtctatgcaatattgggcaatcttgtttgtgtcctggttccttgtgtttggtgtttgggcctcacgaactcgcagcatacgctcctcatgagcatgtagaatagcaagagtcactgtggcagagccagattgagttcgccatggcagtgttaggtactgcattcctgtgtatattcaccatactatccatatcggttgcctttttagggagttgttatatttgagatgtatatgcttgacctaagaaaggatggaaaatcatgttatatttgagatgt

SEQ ID NO: 22872 - protein, 365 aa, Panicum virgatum
  misc_feature: Ceres CLONE 1824092
  misc_feature: Useful for making plants with modulated nitrogen use efficiency
MGLKEQHPQPNTTDQTDAVNSPTADDHYNPAIPRVSSCSTDKDSGLSLCRVCHCVETDFRGESALGFLGIVPPSREPSAPRTNNDATKTSTSKDAITGLKDGTNAPRFVEFISPEGEIFVCATDVESGPLHQQDHLVDLGCSCKNELALAHYACALKWFISHGSTVCEICGSIAANVRPDDFNKVLASLKDYEALRERTSTGELSYLQHVPDTGVDPDAVAAIRRQRLSEISSWFNPHNSHMAVSQGHVDQPPLSPSNNSVLEHSIVAARRVHTRWNLESTGVLVAIGLAVIVLAWLVAPHVGKAAVIGLHMLLGGLCALTLVISMRFVFPRIQYGSMQYWAILFVSWFLVFGVWASRTRSIRSS

SEQ ID NO: 22873 - DNA, 673 bp, Panicum virgatum
  misc_feature: Ceres CLONE 1824105
  misc_feature: Encodes the peptide sequence at SEQ ID NO. 22874
tcattgtcatgaacaggcgcaacactgataatctggtggaggatcttttaagcgattttgaatatgaacttcagcctccatatttgttgtatcggaatgctgcacaagaagtaaatggtatttggttttataaccaacatgactgtgaagctgttgctagcctttttggaagaatactgaatgcttacgccaaagtgcccccaaaaccaaaggtgccttccacaaaaaggtctttttcttgacttcctggatccaactgggcaatagtttccacattgtatgctctgtactcttatattagattcacttgtgtagtatcttctaatgtgcacagtgagtttgaagaattggaggctgttccgacatctgctgcaatagatggcccccttgaacctccaccatcatccagttctctagtttccgatgcgcctgatgaatcactggccaattacttcagtggtgctgctagcattgggagtgtatcaagtgcacaaatggctggaagagcgcatccatccactgaagctgttgcatctgcccatgtgccattgattgttccatctgctactccagcacatcaaataactcatcctttagggggttcatcagctccaccactgcccgtccatgatgcaaatgcccacgccagccattcaacaaatcttctaacacc

SEQ ID NO: 22874 - protein, 79 aa, Panicum virgatum
  misc_feature: Ceres CLONE 1824105
  misc_feature (1)..(59): Pfam Name: DCP1 Pfam Description: Dcp1-like decapping family
IVMNRRNTDNLVEDLLSDFEYELQPPYLLYRNAAQEVNGIWFYNQHDCEAVASLFGRILNAYAKVPPKPKVPSTKRSFS

SEQ ID NO: 22875 - DNA, 704 bp, Panicum virgatum
  misc_feature: Ceres CLONE 1824112
  misc_feature: Encodes the peptide sequence at SEQ ID NO. 22876
catgtaatcagctacctgcaaacgccaaacaggcaattcctcacttggtgagcgttataacagcgcgagcattacctcgctccggccactgccaggtcgcctttcctggccagatggcacatcttggtggacggagggtcctgcgtgctgcccccaaactctgtcgtccgcttcatgccatcctagatacagagagaaaattaaggttggacaaatatttcgaagtggagatgactgtacgtgatagtgatcttgacaaatatggagttgtcaataatgccatctatgctagttacatcgataaaggccgagaaatgctgcttgcgggccttggtttcagcacagattcgctagcatccaggggctgtgctttggcaacgtcagagttaaacctcaagtattttgcacctctgaaggataaagacaagtttgtggtaatgatgaggccagtcgaaatcaagggcgtacggatatttgcagagtattttatagaaacgctgccaaatcgtaatgtagttttaaaagcggtgggcagcttcgtttgcctcaacaaagactaccgtccaactcgtgtgttcccggagttgtcaaccaagctgctgcagttcttcgcatcggacgatgacaagctcaattagctttatagttgtctactcgtgggacctcgtgtaataatataataaagatctattcctacataagcc

SEQ ID NO: 22876 - protein, 211 aa, Panicum virgatum
  misc_feature: Ceres CLONE 1824112
  misc_feature (87)..(172): Pfam Name: 4HBT Pfam Description: Thioesterase superfamily
CNQLPANAKQAIPHLVSVITARALPRSGHCQVAFPGQMAHLGGRRVLRAAPKLCRPLHAILDTERKLRLDKYFEVEMTVRDSDLDKYGVVNNAIYASYIDKGREMLLAGLGFSTDSLASRGCALATSELNLKYFAPLKDKDKFVVMMRPVEIKGVRIFAEYFIETLPNRNVVLKAVGSFVCLNKDYRPTRVFPELSTKLLQFFASDDDKLN

SEQ ID NO: 22877 - DNA, 723 bp, Panicum virgatum
  misc_feature: Ceres CLONE 1824141
  misc_feature: Encodes the peptide sequence at SEQ ID NO. 22878
atatagctccgcccgtcgggaggaaggagtagccccgctgtaccagctgccttcctctactcgcttcccttgccgtcctcctcgcctccttcgccgcggcccccctcatccggcgtcgtcttccgccgtccgccgccgggacacccaaagttccaacttccagatcttgtttcttcgatagaatatgtcgtgctttggatgctgtggtgatgaagatgcacaaggagttccagactccaggaatccgtacccaggacaccatccagcaaggactgatgcataccgccctgctgatcaacctcccaagggtcctcagcctgtcaaaatgcaacccattgcagtccctgccattcctgtggatgagattagggaggtgactaagggttttggtgatgaagctctgattggtgagggctcctttggaagagtatattttggtgttctaagaaatggtaggagtgcggcggtcaaaaagctggattccaataagcagcccgaccaagaattcttggcgcaggtgtctatggtgtcaaggttgaagcacgaaaatgttgttgagttgcttggttattgcgctgatgggaccctacgtgtccttgcttacgagtttgctactatgggctctcttcatgatatgcttcatggaagaaaaggtgttaaaggagctcagcctggtccagttttatcatgggcacaacgtgtgaagatagctgtcggggcagc

SEQ ID NO: 22878 - protein, 179 aa, Panicum virgatum
  misc_feature: Ceres CLONE 1824141
  misc_feature (61)..(175): Pfam Name: Pkinase_Tyr Pfam Description: Protein tyrosine kinase
  misc_feature: SWISSPROT Homolog: EC 2.7.11.1 Non-specific serine/threonine protein kinase
MSCFGCCGDEDAQGVPDSRNPYPGHHPARTDAYRPADQPPKGPQPVKMQPIAVPAIPVDEIREVTKGFGDEALIGEGSFGRVYFGVLRNGRSAAVKKLDSNKQPDQEFLAQVSMVSRLKHENVVELLGYCADGTLRVLAYEFATMGSLHDMLHGRKGVKGAQPGPVLSWAQRVKIAVGA

SEQ ID NO: 22879 - DNA, 1861 bp, Panicum virgatum
  misc_feature: Ceres CLONE 1824153
  misc_feature: Encodes the peptide sequence at SEQ ID NO. 22880
atccatcaccacttcttgtctctcatctttcttaccgcccgccgcccgccggccggctttgcaattcattcaacctcccttttcttttcacccggccagagagcttgcgttgtattcttctccgatccagcgtcatcagctcagcctgcagcaggtcccgtcccgggcggccgccttagctttttgccttgccgtttccccccggcttaggaaccctcgaaaagacgcctcaccatctccttggtgtccttgctaactaactccccattaaattcttcttcctcccgccgggagctagctgcccgcccgctcctcccaattgcttcataagctagctagctagctggtcatcagctgcctgctgcccacacgtacccaacgtccccacgccgcgcacgcaaaccggccggcgggagcaccaaccgggccagcagcaggccgggaaagctagcgccacgaccgaccgagcaagctagcttgctagctctattaggtgcccgccgcccgcgcgcgcaattaaaggaggcggctgcaagggaggagaagatcgtcgccgtcgatcgagctgatcggcaaattattagtcttcacggtggtggtgtatccatccatcgacatatatatgcagggcggtggtgatcaaggagggagcctgggcatggacgtgggcttcgccggcggagcccagtgctcgtcgtcctcggcgacggcggcggcggccgccgcagccgcggcggaggcggaggagcggcagctgctcaagggggagatcgcggtgcacccgctgtgcgagcagctggtgacggcgcacgtggggtgcctgcgcgtggcgacgcccatcgaccacctccccctcatcgacgcgcagctggcgcagtccagcggcctcctccactcctacgccgcccaccaccgccccttcctctctccgcacgacaagcacgacctcgactccttcctcgcgcagtacctgatgctgctgtgctcgttccgggagcaactgcagcagcacgtccgggtgcacgccgtggaggccgtcatggcgtgccgcgagatcgagcagtcactgcaggacctgaccggcgcgatgctagaggaaggctcaggggcgaccatgtcggaggatgaggacgaaccaccgatgctggagggggcactggacatgggctcggatgggcacgacatgatgggcttcggcccgctcctgcccaccgactccgagcgctccctcatggagagggtcaggcaggagctcaagatcgagctcaagcagggtttcaagtcaagaatagaggatgtgagggaagaaatccttcggaaaaggagggccgggaagctgcctggggacaccaccagcatcctcaagcaatggtggcagcagcactccaagtggccataccccacggaagacgataaggcgaagcttgttgaagagactggcctgcagctgaaacaaatcaacaactggttcatcaaccagaggaagaggaattggcacaactcccagacgtcaaccctcaaatcaaagcataaaaggtgatggatcggagatcgagctgcacaatgtatacctgacacatataccaacaacgctaatcaaacggagctggaccatggtgactcactaaaaataaaagaggatcgaccgattcaactgtatatctagtcattagtcagaggtgacagtttcatgacacacacacactagttctgaccactggcatatttgtttgctgtgatttttatttgagctcgtatgctcatgcacattattcttgttaattactgtatagatataaagtgtccccactgtacgtatataatctgaggattaattcattccctgtgcaaattaaatacc

SEQ ID NO: 22880 - protein, 305 aa, Panicum virgatum
  misc_feature: Ceres CLONE 1824153
  misc_feature (99)..(154): Pfam Name: KNOX2 Pfam Description: KNOX2 domain
  misc_feature (44)..(88): Pfam Name: KNOX1 Pfam Description: KNOX1 domain
  misc_feature (210)..(231): Pfam Name: ELK Pfam Description: ELK domain
  misc_feature: Useful for making plants with altered carbohydrate content
  misc_feature: Useful for making plants with altered terpenoid content
  misc_feature: Useful for making plants with altered lignin content
  misc_feature: Useful for making plants with altered sterol content
  misc_feature: Useful for making plants with modulated flowering time
  misc_feature: The sequence is a functional homolog of SEQ ID NO 711 in the 10/374,780 US patent application
  misc_feature: The sequence is a functional homolog of SEQ ID NO 713 in the 10/374,780 US patent application
  misc_feature: The sequence is a functional homolog of SEQ ID NO 490 in the 11/435,388 US patent application
  misc_feature: The sequence is a functional homolog of SEQ ID NO 76 in the 10/374,780 US patent application
  misc_feature: The sequence is a functional homolog of SEQ ID NO 882 in the 10/225,066 US patent application
  misc_feature: The sequence is a functional homolog of SEQ ID NO 712 in the 10/374,780 US patent application
  misc_feature: The sequence is a functional homolog of SEQ ID NO 1996 in the 10/374,780 US patent application
  misc_feature: The sequence is a functional homolog of SEQ ID NO 594 in the 11/479,226 US patent application
  misc_feature: The sequence is a functional homolog of SEQ ID NO 604 in the 11/435,388 US patent application
  misc_feature: The sequence is a functional homolog of SEQ ID NO 902 in the 10/225,066 US patent application
  misc_feature: The sequence is a functional homolog of SEQ ID NO 710 in the 10/374,780 US patent application
  misc_feature: The sequence is a functional homolog of SEQ ID NO 709 in the 10/374,780 US patent application
  misc_feature: The sequence is a functional homolog of SEQ ID NO 708 in the 10/374,780 US patent application
MQGGGDQGGSLGMDVGFAGGAQCSSSSATAAAAAAAAAEAEERQLLKGEIAVHPLCEQLVTAHVGCLRVATPIDHLPLIDAQLAQSSGLLHSYAAHHRPFLSPHDKHDLDSFLAQYLMLLCSFREQLQQHVRVHAVEAVMACREIEQSLQDLTGAMLEEGSGATMSEDEDEPPMLEGALDMGSDGHDMMGFGPLLPTDSERSLMERVRQELKIELKQGFKSRIEDVREEILRKRRAGKLPGDTTSILKQWWQQHSKWPYPTEDDKAKLVEETGLQLKQINNWFINQRKRNWHNSQTSTLKSKHKR

SEQ ID NO: 22881 - DNA, 1279 bp, Panicum virgatum
  misc_feature: Ceres CLONE 1824171
  misc_feature: Encodes the peptide sequence at SEQ ID NO. 22882
atcctctcaaaaaaaaaaaaaaaaaacaacgggcatcaggagggttcaaccaatccccctcccttatccccttcctttcccttccgctccttcctccgccatggccaccaccaccatgtccctccgctccctcgccatggccatggccgacgccgcgctcccgccggcgcacaagctcctccccaccgcccccctcccgcttctctcctcctccacccgcgccgcgccgctcctcctccgcgccacccgccgcctgccgctcgtcgcatgctccgacgccgtcgaggcgggcgtcgagtgggcccacgaggaggaggaggaggaggtggtgggcgaggtcttcgacgaggaggttgaggaggccgaggacgaggtggtggcctcgggcgacgaggaggagggtggggacggcgagggggagtacaccgcggtggagccgcccgaggaggccaaggtctacgtagggaacctcccctacgacttcgacagcgagggcctcgcgcagctcttcgaccaggccggcgtcgtcgaggtcgccgaggtcatctacaacagagagtctggccagagccgtgggttcggctttgttaccatgagcaccattgaagaagctgacaaggccattgaaatgttcaaccgttatgacattagcgggaggctcctgaatgtaaacagggcatctcctaggggtgctcgcatggagagacctcctagacaatttgcatctgctttcagagcttatgttggcaacctgccatggcaagtcgatgactccaggctggtgcagttgttcagtgagcatggagaagttgttaatgctacagttgtctatgatagagaaactggacgctcacgaggatttggttttgtaaccatggcaacaaagggtgaacttgacgatgccatttccgccctcgacgggcaggaattggatggccgcccacttcgggtgaatgttgcagcagagcggccccagaggggcttttgatgctgcgatatgagagagatagctgcttattagtaacgagcatggagatacagcagaggagcaatgggacgcttttgcgggagctgatgccaagttgctagatatcctcccttcgcttcctgatgtttggttcttgccacacggcttttgatgctgctctttgcagctgatgttaatgtcttaatatttgctgacactattagttatattgttcaagtaggctactatcctgatatggtgaatggtgatgccataaaagatctcatcgctatatcctgaaggttcttagtg

SEQ ID NO: 22882 - protein, 295 aa, Panicum virgatum
  misc_feature: Ceres CLONE 1824171
  misc_feature (213)..(284): Pfam Name: RRM_1 Pfam Description: RNA recognition motif. (a.k.a. RRM, RBD, or RNP domain)
  misc_feature (119)..(190): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered alkaloid content
  misc_feature: Useful for making plants with modulated biomass
MATTTMSLRSLAMAMADAALPPAHKLLPTAPLPLLSSSTRAAPLLLRATRRLPLVACSDAVEAGVEWAHEEEEEEVVGEVFDEEVEEAEDEVVASGDEEEGGDGEGEYTAVEPPEEAKVYVGNLPYDFDSEGLAQLFDQAGVVEVAEVIYNRESGQSRGFGFVTMSTIEEADKAIEMFNRYDISGRLLNVNRASPRGARMERPPRQFASAFRAYVGNLPWQVDDSRLVQLFSEHGEVVNATVVYDRETGRSRGFGFVTMATKGELDDAISALDGQELDGRPLRVNVAAERPQRGF

SEQ ID NO: 22883 - DNA, 1104 bp, Panicum virgatum
  misc_feature: Ceres CLONE 1824194
  misc_feature: Encodes the peptide sequence at SEQ ID NO. 22884
acctcaagatcttccccaaatccccccaatcatcctctccacccagatttcgtctcctcaggggcggatccaacgtgggaccccgaacccgacggtcgccgccgcctgctcgccgtccggccgtcggccgccgctcgcctcccctccccaggcctgcgcctcccggctcccgccgtccgtcgagccgccaacgccacctcgggagcggtcgcgctggccagcggcaccgcctctcctcctaccgcctgctctcccctcctctccgaccagatccacctattctaactcggaggaactgctacgccgccactgggcggccggccactcctggttggagaccggcaaaatggtttatcactctagttttgttgatgatgatagcatcaccaaagcttgtggctgtcctttgcttccactaaaaactcatataaagggtccagcccccacctctgagccagataaagcggacatagttgatgaagccataaccttctttcgagcaaatgttttcttcaaaaacttccatgtgaaaagcccagcagacaagttactgatctatctgacattttacatcaatattgccctgaaaagattagaaggctgcaggacgatagctgttgggaccaaggccatcattaatctgggcctggagaaagttcctgtgcctggggaaccagggtttcctttccctggacttttcactcttccggtatcccaggaggaagcagaactgttgaggaattatttgaagcagataagggaggaaacaagtggaagactgctcagctgtgcatacagagctaatggctttccaaacaaatggtggttggcatttgcgaagaggaagttcatgaacattgtcatcctttagacgacatagatattttcggcaacaggttagagttgtttgtagaaatcctggtatctcttatgattgctaggcaaatatgcccatgcgttgctacggacagttggtttaattatcatatacgtatagttacccgttgtttaggttggttctaataatgcctgtttgtccaatgcaagagtccttgtatttcacttacctagtcctgtttggaatataaagctgtgtttaagcag

SEQ ID NO: 22884 - protein, 174 aa, Panicum virgatum
  misc_feature: Ceres CLONE 1824194
  misc_feature (1)..(173): Pfam Name: P21-Arc Pfam Description: P21-ARC (ARP2/3 complex 21 kDa subunit)
MVYHSSFVDDDSITKACGCPLLPLKTHIKGPAPTSEPDKADIVDEAITFFRANVFFKNFHVKSPADKLLIYLTFYINIALKRLEGCRTIAVGTKAIINLGLEKVPVPGEPGFPFPGLFTLPVSQEEAELLRNYLKQIREETSGRLLSCAYRANGFPNKWWLAFAKRKFMNIVIL

SEQ ID NO: 22885 - DNA, 547 bp, Panicum virgatum
  misc_feature: Ceres CLONE 1824222
  misc_feature: Encodes the peptide sequence at SEQ ID NO. 22886
cctacccctctccccccccaccgaacctagcctccgggatccaatgcggcgaccctggagcccactcccgtatggcgccggcggcacggcggagctgtggggcgaggcaggcgtcccgggcgctgctgctcttcctgcaccgctcggcgccacactcggcgtgggggtgggcggtcacgttcgcggccgcggtggtgtacgggctgtgggtgtacttcgtgcgggacttctacatgatcagctacgggctggggacctacctgctgttcctcctgatcggcttcctcccccccctggtggaccaggagctcgaggcgctccacccaaggccctggatccccacccgcggctccgaccacttcaagcccttcattcgcctcctcccccagttgaagttctggtatggctccacgaacgcattcttcattgctttcgtcctgaccttcctgtctgtattcgatgttcctgtcttctggccaatacttgtctgctaatggattgtgctctttgtcctgacagtgaagtgaccgatctgtacgtataatca

SEQ ID NO: 22886 - protein, 140 aa, Panicum virgatum
  misc_feature: Ceres CLONE 1824222
  misc_feature (4)..(140): Pfam Name: Rer1 Pfam Description: Rer1 family
MAPAARRSCGARQASRALLLFLHRSAPHSAWGWAVTFAAAVVYGLWVYFVRDFYMISYGLGTYLLFLLIGFLPPLVDQELEALHPRPWIPTRGSDHFKPFIRLLPQLKFWYGSTNAFFIAFVLTFLSVFDVPVFWPILVC

SEQ ID NO: 22887 - DNA, 685 bp, Panicum virgatum
  misc_feature: Ceres CLONE 1824226
  misc_feature: Encodes the peptide sequence at SEQ ID NO. 22888
atttttttcaagactcatgcttgccttctatctaagcactactcctagttagttagctactggtatctctcatctcctccgatccttccttcttgaggctctctgatctatacagtagtacgtagtcaacagtagtataaactgtgtgtagtacgtagactgtctagctaatccaacagctagcacatcagagctgagcagtcaccattcttgtttatcgccacgccatgccgagcgcgactagcagactacctaatcttccagctgggttccgcttccaccccacagatgaggagctcatcgtccactacctcatgaaccaagcttcctccctcccatgccctgtccccatcatcgccgaggtcaacatctaccagtgcaacccatgggaccttcctgccaaagctttgtttggagagaacgagtggtacttcttcagccccagggatcgcaagtaccccaacggcgcccgccccaaccgtgccgccggatccggctactggaaggccaccggcaccgacaaggccatcctgttgactccaacgagcgagaacatcggagtcaagaaagcccttgtgttctatggtggtaagcctcccaagggggtcaagacagactggatcatgcacgagtaccgcctcacaggagctaacaagaccaccaagcgtagaggatcttccatgag

SEQ ID NO: 22888 - protein, 152 aa, Panicum virgatum
  misc_feature: Ceres CLONE 1824226
  misc_feature (11)..(139): Pfam Name: NAM Pfam Description: No apical meristem (NAM) protein
  misc_feature: Useful for making plants with modulated oxidative stress sensitivity
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: Useful for making plants with altered cell wall content and/or composition
  misc_feature: Useful for making plants with altered lignin content
  misc_feature: The sequence is a functional homolog of SEQ ID NO 854 in the 10/374,780 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 851 in the 10/374,780 US patent application
  misc_feature: Useful for making plants with altered alkaloid content
  misc_feature: The sequence is a functional homolog of SEQ ID NO 853 in the 10/374,780 US patent application
  misc_feature: The sequence is a functional homolog of SEQ ID NO 1012 in the 11/435,388 US patent application
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: The sequence is a functional homolog of SEQ ID NO 891 in the 10/374,780 US patent application
  misc_feature: The sequence is a functional homolog of SEQ ID NO 890 in the 10/374,780 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Useful for making plants with modulated water use efficiency
  misc_feature: Useful for making plants with altered terpenoid content
  misc_feature: Useful for making plants with modulated light quality response
  misc_feature: The sequence is a functional homolog of SEQ ID NO 852 in the 10/374,780 US patent application
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: The sequence is a functional homolog of SEQ ID NO 492 in the 11/435,388 US patent application
  misc_feature: The sequence is a functional homolog of SEQ ID NO 741 in the 11/479,226 US patent application
  misc_feature: The sequence is a functional homolog of SEQ ID NO 2472 in the 10/374,780 US patent application
  misc_feature: The sequence is a functional homolog of SEQ ID NO 520 in the 11/435,388 US patent application
  misc_feature: The sequence is a functional homolog of SEQ ID NO 974 in the 10/225,066 US patent application
  misc_feature: Useful for making plants with modulated nitrogen use efficiency
  misc_feature: The sequence is a functional homolog of SEQ ID NO 2592 in the 10/374,780 US patent application
  misc_feature: The sequence is a functional homolog of SEQ ID NO 288 in the 10/225,066 US patent application
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: The sequence is a functional homolog of SEQ ID NO 612 in the 11/435,388 US patent application
  misc_feature: The sequence is a functional homolog of SEQ ID NO 320 in the 10/374,780 US patent application
  misc_feature: The sequence is a functional homolog of SEQ ID NO 850 in the 10/225,066 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: Useful for making plants with modulated light quality sensitivity
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: The sequence is a functional homolog of SEQ ID NO 476 in the 10/666,642 US patent application
  misc_feature: The sequence is a functional homolog of SEQ ID NO 2 in US patent 7230164
  misc_feature: The sequence is a functional homolog of SEQ ID NO 6 in US patent 7230160
  misc_feature: The sequence is a functional homolog of SEQ ID NO 116 in the 10/225,066 US patent application
  misc_feature: The sequence is a functional homolog of SEQ ID NO 2476 in the 10/374,780 US patent application
  misc_feature: The sequence is a functional homolog of SEQ ID NO 88 in the 11/375,241 US patent application
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: Useful for biocontainment applications
  misc_feature: Useful for making plants with modulated biomass
  misc_feature: The sequence is a functional homolog of SEQ ID NO 106 in the 10/225,068 US patent application
  misc_feature: The sequence is a functional homolog of SEQ ID NO 2348 in the 10/374,780 US patent application
  misc_feature: The sequence is a functional homolog of SEQ ID NO 340 in the 10/412,699 US patent application
  misc_feature: The sequence is a functional homolog of SEQ ID NO 778 in the 11/479,226 US patent application
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: The sequence is a functional homolog of SEQ ID NO 2590 in the 10/374,780 US patent application
  misc_feature: The sequence is a functional homolog of SEQ ID NO 286 in the 10/225,066 US patent application
  misc_feature: The sequence is a functional homolog of SEQ ID NO 1365 in the 11/479,226 US patent application
  misc_feature: The sequence is a functional homolog of SEQ ID NO 2474 in the 10/374,780 US patent application
  misc_feature: The sequence is a functional homolog of SEQ ID NO 744 in the 10/225,066 US patent application
  misc_feature: The sequence is a functional homolog of SEQ ID NO 2416 in the 10/374,780 US patent application
  misc_feature: The sequence is a functional homolog of SEQ ID NO 914 in the 10/225,066 US patent application
  misc_feature: The sequence is a functional homolog of SEQ ID NO 328 in the 10/374,780 US patent application
  misc_feature: The sequence is a functional homolog of SEQ ID NO 852 in the 10/225,066 US patent application
  misc_feature: The sequence is a functional homolog of SEQ ID NO 1729 in the 11/479,226 US patent application
  misc_feature: The sequence is a functional homolog of SEQ ID NO 745 in the 11/479,226 US patent application
  misc_feature: The sequence is a functional homolog of SEQ ID NO 1270 in the 10/374,780 US patent application
  misc_feature: The sequence is a functional homolog of SEQ ID NO 1423 in the 10/412,699 US patent application
  misc_feature: The sequence is a functional homolog of SEQ ID NO 898 in the 10/666,642 US patent application
  misc_feature: Useful for making plants with altered carbohydrate content
  misc_feature: The sequence is a functional homolog of SEQ ID NO 142 in the 10/286,264 US patent application
  misc_feature: The sequence is a functional homolog of SEQ ID NO 324 in the 10/412,699 US patent application
  misc_feature: The sequence is a functional homolog of SEQ ID NO 756 in the 11/479,226 US patent application
  misc_feature: The sequence is a functional homolog of SEQ ID NO 310 in the 10/666,642 US patent application
MPSATSRLPNLPAGFRFHPTDEELIVHYLMNQASSLPCPVPIIAEVNIYQCNPWDLPAKALFGENEWYFFSPRDRKYPNGARPNRAAGSGYWKATGTDKAILLTPTSENIGVKKALVFYGGKPPKGVKTDWIMHEYRLTGANKTTKRRGSSM

SEQ ID NO: 22889 - DNA, 630 bp, Panicum virgatum
  misc_feature: Ceres CLONE 1824231
  misc_feature: Encodes the peptide sequence at SEQ ID NO. 22890
gcgtcggattacaaaccgagccacccgcgggcgccgccgccagcgagatggaggccgccggcctgcggctgcccgcgctcggccaccaccaccactactgcggcggcggattcaaacgcggctggctcgaggccgctcggggcgagcggcgccgccgagcgggcggggcctcctgctccccagctctctgctccctcgctgcgagcgggtagtggcaatggcgctgctgttgggcccgtggggagcggcgcggaggcggcgtgcgccaggaggatgcttcatgtcgtgctggtttcgccgctgatcccaggaaatacagggtccatttcaaggacgtgtgctgcgtctgcagtaggtctgcatcttgttgggccattaggtttcaagttagatgacacgaaattgaagcgggcaggattggattattggccatatgttgttgtcaagattcatgactcctgggatgacttccgtgattatttcattaagcaggaaggagaaacaaggctgctggcatttaccaaaagaggaacaagcattcattcagatttctcatacaagccaggggactggctagtatttggttctgaaactaaaggattacctcaagaagaccatgaggattgctgt

SEQ ID NO: 22890 - protein, 209 aa, Panicum virgatum
  misc_feature: Ceres CLONE 1824231
  misc_feature (92)..(209): Pfam Name: SpoU_methylase Pfam Description: SpoU rRNA Methylase family
ASDYKPSHPRAPPPARWRPPACGCPRSATTTTTAAADSNAAGSRPLGASGAAERAGPPAPQLSAPSLRAGSGNGAAVGPVGSGAEAACARRMLHVVLVSPLIPGNTGSISRTCAASAVGLHLVGPLGFKLDDTKLKRAGLDYWPYVVVKIHDSWDDFRDYFIKQEGETRLLAFTKRGTSIHSDFSYKPGDWLVFGSETKGLPQEDHEDC

SEQ ID NO: 22891 - DNA, 1120 bp, Panicum virgatum
  misc_feature: Ceres CLONE 1824234
  misc_feature: Encodes the peptide sequence at SEQ ID NO. 22892
aggctggctgccgccgccccccacccagcagcagcagcagctctcgggagggactcgacgccgccgcccgccgcctccgctactcccatcaccggccgtcgccgtcccgcccttcatggccgggcagtccgacccgcacctctccatcttctcgccctccgaggtggagttcgtggcggaggatgagatcgtcgacatcgtccccaacatccgcatggacgccctcaacatgatatgcggggacttcgggcccttctacccgcaaatcccggccaaggtgccgctctggctcgctgtcgcgctcaagaagcgtggcaagtgcaccatccgcaccccggactggatgactgttgaccgtttgacacaggtactggaagcagaaagagagtcctctcgagaattccagccattaccattccactatattgaaatttctaagctgctgtttgatcatgcacgtgatgacatctcagatgcatacttggtgagatctttggttgaggacatcagagatgtcagattccacaaggttgagactggattagagacaatatctggacgcactcatgctgtgaagctcaaaaatctgtctgcaatggaagtgaacattgtccggcctttcatggtgagaactttgcaggcattctataagcacgatagtccacagatgattcagcaagcagatactacagggagcaggccaacaccagttacagaccgtggtccaagaagagatctaagacgcaggtagtgagcctaatatgcatgtgcctatcacttgtatttgcaaagtatatctgaggacagcagtagttgaaggttggcattgctttctgaggacagcagtagttgaaggttggcattgctttcttgcaatgttacatgctaagaatgtgttaatgtcctgaccccctgagatctatcaattagtaaaggcaatggtgcatcgtccatttattagaagtttttctaagctattatattcgatctggttgtattcagggaaaggtaaagatagtaggcgacggcaataatctctcacaaaaagaagattttgtccctgaatgattgaacaagtgtatgttacagtttggcaattaattacacttaaaagtttgac

SEQ ID NO: 22892 - protein, 211 aa, Panicum virgatum
  misc_feature: Ceres CLONE 1824234
  misc_feature (20)..(167): Pfam Name: Psf2 Pfam Description: Partner of SLD five, PSF2
MAGQSDPHLSIFSPSEVEFVAEDEIVDIVPNIRMDALNMICGDFGPFYPQIPAKVPLWLAVALKKRGKCTIRTPDWMTVDRLTQVLEAERESSREFQPLPFHYIEISKLLFDHARDDISDAYLVRSLVEDIRDVRFHKVETGLETISGRTHAVKLKNLSAMEVNIVRPFMVRTLQAFYKHDSPQMIQQADTTGSRPTPVTDRGPRRDLRRR

SEQ ID NO: 22893 - DNA, 478 bp, Panicum virgatum
  misc_feature: Ceres CLONE 1824238
  misc_feature: Encodes the peptide sequence at SEQ ID NO. 22894
gccccatccccagctacctccgctagctagctagcccgcccgcccaaccaagagggagggtgggccgccagccccgccgccgccgccgccgccagatggacccccccgccgaccccccccggaccgacctgatgaccctccccccgcccctgctgaaccagcagagccggaaccccgagtcccgcggccacctcaccatcccgctctcccccatcgtcctcggctgcaagttcgtcgcctccgccgtccacaaggccgggctcgcgaagctcatcggactcgccggcgagaccaacgtccagggagaggagcagaagaagctggacgtgctgtccaacgaggtgttcgtcaaggccctcgtcagcagcggccgcacctgcatacttgtgtcggaggaggacgaggaggcaaccttcgtggatcctgcgctgcgtgggaagtactgcgtctgctttgatccgcttgatggctcctccaa

SEQ ID NO: 22894 - protein, 127 aa, Panicum virgatum
  misc_feature: Ceres CLONE 1824238
  misc_feature (13)..(127): Pfam Name: FBPase Pfam Description: Fructose-1-6-bisphosphatase
  misc_feature: SWISSPROT Homolog: EC 3.1.3.11 Fructose-bisphosphatase
  misc_feature: Useful for making plants with modulated biomass
MDPPADPPRTDLMTLPPPLLNQQSRNPESRGHLTIPLSPIVLGCKFVASAVHKAGLAKLIGLAGETNVQGEEQKKLDVLSNEVFVKALVSSGRTCILVSEEDEEATFVDPALRGKYCVCFDPLDGSS

SEQ ID NO: 22895 - DNA, 681 bp, Panicum virgatum
  misc_feature: Ceres CLONE 1824252
  misc_feature: Encodes the peptide sequence at SEQ ID NO. 22896
caaaggatgtaatcataaatggagtcattgtgaaggtcaagtactgtgacacctgcatgctgtatcgaccacctcgatgctcgcactgttctatctgtaataactgcgtggagcgctttgatcaccactgtccttgggttgggcaatgcataggattgcgcaattatcggttcttctatatgtttgtattctctacgacattactctgcctatacgtgtttggcttctgctgggtgtacattgtcaagatcagagatgcagagcagttgtcaatctggaaagcaatgttgaaaacgccagcatcaatggttctgatcatctactgcttcatctgtgtgtggtttgtaggtggcctgtctgtcttccatttctacctaatgagcactaaccagacaacctatgaaaacttcagatatcgctatgatcggcgggccaatccatacaacatagggattgtgaacaacttcatggagatcttctgcactgcagtccctccttcaaagaacaatttccgagctagggtcccagcagagcaaggtttacagcaaccacgtgcaccagcaaggggattcatgagcccgaacatgagcaaacctattggagattttgaaatgggtaggaagccggtatcctgggatgaacctaggtcagcagctgatatcagagacttggaggttggtc

SEQ ID NO: 22896 - protein, 226 aa, Panicum virgatum
  misc_feature: Ceres CLONE 1824252
  misc_feature (4)..(68): Pfam Name: zf-DHHC Pfam Description: DHHC zinc finger domain
KDVIINGVIVKVKYCDTCMLYRPPRCSHCSICNNCVERFDHHCPWVGQCIGLRNYRFFYMFVFSTTLLCLYVFGFCWVYIVKIRDAEQLSIWKAMLKTPASMVLIIYCFICVWFVGGLSVFHFYLMSTNQTTYENFRYRYDRRANPYNIGIVNNFMEIFCTAVPPSKNNFRARVPAEQGLQQPRAPARGFMSPNMSKPIGDFEMGRKPVSWDEPRSAADIRDLEVG

SEQ ID NO: 22897 - DNA, 642 bp, Panicum virgatum
  misc_feature: Ceres CLONE 1824270
  misc_feature: Encodes the peptide sequence at SEQ ID NO. 22898
atccaatccatcctcgtccccgtttccatccctgcgaagcatcaggctttaatttttccgtctccgagaatccatccctagctagctcgacccggccggccatggcggcgcggctgcccctggcgatcctgatgctggccctggccgtcgccgggcgcgcggcggcgcaggactacgacttcttctacctcgtgctgcagtggcccgggtcctactgcgacaccaagcagagctgctgctacccctcgtccggcaagccggcggccgacttcggcatccacggcctctggcccaaccgcgacgacggctcctacccgcagaactgcaaccccgacgccgccttcaacccctccaaggtgcgccgccgccgccgcccctcgtgttcttcttcccggccggttgccatgccgttgctgctctgcatgcgtttcatgcatcccgctgtcttctttccaacgtgaaagaagaaaaattggatcagtgattttcttgtttactgttataaaattgaatttgcagtaatcctggttaataaaaaagctgcctttataatctgcaaaataaaagaataatcacattcctgcatgccccaagcaagtactattcgaatattcgttgcagttggcacggtcgtccacggag

SEQ ID NO: 22898 - protein, 119 aa, Panicum virgatum
  misc_feature: Ceres CLONE 1824270
  misc_feature (25)..(119): Pfam Name: Ribonuclease_T2 Pfam Description: Ribonuclease T2 family
  misc_feature: SWISSPROT Homolog: EC 3.1.27.1 Ribonuclease T(2)
MAARLPLAILMLALAVAGRAAAQDYDFFYLVLQWPGSYCDTKQSCCYPSSGKPAADFGIHGLWPNRDDGSYPQNCNPDAAFNPSKVRRRRRPSCSSSRPVAMPLLLCMRFMHPAVFFPT

SEQ ID NO: 22899 - DNA, 688 bp, Panicum virgatum
  misc_feature: Ceres CLONE 1824274
  misc_feature: Encodes the peptide sequence at SEQ ID NO. 22900
gtatagtgattaaatattggcattcagtagctagttgtcgtctagtcccctctcaatctgctgcttgatgtggtggttctaccgcaaggggccctcgggcttcgccggcgcctccacggccgaggaggtcaccgccggcgtagacggccgcggcctggtcgctgtcatcacaggtgcgtcgagtggaatcgggctggagacggcgcgcgtcctggcgctgcgcggtgtgcacgtcgtcatgcccgtccgcaacgtcgccgccgggctcgtagtcaaggagtccatcgtggccaacatccccggcgcaagaattgacgtgctggagctggacctcagctccatggcatcggtaaggagattcgcctccgagttcgagtctctgaacctgcccctgaacattctcatcaacaacgctggagtgatgacaaggaactgcacgtgttcctgcgacggcctggaactgcacttcgcaacaaatcacattggtcactttcttctaacaaacctcctattggagaacatgaagagcgcatgtagggacagcggcgccgagggacggattgtcaatgtgacgtcagcagggcataccatgacttatcctgaagggatacgcttcgataaaattcatgatccttcaggtttgaatgactttattgcttacggccaatccaagcttgccaatatcctt

SEQ ID NO: 22900 - protein, 206 aa, Panicum virgatum
  misc_feature: Ceres CLONE 1824274
  misc_feature (30)..(181): Pfam Name: adh_short Pfam Description: short chain dehydrogenase
  misc_feature: SWISSPROT Homolog: EC 1.3.1.33 Protochlorophyllide reductase
MWWFYRKGPSGFAGASTAEEVTAGVDGRGLVAVITGASSGIGLETARVLALRGVHVVMPVRNVAAGLVVKESIVANIPGARIDVLELDLSSMASVRRFASEFESLNLPLNILINNAGVMTRNCTCSCDGLELHFATNHIGHFLLTNLLLENMKSACRDSGAEGRIVNVTSAGHTMTYPEGIRFDKIHDPSGLNDFIAYGQSKLANI

SEQ ID NO: 22901 - DNA, 712 bp, Panicum virgatum
  misc_feature: Ceres CLONE 1824277
  misc_feature: Encodes the peptide sequence at SEQ ID NO. 22902
attattcgaagccgtacgcccggcagatcgccctcgccactccacttcactggggatctcctcctcctccactccacttctcttcctttgcggcgacgactgggctcgccagctcttccccggcgacgagcaccccccctccccccaagactgcaggtcggttggttaggcagttcggaccggcggcgcggccatggcttccaacggcatcacccccagagatgtatgtgttgttggggttgcacgcacccctatgggtggtttccttggtgccttgtcttccttgcctgcaaccaaacttgggtctatagcaattcaagctgctctgaaaagagcaaacgtggatccagccgttgtgcaggaggtctactttggaaacgtcttgagtgctaatttgggacaagctcctgcaaggcaagctgctctgggtgcagggataccaaacactgttgtctgtaccactgttaacaaagtctgtgcatctggcatgaaagctactatgtttgcagcacagtcaattcaactgggtatcaatgatattgttgtggcaggtggcatggaaagcatgtccaatgccccaaagtacattgctgaagctaggagagggtctcgtttcggacatgacacacttgtcgatggcatgcttaaggatggcctttgggacgtatatggtgattgtgccatgggaatgtgtgccgagctttgtgctgac

SEQ ID NO: 22902 - protein, 172 aa, Panicum virgatum
  misc_feature: Ceres CLONE 1824277
  misc_feature (8)..(172): Pfam Name: Thiolase_N Pfam Description: Thiolase, N-terminal domain
  misc_feature: SWISSPROT Homolog: EC 2.3.1.9 Acetyl-CoA C-acetyltransferase
MASNGITPRDVCVVGVARTPMGGFLGALSSLPATKLGSIAIQAALKRANVDPAVVQEVYFGNVLSANLGQAPARQAALGAGIPNTVVCTTVNKVCASGMKATMFAAQSIQLGINDIVVAGGMESMSNAPKYIAEARRGSRFGHDTLVDGMLKDGLWDVYGDCAMGMCAELCA

SEQ ID NO: 22903 - DNA, 651 bp, Panicum virgatum
  misc_feature: Ceres CLONE 1824291
  misc_feature: Encodes the peptide sequence at SEQ ID NO. 22904
aagttgaggattgggtaaaaacatgctcctagaggcgatatggtcaagtcaatgctgaaataaagaaagtttggagatatttgtatcgtacgatatacaattgctctgatggaattgccgatcataataaggactatatagttgaatttccagacataagtccaagctcgttcagctctcagctttctaaacgaaggggtatgtcaattcagagtaaccataggaggtttttcttaagtgaggtctctggaagcctaccacatccacatctatggtattccacaaaggaggccatcaaagcccttgaactattcctcgatgcaggaaatgatttttcaagaagtctcacatataggtatgaccttgtcgacctaactaggcagtgcctatcaaaactagcaaatgaagtgtaccttgacgcgatgcattcataccagaagaaagatttgagtagcttgaattcaaacacaaggaaatttcttgaaatcattgtggatattgatgtactactggctgctgatgataattttctgctgggcccctggttggaaagtgcaaaaagtcttgctgtcactgacaatgaacgcaagcagtacgagtggaatgccagaacacaggtgacgatgtggtacgacaacaccgagaccgagc

SEQ ID NO: 22904 - protein, 150 aa, Panicum virgatum
  misc_feature: Ceres CLONE 1824291
  misc_feature: SWISSPROT Homolog: EC 3.2.1.50 Alpha-N-acetylglucosaminidase
MSIQSNHRRFFLSEVSGSLPHPHLWYSTKEAIKALELFLDAGNDFSRSLTYRYDLVDLTRQCLSKLANEVYLDAMHSYQKKDLSSLNSNTRKFLEIIVDIDVLLAADDNFLLGPWLESAKSLAVTDNERKQYEWNARTQVTMWYDNTETE

SEQ ID NO: 22905 - DNA, 507 bp, Panicum virgatum
  misc_feature: Ceres CLONE 1824294
  misc_feature: Encodes the peptide sequence at SEQ ID NO. 22906
cgcgccgtgccggctcggtgccccaatctcactcacaccccgcgccacccgcgatgacgccggcagcgatctcccgctccagcgcccacctcgccctcgcctccgccgagctcaggcagcccctcacccgccctccgcgagccgcgcgacctctcccacccccttcgcccgtggcccgctgcggggccgcgcgccgacgccgtgtccacttgcggcgcgcccgcagccgcggggacagatgcccgacaggctcgtgaggattctcttggtatcactgattttgacaaggatacgatattgaatctcccccatcgccccattcaggctaagacacgaatgaaatctgcacactggatcttcctcccgatcaaagggacatccatggccatgactgctgccaagccgtcaatgacaccagatgtttctcttgagacaggattcttcttacatggtgggcatgctatccatgtgggtcctgatgatatccaactgggcctccgtgaggag

SEQ ID NO: 22906 - protein, 56 aa, Panicum virgatum
  misc_feature: Ceres CLONE 1824294
  misc_feature: SWISSPROT Homolog: EC 2.1.3.3 Ornithine carbamoyltransferase
  misc_feature: Useful for making plants with modulated nitrogen use efficiency
MKSAHWIFLPIKGTSMAMTAAKPSMTPDVSLETGFFLHGGHAIHVGPDDIQLGLRE

SEQ ID NO: 22907 - DNA, 1325 bp, Panicum virgatum
  misc_feature: Ceres CLONE 1824298
  misc_feature: Encodes the peptide sequence at SEQ ID NO. 22908
acgttccaccaggtcaccgcttccgcgatcgggcaacgcaaccgcctcctcccccggcaccgccaccacccccacgctccgcacgccgccgtcggggcctcctgctctcccctcatatactccgactccaccagccgccgcccctctgcctttcctcctgcagcctccagatctccctctcccccggtccgttcacacacactcgtgaagagcgtgtgcaagcgcaggcaaagcgcacacacccatggcgcctctgctcctgctcttcctcctctgcggcctctgcgccctcttctcgctcaccacctcctcgcgcgccggcgccggcgccaagaagggcggcggcgctgggggacggggcgaggaagcaggcgcggcccgacccggaggcggacctgggcatcgtcttctccacgttcgaccacgacggcgacggcttcatcacggcggtcgagctggaggagtcgctgcgccggctcggcatcgccgtgtccgccgacgaggccgccgccatggtggcgcgcgtcgacgccaacagcgacgggctcatcgacatccacgagttccgggagctctacgattccatacccaagaagcggaagcaccagcaccccgccgccgatctcggcgcggcgagtagggaggtgcccgtggaggacgccgaggaagaagaggccggggaggaggaggaggaggaggagagggacctgcgggaggcgttcgacgtcttcgacggcaacaaggacgggctcatctccgctgaggagctcggcaccgtgctgggctccctcggcctgcgccgcgccggcgccggcaggcccgccgtcgccgagtgccgcgacatgatacgcctcgtcgacagcgacggcgacggcatggtcagcttcgaggagttcaagcgcatgatgaccgtcgtcaaggcctaagctcctcctcttctcctcacagatcaaatacggagtataaccaaaacctggagctgatttatttgcaaaggcaagtaacgttattttgttcttggatcggaacagtttcatcgtgttgttagtagaagcgcgatcaattaacaccaggagctcgtatttgtttatggggagttgaaagctggatcgagtagcttctcgctctgtgtttctcccctgttcttgaatcttcttcacttcctcctcctcctcctcctcctttccagtctaattatttcatacttcttcttagttctggttactgttttgactgacaagcatcagacatgtatgtaaatattagttcttgctcgctgtcaggttgatctgtggaaaaagaacaacaggatgaatggaaatccg

SEQ ID NO: 22908 - protein, 307 aa, Panicum virgatum
  misc_feature: Ceres CLONE 1824298
  misc_feature (277)..(305): Pfam Name: efhand Pfam Description: EF hand
  misc_feature (235)..(263): Pfam Name: efhand Pfam Description: EF hand
VPPGHRFRDRATQPPPPPAPPPPPRSARRRRGLLLSPHILRLHQPPPLCLSSCSLQISLSPGPFTHTREERVQAQAKRTHPWRLCSCSSSSAASAPSSRSPPPRAPAPAPRRAAALGDGARKQARPDPEADLGIVFSTFDHDGDGFITAVELEESLRRLGIAVSADEAAAMVARVDANSDGLIDIHEFRELYDSIPKKRKHQHPAADLGAASREVPVEDAEEEEAGEEEEEEERDLREAFDVFDGNKDGLISAEELGTVLGSLGLRRAGAGRPAVAECRDMIRLVDSDGDGMVSFEEFKRMMTVVKA

SEQ ID NO: 22909 - DNA, 623 bp, Panicum virgatum
  misc_feature: Ceres CLONE 1824306
  misc_feature: Encodes the peptide sequence at SEQ ID NO. 22910
acacattcacaccccaaagcagcgcagccgcctcattcctcctctccatcctcctctctctctctctcgcgcgccgctcttcccgttccgttccaggagagcagtgaggcgggtagtagtggtcggggaggggaggcaagatgttcatcgagagcttccacgagggcaaggacggcgcctcccgctgggtcgtccgccccaagtccgtcaagtacaacttccggaccagcaccgccgtccccaagctcggggtgatgctcgtggggtggggcggcaacaacgggtccacgctgacggctggggtcatcgccaacagggaggggatctcatgggcgaccaaggacaaggtgcagcaagccaactacttcggctccctcactcaggcctccaccatcagggttggcagctacaacggggaggagatctacgcgccgttcaagagcctcctgcccatggtaaaccctgatgacattgtgttcggaggctgggacatcagcaacatgaacctggccgatgccatgacaagggccaaggtgctggacattgacctgcagaagcagctcaggccctacatggagtccatggtgccactccccggcatctatgatccggacttcatcgca

SEQ ID NO: 22910 - protein, 160 aa, Panicum virgatum
  misc_feature: Ceres CLONE 1824306
  misc_feature (36)..(160): Pfam Name: NAD_binding_5 Pfam Description: Myo-inositol-1-phosphate synthase
  misc_feature: SWISSPROT Homolog: EC 5.5.1.4 Inositol-3-phosphate synthase
MFIESFHEGKDGASRWVVRPKSVKYNFRTSTAVPKLGVMLVGWGGNNGSTLTAGVIANREGISWATKDKVQQANYFGSLTQASTIRVGSYNGEEIYAPFKSLLPMVNPDDIVFGGWDISNMNLADAMTRAKVLDIDLQKQLRPYMESMVPLPGIYDPDFI

SEQ ID NO: 22911 - DNA, 625 bp, Panicum virgatum
  misc_feature: Ceres CLONE 1824307
  misc_feature: Encodes the peptide sequence at SEQ ID NO. 22912
ctcttctctcaccccggcgtcgctagggttttgagttttgactcctaaaccgcgacgccatgatgcaaccgccgccgccggaacagcaccaggtatgggcaatggcgcccccgcccccgccgcagtactaccaggcggggcaccccccaccgccgcccccgcagttctaccaggcggggcctccgccgcccgccatgtggggccagccgccgccgcaggaggcgcccgcgccggcaccgtccggaggtgcgggaggggacgaggccaggaccctctggatcggggacttgcagtactggatggacgagaactacctctacagctgcttctcccaggacggcgaggttatttcagtgaagataattcggaacaagcagactgggcaacctgagggttatggttttattgaatttggcaaccatgctttagctgaacaagttctccataattataatggtcaaatgatgcctaatggcaaccaacctttcaaattgaattgggctactagtggggctggtgagaaacgtggatatgatggttcagattatactatatttgttggggatctggcctcggatgttacagatttcattctacaagatacattcaagagtcgttatccatc

SEQ ID NO: 22912 - protein, 143 aa, Panicum virgatum
  misc_feature: Ceres CLONE 1824307
  misc_feature (27)..(99): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered terpenoid content
  misc_feature: The sequence is a functional homolog of SEQ ID NO 536 in the 10/666,642 US patent application
  misc_feature: The sequence is a functional homolog of SEQ ID NO 1484 in the 10/666,642 US patent application
  misc_feature: The sequence is a functional homolog of SEQ ID NO 278 in the 10/714,887 US patent application
  misc_feature: The sequence is a functional homolog of SEQ ID NO 278 in the 11/435,388 US patent application
  misc_feature: The sequence is a functional homolog of SEQ ID NO 252 in the 10/714,887 US patent application
  misc_feature: The sequence is a functional homolog of SEQ ID NO 252 in the 11/435,388 US patent application
  misc_feature: The sequence is a functional homolog of SEQ ID NO 568 in the 10/666,642 US patent application
MWGQPPPQEAPAPAPSGGAGGDEARTLWIGDLQYWMDENYLYSCFSQDGEVISVKIIRNKQTGQPEGYGFIEFGNHALAEQVLHNYNGQMMPNGNQPFKLNWATSGAGEKRGYDGSDYTIFVGDLASDVTDFILQDTFKSRYP

SEQ ID NO: 22913 - DNA, 600 bp, Panicum virgatum
  misc_feature: Ceres CLONE 1824343
  misc_feature: Encodes the peptide sequence at SEQ ID NO. 22914
gaagacaaactttctcctgatctcctcccttgctcgagatcttccttccctggcggcgacgactgggagagcggcggcccagccctttgccggcgacgagcgcatcctccaggtgccaggatgtccaatgtgaccgtgtgcgtgcggttcaggccgctgagtcacaaagagaggaaggctaatggtgacaatgtctgcttcaggaaactggactccgagtcctttgttttcaaggatgagagggaagaagatgttatattcagctttgacaaggtgttctatgaagatgcacaacagtctgatgtctatgacttccttgcagtgcccattgtttcagatgccatcaacggaataaatgggactataattacttatggtcagactggggctggaaagacatatagcatggagggaccgagcatcttgcactgcaatgagcagaaaactggactggtacagcgagttgtggatgagctatttgtatgtttaagatcatcaccaagcacatggactgttaagttgtcaatggtggagatatatttggaaaaagtgagggaccttcttgatttgtccaaagacaacctacagatcaaggagagt

SEQ ID NO: 22914 - protein, 159 aa, Panicum virgatum
  misc_feature: Ceres CLONE 1824343
  misc_feature (9)..(158): Pfam Name: Kinesin Pfam Description: Kinesin motor domain
MSNVTVCVRFRPLSHKERKANGDNVCFRKLDSESFVFKDEREEDVIFSFDKVFYEDAQQSDVYDFLAVPIVSDAINGINGTIITYGQTGAGKTYSMEGPSILHCNEQKTGLVQRVVDELFVCLRSSPSTWTVKLSMVEIYLEKVRDLLDLSKDNLQIKE

SEQ ID NO: 22915 - DNA, 635 bp, Panicum virgatum
  misc_feature: Ceres CLONE 1824346
  misc_feature: Encodes the peptide sequence at SEQ ID NO. 22916
aagaactgcacccgaagcatcgcccgattggtattgggcgatcgattggtcgatcgggggcggaggaagggggaggcccgggaggaggcggggagatggcggcgtgccggggattcttcgagtgcctgctcaggctgctcaacttcttcctcaccgtcgccggcctcgccatggtcgggtacgggatctaccttctcgtcgagtggatgaagatatccggcggcgggggctcgccggcgcacgtgctcgtcctcggccggccgttgctcggggccgtcgcgctaggtgacagcttcctcgaccatctaccaaaagcatggtttatttatttgttcatcggtgttggtgctatcgtcttcctcgtgtctctgtttggctgcatcggtgcagggacaagaaacacctgctgcttgtgtttctatgctttcttggtcttattgttgatccttgctgaggctggagctgccgcgttcatcttctttgaccatagctggatagatgtaataccaaaggacaagacacgtaacttcgatgttatgtatgactttctgaaggataactgggagattgcaagatgggttgctctcggcgttgttgtttttgaggccgtgcttttcctgttagctctgactgtc

SEQ ID NO: 22916 - protein, 179 aa, Panicum virgatum
  misc_feature: Ceres CLONE 1824346
  misc_feature (7)..(170): Pfam Name: Tetraspannin Pfam Description: Tetraspanin family
MAACRGFFECLLRLLNFFLTVAGLAMVGYGIYLLVEWMKISGGGGSPAHVLVLGRPLLGAVALGDSFLDHLPKAWFIYLFIGVGAIVFLVSLFGCIGAGTRNTCCLCFYAFLVLLLILAEAGAAAFIFFDHSWIDVIPKDKTRNFDVMYDFLKDNWEIARWVALGVVVFEAVLFLLALT

SEQ ID NO: 22917 - DNA, 667 bp, Panicum virgatum
  misc_feature: Ceres CLONE 1824367
  misc_feature: Encodes the peptide sequence at SEQ ID NO. 22918
tacacagcaacattttgaagcaagaactgtttgctgattatgtctccatatggcctaacaaattccaaaacaaaactaatggaatcacgcctcgtagatggctcaagttctgtaaccctgagttgagtgaaataatcacaaaatggctaaagacagatcagtggacaagtgacctcgatctacttactggacttcgcaaatttgcagatgatgaaaaacttcatgctgagtgggcagcagctaagttagcttgcaagaagcgcctggccaaacatgtcttggatgcgacaggtgttacgattgatccaactagcctttttgatatacagattaaacgcatccatgagtataagaggcagctgctaaacatattgggagctgtttacagatacaaaaagttaaaggaaatgagcgcagaagagaagcagaaggttacaccacgcactgtcatgataggggggaaagcatttgcaacatacactaatgccaaaagaatagtgaaattggtaaacgatgttggtgctgtagtgaacaatgatcctgaagttaacaaatatctgaaggttgtcttcattccgaattacaatgtatcggtggctgaagttcttattcctggtagcgaactgtcacaacatattagtactgctggtatggaagcaagaggaac

SEQ ID NO: 22918 - protein, 221 aa, Panicum virgatum
  misc_feature: Ceres CLONE 1824367
  misc_feature (1)..(221): Pfam Name: Phosphorylase Pfam Description: Carbohydrate phosphorylase
  misc_feature: SWISSPROT Homolog: EC 2.4.1.1 Phosphorylase
HSNILKQELFADYVSIWPNKFQNKTNGITPRRWLKFCNPELSEIITKWLKTDQWTSDLDLLTGLRKFADDEKLHAEWAAAKLACKKRLAKHVLDATGVTIDPTSLFDIQIKRIHEYKRQLLNILGAVYRYKKLKEMSAEEKQKVTPRTVMIGGKAFATYTNAKRIVKLVNDVGAVVNNDPEVNKYLKVVFIPNYNVSVAEVLIPGSELSQHISTAGMEARG

SEQ ID NO: 22919 - DNA, 1537 bp, Panicum virgatum
  misc_feature: Ceres CLONE 1824406
  misc_feature: Encodes the peptide sequence at SEQ ID NO. 22920
ctcgcacaaacgcatcgagcacacgcacagagcagctcagcagagaactgagaagccaaagaagaacctctgcacgaatccggcttcgatccatcgacaggaacaccgcacaccgccagccagacgcagccgatcaaggcgggttaccggcaatgggcgagctgatccctgggttgcccgaggaggtggcgcgggagtgcctcgtccgggtgggcttcgaccagctgcccgtggtgcgccgcatctcgcgccagtggaagtcggaggtggagtcgccggactaccaccgcctgcgccgggccgaggggctggcgcgcccggtgctcgcgctggtccaggcgcgccccgcggcgccggccggcggcgcgggcccggcggcggataagcagcactcgtcggctggggggccctccaacgcgtaccggatggtgctgctggacccggaggagggccggtgggcgccgctgccggcgccgcccgggccggcggggagcctgcccctgttctgccaggtggccgccgtgggcggcggcgggcaggggcgggagcggctggtggtcgtcgggggctgggacccggagacgtgggcgccggtggacgcggtgctcgtgtacgacttcctgaccggcgcgtggcgccgcggcgcgccgatgccgggcccccgccggtccttcttcgcctgcgcggccgtcggcggggccgtgtacgtggcgggcggccacgacgaggagaagaacgcgctgcgatcggcgctggcgtacgacccggagcgcgacgcgtgggcggggctccccgacatggcggaggagcgcgacgagccgcgcgggctctgcgtcggcggcaggttcctcgtcatcggtgggtacccgacgcaggcgcagggccgcttcgtcggctccgcggaggccttcgacccggcggcgtcggcctgggcgcccgtccgggacggcctgctcgaggacggcgcgtgcccgaggacctgctgcgcggcgccgggggccgcggggcgcctgtacatgctccgcgacgggcacctcgtggcgcgcgacgccgcgccgggcgcggcgtggcgaccggtggcgccggtgcccgaggacgcgcgcaccgcggcgaccgtctccgccatccccggcggccgcgtcgtggtggtcggctccgggtgccacggcggggaccagagcgtgtacgtgctccgcgaggaggccgggaagggcgcgtcctgggagcgcgcggcggcgccgcctgagttcgccgggcacgtgcaggcctcctgctgcctcgaaatctgatgaagtgtactacatagtatacgagtagaatgcagaccagatctccctacaagtttgtacatacctacgtactcctgaactctgcaactacgtctcactgttgtgtagagaaagaacatcaagctaagcagagtaacgaggggaggggcaaaaaaatagtttaacaacaagtagcaaaatatgtactgcactaaaaatgtttgagaaatgagtgaagtgtcaatggcagtttttgaggtctttgctgg

SEQ ID NO: 22920 - protein, 378 aa, Panicum virgatum
  misc_feature: Ceres CLONE 1824406
  misc_feature (117)..(168): Pfam Name: Kelch_1 Pfam Description: Kelch motif
  misc_feature (171)..(217): Pfam Name: Kelch_1 Pfam Description: Kelch motif
  misc_feature (3)..(50): Pfam Name: F-box Pfam Description: F-box domain
MGELIPGLPEEVARECLVRVGFDQLPVVRRISRQWKSEVESPDYHRLRRAEGLARPVLALVQARPAAPAGGAGPAADKQHSSAGGPSNAYRMVLLDPEEGRWAPLPAPPGPAGSLPLFCQVAAVGGGGQGRERLVVVGGWDPETWAPVDAVLVYDFLTGAWRRGAPMPGPRRSFFACAAVGGAVYVAGGHDEEKNALRSALAYDPERDAWAGLPDMAEERDEPRGLCVGGRFLVIGGYPTQAQGRFVGSAEAFDPAASAWAPVRDGLLEDGACPRTCCAAPGAAGRLYMLRDGHLVARDAAPGAAWRPVAPVPEDARTAATVSAIPGGRVVVVGSGCHGGDQSVYVLREEAGKGASWERAAAPPEFAGHVQASCCLEI

SEQ ID NO: 22921 - DNA, 1049 bp, Panicum virgatum
  misc_feature: Ceres CLONE 1824421
  misc_feature: Encodes the peptide sequence at SEQ ID NO. 22922
agccaaagtttacagcttgatttacggaacctcctcgggctctccccggccatggaggagctcctgctgcgccaagccggcctcccgcggccggtggcgcctcgccgccggctacgcgtcgtcgccgtcgcgctgcggaccaggcccaccagcctcgccgtcccgggcctcccgcccgcgcccgcggcgccggcgccggagcccgtgctgccgtcgccgcccgtatccgcggacgccgcagcggtgctgctcgcggctggcgtgccgcccgcggacctccggcgcgcggcggggatgtgcccggagctgctgtccatgcccgcggagaccatcgcggcgcggctccggccgacgctctacttcctgcgcgcgctcggcgtgcccgacctgcaccgccgcgccgacctgctgtccttctcggtggaggagaagctgctgccccggatcgagttcctcgagtcgctgggcctgccctcccgcgccgcgcgttccatggcgcgccgcttcccggcgctcttctgctacggcgtggaggggaacatgcggcccaaggcggagtacctcctgggcgccatgggccgcgacgccggcgagctgctcgagttcccggagtacttctcgtacgcgcttgccgcgcgcatcgcgccgcgccacgaggcgtgcgcggcgcgcggggtgaagctgccgctgcccgccatgctccgccccggggaggccaagttccgcgccacgctcgccggctgcgtcgggtccacgccgccccggaggcggtcgccgctgtggcacgccacgtgggtggacgacagcgaccacgccggcgcggcggcgaaggaggctgcggcggcggtgtgacggccggacggcggcgtcgcattggtagcgatcgagcggagcgagtggttctcggcggtgtaaacatgtgcatacggattggcattggccgcttgtaagtatgataccacgaatctagttggttccatggtcgcattgccactccatgacgtgaccaaagccattggctacttctccaaaaaacacacacaacacac

SEQ ID NO: 22922 - protein, 266 aa, Panicum virgatum
  misc_feature: Ceres CLONE 1824421
  misc_feature (2)..(226): Pfam Name: mTERF Pfam Description: mTERF
MEELLLRQAGLPRPVAPRRRLRVVAVALRTRPTSLAVPGLPPAPAAPAPEPVLPSPPVSADAAAVLLAAGVPPADLRRAAGMCPELLSMPAETIAARLRPTLYFLRALGVPDLHRRADLLSFSVEEKLLPRIEFLESLGLPSRAARSMARRFPALFCYGVEGNMRPKAEYLLGAMGRDAGELLEFPEYFSYALAARIAPRHEACAARGVKLPLPAMLRPGEAKFRATLAGCVGSTPPRRRSPLWHATWVDDSDHAGAAAKEAAAAV

SEQ ID NO: 22923 - DNA, 710 bp, Panicum virgatum
  misc_feature: Ceres CLONE 1824428
  misc_feature: Encodes the peptide sequence at SEQ ID NO. 22924
accacatcccccatcgaaaaccgtcatcgccttcggggccttcctcctcgccgtctccctcgcgggcctcgtcggcgcttgctgccgcgtcacctggctgctctgggtctacctcctcgccatgttcgccctcatcgtcgccctcttctgcctcaccgtcttcgccttcgccgtcaccaaccgcggcgccggggaggccgtctccggccgcggctacaaggagtaccgcctcggggactactccaactggctgcagaagcgcgtcgagagcaccaagaactggaacaggatcaggagctgcctccaggactccaaggtctgcaagagcttgcaggacagcagggagacgttcgcggacttcatacgctccgacctctcacccatccagtccgggtgctgcaagccccccacgagctgcaacttcacctacgtgagcggcacggagtggaccaagacgacgacccccgccggcgcggcggcggacccggactgcggcacctggagcaaggaggcgctctgctacgactgccagtcctgcaaggccggcgtggtggccaccttcaagcgcgactggaagcgcgtcgccgtcgtcaacatcgtcttcctcgtcttcatcatcatcgtctactccgtcggctgctgcgccttccggaacaacgcagggacaacgccgcctaccgcggcggctggaagcagggcggctacgcctg

SEQ ID NO: 22924 - protein, 236 aa, Panicum virgatum
  misc_feature: Ceres CLONE 1824428
  misc_feature (1)..(205): Pfam Name: Tetraspannin Pfam Description: Tetraspanin family
PHPPSKTVIAFGAFLLAVSLAGLVGACCRVTWLLWVYLLAMFALIVALFCLTVFAFAVTNRGAGEAVSGRGYKEYRLGDYSNWLQKRVESTKNWNRIRSCLQDSKVCKSLQDSRETFADFIRSDLSPIQSGCCKPPTSCNFTYVSGTEWTKTTTPAGAAADPDCGTWSKEALCYDCQSCKAGVVATFKRDWKRVAVVNIVFLVFIIIVYSVGCCAFRNNAGTTPPTAAAGSRAATP

SEQ ID NO: 22925 - DNA, 1707 bp, Panicum virgatum
  misc_feature: Ceres CLONE 1824433
  misc_feature: Encodes the peptide sequence at SEQ ID NO. 22926
aattctcctaggcccacaccgatgtgctgacccacctcacacggtaggaaaattcctagaagcttctgaattttcgaattaactaccttttgattggcacctcagtcagaaaaaatttcatttatttttccctaatacacagtgcacgactttgcattattctactagagaaaatcgaaagcaaaatggagatgctactgctacagtgctacttgctccatctccaattctccatccatccatgtgtccaaaccgcagtcactcgtgcgcttgatgcataaaaaccaaagcaccccgtggacacacgcctggttggtgttggtgccttcctctccacagctgccgcaccttatcgtcttcctccttggctgcttcatcctcaacagcagcgccagcgcctccttcctcttccccgtcgatcgacatggctgctcaagaggagaagactgctcctgccaagacagaggaggcggagcagcagccacggcctcaaccggcagcaggggcggcgcgcagggctgggccatcggcgccggccaaccccttcgacttctccaccatgatgaacctgctcaatgaccccagcatcaaggagatggcggagcagatcgccaaggacccggccttcacggagatggcggagcagctgcagaagatgacggtggtgtcgccgcggcaggcgccggcgcccgaggcggcggtggcgctggacccgcacaagtacgtggcgacgatgcagcagctgatgcagaacccgcagttcgtggccatggcggagcggctgggcagcgcgctgatgcaggaccccgccatggccaccatgctgggcggcctcaccaaccccgcgcacaaggagcagctcgaggcccgcatcgcgcgcatgaaggacgaccccacgctcaagcccatcctcgacgagatcgaggccggcggccccgccgccatgatgaagtactggaacgaccccgaggctctgcacaagttcgggcgggccatgggcgtcggcccgtcgagcgaggccgccgccggcgcggaggaggaagaggccgccggcgaggaaggcgatggcgagtacgaggaggaggaggaggagtccgtcatccaccacaccgccagcgtcggcgacgtggagggcctgaagaaggcgctggaggagggcgtggacaaggacgaggaggactcggaagggcggcgaggcctgcacttcgcgtgcggatacggcgaggtcaagtgcgcgcaggtgctcctggaggccggcgcggcggtggacgccgtggacaagaacaagaacacggcgctgcactacgcggccggctacgggcgcaaggaatgcgtggcgctgctggtcgagaacggcgccggcgtgacgctgcagaacctggacgggaagacgcccatcgacgtcgccaggctcaacaaccaggaggacgtcctcaagctgctcgagaagcacgccttcgtatagacgctgcttgcttgcttcatgccctccttccttaatttgctcagttgctctgctgcaccctgctttgctttgctttctcggcccaaacaagtcccttcttttctttattattatatatatatacatagctcggtcttcagtgtatgtatgtatgtacgtactgagattatccatgccatgcatgccagatttagcttgcgtgattaaggttgaataaggaagatattttcatttcatcatcc

SEQ ID NO: 22926 - protein, 346 aa, Panicum virgatum
  misc_feature: Ceres CLONE 1824433
  misc_feature (287)..(319): Pfam Name: Ank Pfam Description: Ankyrin repeat
  misc_feature (254)..(286): Pfam Name: Ank Pfam Description: Ankyrin repeat
  misc_feature: SWISSPROT Homolog: EC 2.4.2.30 NAD(+) ADP-ribosyltransferase
  misc_feature: The sequence is a functional homolog of SEQ ID NO 1839 in the 10/374,780 US patent application
MAAQEEKTAPAKTEEAEQQPRPQPAAGAARRAGPSAPANPFDFSTMMNLLNDPSIKEMAEQIAKDPAFTEMAEQLQKMTVVSPRQAPAPEAAVALDPHKYVATMQQLMQNPQFVAMAERLGSALMQDPAMATMLGGLTNPAHKEQLEARIARMKDDPTLKPILDEIEAGGPAAMMKYWNDPEALHKFGRAMGVGPSSEAAAGAEEEEAAGEEGDGEYEEEEEESVIHHTASVGDVEGLKKALEEGVDKDEEDSEGRRGLHFACGYGEVKCAQVLLEAGAAVDAVDKNKNTALHYAAGYGRKECVALLVENGAGVTLQNLDGKTPIDVARLNNQEDVLKLLEKHAFV

SEQ ID NO: 22927 - DNA, 694 bp, Panicum virgatum
  misc_feature: Ceres CLONE 1824434
  misc_feature: Encodes the peptide sequence at SEQ ID NO. 22928
ttctagacgccacacacacaccctctctgccctcagctcctcgccgaaccggaacacccgcacacccacgccacttgtacaccatggcgcccccgtcggcgcacaagtcgccggtgccgccggccaccggcctcggtctcggcgtcgtcggtggcgtcggaggcgtgggcatgggcccccacttcaggggcgtgcggaagcgcccgtgggggcggtacgccgcggagatccgcgacccggccaagaagagccgcgtctggcttggcacgtacgacacggccgaggaggccgcccgcgcctacgacgccgccgcgcgcgagttccgcggcgccaaggccaagaccaacttcccgttcgcgtccaagtgccccgtcgccgccggcgccggcagccccagcagcaacagcaccgtggagtcgggcggaggcggcggcgtccaggcgcctatgcaggccatgccgctgcccccggccctcgatctcgatctcttccaccgggcggcggccgtgaccgcggtctcccccggcggcatgcggtttcccttcaaagggttccctgtcgcgcgcccgaccccgaacccctacttcttctacgaacaggcgtccggctaccggatgctcaaggtcgccccgccgccggtcaccgtggccgccgtcgcgcagagcgactccgactcctcgtcggtggtcgatcc

SEQ ID NO: 22928 - protein, 203 aa, Panicum virgatum
  misc_feature: Ceres CLONE 1824434
  misc_feature (32)..(83): Pfam Name: AP2 Pfam Description: AP2 domain
  misc_feature: Useful for making plants with altered alkaloid content
  misc_feature: The sequence is a functional homolog of SEQ ID NO 20 in the 10/903,236 US patent application
  misc_feature: The sequence is a functional homolog of SEQ ID NO 2213 in the 10/666,642 US patent application
  misc_feature: The sequence is a functional homolog of SEQ ID NO 80 in the 10/714,887 US patent application
  misc_feature: The sequence is a functional homolog of SEQ ID NO 80 in the 11/435,388 US patent application
  misc_feature: The sequence is a functional homolog of SEQ ID NO 18 in the 10/903,236 US patent application
  misc_feature: The sequence is a functional homolog of SEQ ID NO 2211 in the 10/666,642 US patent application
  misc_feature: The sequence is a functional homolog of SEQ ID NO 78 in the 10/714,887 US patent application
  misc_feature: The sequence is a functional homolog of SEQ ID NO 78 in the 11/435,388 US patent application
  misc_feature: The sequence is a functional homolog of SEQ ID NO 1466 in the 10/666,642 US patent application
  misc_feature: The sequence is a functional homolog of SEQ ID NO 2136 in the 10/374,780 US patent application
  misc_feature: The sequence is a functional homolog of SEQ ID NO 36 in the 10/714,887 US patent application
  misc_feature: The sequence is a functional homolog of SEQ ID NO 36 in the 11/435,388 US patent application
  misc_feature: The sequence is a functional homolog of SEQ ID NO 368 in the 10/225,066 US patent application
  misc_feature: The sequence is a functional homolog of SEQ ID NO 6 in the 10/903,236 US patent application
MAPPSAHKSPVPPATGLGLGVVGGVGGVGMGPHFRGVRKRPWGRYAAEIRDPAKKSRVWLGTYDTAEEAARAYDAAAREFRGAKAKTNFPFASKCPVAAGAGSPSSNSTVESGGGGGVQAPMQAMPLPPALDLDLFHRAAAVTAVSPGGMRFPFKGFPVARPTPNPYFFYEQASGYRMLKVAPPPVTVAAVAQSDSDSSSVVD

SEQ ID NO: 22929 - DNA, 669 bp, Panicum virgatum
  misc_feature: Ceres CLONE 1824441
  misc_feature: Encodes the peptide sequence at SEQ ID NO. 22930
aagcgtacatggtgccggcggaccggcgcgccccgcgcgcggcggccgactcgctgctgtcgcacgccatcttccacgacgggcggctggtccggcggccggagctggcgcaggcgctgttcgcgctggcgtacctcccgctggggttcctcctggctctgttccgcgtcttcttcaacctcatgatcccggcgcgcctcgtccgccacacgtaccgcttgacgggcatccgcctcgccgtccgcggggctcccccgccggcgccgcggccgggcgcgccggggtccctcctggtgtgcaaccaccgcacggcgctggacccgatcatcatctccgtggcgctggggcggcccgtgacgtgcgtgacctacagcgtgagccggctgtcgacggcggtctcgccgatccgcgcggtggcgctgacgcgcgaccggcgcgccgacgcggcgcgcatggcggcgctgctggcggagggcgacgtggtggtgtgccccgaggggacgacgtgccgggagccggcgctgctgcgcttctcggcgctgttcgcggagctcacggaccgggtggtgccggtggcgctggaggcgcgccaggggacctactacgggtccacggcgcgcggctggaagtggctcgactcctacttcttctacatgaacccgcgccccg

SEQ ID NO: 22930 - protein, 222 aa, Panicum virgatum
  misc_feature: Ceres CLONE 1824441
  misc_feature (77)..(194): Pfam Name: Acyltransferase Pfam Description: Acyltransferase
  misc_feature: SWISSPROT Homolog: EC 2.3.1.15 Glycerol-3-phosphate O-acyltransferase
AYMVPADRRAPRAAADSLLSHAIFHDGRLVRRPELAQALFALAYLPLGFLLALFRVFFNLMIPARLVRHTYRLTGIRLAVRGAPPPAPRPGAPGSLLVCNHRTALDPIIISVALGRPVTCVTYSVSRLSTAVSPIRAVALTRDRRADAARMAALLAEGDVVVCPEGTTCREPALLRFSALFAELTDRVVPVALEARQGTYYGSTARGWKWLDSYFFYMNPRP

SEQ ID NO: 22931 - DNA, 695 bp, Panicum virgatum
  misc_feature: Ceres CLONE 1824467
  misc_feature: Encodes the peptide sequence at SEQ ID NO. 22932
aggaagaggttgggagccaatcgcgcgcgcgagcctagtacagtagtggataagaaagagtgctagcagaggagaagctatccaggagagcaagcaatggcgtcgccgtccacgctgcctttgacgtccgccttcccctccccctcgcgccgcctcgcggcgtctcgccgggcgacgtctctggtcatcgtcgcccaggggaaggtcaagaagtaccgccaggtcatactgacagacgacatacaagaagtaggtaagaaaggggaaacattgaaggtgcgagctggattttaccgcaatttcctccttcccaagggcaaggccacgcttctaaccccacaagtcctcaaggaaatgcaactagaacaggagagaatagaagctgagaagaagcgggtcaaagaagaagcacaacaacttgctcgagtttttgaaaccatcggggctttcaagattccacgcaaaggcggaaaaggaaaacaaatctttggaagcgtcacggcacaggatgttgttgacataattaagtcacaacttaatagagaggtcgacaagaggcttgtggcagttccagaaattcgtgaaactggagagtatgttgctgagattaagcttcacccagatgtgacagctcgagtaaggctgaacgtctatgccaaatgagatgtgcagttacagaagcttgcatggatggg

SEQ ID NO: 22932 - protein, 188 aa, Panicum virgatum
  misc_feature: Ceres CLONE 1824467
  misc_feature (102)..(188): Pfam Name: Ribosomal_L9_C Pfam Description: Ribosomal protein L9, C-terminal domain
  misc_feature (41)..(88): Pfam Name: Ribosomal_L9_N Pfam Description: Ribosomal protein L9, N-terminal domain
MASPSTLPLTSAFPSPSRRLAASRRATSLVIVAQGKVKKYRQVILTDDIQEVGKKGETLKVRAGFYRNFLLPKGKATLLTPQVLKEMQLEQERIEAEKKRVKEEAQQLARVFETIGAFKIPRKGGKGKQIFGSVTAQDVVDIIKSQLNREVDKRLVAVPEIRETGEYVAEIKLHPDVTARVRLNVYAK

SEQ ID NO: 22933 - DNA, 1741 bp, Panicum virgatum
  misc_feature: Ceres CLONE 1824480
  misc_feature: Encodes the peptide sequence at SEQ ID NO. 22934
actccagtccgtcctctcccaccaccccactccactgagccgccgcgagctcgctcggctgcagctccagcctcctgcagcgcctcttcctcctccggcgccccctctccctctcctcccagcagccttgcagcgacctgccaacagtgcgctagctctccccgggcagaatgaccaaagatgaggagttcaagctggtcaagatccagaaccatctgctgagggtgaacatacactgcgacgggtgcaagcacaaggtcaagaagctgctccagaagattgaaggcgtgtactcggtggccatcgatgtggacaaccacaaggtctcggtgacgggggacgtggacgccgagacattgatccggaagctcaccagaggcggcaaacatgccgagctgtggtcgccgcagaaggtcggcggcaaccagggccacaagggcaataaccagcagaagcagcagcagaaccaccagcaccagcaccagcagcatcagcagaagcagcagcatcagcagaagcaaggtgccaatctgagcaaggatggccacaacaacaagaacaacaacggcgggcagaaggagcagggcgggcaggggggaggggttggaagcctcatgcagggcctcaaggcgttcaagagccagcacaacaacaagcaccagctcgctgagctcagctccgaggatgatgacctgtatgatgatgaggatgacgagttcgacgatgactatgaggaggagctccgcttcctcggggacaagatgagccagcttgggttccacagcaacaaccaccaccagaaccagaacaagaacggcaacaatgccgctgtcaacaaccacaacaatggcaagaaaggtaatggtggcgccggaggtggtggagccaatcaccaccagaaccagaagaatgtgaatgtgatcaacatggcagcggcaaatgccaagatgggtgctggcgtcggcgtccagaaccagaagaatgcgaatgtgatcaacatggcggcagcggcaaacgccaagatggccaatggtgcccagaggaacgctggtgccatgtctggcatgctgggcctgagccatggcctgggagcaggcaatgccgctcctggcttccaaggctacacaggcttcaaccatccgtcctatgctgctgccggctatggaggtctacagcaacagcaccacctccagcagcagcagagcaacaacctcatggcgagcatgcaggggtatcatcatcacccggcggcgacggcggcgatgaagaacaatttgaggggcctgaacagcaacatgatgatgatgcatcagccccagcagcagccgcagatgatgtaccactcctctccccagatcagcccctacactggctactacaacccttacaactactactaccatccccatcctggcagcgctggttacccggccagcaatggggatgtggagaccatgttcagtgatgagaacaccaagggatgtgttgtcatgtagggatgttgctacaaagctagaatctagaggttgttgatgaaggatggtaatggtgatgcagtcctgctaccttttcttttttcgtctcattatttttctgctcttatggtttcgcctgtatcaagaatgaatcatggtgttgacttagatgtgctgttgaaagtaggggcaacatgagagggtgatcaaacactgtaatgtaataccttttactgcctagtgctttgccctgactggcttgctat

SEQ ID NO: 22934 - protein, 441 aa, Panicum virgatum
  misc_feature: Ceres CLONE 1824480
  misc_feature (16)..(76): Pfam Name: HMA Pfam Description: Heavy-metal-associated domain
MTKDEEFKLVKIQNHLLRVNIHCDGCKHKVKKLLQKIEGVYSVAIDVDNHKVSVTGDVDAETLIRKLTRGGKHAELWSPQKVGGNQGHKGNNQQKQQQNHQHQHQQHQQKQQHQQKQGANLSKDGHNNKNNNGGQKEQGGQGGGVGSLMQGLKAFKSQHNNKHQLAELSSEDDDLYDDEDDEFDDDYEEELRFLGDKMSQLGFHSNNHHQNQNKNGNNAAVNNHNNGKKGNGGAGGGGANHHQNQKNVNVINMAAANAKMGAGVGVQNQKNANVINMAAAANAKMANGAQRNAGAMSGMLGLSHGLGAGNAAPGFQGYTGFNHPSYAAAGYGGLQQQHHLQQQQSNNLMASMQGYHHHPAATAAMKNNLRGLNSNMMMMHQPQQQPQMMYHSSPQISPYTGYYNPYNYYYHPHPGSAGYPASNGDVETMFSDENTKGCVVM

SEQ ID NO: 22935 - DNA, 705 bp, Panicum virgatum
  misc_feature: Ceres CLONE 1824496
  misc_feature: Encodes the peptide sequence at SEQ ID NO. 22936
aatcgtttctgtggcttctgaatcggatttggcgcagggtttagggagaatggcgaccaagaggagcgtggacaccctgtcggaggcggatctcaaggggaagaaggtgttcctccgcgccgacctcaacgtgccgctggatgacagccagaagatcaccgacgacacccgcatccgcgcgtccgtgcccaccatcaagttcctgatggagaagggcgccaaggtcatcctggccagccatctgggacgtccaaaaggtgtcactcccaaatacagcttgaagcccctagtcccacgcttgtctgagctccttggagttaatgttgttatggccaatgactgcattggtgaggaagttcagaagttggctgcttctttaccagatggaggtgttctgcttttagaaaacgttaggttctacaaggaggaagagaagaacgaccctgagtttgccaagaagctggcatctgttgctgatctctatgtaaatgatgcctttggcactgcacacagagcccatgcttcaacagagggagttaccaagtatttgaagcctgctgttgctggcttcctcatgcagaaggaacttgactaccttgttggcgctgttgccaacccgaagaagccgtttgctgcaattgttggcggatcaaaggtgtcgacgaagattggagtgatcgagtctctattggcgaagttgacatc

SEQ ID NO: 22936 - protein, 218 aa, Panicum virgatum
  misc_feature: Ceres CLONE 1824496
  misc_feature (3)..(217): Pfam Name: PGK Pfam Description: Phosphoglycerate kinase
  misc_feature: SWISSPROT Homolog: EC 2.7.2.3 Phosphoglycerate kinase
MATKRSVDTLSEADLKGKKVFLRADLNVPLDDSQKITDDTRIRASVPTIKFLMEKGAKVILASHLGRPKGVTPKYSLKPLVPRLSELLGVNVVMANDCIGEEVQKLAASLPDGGVLLLENVRFYKEEEKNDPEFAKKLASVADLYVNDAFGTAHRAHASTEGVTKYLKPAVAGFLMQKELDYLVGAVANPKKPFAAIVGGSKVSTKIGVIESLLAKLT

SEQ ID NO: 22937 - DNA, 972 bp, Panicum virgatum
  misc_feature: Ceres CLONE 1824501
  misc_feature: Encodes the peptide sequence at SEQ ID NO. 22938
aagcaaagcgtgcggaactgaattccttgcgtctcctctgctcttggcatctcgtcctcgacctctccttgctatatatagcttcgtcttcgcaagatcatcgcagcgtttgtgatcgagcttgcacgggaggagaacaggagcagctagcggcaatggccgtgggcatgaggggttgtttgctggtcctgacgcttgggctcgccatggctgcgacctcgtcggcggccatctacaaggtcggcgacgcctccggctggaccatcctcggcaacatcaactacgccaactggactgcgaagaagaccttccatgttggagacatcatagagttcacgtacccccagggcatccacaacgtgctggaggtgaccaaggccgactacgacagctgcaccaactccacgcccatcgccacgcacacctccggcgacgacaagatcgccatcaagaggcccggccaccgcttcttcatctgcggcgttcccggccactgcgccgccggccagaaggtcaacatccgcgtcctcaagccgcggtcctctgacgccccttccaaggcgcccgcgcccgcgccgacgcgctcggcggcggcgacgcccagtggcagcagcgagccgagcgccgcctcgccaccggccgcctcgtccaccgacagcacccccgacgcgccgacgaccaccgcgccagcgcccaacgccaacggcgccggggtccgtggaggttaccgggctgtcgtagcgatggcgctggcggcggtcgccaccatggctgtgctacagtagatcaggactccctactccctagtggccttgtgcattcgagagtctacatgtgatttttttttcaaagtaagcgtctacatgtgattgtttcgccacgatgtgtgcttgagtgtgaaacttttttgtttttggggttattgttcacttgcagatgcgattgatcatccaggatcatgtacttctggtc

SEQ ID NO: 22938 - protein, 209 aa, Panicum virgatum
  misc_feature: Ceres CLONE 1824501
  misc_feature (35)..(118): Pfam Name: Cu_bind_like Pfam Description: Plastocyanin-like domain
MAVGMRGCLLVLTLGLAMAATSSAAIYKVGDASGWTILGNINYANWTAKKTFHVGDIIEFTYPQGIHNVLEVTKADYDSCTNSTPIATHTSGDDKIAIKRPGHRFFICGVPGHCAAGQKVNIRVLKPRSSDAPSKAPAPAPTRSAAATPSGSSEPSAASPPAASSTDSTPDAPTTTAPAPNANGAGVRGGYRAVVAMALAAVATMAVLQ

SEQ ID NO: 22939 - DNA, 391 bp, Panicum virgatum
  misc_feature: Ceres CLONE 1824541
  misc_feature: Encodes the peptide sequence at SEQ ID NO. 22940
caaggagacgccgaacccggtgcgcaagggggcgcgccggacgaaccgcggcagctggggctgctacgggcggcagccgcaccgaaagcggcggatatggctctcgagcttctacaccgccgagacgggggcgcgcgcgcaagacgtcgcctcgatcgcgctccgcggccgcgccgcatgcctcaacttctccgactctccgcgcctgctcagggtgcccccgatgggcgcggggcacgacgagatgaggcgggtcgccgccgtgtcctctaatctcatccggcctgctcccgatcccgtcaatgccgccaccaaggaggtggcccccacgccatcggatgccttgcctagcccgacgcagatcatcgatgacccctacagcattgtgcac

SEQ ID NO: 22940 - protein, 129 aa, Panicum virgatum
  misc_feature: Ceres CLONE 1824541
  misc_feature: Useful for making plants with modulated water use efficiency
  misc_feature: The sequence is a functional homolog of SEQ ID NO 1232 in the 10/374,780 US patent application
  misc_feature: The sequence is a functional homolog of SEQ ID NO 718 in the 11/435,388 US patent application
  misc_feature: The sequence is a functional homolog of SEQ ID NO 1223 in the 10/374,780 US patent application
  misc_feature: The sequence is a functional homolog of SEQ ID NO 1412 in the 10/412,699 US patent application
  misc_feature: The sequence is a functional homolog of SEQ ID NO 716 in the 11/435,388 US patent application
  misc_feature: Useful for making plants with modulated biomass
KETPNPVRKGARRTNRGSWGCYGRQPHRKRRIWLSSFYTAETGARAQDVASIALRGRAACLNFSDSPRLLRVPPMGAGHDEMRRVAAVSSNLIRPAPDPVNAATKEVAPTPSDALPSPTQIIDDPYSIV

SEQ ID NO: 22941 - DNA, 1042 bp, Panicum virgatum
  misc_feature: Ceres CLONE 1824542
  misc_feature: Encodes the peptide sequence at SEQ ID NO. 22942
gtcaccgcggcagcatcacatcacaggcctcgccactccgcgagccgaagagcgagacgaacagcttccccgggactctagaggcatccatcagcgctctgcgagcagcggcaatccaatcagccaatcaacccgcctccgcgcgaaatgtccatctcgatgcgcctcgcgatcccggcgccggcggccgcgaccgtggcgccgccgcggctgagggtgcggccggccggcaacgggggctctcttcccgtcgcgcgcgtcgccctgcggacggagacggccgcgctcaggggatgcgcatcgctgcccctgaagccgcagccgctgggcgcgggcgcgggccagccgagccggcgccggggggcggccgcagtgtgccactcgtcggcgcacctgagcgcgcggacgatgcagtggatctctgccggggccagcgcagtgttattgcttgctaaaggaacagccataaacaaatctttccttgtgccatttttcgctttgcaagcaccttgcagcataatctcatggatcaagggtgattatggccaatggactgcttttcttgctcttttggtgcgcttgttcttcttcattccaggtgaacttgagcttccgctgtcaacaatgctgcttgtgagcgttgctccttaccaactaatgaatctgaggggaactcaaggtggtgcagttctgtcattggccatagccgggtttctcgcttttcaacacttcaccagggtgggaggtctaggcaaagcctttgagcagggatcggtcattgcgaccttggccattatctgcatcacaatcatccccttgatgctgctattctgattggagtaggttggcaagagtttgctcctcgttgtgcatccaatgacggataaataaaaaccttgtgatgccacattcagtcttcctagttccttttcgcaaataagaccgatttgttttatacagtccgaaatgtatgtagtatgtactgatgtaccttggtgtgcggtttggtaatgttagtccaaaagattttgattttcttcag

SEQ ID NO: 22942 - protein, 228 aa, Panicum virgatum
  misc_feature: Ceres CLONE 1824542
  misc_feature (38)..(221): Pfam Name: WCOR413 Pfam Description: Cold acclimation protein WCOR413
MSISMRLAIPAPAAATVAPPRLRVRPAGNGGSLPVARVALRTETAALRGCASLPLKPQPLGAGAGQPSRRRGAAAVCHSSAHLSARTMQWISAGASAVLLLAKGTAINKSFLVPFFALQAPCSIISWIKGDYGQWTAFLALLVRLFFFIPGELELPLSTMLLVSVAPYQLMNLRGTQGGAVLSLAIAGFLAFQHFTRVGGLGKAFEQGSVIATLAIICITIIPLMLLF

SEQ ID NO: 22943 - DNA, 647 bp, Panicum virgatum
  misc_feature: Ceres CLONE 1824547
  misc_feature: Encodes the peptide sequence at SEQ ID NO. 22944
aaactgatatttcaaattaaactaaatgtatttgccttctttgaatttgtataatcagcccgacattctaccgcatctacaagagcaagtcgaccgagggtttccagtcggttccctacgtggtggcgctgttcagcgcgatgctgtggatcttctacgcgatgatcaagtccaacgagttcctcctcatcaccatcaacgcagccggcatcgttattgagagtatctacatagtcatgtacttcgtctacgcagacaagaaagctaagtggttcactgccaagatcatgcttggcctcaacgtcggcttcttcggggccatcctcctcgttaccctgctcctcttcaagggcgacaagcgcatcgtcaccctcggatggatctgcgtcgccttctccgtcagcgtcttcgtcgcgcccctcagcatcatcaagcgcgtgattcagacgaggagcgtggagtacatgcccttctccctctcgctctcgctcaccctcagcgccgtcgtctggttcctctacggcctcctcatcaaggacaaatacgtcgcgctcccgaacgtcctcgggttcagcttcggcgtggtccagatgatcctgtacgtggtctacatgaacaagacgccggtggtcgccgagggcaaggac

SEQ ID NO: 22944 - protein, 168 aa, Panicum virgatum
  misc_feature: Ceres CLONE 1824547
  misc_feature (76)..(162): Pfam Name: MtN3_slv Pfam Description: MtN3/saliva family
MLWIFYAMIKSNEFLLITINAAGIVIESIYIVMYFVYADKKAKWFTAKIMLGLNVGFFGAILLVTLLLFKGDKRIVTLGWICVAFSVSVFVAPLSIIKRVIQTRSVEYMPFSLSLSLTLSAVVWFLYGLLIKDKYVALPNVLGFSFGVVQMILYVVYMNKTPVVAEGK

SEQ ID NO: 22945 - DNA, 651 bp, Panicum virgatum
  misc_feature: Ceres CLONE 1824553
  misc_feature: Encodes the peptide sequence at SEQ ID NO. 22946
ctagctcgaagcagagcagtcgccatggagctccggcggctcccccgcgacgcactcgtgcccctgctcgtgctgttgccggtggtggtggtggttcacgcgaccccacgcctggagatggtgaccgccgcggcgtcgggcggcggcacggccaccaccaccaccaccagggcgcgcgcggcggcggcggcgtgcgcgagctggcgcctcggggtggagaccaacaacatccggggctggtacagcatccccgcggagtgccggggctacgtcagcgactacatgctcggcgaccagttccggcaggactgcgcggtggtggcgcgcgaggccgccgcctacgccgaggggctcgcgctcgccggcgacggcagggaggcgtgggtgctggacgtcgacgacaccgccctcaccaacctcccctactacgccgacaccgggttcggggcggagccgtacaacgcgacctacttcgacgagtacgtggcgaacgcgacggcgccggcgctgccggaggcgctggagctctacgggaagctgctggcgctgggcatcaaggtcgtcttcatcaccggccgccacgactacgagagggagcccaccgtcaggaacctccgcagcgccggctaccacacctgggagaagctcgtg

SEQ ID NO: 22946 - protein, 208 aa, Panicum virgatum
  misc_feature: Ceres CLONE 1824553
  misc_feature (42)..(208): Pfam Name: Acid_phosphat_B Pfam Description: HAD superfamily, subfamily IIIB (Acid phosphatase)
  misc_feature: SWISSPROT Homolog: EC 3.1.3.2 Acid phosphatase
MELRRLPRDALVPLLVLLPVVVVVHATPRLEMVTAAASGGGTATTTTTRARAAAAACASWRLGVETNNIRGWYSIPAECRGYVSDYMLGDQFRQDCAVVAREAAAYAEGLALAGDGREAWVLDVDDTALTNLPYYADTGFGAEPYNATYFDEYVANATAPALPEALELYGKLLALGIKVVFITGRHDYEREPTVRNLRSAGYHTWEKL

SEQ ID NO: 22947 - DNA, 692 bp, Panicum virgatum
  misc_feature: Ceres CLONE 1824571
  misc_feature: Encodes the peptide sequence at SEQ ID NO. 22948
gagagacacgaatccggaattccggatagagcgccgcccccacctcgacccgctccgtccggcgacgaggaccccgttccggcgccgccacagcgtcgaaccgagagaagggcgaggagggggggcaagcatgacgacgatccggcggttctgctgcgacgacctcctccgcttcgcctccgtcaacctcgaccacctcaccgagacgttcaacatgtcgttctacatgacgtacatggcgcgctggcccgactacttccacgccgccctcagccctggcggccgcgtcatgggttacagtatgtctcttattccctttcttcgtggttgtttgggcgtctggttggtttgtcctatcaattttgtgtggctagttgtgtgttcctagttcttctgcatcgttgcttgtcaaattaatgttaagctgaaactgtagagtgcaaaccctcgatggtagttgaattttgagacatgagttgtttgggggggctggattatcttcatctggtatgtttttcgcgcaattaatcatatgtggatatgcgaactgtgcaattgatgaatttgttctccaagtagacattgttgcaatgcaaatgcacgtgaggaccgagatttacaatgttggtttatataagtcttagtgggggtgaatgaaacagcagaagatacaaataacgagtcactagtac

SEQ ID NO: 22948 - protein, 85 aa, Panicum virgatum
  misc_feature: Ceres CLONE 1824571
  misc_feature: SWISSPROT Homolog: EC 2.3.1.88 Peptide alpha-N-acetyltransferase
MTTIRRFCCDDLLRFASVNLDHLTETFNMSFYMTYMARWPDYFHAALSPGGRVMGYSMSLIPFLRGCLGVWLVCPINFVWLVVCS

SEQ ID NO: 22949 - DNA, 567 bp, Panicum virgatum
  misc_feature: Ceres CLONE 1824574
  misc_feature: Encodes the peptide sequence at SEQ ID NO. 22950
acgctcccccccaccacccagatcgcaccccagccagccgagccaacccgatcatcgatcccctgatccccatagggatacatccccaggagcccgcacccgaccaagccaagtacgcgctacccccgctgctggcaccgctccgaccgagggtacggtgcaacgcggcaccagcagccgaagccgagcgtgtagctagccgcacatggtgtccctgcagtcggcgctcctgccggaggccagcaagcggccgccgtgcctctccctcgtgggcggcggcgccgccgcctcccccgccaccagcaagaagcggaagcgggacggcggcggcgacgaccgcggcgaggtcgtggacgggatcgagctcaatttcgacgccgcgccgctgccccccgggtggcaacgctgcctcgacatcaagtcggggcggatccactactacaacacgaggacgcagaagcggacgtggaaggaccccagaggcgagccggactaccgcgccgccgccgacgaggaggaagagtccacgaattgcccgtcgccggggctggacctggagctgaacct

SEQ ID NO: 22950 - protein, 120 aa, Panicum virgatum
  misc_feature: Ceres CLONE 1824574
  misc_feature (61)..(91): Pfam Name: WW Pfam Description: WW domain
  misc_feature: SWISSPROT Homolog: EC 5.2.1.8 Peptidylprolyl isomerase
MVSLQSALLPEASKRPPCLSLVGGGAAASPATSKKRKRDGGGDDRGEVVDGIELNFDAAPLPPGWQRCLDIKSGRIHYYNTRTQKRTWKDPRGEPDYRAAADEEEESTNCPSPGLDLELN

SEQ ID NO: 22951 - DNA, 1357 bp, Panicum virgatum
  misc_feature: Ceres CLONE 1824585
  misc_feature: Encodes the peptide sequence at SEQ ID NO. 22952
aggacatttcgcacgaacggggaagaaatcacacgccggcgcacttcggaccgcacgagatggcggcggcgcttccccgagccgccgccgcccgcgccaagcgatccggctccggcctccccctccgcctttccgtcctcgcggtgcgcgggcccttctcatccgaggccgcgccgacccctgcccccgcggccgcggctggcggcgaggaggacggcggcgacctgcgcggccgcatcttccggctgggactggcgaagcggagcgcgacggaggcgctcgagaagtggtccggcgagggccgcgccgcccccgccgcggagctccgccgcatcgcgcgcgacctcagccgcgtccgccgctacaagcacgccctcgaggtagcagactggatgaagacacatcatgagtctgatttgtctgggagtgactatggaatgcgcattgacttgattaccagagtttttggtgccaatgcggctgaagatttctttgagaagcttccatctgaagccaaatcgctagaagcctacacggcacttcttcattcctatgctcgatcaaagatgacagacaaagctgaaaggctgtttgggagaatgaaggatgcaaacctgcccatggatgccctggtttataatgaaatgatgaccttgtacatttctgttcgggagcttgataaagttcaggtcattgccgaagaactacaaaggcagaatgtctccccagatcttttcacttacaatctccggatcagtgcagcagttgcttccatggacctcgagggcttcaaaggaattctcgatgagatgtcaaaggatccaaactccaaagaaggatggacggtgtaccggaagcttgccgctatttacattgatgccagccagtttgttgcctcaggaaattcactggtggaagccgaggcaaagatcagccagagtgagtggataacctatgatttcctcgtccttctacatgccggcctcggcaacctggagaggataaaggacatatggaagtcgatgctcatgacttctcatcggatgacgagccggaactacatctgcgtgatctcctcgtacctgctgtgcgagcgggtgaaggacgcgggggagatcgtcgaccagtggcagcggtccaaggctccggagttcgacatctccgcctgcaaccggctgctcgacgcgcttctgaacgccggcctcaccgacacggcggagaggttcagggaactgatgctgcagaagagttgcatactgacgagcagggcaactgtagctgagtgcagtgattgttgattttcttggacttgtgtttgctgtgcgatgaaggaataataaaggagttgcataccgcc

SEQ ID NO: 22952 - protein, 412 aa, Panicum virgatum
  misc_feature: Ceres CLONE 1824585
  misc_feature (156)..(190): Pfam Name: PPR Pfam Description: PPR repeat
MAAALPRAAAARAKRSGSGLPLRLSVLAVRGPFSSEAAPTPAPAAAAGGEEDGGDLRGRIFRLGLAKRSATEALEKWSGEGRAAPAAELRRIARDLSRVRRYKHALEVADWMKTHHESDLSGSDYGMRIDLITRVFGANAAEDFFEKLPSEAKSLEAYTALLHSYARSKMTDKAERLFGRMKDANLPMDALVYNEMMTLYISVRELDKVQVIAEELQRQNVSPDLFTYNLRISAAVASMDLEGFKGILDEMSKDPNSKEGWTVYRKLAAIYIDASQFVASGNSLVEAEAKISQSEWITYDFLVLLHAGLGNLERIKDIWKSMLMTSHRMTSRNYICVISSYLLCERVKDAGEIVDQWQRSKAPEFDISACNRLLDALLNAGLTDTAERFRELMLQKSCILTSRATVAECSDC

SEQ ID NO: 22953 - DNA, 665 bp, Panicum virgatum
  misc_feature: Ceres CLONE 1824586
  misc_feature: Encodes the peptide sequence at SEQ ID NO. 22954
acccaccatcaccgagctctgcatctctctcggcacgcgcgcgagctctccttactcgtcgaggtgccttgatggcgaccgaagtggctgacgctccggtgccgctgccggaggcgggccccgacaccgccgcggaggcccctgccgcggacgccgccgcggccgccggcgacgcgaagccggccaaggccaagaaggccgcagcgccgcggaagcgcgcgaacccgacccacccgccgtacgccgagatgatctcggaggcgatcacgtcgctcaaggagaggacggggtcgagccagtacgcgatcgccaagttcctggaggacaagcacaaggacaagctgccgcccaacttccgcaagatgctgctcgtgcagctgaagaagctcgccgccgccggcaagctcaccaaggtcaagaactcctacaaggtgccgtcggggcgcgccccggccgccgacaagcccaagcccaaggccaaggccaagaagcctgctgccgccaagccgaagccgaagcccgctgcgaagaagcccaaggccgccgccaagaccaagcccgctgcgaagccgaaggccgccgccaagcccgcggccaagccgaaggctgtcgctgcgaagcccaagccggctgccaagcccaagccagccgccaagccggctgcc

SEQ ID NO: 22954 - protein, 197 aa, Panicum virgatum
  misc_feature: Ceres CLONE 1824586
  misc_feature (53)..(123): Pfam Name: Linker_histone Pfam Description: linker histone H1 and H5 family
  misc_feature: Useful for making plants with modulated nitrogen use efficiency
  misc_feature: Useful for making plants with modulated oxidative stress sensitivity
MATEVADAPVPLPEAGPDTAAEAPAADAAAAAGDAKPAKAKKAAAPRKRANPTHPPYAEMISEAITSLKERTGSSQYAIAKFLEDKHKDKLPPNFRKMLLVQLKKLAAAGKLTKVKNSYKVPSGRAPAADKPKPKAKAKKPAAAKPKPKPAAKKPKAAAKTKPAAKPKAAAKPAAKPKAVAAKPKPAAKPKPAAKPA

SEQ ID NO: 22955 - DNA, 1420 bp, Panicum virgatum
  misc_feature: Ceres CLONE 1824618
  misc_feature: Encodes the peptide sequence at SEQ ID NO. 22956
acaagcaccgcaactgttgcatactccgcaaggaatacaacaaagctccaacccaacgatgatgggggaaagagatgaacagacctgccccaatcgcggctaaaccctagcttagcggcgggcgcggatgcccctcgcactccttctctcccgcatttcccagccggccaaaatgcccagcacccgctccgccgcctccgccaggctggtccgcgcctcccgcgccgacgtcaacccagttgtacaagaagtgaaacgtgaatccagtgtttctttcgatgtttccaagcctgaatcaactacttctgttaagaggaaaagggtgaagcgagagcttgaagtgaatggggagcctcctaagaagcaggttggtattgtccctgacattgaggattttcgatatgacaggaccaaagcggttacatcatcgagtaaggcaaccctgtcttcggtcaaggtggagggaaagctcagagtttcttcagttataaaagctaaagctccagaaaactgggaggcagttcttgggggtattaaaaacatgaggttatctggccaagcccctgtagatacgaaaggctgtgaaaaagctggatctctccttccgcccaaggaaagaagatttgcagttctgatatcaactatgatgtctagccaaactaaagatgaagttacacatgctgctgtggaacgtctctctgaaaatggtttacttgatcctgatgctatagtcaggattgatgaggctacgcttgcaaatcttatcaaacctgttggattctatcagagaaaggctcaattcataaaagaagcttctaaaatttgcctcgaacgttttggaggtgatattccagattctctgaacgagctgcttgctctgagaggagttggccctaaaatggctcatttggtgatgagcattgcttggaagaatactcaaggaatctgtgttgacactcatgtgcatcgcatttctaaccgtcttggatgggttttccgggaaggaacaaaacagaaaacaacaactccggaacagacaagaatgtctctagagaagtggctacccaaggatgagtgggaacctataaacccattactggttggttttgggcagactatctgcactccactgaggcccaagtgtgacatgtgtggcatcaataacctttgcccttcagctttcaaggaatcttctagtccaaatcctaagcaaaagaaaacgaggtcttcatagagcttgaccatgactgagctggcactgaaggtagataaatatttttggattgcccgttggtggtagatattattgagtattcttttgcttgatctactgtcgtgtgatcagccttggtgccaagtaccattggcaaaccatgtatcattttgtatatatagctgtaatatgctcaagacttttgtc

SEQ ID NO: 22956 - protein, 353 aa, Panicum virgatum
  misc_feature: Ceres CLONE 1824618
  misc_feature (155)..(281): Pfam Name: HhH-GPD Pfam Description: HhH-GPD superfamily base excision DNA repair protein
  misc_feature: SWISSPROT Homolog: EC 4.2.99.18 DNA-(apurinic or apyrimidinic site) lyase
MPSTRSAASARLVRASRADVNPVVQEVKRESSVSFDVSKPESTTSVKRKRVKRELEVNGEPPKKQVGIVPDIEDFRYDRTKAVTSSSKATLSSVKVEGKLRVSSVIKAKAPENWEAVLGGIKNMRLSGQAPVDTKGCEKAGSLLPPKERRFAVLISTMMSSQTKDEVTHAAVERLSENGLLDPDAIVRIDEATLANLIKPVGFYQRKAQFIKEASKICLERFGGDIPDSLNELLALRGVGPKMAHLVMSIAWKNTQGICVDTHVHRISNRLGWVFREGTKQKTTTPEQTRMSLEKWLPKDEWEPINPLLVGFGQTICTPLRPKCDMCGINNLCPSAFKESSSPNPKQKKTRSS

SEQ ID NO: 22957 - DNA, 648 bp, Panicum virgatum
  misc_feature: Ceres CLONE 1824647
  misc_feature: Encodes the peptide sequence at SEQ ID NO. 22958
aagcccacacccgccacgcccgtgcctgcgccacccgacggtcagccagaccgcggccatggacatggagctgcccctcccgctgctgctcggctccatgaccgtggccgtcgccgcctgcctcctcctcctccgcggccgcggcgggaagcagcgcccgctgccgccggggccgcgggggtggccggtgctgggcaacctgccgcagctcggcgccaagccgcacctcgcgcgccgccgcgggggtggtagtcagggggtggcgctggggcaggtggccaacgtctgcgccaccaacacgctcgcccgggccacggtggggcgccgcgtcttcgcggccgacggcggggagggcgccagcagggagttcaaggacatggtggtcgagctcatgcagctcgccggcgtcttcaacgtcggggacttcgtgcccgcgctggcctggctcgacccgcagggcgtcgtcgccaggatgaagcgcctgcaccgccgctacgacgacatgatggaccggatcatcagggagaggcaggccgccgaggaaggcaaggacctgctcagcgtgctcctggccaggatgcgggaccggcagccgctcgccgacggcgaggacggcacgatcaacgagaccgacatcaaagcgcttct

SEQ ID NO: 22958 - protein, 196 aa, Panicum virgatum
  misc_feature: Ceres CLONE 1824647
  misc_feature: SWISSPROT Homolog: EC 1.14.13.21 Flavonoid 3'-monooxygenase
MDMELPLPLLLGSMTVAVAACLLLLRGRGGKQRPLPPGPRGWPVLGNLPQLGAKPHLARRRGGGSQGVALGQVANVCATNTLARATVGRRVFAADGGEGASREFKDMVVELMQLAGVFNVGDFVPALAWLDPQGVVARMKRLHRRYDDMMDRIIRERQAAEEGKDLLSVLLARMRDRQPLADGEDGTINETDIKAL

SEQ ID NO: 22959 - DNA, 629 bp, Panicum virgatum
  misc_feature: Ceres CLONE 1824667
  misc_feature: Encodes the peptide sequence at SEQ ID NO. 22960
aactagttctggccttctgggaaactactccgcaaggaccaagagtccagaacctcgccagctttcatcagctccggcgacttggagaaggacgaagccacaaaatccgatcgaaagtttggtgcttgcaaggcgaggggagtggatttctgtgcgtggtgagggaagtggatttccgtgcgcggatggggcaggcgttccgcaagctgttcgatgccttcttcggcaccagcgagatgagggtcgtgatgcttgggctggatgccgcgggcaaaaccaccatcctgtacaagctgcatatcggggaggttttgtcgactgttcccacgattggtttcaatgtcgagaaagtgcagtacaagaatgtgatgtttactgtttgggatgtcggtggccaagagaaattgaggcccctgtggaggcgctacttcaacaacacagatggcttgatctacgtggttgattcattggatcgagagagaattggaaaagccaaagctgaatttcaggcaataattaatgatcctttgatgcttaacagtgtcatattggtatttgccaataaacaagatatgaaaggggcaatggcaccaatggaagtgtgcgagggccttggcctttatgatttg

SEQ ID NO: 22960 - protein, 147 aa, Panicum virgatum
  misc_feature: Ceres CLONE 1824667
  misc_feature (5)..(147): Pfam Name: Arf Pfam Description: ADP-ribosylation factor family
  misc_feature: Useful for making plants with altered alkaloid content
  misc_feature: Useful for making plants with altered lignin content
  misc_feature: Useful for making plants with modulated nitrogen use efficiency
  misc_feature: Useful for making plants with altered terpenoid content
MGQAFRKLFDAFFGTSEMRVVMLGLDAAGKTTILYKLHIGEVLSTVPTIGFNVEKVQYKNVMFTVWDVGGQEKLRPLWRRYFNNTDGLIYVVDSLDRERIGKAKAEFQAIINDPLMLNSVILVFANKQDMKGAMAPMEVCEGLGLYD

SEQ ID NO: 22961 - DNA, 493 bp, Panicum virgatum
  misc_feature: Ceres CLONE 1824668
  misc_feature: Encodes the peptide sequence at SEQ ID NO. 22962
gttaaactagttctggctttcggggaactcctccgctaggacctagactccgcaagctcgccagctttcatctcctccggcgacttgtagaaggacgaatcccctgaatccgatctaaagtttggtgctagccaggcgaggggagtggatttctgtgcgtggcgagggaagtggatttccgtccgcggatggggcacgcgttcctcaagctgtactatgccttcttcggcacccgcgagatgagggtctagatgcttgggctggatgcctccggcatcaccgccatcctgtacaagctacatatcgtggaggtttagtcaactgtttgcacaattggtttcgatgacgagaaagagcaataccagattgagatgtttactgtttggcatgacggtgggcaagaaaaattgaagctcctgaggatgccctacttctacaacactgatggcttgatgtatctggttgattcattggatcgagagagagttggaaa

SEQ ID NO: 22962 - protein, 40 aa, Panicum virgatum
  misc_feature: Ceres CLONE 1824668
  misc_feature: Useful for making plants with altered alkaloid content
  misc_feature: Useful for making plants with altered lignin content
MFTVWHDGGQEKLKLLRMPYFYNTDGLMYLVDSLDRERVG

SEQ ID NO: 22963 - DNA, 1480 bp, Panicum virgatum
  misc_feature: Ceres CLONE 1824669
  misc_feature: Encodes the peptide sequence at SEQ ID NO. 22964
aattagaaacgccaaacgggagaaggagaagaagaactgcacccccgggtaatcaatcgccctctcctccgcctccttgtcctcatcctcctcaccagccgcgcgaaaattcggcgcgattctggcgggattcgttggagctcccctgagaatcggagtttttttttgactggtagatagattggtattgggagatcgattggttgatcggaggcggaggaagggggaggccgggaggaggaggaagggagatggcggcgtgccggggattcttcgagtgcctgctgaggctgctcaacttcttcctcaccgtcgccggcctcgccatggtcgggtacgggatctacctgctcgtcgagtggatgaagatatccgggggcggcggcggcggggggtcgccggcgcacgtgctcgtcctcggcaggccgttgctcggggccgtcgcgctcggtgacagcttcctcgacaagctgcccaaagcatggtttatttatttgttcatcggtgttggtgcggtcgtcttcctcgtgtctctgtttggctgcatcggagcagggacaagaaacacctgctgcttgtgtttctatgctttcttggtcttattgttgatccttgctgaggctggagccgccgcgttcatcttctttgaccatagctggaaagatgtaatcccaaaggataagacacataacttcgatgttatgtatggctttctgaaggacaactgggagattgcaagatgggttgctctcggcgttgttgtttttgaggcagtgcttttcctgttagctctggttgtcagggctatgaacaaacctgctgagtatgacagtgatgacgaaatcattgcaattggccgaagcccgaccatgcggcagccattgattcatgcacaaaatgttcctgccactggtgttcctgtcccaacacttgatcaacgtgcaagcagaaacgatgcatggagccaaaggatgcgagagaagtacggtcttgacacgagccaattcacctacaacccttcagacccaagcaggtatcagcagaatggtgcgcctcaggctgaagaaaggagtcgttgcaccatcatgtgaagaatcattcatgaggtcctgagataatgaattttcttgaacgggctatctcagcttgtgagtttggtgttaccgtgttgttcagagtggtgtatgggatagagtcgctaccagaacattggtccttcatgatacatcttctctctgcaaatgctctatgcacctgtaaccttcttgtgagtgaggaactgttagccattgacatctccttatcggggtttgtttcttgtctgcatttccccccatttcacacttccaagtccgtttccagattgtcgagcagctctgtttaatttagatgttgtactcaagtttgtaaggtttggttgtgcagtgtagtaagatgggttagaagaaatctttgagtattatggaaatgagttatattc

SEQ ID NO: 22964 - protein, 279 aa, Panicum virgatum
  misc_feature: Ceres CLONE 1824669
  misc_feature (7)..(173): Pfam Name: Tetraspannin Pfam Description: Tetraspanin family
MAACRGFFECLLRLLNFFLTVAGLAMVGYGIYLLVEWMKISGGGGGGGSPAHVLVLGRPLLGAVALGDSFLDKLPKAWFIYLFIGVGAVVFLVSLFGCIGAGTRNTCCLCFYAFLVLLLILAEAGAAAFIFFDHSWKDVIPKDKTHNFDVMYGFLKDNWEIARWVALGVVVFEAVLFLLALVVRAMNKPAEYDSDDEIIAIGRSPTMRQPLIHAQNVPATGVPVPTLDQRASRNDAWSQRMREKYGLDTSQFTYNPSDPSRYQQNGAPQAEERSRCTIM

SEQ ID NO: 22965 - DNA, 491 bp, Panicum virgatum
  misc_feature: Ceres CLONE 1824680
  misc_feature: Encodes the peptide sequence at SEQ ID NO. 22966
gtcgccgagcaaggagcagccacgaaccgagaccccatcgccattcgccaccaagatcaattcgagctagacaagatcacaagacatggagtacgacgagcaggagtcgccggaggccgccgccggggaggagtacgccacggtcatgtccgcgccgcccaagcgccccgcggggcggaccaagttccgggagacccgccacccggtgtaccgcggcgtgcggcggcgcggccccgcggggcgctgggtctgcgaggtccgggagcccaactggatgtcccgcatctggctcggctccttcgccaccgccgaggccgcggcgcgcgcgcacgacggcgccgcgctcgcgctccggggccacgcggcctgcctcaacttcggcgactcggcgcgcctgctccgcggataccccctcactcgcgctgcgcgccacgacctccgccgcggcgccaccgggctcgcctaagcctccgggcaccgacgacgcacgc

SEQ ID NO: 22966 - protein, 126 aa, Panicum virgatum
  misc_feature: Ceres CLONE 1824680
  misc_feature (40)..(92): Pfam Name: AP2 Pfam Description: AP2 domain
  misc_feature: The sequence is a functional homolog of SEQ ID NO 4 in US patent 7317141
  misc_feature: The sequence is a functional homolog of SEQ ID NO 750 in the 11/435,388 US patent application
  misc_feature: The sequence is a functional homolog of SEQ ID NO 1245 in the 10/374,780 US patent application
  misc_feature: The sequence is a functional homolog of SEQ ID NO 1224 in the 10/374,780 US patent application
  misc_feature: The sequence is a functional homolog of SEQ ID NO 1413 in the 10/412,699 US patent application
  misc_feature: The sequence is a functional homolog of SEQ ID NO 710 in the 11/435,388 US patent application
  misc_feature: The sequence is a functional homolog of SEQ ID NO 1229 in the 10/374,780 US patent application
  misc_feature: Useful for making plants with modulated water use efficiency
  misc_feature: The sequence is a functional homolog of SEQ ID NO 1232 in the 10/374,780 US patent application
  misc_feature: The sequence is a functional homolog of SEQ ID NO 718 in the 11/435,388 US patent application
  misc_feature: The sequence is a functional homolog of SEQ ID NO 1223 in the 10/374,780 US patent application
  misc_feature: The sequence is a functional homolog of SEQ ID NO 1412 in the 10/412,699 US patent application
  misc_feature: The sequence is a functional homolog of SEQ ID NO 716 in the 11/435,388 US patent application
  misc_feature: The sequence is a functional homolog of SEQ ID NO 1227 in the 10/374,780 US patent application
  misc_feature: The sequence is a functional homolog of SEQ ID NO 706 in the 11/435,388 US patent application
  misc_feature: Useful for making plants with modulated salt sensitivity
  misc_feature: Useful for making plants with modulated nitrogen use efficiency
  misc_feature: Useful for making plants with modulated low light sensitivity
  misc_feature: The sequence is a functional homolog of SEQ ID NO 1248 in the 10/374,780 US patent application
  misc_feature: The sequence is a functional homolog of SEQ ID NO 1225 in the 10/374,780 US patent application
  misc_feature: The sequence is a functional homolog of SEQ ID NO 2 in US patent 7253000
  misc_feature: The sequence is a functional homolog of SEQ ID NO 1722 in the 10/412,699 US patent application
  misc_feature: The sequence is a functional homolog of SEQ ID NO 192 in the 11/375,241 US patent application
  misc_feature: The sequence is a functional homolog of SEQ ID NO 1958 in the 10/374,780 US patent application
  misc_feature: The sequence is a functional homolog of SEQ ID NO 2241 in the 10/666,642 US patent application
  misc_feature: The sequence is a functional homolog of SEQ ID NO 424 in the 10/714,887 US patent application
  misc_feature: The sequence is a functional homolog of SEQ ID NO 46 in the 10/412,699 US patent application
  misc_feature: The sequence is a functional homolog of SEQ ID NO 57 in the 10/838,616 US patent application
  misc_feature: The sequence is a functional homolog of SEQ ID NO 576 in the 11/435,388 US patent application
  misc_feature: The sequence is a functional homolog of SEQ ID NO 72 in the 10/669,824 US patent application
  misc_feature: The sequence is a functional homolog of SEQ ID NO 72 in the 10/870,198 US patent application
  misc_feature: The sequence is a functional homolog of SEQ ID NO 98 in the 10/675,852 US patent application
  misc_feature: The sequence is a functional homolog of SEQ ID NO 1246 in the 10/374,780 US patent application
  misc_feature: The sequence is a functional homolog of SEQ ID NO 748 in the 11/435,388 US patent application
  misc_feature: The sequence is a functional homolog of SEQ ID NO 1239 in the 10/374,780 US patent application
  misc_feature: The sequence is a functional homolog of SEQ ID NO 764 in the 11/435,388 US patent application
  misc_feature: The sequence is a functional homolog of SEQ ID NO 1230 in the 10/374,780 US patent application
  misc_feature: The sequence is a functional homolog of SEQ ID NO 724 in the 11/435,388 US patent application
  misc_feature: The sequence is a functional homolog of SEQ ID NO 1720 in the 10/412,699 US patent application
  misc_feature: The sequence is a functional homolog of SEQ ID NO 1956 in the 10/374,780 US patent application
  misc_feature: The sequence is a functional homolog of SEQ ID NO 196 in the 11/375,241 US patent application
  misc_feature: The sequence is a functional homolog of SEQ ID NO 2239 in the 10/666,642 US patent application
  misc_feature: The sequence is a functional homolog of SEQ ID NO 422 in the 10/714,887 US patent application
  misc_feature: The sequence is a functional homolog of SEQ ID NO 44 in the 10/412,699 US patent application
  misc_feature: The sequence is a functional homolog of SEQ ID NO 55 in the 10/838,616 US patent application
  misc_feature: The sequence is a functional homolog of SEQ ID NO 574 in the 11/435,388 US patent application
  misc_feature: The sequence is a functional homolog of SEQ ID NO 70 in the 10/669,824 US patent application
  misc_feature: The sequence is a functional homolog of SEQ ID NO 70 in the 10/870,198 US patent application
  misc_feature: The sequence is a functional homolog of SEQ ID NO 96 in the 10/675,852 US patent application
  misc_feature: The sequence is a functional homolog of SEQ ID NO 2 in US patent 7138277
  misc_feature: The sequence is a functional homolog of SEQ ID NO 1314 in the 11/479,226 US patent application
  misc_feature: The sequence is a functional homolog of SEQ ID NO 16 in the 10/225,068 US patent application
  misc_feature: The sequence is a functional homolog of SEQ ID NO 186 in the 10/374,780 US patent application
  misc_feature: The sequence is a functional homolog of SEQ ID NO 190 in the 11/375,241 US patent application
  misc_feature: The sequence is a functional homolog of SEQ ID NO 516 in the 11/435,388 US patent application
  misc_feature: The sequence is a functional homolog of SEQ ID NO 566 in the 10/225,066 US patent application
  misc_feature: The sequence is a functional homolog of SEQ ID NO 616 in the 10/412,699 US patent application
  misc_feature: The sequence is a functional homolog of SEQ ID NO 692 in the 11/435,388 US patent application
  misc_feature: The sequence is a functional homolog of SEQ ID NO 1228 in the 10/374,780 US patent application
  misc_feature: The sequence is a functional homolog of SEQ ID NO 722 in the 11/435,388 US patent application
  misc_feature: The sequence is a functional homolog of SEQ ID NO 752 in the 11/435,388 US patent application
  misc_feature: The sequence is a functional homolog of SEQ ID NO 1244 in the 10/374,780 US patent application
  misc_feature: The sequence is a functional homolog of SEQ ID NO 744 in the 11/435,388 US patent application
  misc_feature: The sequence is a functional homolog of SEQ ID NO 1235 in the 10/374,780 US patent application
  misc_feature: The sequence is a functional homolog of SEQ ID NO 714 in the 11/435,388 US patent application
  misc_feature: Useful for making plants with altered terpenoid content
  misc_feature: Useful for making plants with modulated flowering time
  misc_feature: The sequence is a functional homolog of SEQ ID NO 1226 in the 10/374,780 US patent application
  misc_feature: The sequence is a functional homolog of SEQ ID NO 698 in the 11/435,388 US patent application
  misc_feature: The sequence is a functional homolog of SEQ ID NO 700 in the 11/435,388 US patent application
  misc_feature: The sequence is a functional homolog of SEQ ID NO 1221 in the 10/374,780 US patent application
  misc_feature: The sequence is a functional homolog of SEQ ID NO 1410 in the 10/412,699 US patent application
  misc_feature: The sequence is a functional homolog of SEQ ID NO 720 in the 11/435,388 US patent application
  misc_feature: The sequence is a functional homolog of SEQ ID NO 704 in the 11/435,388 US patent application
  misc_feature: The sequence is a functional homolog of SEQ ID NO 780 in the 11/435,388 US patent application
  misc_feature: The sequence is a functional homolog of SEQ ID NO 696 in the 11/435,388 US patent application
  misc_feature: The sequence is a functional homolog of SEQ ID NO 694 in the 11/435,388 US patent application
  misc_feature: The sequence is a functional homolog of SEQ ID NO 1238 in the 10/374,780 US patent application
  misc_feature: The sequence is a functional homolog of SEQ ID NO 770 in the 11/435,388 US patent application
  misc_feature: The sequence is a functional homolog of SEQ ID NO 1243 in the 10/374,780 US patent application
  misc_feature: The sequence is a functional homolog of SEQ ID NO 768 in the 11/435,388 US patent application
  misc_feature: The sequence is a functional homolog of SEQ ID NO 1241 in the 10/374,780 US patent application
  misc_feature: The sequence is a functional homolog of SEQ ID NO 762 in the 11/435,388 US patent application
  misc_feature: The sequence is a functional homolog of SEQ ID NO 1222 in the 10/374,780 US patent application
  misc_feature: The sequence is a functional homolog of SEQ ID NO 1411 in the 10/412,699 US patent application
  misc_feature: The sequence is a functional homolog of SEQ ID NO 712 in the 11/435,388 US patent application
  misc_feature: Useful for making plants with modulated biomass
  misc_feature: The sequence is a functional homolog of SEQ ID NO 702 in the 11/435,388 US patent application
  misc_feature: The sequence is a functional homolog of SEQ ID NO 776 in the 11/435,388 US patent application
  misc_feature: The sequence is a functional homolog of SEQ ID NO 778 in the 11/435,388 US patent application
  misc_feature: The sequence is a functional homolog of SEQ ID NO 1231 in the 10/374,780 US patent application
  misc_feature: The sequence is a functional homolog of SEQ ID NO 708 in the 11/435,388 US patent application
  misc_feature: The sequence is a functional homolog of SEQ ID NO 1236 in the 10/374,780 US patent application
  misc_feature: The sequence is a functional homolog of SEQ ID NO 1234 in the 10/374,780 US patent application
  misc_feature: The sequence is a functional homolog of SEQ ID NO 1050 in the 10/666,642 US patent application
  misc_feature: The sequence is a functional homolog of SEQ ID NO 1233 in the 10/374,780 US patent application
  misc_feature: The sequence is a functional homolog of SEQ ID NO 154 in the 10/225,068 US patent application
  misc_feature: The sequence is a functional homolog of SEQ ID NO 1716 in the 10/412,699 US patent application
  misc_feature: The sequence is a functional homolog of SEQ ID NO 1952 in the 10/374,780 US patent application
  misc_feature: The sequence is a functional homolog of SEQ ID NO 200 in the 11/375,241 US patent application
  misc_feature: The sequence is a functional homolog of SEQ ID NO 4 in the 10/666,642 US patent application
  misc_feature: The sequence is a functional homolog of SEQ ID NO 572 in the 11/435,388 US patent application
MEYDEQESPEAAAGEEYATVMSAPPKRPAGRTKFRETRHPVYRGVRRRGPAGRWVCEVREPNWMSRIWLGSFATAEAAARAHDGAALALRGHAACLNFGDSARLLRGYPLTRAARHDLRRGATGLA

SEQ ID NO: 22967 - DNA, 1450 bp, Panicum virgatum
  misc_feature: Ceres CLONE 1824687
  misc_feature: Encodes the peptide sequence at SEQ ID NO. 22968
gattccgcgtcacttgccagtcaacagtgaccaggtcgggcggccgtcgatctcaccgcacaccgccggtccagtcctcgccggcgtcggacgcggtgaagttgaagttaaaactggtaaatttggatccatttcatatcgactcggagaattttttggatcttatctggccaccaccatggaacatgacggcacgaacctgactgtcactgaggccgtgcgctccgtgcagctgctcaagattgacggctactgtgccaccgctgccatggagacatcggagttcatcaaatccagatggaatatctatggccacgagtgggagatccgtttctatcctgattactggcacttcttcgaggaggaggaagcgtactaccaactcgatgaccacaccgagtgggtcgctctgaagctcatccttgtcagtgaaccccagagggacaagctgagggtgaatctgagctgccggcttgtatgccccagccagcatctcgatccctccgaagagaagattgtgtcccatgtatttgacagccactccaaatgctcgcctgaagttctcctcatgccgaaacacgtcctaccatcatcaggttatatcgtgaatgactcactgaccgtggaatgcacaatcaccgtgctagcccacttggacaccgcggataaggagcagcccctgctagtgccgccaccgtcggacctacaccagcacctcggtgagctcttggagagccaagacggagcggacatcacgtttcatgtctctggggaatccttcgccgcccacaaggtcatacttgccgcaaggtccccggttttcaaggccaagttctccggaggcatggaggaaacaagctccgagtctgtggtgatcgaagacatggaggctgctgtgttcaagtccatgcttcacttcatctacactgacatggctccggagctcgacggtgacctggagcctcaggcagcggcgaccatggctcagcacctcctggcagctgcagacaggtatgggctgaacaggctcaagctgatatgtgaatgcaagctctctggtggcatcgacattggcatagcggccaccacgttggctctcgccgagcagcaccactgctcgctgctcaaagccaagtgtcttgagttcgtcaccaagtcgcctgaaactcttgatgctgtcttggcaactgatggctacgcgcatctggtggcaagctgccccttggtgctgactgaactactgagggctgcgcgtggaaggaagatctgagctggatgatggttttcgttgactgtccttgcgtcctaatattactatctgcctagtactattgtcagttgctctaaaaaaaagtactactgtcagttgcttctcatattatgatttccctaagatgtgtgacctgtatgactgctatatcatgatgaactagtgcttgcagttgatttc

SEQ ID NO: 22968 - protein, 363 aa, Panicum virgatum
  misc_feature: Ceres CLONE 1824687
  misc_feature (180)..(296): Pfam Name: BTB Pfam Description: BTB/POZ domain
MEHDGTNLTVTEAVRSVQLLKIDGYCATAAMETSEFIKSRWNIYGHEWEIRFYPDYWHFFEEEEAYYQLDDHTEWVALKLILVSEPQRDKLRVNLSCRLVCPSQHLDPSEEKIVSHVFDSHSKCSPEVLLMPKHVLPSSGYIVNDSLTVECTITVLAHLDTADKEQPLLVPPPSDLHQHLGELLESQDGADITFHVSGESFAAHKVILAARSPVFKAKFSGGMEETSSESVVIEDMEAAVFKSMLHFIYTDMAPELDGDLEPQAAATMAQHLLAAADRYGLNRLKLICECKLSGGIDIGIAATTLALAEQHHCSLLKAKCLEFVTKSPETLDAVLATDGYAHLVASCPLVLTELLRAARGRKI

SEQ ID NO: 22969 - DNA, 1724 bp, Panicum virgatum
  misc_feature: Ceres CLONE 1824693
  misc_feature: Encodes the peptide sequence at SEQ ID NO. 22970
agcttcatgaagtggctctgcactttcctgaagggttcaaagcctggcgagccgaaccagcggcggccccggattacggccggcggagaggaggaggacacgctctggcaacctccagtcagaccaaagaatgacccacctagaaatgacaatgaagaattggaccgtgcaattgcagagtctcttgcagaggatgtcaaaccccccaaagaacgaaaccataagggagacagcaacgatgaagatcttgcaagagccatacaggacagtctcaacatgaatccttacacgccttacaacccttatgccccttcccaggcccagccgagaggacacagggtatgtggacgctgcaagcatgagataggacatggccattacttgagctgcatgggaatttactggcaccctcagtgcttccgctgctgctcctgtggccaccctatccgtgagactgagttcaccttgctaggcacagatccataccacaagttgtgctacaaggagctgcatcacccaaaatgcgacgtctgccttcagtttattccaacgaacaggagtggcttgatagagtacagagcccacccattctggggtcagaagtactgccctttacatgagcaagacaggacgccgcgttgctgtagctgtgagaaaatggagccaaggaacacaaagtatatgtcactaggagatggccgcagcttgtgcatggaatgcctaggatctgcagtcatggacactggcgagtgccaacccctgtaccattctatcagagactactacgaggggatgtacatgaaactggaccagcagatacccatgctcttggttgaacggcaagcgcttaacgaagccatggaaggagagagcaaaggtccacaccatatgcctgaaacaagaggcctatgtctgtcagaggagcagactgtgagcagtatacttaggaggcccagaattggtggaaaccggttactggacatgagaactcagccacaaaagctgacaaggagatgtgaagttactgcgatacttgtcttgtatggtctccccaggctactaacaggctccattcttgcccatgagctgatgcacgggtggttgcgcctcaaaggttaccgaaacctaaatgcggaggttgaagaaggcatatgccaggtcatgtcttacttgtggctggaatcagagattcttccagcttcctcaaggcacgcgccttcatcgtcctacgcctcctcttcctcttcttcttatccacccacatcatccaagaaaggtggaatttctcataccgagaagaagctcggagagttcttcatgcaccagattgccaatgacacatcaacagcctacggtgacggtttcagaactgcctatgctgctgtcaacaagtatggccttcgccaaacactgaaccatatacgcctgactggaggcttccctgtataagagagagatatacacgttatgtccattctacatgcatagcacaaagatcatatatcaaaggtgatataaacatggaggttaagtggtttatggaagagtgattcagatttcggtgaccttgagttttcgaaggggtcatgtgagagcaaatcagaaaaggaactgcatttgctcgaattaataggaataggagttggcgatgcacaagtgtaataagattgcccaaaagtgcctatgtaaaacagtacatgtcatactaatataatgaagtagat

SEQ ID NO: 22970 - protein, 480 aa, Panicum virgatum
  misc_feature: Ceres CLONE 1824693
  misc_feature (113)..(169): Pfam Name: LIM Pfam Description: LIM domain
MKWLCTFLKGSKPGEPNQRRPRITAGGEEEDTLWQPPVRPKNDPPRNDNEELDRAIAESLAEDVKPPKERNHKGDSNDEDLARAIQDSLNMNPYTPYNPYAPSQAQPRGHRVCGRCKHEIGHGHYLSCMGIYWHPQCFRCCSCGHPIRETEFTLLGTDPYHKLCYKELHHPKCDVCLQFIPTNRSGLIEYRAHPFWGQKYCPLHEQDRTPRCCSCEKMEPRNTKYMSLGDGRSLCMECLGSAVMDTGECQPLYHSIRDYYEGMYMKLDQQIPMLLVERQALNEAMEGESKGPHHMPETRGLCLSEEQTVSSILRRPRIGGNRLLDMRTQPQKLTRRCEVTAILVLYGLPRLLTGSILAHELMHGWLRLKGYRNLNAEVEEGICQVMSYLWLESEILPASSRHAPSSSYASSSSSSYPPTSSKKGGISHTEKKLGEFFMHQIANDTSTAYGDGFRTAYAAVNKYGLRQTLNHIRLTGGFPV

SEQ ID NO: 22971 - DNA, 625 bp, Panicum virgatum
  misc_feature: Ceres CLONE 1824701
  misc_feature: Encodes the peptide sequence at SEQ ID NO. 22972
gttgaaggctcctgagctcctttatagatcccttgcagcgaagcttgtggttggcatgcctttcaaggaccttgctactgtagattccattcttttgagggagctcccccctgtagaagatgctgaagctaggcttgcactcaaaagattagttgacattagcatgggagtgttgacccccttatcagagcagttgacaaaaccactcccacatgcaattgcgcttgtcaaccttgacgaactatcaagtggggctcacaaacttttgccacaaggtactagacttgctgtcacccttcgtggagatgaatcagacgagcagctagatatccttaagggtgttgatgatataacaatgctgctacatagcgttccatatggtgaggagaagactggcagagtacatgctgctaggaggttattcgagtacttacagaacaatggcttgaactttcctgtaatccatcacatagagttccctaaaaccattggcagagatgatcttgtcattggtgctggggcgaatgttggtgctctcctagtcgatggtcttggtgatggtgtacttcttgaagctgctgaccaggaatttgagttcctgagggacacatctttcaacttgctt

SEQ ID NO: 22972 - protein, 207 aa, Panicum virgatum
  misc_feature: Ceres CLONE 1824701
  misc_feature: SWISSPROT Homolog: EC 1.17.4.3 4-hydroxy-3-methylbut-2-en-1-yl diphosphate synthase
LKAPELLYRSLAAKLVVGMPFKDLATVDSILLRELPPVEDAEARLALKRLVDISMGVLTPLSEQLTKPLPHAIALVNLDELSSGAHKLLPQGTRLAVTLRGDESDEQLDILKGVDDITMLLHSVPYGEEKTGRVHAARRLFEYLQNNGLNFPVIHHIEFPKTIGRDDLVIGAGANVGALLVDGLGDGVLLEAADQEFEFLRDTSFNL

SEQ ID NO: 22973 - DNA, 719 bp, Panicum virgatum
  misc_feature: Ceres CLONE 1824710
  misc_feature: Encodes the peptide sequence at SEQ ID NO. 22974
caccattccaaaccaaacacgagagctagcgtccggctagtgagagcagcagccagcaagcgggcaaggcaagagagaaagcaggcaggcaaacatgtgtggtggtgcgatcctcgcggagctcataccgagcgcgccggcgcgccgcgtcacgccgggccacgtctggcccgcggccaagcagcagaggagggccgacgacttcgaggccgcgttccgggagttcgactccgactccgactccgacgaggaggtggagagcaagccgctcggcttcaacgcttcccccgccggcgcggcgaccaggaagctgaggaggcagcagcagcagcagcagcagcgggagctggccgcgccggcgccgagcaggcgccgcaaggccgcgcagtacaagggcgtccggcgccgcccgtggggcaagtgggccgccgagatccgcgaccccgtcaagggcgtccgcgtctggctcggcaccttctcctccgccgaggccgccgcgctcgcctacgacgccgccgcgcgcgacatccgcgggcccagggccaagctcaacttcccctcgaacgccgacgcccctcccgccgccgggcgcaagcgcgccgagttcgtcgacctcgtcgccgacgaggaggacgagcagcagcgccacgcagcgtccggcgtcaagcacgaggccggggccaccaacagcgagacctccgagtccggcggcgccctcc

SEQ ID NO: 22974 - protein, 208 aa, Panicum virgatum
  misc_feature: Ceres CLONE 1824710
  misc_feature (97)..(148): Pfam Name: AP2 Pfam Description: AP2 domain
  misc_feature: Useful for making plants with altered alkaloid content
  misc_feature: The sequence is a functional homolog of SEQ ID NO 162 in the 10/714,887 US patent application
  misc_feature: The sequence is a functional homolog of SEQ ID NO 162 in the 11/435,388 US patent application
  misc_feature: The sequence is a functional homolog of SEQ ID NO 30 in the 10/903,236 US patent application
MCGGAILAELIPSAPARRVTPGHVWPAAKQQRRADDFEAAFREFDSDSDSDEEVESKPLGFNASPAGAATRKLRRQQQQQQQRELAAPAPSRRRKAAQYKGVRRRPWGKWAAEIRDPVKGVRVWLGTFSSAEAAALAYDAAARDIRGPRAKLNFPSNADAPPAAGRKRAEFVDLVADEEDEQQRHAASGVKHEAGATNSETSESGGAL

SEQ ID NO: 22975 - DNA, 1275 bp, Panicum virgatum
  misc_feature: Ceres CLONE 1824713
  misc_feature: Encodes the peptide sequence at SEQ ID NO. 22976
gccaaaaccacgagccctcacaaaaccagagcaggtcgctgctccgccgccgcgccatggcttcgccgtcaccctcctcgccgctccacccgcaccagcaccagcaccagcacccccttcctccgaatgctcacccccaattccaagccccgccgccttcgatgccgccgccgccgccagcggcgccacccaaggcgctcgatctggaggtcaccgtcgtttccgggaagcacctgaagaacgtcaactggcgacgcggtgacctccgcgcctacgtcgtcgcctacctcgacccctcccgccgcgccgccacccgccccgacgacgccggcgggtgcaagccagtctggaacgagcgcctcgtcctcccgctcccgccccacctctcaccgcacgatccctccatcctcctgtccctcgacgtcttccactccaagccctccgactcgcccaagccgctcgtcggatccgcccgctcgcctctccgcgacctcctcttccccacaaaccctaaccctagccacgattccgcggcctccactctcgtcagcctgccgctccttcgcccttcaggccgtccacagggaaagctccgcatccgcgttgccatccgcgagcgcttgccgccgcttcctgagccgcagtacccgctgccttccagctccccatactactttccaccgcctccgcctcccacctactcggccccgccgcagtacggatccgaacagtattaccgtcccagtgggagtgagagtggaaggtatggactaggcactggacttgcggtgggtgctgtggctggaaccctcggggggctagctatcgatgaaggggtgaagtacaaggaggagaaggctgcagagcgggtggaagagaaggtggtacctgctgggagggatggttacagcgagtatcgtggcgactattgaatgggagcttgtggtggagtggacttgaggatgcactgtgagttggttcttcttccctacctgtgggaatagagtcacagtgttagtttatgatttgctccatatatgtatatatttgtgtatgctgtggatcattttgatgcctatgaagtaatatgtatgaaatatttggcttgtgccatgaaggtttaatgtttttctttgatggtgtacttgtgtcttgttttttgggtcttatctttttctgcaattgtactatctgtttttcattgtatctggtacgttggaattgttgtatatagtacactcataaataataattatactgctctgctttccttgc

SEQ ID NO: 22976 - protein, 291 aa, Panicum virgatum
  misc_feature: Ceres CLONE 1824713
  misc_feature (50)..(140): Pfam Name: C2 Pfam Description: C2 domain
MASPSPSSPLHPHQHQHQHPLPPNAHPQFQAPPPSMPPPPPAAPPKALDLEVTVVSGKHLKNVNWRRGDLRAYVVAYLDPSRRAATRPDDAGGCKPVWNERLVLPLPPHLSPHDPSILLSLDVFHSKPSDSPKPLVGSARSPLRDLLFPTNPNPSHDSAASTLVSLPLLRPSGRPQGKLRIRVAIRERLPPLPEPQYPLPSSSPYYFPPPPPPTYSAPPQYGSEQYYRPSGSESGRYGLGTGLAVGAVAGTLGGLAIDEGVKYKEEKAAERVEEKVVPAGRDGYSEYRGDY

SEQ ID NO: 22977 - DNA, 1627 bp, Panicum virgatum
  misc_feature: Ceres CLONE 1824714
  misc_feature: Encodes the peptide sequence at SEQ ID NO. 22978
tatacatacatgtctatgataaatggacatgttgcagctggcaactcgaaggaggcatttcagcttcatgatgaaatgatccatagaggatttgctcctgatgataaattctgagaagtactggtaatggtaccgtactcttgccagtgtctttggaattgttgcctccacagatattgtgaatttgatgatgaaggtgagtatgagacattttagcatcgagccttgaaacaacatctagttttgcatttaaccctaatccttacagtcatagtggaatcaacaatgaaaaatgatgtctggtatacttacctttgtatgatatgacaaatcatgtcctttaccagatcaagaaagaaacttgttagatgtacaagtacaagtggcattggcggtgcaattaatattatttttctttttggcctttttagtatttcacccttctacctggtttgtgacttggcactgtcatatactaaccctgataattgtcttaggaagtaattactatggaagtcctctcccatgggaactttgtattgtgggagtggtttgttcaccaaggtccagaaatgttggacagcagaattatagaaaatcttcttaacctctcaggtactcttttgacccagcagaaatgttccctccacatatattctaccttttacaaactcagctaggtccaggctttaatttgcttattagaaatactttcagaatcatcttaccaggagtttattttgacaaagcctttgtatatcttaccaggagtagtatgttatcagttagtggcattttttaaaaccatttgtttttgtggttgctaaactcacatgtacgcttcgatgagttacttcctgttcaggggcagatccagagaaatgagagagcactggagcttcattacttggtcttggtgagagagacagatacgacacaaagtaggtaatgcccgagcttcaagcctgcaactatggtctacaaattccacgatgtggtaaggttttaagaaataagaaacatgttattgggttatggagctacttgtttgcactgaaccctttgttaggaatataaaggatcgatgggtcagaaaaacaaaaagttcaggataaaaagaaattagtgcaccccccaaaaaaaaaagttaaaaaatctagtggtaggcttctttgttgccgagtgaccctttgaaagatgtttcttttagtgcaaataccagcaccctcttgctcatgaaattgtgaccagcagaacaacatcattaaatttagtttgtgattatttgcactgctaggtatgatcataaaaatcagacagacctctttgattggtaagaaaaactataatccttctaaaatttagaatctggaggatgtcatgtgaaacctgggatggtaagaagattcgaaccatgcaaaagatgtcattatgtttcatctgtcatattaacagcaacaatgaacagagtatgtacaagatgtcatatgtacaagcttaccccattatctacatgcaggctaagcaaaaactgctgcacagaaaagatagaaaattgattgggatgctaaatatgcgtctccttcattctgctctccagaagagcagccaaaagaatattgaatgg

SEQ ID NO: 22978 - protein, 37 aa, Panicum virgatum
  misc_feature: Ceres CLONE 1824714
  misc_feature (1)..(35): Pfam Name: PPR Pfam Description: PPR repeat
YTYMSMINGHVAAGNSKEAFQLHDEMIHRGFAPDDKF

SEQ ID NO: 22979 - DNA, 675 bp, Panicum virgatum
  misc_feature: Ceres CLONE 1824730
  misc_feature: Encodes the peptide sequence at SEQ ID NO. 22980
aaactcaactccgcctcgactccccagccgacctccgccgcattcccacacacccccattccccacggcccacacgcgcgggcccaggcgcccaatctccatccccacaccttcgtcgtcttcgtcttcgtctacgacttctgctgccgctcggctcaccctggcggcctcgctgttcgatctcgcgctgcgatggagcggtacgaggtgatccgggacatcggggcgggaaacttcagggtggccaagatggtgcgggacgtcaagaccgaggagctcttcgccgtcaagttcatcgagagaggccagatgattgatgagcatgttgaaagggagattatgaaccaccggtcactgaagcatccaaacataattagattcaaggaggttgtgctaactcccacacatttggcgatagatatggaatatgctgctggtggtgagctatttgaaaggatttgcaatgctgggaggtttagtgaggatgaggcaaggttcttcttccaacaactgatttcaggagtgagctattgtcattcaatgcaaatatgccatagagatctgaaactagaaaatactctcttagatggcagtgccgcacctcggctcaagatctgtgattttggttattccaagtcttctgtgttgcactctcaaccaaaatcaactgttggc

SEQ ID NO: 22980 - protein, 160 aa, Panicum virgatum
  misc_feature: Ceres CLONE 1824730
  misc_feature (4)..(160): Pfam Name: Pkinase Pfam Description: Protein kinase domain
  misc_feature: SWISSPROT Homolog: EC 2.7.11.1 Non-specific serine/threonine protein kinase
  misc_feature: Useful for making plants with modulated water use efficiency
  misc_feature: Useful for biocontainment applications
  misc_feature: Useful for making plants with modulated biomass
  misc_feature: Useful for making plants with modulated time to senescence
MERYEVIRDIGAGNFRVAKMVRDVKTEELFAVKFIERGQMIDEHVEREIMNHRSLKHPNIIRFKEVVLTPTHLAIDMEYAAGGELFERICNAGRFSEDEARFFFQQLISGVSYCHSMQICHRDLKLENTLLDGSAAPRLKICDFGYSKSSVLHSQPKSTV

SEQ ID NO: 22981 - DNA, 660 bp, Panicum virgatum
  misc_feature: Ceres CLONE 1824743
  misc_feature: Encodes the peptide sequence at SEQ ID NO. 22982
acagaccactcagctcaaccagtcaagctcaacgcaagcgaccacaagcactgaagcagccactcgactccacataccaagctcaagcatccacctgaagaaaacagcagcagcagccagcaggaagcagccatggacatgggccgcctcgagcgctcgacctcctcctcctcgtcctccaccacctcggcgtcctcgtcctcgtcgggcaggaacgacaaggcgtcgccgccgacctcgccctccccgccggcgccgcccaagaagcgccccgcgggccgcaccaagttccgcgagacgcgccacccggtgttccgcggcgtgcgccgccggggcgccgcgggccgctgggtgtgcgaggtgcgcgtcccggggaaccgcggcgcgcgcctgtggctcggcacctacgtcgccgccgaggccgcggcgcgcgcgcacgacgccgcgatgctcgccctgggccgcggcggctccggggcggggctcaacttcccggactccgcgtggcggctcgcgctgccgccgccctccgcgctcccgagcctggacgacgcccgccgcgccgccctcgaggccgtcgcggacttccagcgccgctccggtgccaatgacagcgccgccgccgcggtcgacaaggcgacctcgagcatgtcggctccg

SEQ ID NO: 22982 - protein, 175 aa, Panicum virgatum
  misc_feature: Ceres CLONE 1824743
  misc_feature (59)..(112): Pfam Name: AP2 Pfam Description: AP2 domain
  misc_feature: The sequence is a functional homolog of SEQ ID NO 752 in the 11/435,388 US patent application
  misc_feature: The sequence is a functional homolog of SEQ ID NO 1247 in the 10/374,780 US patent application
  misc_feature: The sequence is a functional homolog of SEQ ID NO 746 in the 11/435,388 US patent application
  misc_feature: The sequence is a functional homolog of SEQ ID NO 1244 in the 10/374,780 US patent application
  misc_feature: The sequence is a functional homolog of SEQ ID NO 744 in the 11/435,388 US patent application
  misc_feature: The sequence is a functional homolog of SEQ ID NO 1228 in the 10/374,780 US patent application
  misc_feature: The sequence is a functional homolog of SEQ ID NO 722 in the 11/435,388 US patent application
  misc_feature: The sequence is a functional homolog of SEQ ID NO 1235 in the 10/374,780 US patent application
  misc_feature: The sequence is a functional homolog of SEQ ID NO 714 in the 11/435,388 US patent application
  misc_feature: The sequence is a functional homolog of SEQ ID NO 1248 in the 10/374,780 US patent application
  misc_feature: The sequence is a functional homolog of SEQ ID NO 1230 in the 10/374,780 US patent application
  misc_feature: The sequence is a functional homolog of SEQ ID NO 724 in the 11/435,388 US patent application
  misc_feature: The sequence is a functional homolog of SEQ ID NO 2 in US patent 7253000
  misc_feature: The sequence is a functional homolog of SEQ ID NO 1221 in the 10/374,780 US patent application
  misc_feature: The sequence is a functional homolog of SEQ ID NO 1410 in the 10/412,699 US patent application
  misc_feature: The sequence is a functional homolog of SEQ ID NO 720 in the 11/435,388 US patent application
  misc_feature: The sequence is a functional homolog of SEQ ID NO 1246 in the 10/374,780 US patent application
  misc_feature: The sequence is a functional homolog of SEQ ID NO 748 in the 11/435,388 US patent application
  misc_feature: The sequence is a functional homolog of SEQ ID NO 2 in US patent 7138277
  misc_feature: The sequence is a functional homolog of SEQ ID NO 1224 in the 10/374,780 US patent application
  misc_feature: The sequence is a functional homolog of SEQ ID NO 1413 in the 10/412,699 US patent application
  misc_feature: The sequence is a functional homolog of SEQ ID NO 710 in the 11/435,388 US patent application
  misc_feature: The sequence is a functional homolog of SEQ ID NO 1229 in the 10/374,780 US patent application
  misc_feature: The sequence is a functional homolog of SEQ ID NO 4 in US patent 7317141
  misc_feature: The sequence is a functional homolog of SEQ ID NO 750 in the 11/435,388 US patent application
  misc_feature: The sequence is a functional homolog of SEQ ID NO 1245 in the 10/374,780 US patent application
  misc_feature: The sequence is a functional homolog of SEQ ID NO 1231 in the 10/374,780 US patent application
  misc_feature: The sequence is a functional homolog of SEQ ID NO 708 in the 11/435,388 US patent application
  misc_feature: The sequence is a functional homolog of SEQ ID NO 1232 in the 10/374,780 US patent application
  misc_feature: The sequence is a functional homolog of SEQ ID NO 718 in the 11/435,388 US patent application
  misc_feature: The sequence is a functional homolog of SEQ ID NO 1236 in the 10/374,780 US patent application
  misc_feature: The sequence is a functional homolog of SEQ ID NO 1222 in the 10/374,780 US patent application
  misc_feature: The sequence is a functional homolog of SEQ ID NO 1411 in the 10/412,699 US patent application
  misc_feature: The sequence is a functional homolog of SEQ ID NO 712 in the 11/435,388 US patent application
  misc_feature: Useful for making plants with modulated low light sensitivity
  misc_feature: Useful for making plants with modulated salt sensitivity
  misc_feature: Useful for making plants with modulated nitrogen use efficiency
  misc_feature: The sequence is a functional homolog of SEQ ID NO 1239 in the 10/374,780 US patent application
  misc_feature: The sequence is a functional homolog of SEQ ID NO 764 in the 11/435,388 US patent application
  misc_feature: The sequence is a functional homolog of SEQ ID NO 1241 in the 10/374,780 US patent application
  misc_feature: The sequence is a functional homolog of SEQ ID NO 762 in the 11/435,388 US patent application
  misc_feature: The sequence is a functional homolog of SEQ ID NO 702 in the 11/435,388 US patent application
  misc_feature: The sequence is a functional homolog of SEQ ID NO 1722 in the 10/412,699 US patent application
  misc_feature: The sequence is a functional homolog of SEQ ID NO 192 in the 11/375,241 US patent application
  misc_feature: The sequence is a functional homolog of SEQ ID NO 1958 in the 10/374,780 US patent application
  misc_feature: The sequence is a functional homolog of SEQ ID NO 2241 in the 10/666,642 US patent application
  misc_feature: The sequence is a functional homolog of SEQ ID NO 424 in the 10/714,887 US patent application
  misc_feature: The sequence is a functional homolog of SEQ ID NO 46 in the 10/412,699 US patent application
  misc_feature: The sequence is a functional homolog of SEQ ID NO 57 in the 10/838,616 US patent application
  misc_feature: The sequence is a functional homolog of SEQ ID NO 576 in the 11/435,388 US patent application
  misc_feature: The sequence is a functional homolog of SEQ ID NO 72 in the 10/669,824 US patent application
  misc_feature: The sequence is a functional homolog of SEQ ID NO 72 in the 10/870,198 US patent application
  misc_feature: The sequence is a functional homolog of SEQ ID NO 98 in the 10/675,852 US patent application
  misc_feature: Useful for making plants with altered terpenoid content
  misc_feature: Useful for making plants with modulated flowering time
  misc_feature: The sequence is a functional homolog of SEQ ID NO 1238 in the 10/374,780 US patent application
  misc_feature: The sequence is a functional homolog of SEQ ID NO 770 in the 11/435,388 US patent application
  misc_feature: The sequence is a functional homolog of SEQ ID NO 692 in the 11/435,388 US patent application
  misc_feature: The sequence is a functional homolog of SEQ ID NO 1243 in the 10/374,780 US patent application
  misc_feature: The sequence is a functional homolog of SEQ ID NO 768 in the 11/435,388 US patent application
MDMGRLERSTSSSSSSTTSASSSSSGRNDKASPPTSPSPPAPPKKRPAGRTKFRETRHPVFRGVRRRGAAGRWVCEVRVPGNRGARLWLGTYVAAEAAARAHDAAMLALGRGGSGAGLNFPDSAWRLALPPPSALPSLDDARRAALEAVADFQRRSGANDSAAAAVDKATSSMSA

SEQ ID NO: 22983 - DNA, 1022 bp, Panicum virgatum
  misc_feature: Ceres CLONE 1824744
  misc_feature: Encodes the peptide sequence at SEQ ID NO. 22984
aaatccaagctcctcctctcccctcgacctctcctggcagacatcgacgatccaaagatagcgcaaccgcctccctctccgatctccccctatttgaggatcccaccgagacctcctcttcttctcccacggcacgatcgaggacccaagaatccaattccagccgagaaagagaaagcaagcaggcaatttcgagagagatttaatctaaaggagcgatctttgaggcaggcagaggagaggatcaacatccatggcggcggtgatggtggcgaggcaggggcgggagctgcagcggtacagcgacagcaccggcggcgaggtggaggtgctggtgatcagctcgcagaagaagggccccgcgggtggcgtgctgatccccaagggcgggtgggagctggacgagtccatggacgaggcggcccggcgcgaggccgcggaggaggccggcgtggtcggcgagacgggccccgcgctggggcggtggtgctaccgcagccgcagctacgacgcgacctacgagggcttcgtgctcccgctgcgcgtcacggcggagctggagcggtggcccgagatgggcgcccgccgccgggagtgggtcacccccgccgaggccgtcgcgcggtgcccgcacgcgtggatgcgcgaggcgctgcaacgcttcgccggcaccgtcgtcgccggggccggggccacggcggcgctcctcggctccgccctgtagccgggcgcgcgggctcggctccggcctcgcgcgtttttcggccggccaaacccggacgcgcgcgcgcggcgggaggctccggctgcacggagacatgggtaacggcagtagatcgacggtgtggctcggccatcgtactgtggccaaatcgatgtcacaaggacacggctctgtacagtcctggctggttggggattttctttcggaagaaacatgtaaatctgacgtactagtagttgacacaattcttcattgtgacacgagcaaggaatttaaaacggcagcaaagattcaccag

SEQ ID NO: 22984 - protein, 156 aa, Panicum virgatum
  misc_feature: Ceres CLONE 1824744
  misc_feature (1)..(140): Pfam Name: NUDIX Pfam Description: NUDIX domain
  misc_feature: SWISSPROT Homolog: EC 3.6.1.52 Diphosphoinositol-polyphosphate diphosphatase
MAAVMVARQGRELQRYSDSTGGEVEVLVISSQKKGPAGGVLIPKGGWELDESMDEAARREAAEEAGVVGETGPALGRWCYRSRSYDATYEGFVLPLRVTAELERWPEMGARRREWVTPAEAVARCPHAWMREALQRFAGTVVAGAGATAALLGSAL

SEQ ID NO: 22985 - DNA, 1144 bp, Panicum virgatum
  misc_feature: Ceres CLONE 1824753
  misc_feature: Encodes the peptide sequence at SEQ ID NO. 22986
atttttccattcgaagcgcagcctcgatttgattcccaattcccaattccccaccatcaccaccgtctcccttcccgtgtgatcgctccacaagcccccatggccggctacccgccgcccgcctccggctacccctacggccccggcgccgggggtgccggaggctacggcgccccgccgccctacggctcctccccggccccctccgccccgccctacggcgacaagccccccaaggaaggcaagacctcctcctcctcctccgcgccgcccaactacggcgccccgccctcctcccagccctacggcggcggcggcggaggctacggcgcgccgccgcacgcgcccgcgccctacggggccccgccgccggcgtacgggggcggttacggcgggagccccttcgcgtcgcttgtgccgtccgcgttcccgcccgggaccgaccccaacgtggtggcctgcttccaggcggcagaccgcgacggcagcgggatgatcgacgacaaggagctgcagtccgcgctctccggttacaaccagagcttcagcctccgcaccgtccacctccttatgtacctattcaccaacaccaacgtccgcaagatcgggcccaaggaatttacttctgtgttttacagtcttcagaattggagagcaatatttgaaagatttgaccgtgatcggagtggtaagattgactcatcagaactgcgtgatgctcttctcagtctgggatattccgtctctccaactgtgctagacctgcttgtgtctaaatttgacaagactgggggcaagagcagagcaattgaatatgataacttcattgaatgttgcctcactgttaagggactgactgagaagttcaaggagaaggacaccgcatactccgggtctgcggcgtttacttatgaggctttcatgctgaccgtgctccctttcctcatcgcctagtagcacagttcagagccaaagctaagcatgccatgccagttgtgtaaaagtggagagagttgttttgagctgagttaaaattcttggatttgattggtgttcctggtgttgcttgtcataaagttgatgggtgggtatgtttagctcagaaaatgctacaacctatatatagcactggatctgtttgttc

SEQ ID NO: 22986 - protein, 284 aa, Panicum virgatum
  misc_feature: Ceres CLONE 1824753
  misc_feature (183)..(211): Pfam Name: efhand Pfam Description: EF hand
  misc_feature: SWISSPROT Homolog: EC 3.4.22.52 Calpain-1
MAGYPPPASGYPYGPGAGGAGGYGAPPPYGSSPAPSAPPYGDKPPKEGKTSSSSSAPPNYGAPPSSQPYGGGGGGYGAPPHAPAPYGAPPPAYGGGYGGSPFASLVPSAFPPGTDPNVVACFQAADRDGSGMIDDKELQSALSGYNQSFSLRTVHLLMYLFTNTNVRKIGPKEFTSVFYSLQNWRAIFERFDRDRSGKIDSSELRDALLSLGYSVSPTVLDLLVSKFDKTGGKSRAIEYDNFIECCLTVKGLTEKFKEKDTAYSGSAAFTYEAFMLTVLPFLIA

SEQ ID NO: 22987 - DNA, 559 bp, Panicum virgatum
  misc_feature: Ceres CLONE 1824757
  misc_feature: Encodes the peptide sequence at SEQ ID NO. 22988
gcacgctcaggcattcctactctcaacttctgctcgcctctcttcgttctctctcgtctcctcttctcgatcgagcgctccatctgcggccctgtggttgacctgtcaaacgccggactgagacgtccaagggggcgtggtgaccagcacatggatccatggatcggcacccagccttctctgagtcttgacctgcacgtccgcctgccgccgctcagccgccaccacgcgccagtcgccttggccaagccctgggtgctcgtcaaggagaacttcctgcagcctctaaagaaacaaccagaggggacggccctcaagacagagctccaccggatgaccgaggagaaccggcgcctggccgaggcgctcacggcggcggccgcctaggactaggcgctgcggagacagcacaccgagatggtcgccgcgggcgccgccgccaccaccggcccgtcctctgcggcggagggcgggtcggtgtcgtcgtctcggacgcgcaagacaagcgagagcctggacaccgcggcggcggcgacgggcgcgacgcgggctccatggg

SEQ ID NO: 22988 - protein, 78 aa, Panicum virgatum
  misc_feature: Ceres CLONE 1824757
  misc_feature: The sequence is a functional homolog of SEQ ID NO 1200 in the 10/374,780 US patent application
  misc_feature: The sequence is a functional homolog of SEQ ID NO 1395 in the 10/412,699 US patent application
MDPWIGTQPSLSLDLHVRLPPLSRHHAPVALAKPWVLVKENFLQPLKKQPEGTALKTELHRMTEENRRLAEALTAAAA

SEQ ID NO: 22989 - DNA, 675 bp, Panicum virgatum
  misc_feature: Ceres CLONE 1824765
  misc_feature: Encodes the peptide sequence at SEQ ID NO. 22990
aacggcgccaaagccacaaacccgagttcctctgctccccgagcagccgaacagagtggtctccagagcactccccatggcgacgggagctgcgacggcccccgttcagactgtggtgctgagggtgtccatccactgccatggctgcaagaagaaggtccggaaggtgctcaagagcgtcgaaggtgtgcagaacgtgacggtggacgccgcgcagcacaaggtgacggtgacgggcaccgtggacgccaacacgctcgtccagaggctgcacaagtccggcaagaagggggtgccgtggcagtactgccacccgcccgccaacaagaccgaggccgcgccggcgccggcgccggcgtcggaggcagctccgccggcgcagcctgccggcgacggcggcaaggatgctgctgcgaaagcggcggacaagaagccggaggaggcggtgaaggagccgcaggtcgagagctccgagaagaagcagcctaagcaggaggccgcgggcacggagaagaaggcggaagcagagccgaaggcggagaagaaagtggaggcgaagaaggacggcggcgacagcgaggcagctgagaccaaggccaagggcgcagagccagcaaaggaagaggcgaaaggagccgccgccgccgccgctaatgccaagaacgaggacgcagc

SEQ ID NO: 22990 - protein, 199 aa, Panicum virgatum
  misc_feature: Ceres CLONE 1824765
  misc_feature (14)..(74): Pfam Name: HMA Pfam Description: Heavy-metal-associated domain
MATGAATAPVQTVVLRVSIHCHGCKKKVRKVLKSVEGVQNVTVDAAQHKVTVTGTVDANTLVQRLHKSGKKGVPWQYCHPPANKTEAAPAPAPASEAAPPAQPAGDGGKDAAAKAADKKPEEAVKEPQVESSEKKQPKQEAAGTEKKAEAEPKAEKKVEAKKDGGDSEAAETKAKGAEPAKEEAKGAAAAAANAKNEDA

SEQ ID NO: 22991 - DNA, 1580 bp, Panicum virgatum
  misc_feature: Ceres CLONE 1824769
  misc_feature: Encodes the peptide sequence at SEQ ID NO. 22992
acccgcaaacttgcttcgcattccacccctcgcccgatctcccgctctctcgccggcgatggcgccgccggcggaaagggccacggcggggaggaagtctccggccaccgtgctcctcctctacgtagcctgcgccttcatcctgctgcttctcctcgccttctactcgccccgcctccagccccccgcccatggccgcagcctccatcgccgcctcaggctccaccacaagagcttcccatcatccggcgctgcctccgttcggggagaggggcaacaccagcagcagcaccatcacgcggcttccttcgacccggccattgccgagctggagcgccggctggacgacaaggagtgggagcgcgagcactaccgcctcctccacggcgacgaagacggcggcgagccggacgaccacatgaaggaatgggaggaattcctgaaggaggaggaggatttcatcaacgacgacgaccgcttcaacctcgctgaccgcatcagcgcgctcttccccaagatcgacgtcgctccgacggacggcttcgtatccctcgacgagctcaccacctggaacctcgagcaggccagggccggccagcaccgccgttcctccagggagatggagctctacgacaagagcggcagcgggattgtctccttcgggaccttcaacgctctgcgccaggagtcccatggagagggtaatatgctggggttcccgtggtggaaggaggagcacttcaatgcttcagatgcaaacggtgatggtttccttgataaatctgagtttaatgatttccttaatccaactgattcggataatcctaaaatcatcaatttgctcagcaaacaagaaataaggcagagggacaaagatggtgatggaaagctaaactttgatgaatactttaatgggctacatgaccatatacatggttatgatgatgagagtgcagatatttcccatattgggaacatgacagttgcaaaggatcggttctccaaacttgataaagataatgatgggtttatttcagagcatgaactagaacctgttcttgataagctctatctttctgaacgttattatgctagacagcaagccattcatgctatttcagaggcagacaaggatcatgacggaagactaactttgggcgagatgattgagaacccgtatgcattttacggcagtgtgtaccttagcgatgacgaagactatttccatgacgaattccgctgaggcatctgcagctctgaattctgatgtacaccatgactaaagttgatcatcctgagcagactgtcggtgcccttaccacgcaagcaacacgtaacagatcagcatgaaaacagatcagcagctgagagaatggagagctcagagttactgctatatatagtttaacacacctagcattagtcatcacttggttctttctttcaagttgtttgtcttaaatgaaaaggacgacatcatcctattggcagtaccatcccagggaagagggttttatatgtataccattataaaagatggccccgacgtccataccactaaaaagtttggtgatacctgt

SEQ ID NO: 22992 - protein, 394 aa, Panicum virgatum
  misc_feature: Ceres CLONE 1824769
  misc_feature (309)..(337): Pfam Name: efhand Pfam Description: EF hand
MAPPAERATAGRKSPATVLLLYVACAFILLLLLAFYSPRLQPPAHGRSLHRRLRLHHKSFPSSGAASVRGEGQHQQQHHHAASFDPAIAELERRLDDKEWEREHYRLLHGDEDGGEPDDHMKEWEEFLKEEEDFINDDDRFNLADRISALFPKIDVAPTDGFVSLDELTTWNLEQARAGQHRRSSREMELYDKSGSGIVSFGTFNALRQESHGEGNMLGFPWWKEEHFNASDANGDGFLDKSEFNDFLNPTDSDNPKIINLLSKQEIRQRDKDGDGKLNFDEYFNGLHDHIHGYDDESADISHIGNMTVAKDRFSKLDKDNDGFISEHELEPVLDKLYLSERYYARQQAIHAISEADKDHDGRLTLGEMIENPYAFYGSVYLSDDEDYFHDEFR

SEQ ID NO: 22993 - DNA, 665 bp, Panicum virgatum
  misc_feature: Ceres CLONE 1824778
  misc_feature: Encodes the peptide sequence at SEQ ID NO. 22994
gttctcccaccaccaccaccatccctcctcgaggcataggaagggggaggaaaacctccaagccgccgcgtcgcgggcgcccacaccactcctccctcctgccctcgcctcgccatggccgccgcgctcctcctggcggtcctcctcccgctcgtggccaccccgtcccgcgccgccgcgccggcaagtgcgccctccaccgccgcgttccagctccacggcgacgtctatcccacaggccactactatgtcactatgaacattgggaacccggcgaagccctacttcctggacgtggacaccggcagcgacctcacatggcttcagtgcgacgcaccctgccagagctgcaacaaggtgccgcacccattgtatcggcctgcacagaacaggcttataccgtgtgcagattctctttgcactgcactccacagtggactgggttcaaacaagaagtgcccttcaccaaaacaatgtgactaccaaatcaagtacacagacagcgcatcatctcaaggtgtgcttatcaatgacaacttctcgctgcccctcaagtcctccaacattcgtcccagcctgacctttggctgtgggtatgatcagcaagttggaaaaaatggtgcggtgcaagcagtgacagacggcttacttgggcttgggagggg

SEQ ID NO: 22994 - protein, 183 aa, Panicum virgatum
  misc_feature: Ceres CLONE 1824778
  misc_feature: SWISSPROT Homolog: EC 3.4.23.12 Nepenthesin
MAAALLLAVLLPLVATPSRAAAPASAPSTAAFQLHGDVYPTGHYYVTMNIGNPAKPYFLDVDTGSDLTWLQCDAPCQSCNKVPHPLYRPAQNRLIPCADSLCTALHSGLGSNKKCPSPKQCDYQIKYTDSASSQGVLINDNFSLPLKSSNIRPSLTFGCGYDQQVGKNGAVQAVTDGLLGLGR

SEQ ID NO: 22995 - DNA, 668 bp, Panicum virgatum
  misc_feature: Ceres CLONE 1824783
  misc_feature: Encodes the peptide sequence at SEQ ID NO. 22996
aagaagcgccgcctcaccccggagcaggtgcatctgctggagaggagcttcgaggaggagaacaagctggagccggagcgcaagacggagctggcccgcaagctggggctgcagcctcgccaggtggccgtctggttccagaaccgccgcgcccgctggaagaccaagcagctcgagcgcgacttcgaccgcctcaaggcctccttcgacgccctccgcgccgaccacgacctcctcctccaggacaaccaccgcctccgctcacaggtggcgtcgttgaccgagaagctgcaagagaaggaggtgacggagggcggcgtcagcgccgacgccgacgccgcggcgctgccggtggatgccaaggttcccttggccgatgacgtcgaggagccggctgcggaggcgttcgaggagcagcaggtcaagtccgaggacaggctgagcacgggcagcggcgggagcgcggtggtggacacggacgcgctgctgtgcggccggttcgccgccgcagtcgacagcagcgtcgagtcctacttccccggcggcgaggaccactaccacgactgcgggatgggccccgtcaaccactgcccgggagggattcagtcggatgacgacggcgcgggcagcgatgagggatgcagctactatcccgaagaagaagccgc

SEQ ID NO: 22996 - protein, 222 aa, Panicum virgatum
  misc_feature: Ceres CLONE 1824783
  misc_feature (1)..(55): Pfam Name: Homeobox Pfam Description: Homeobox domain
  misc_feature (56)..(100): Pfam Name: HALZ Pfam Description: Homeobox associated leucine zipper
  misc_feature: The sequence is a functional homolog of SEQ ID NO 218 in the 10/225,068 US patent application
  misc_feature: The sequence is a functional homolog of SEQ ID NO 262 in the 10/412,699 US patent application
  misc_feature: The sequence is a functional homolog of SEQ ID NO 574 in the 11/479,226 US patent application
  misc_feature: The sequence is a functional homolog of SEQ ID NO 74 in the 10/374,780 US patent application
KKRRLTPEQVHLLERSFEEENKLEPERKTELARKLGLQPRQVAVWFQNRRARWKTKQLERDFDRLKASFDALRADHDLLLQDNHRLRSQVASLTEKLQEKEVTEGGVSADADAAALPVDAKVPLADDVEEPAAEAFEEQQVKSEDRLSTGSGGSAVVDTDALLCGRFAAAVDSSVESYFPGGEDHYHDCGMGPVNHCPGGIQSDDDGAGSDEGCSYYPEEEA

SEQ ID NO: 22997 - DNA, 672 bp, Panicum virgatum
  misc_feature: Ceres CLONE 1824803
  misc_feature: Encodes the peptide sequence at SEQ ID NO. 22998
acagggcattcctcctccctcgcccgtcccatccagcaggctcctcctcatcttcctcctgctgagctcgtcctcttcctcgtcggcccacgttcgcgcggggagagcgaagaatcgctggcgaggagcgcaattgggattcttgcatgcatggatgcggcgcagtggcaccaggggctagggctagggaagcctatggaggagatgctcatggctggaaacacaaatcctaaccagaatccgaatcccccgccggccgcgccctcggcggcacccggctcccagaggcctagtggcgctccggcagcagacgcggcagcgcccggcgctggggcggccggcgccggcgccggcacggagcggcgggcgcggccgcagaaggagaaggcgcccaactgcccgcggtgcaactccaccaacaccaagttctgctactacaacaactacagcctgcagcagccgcgctacttctgcaagacgtgccgccgctactggaccgagggcggctcgctccgcaacgtcccggtgggcggcggctccaggaagaacaagcgctcgtcctcggccgtgtcgtccgcggccgcggcggccgtctccacctccgcggcggtgtccggcacgatccccgtggggctcgctgccaagaaccccaagctgatgcacgagggcgcg

SEQ ID NO: 22998 - protein, 173 aa, Panicum virgatum
  misc_feature: Ceres CLONE 1824803
  misc_feature (76)..(138): Pfam Name: zf-Dof Pfam Description: Dof domain, zinc finger
  misc_feature: The sequence is a functional homolog of SEQ ID NO 2750 in the 10/374,780 US patent application
  misc_feature: The sequence is a functional homolog of SEQ ID NO 396 in the 10/225,066 US patent application
  misc_feature: Useful for making plants with modulated nitrogen use efficiency
  misc_feature: The sequence is a functional homolog of SEQ ID NO 2318 in the 10/374,780 US patent application
  misc_feature: The sequence is a functional homolog of SEQ ID NO 240 in the 10/225,066 US patent application
MDAAQWHQGLGLGKPMEEMLMAGNTNPNQNPNPPPAAPSAAPGSQRPSGAPAADAAAPGAGAAGAGAGTERRARPQKEKAPNCPRCNSTNTKFCYYNNYSLQQPRYFCKTCRRYWTEGGSLRNVPVGGGSRKNKRSSSAVSSAAAAAVSTSAAVSGTIPVGLAAKNPKLMHEG

SEQ ID NO: 22999 - DNA, 625 bp, Panicum virgatum
  misc_feature: Ceres CLONE 1824812
  misc_feature: Encodes the peptide sequence at SEQ ID NO. 23000
attataatttctgactgggtacctatcccagcaaactgtgatgatcccttccgcgaccgggcccgcgccgccctaggtggatcgcgccgtggcgagagacatgggccgcgaggccgccgcggggtgcgcactgcgcggcctcctcggctggcaccgcggccacccgagatcaccctcgtccctggcgttggtttggttcatgctccattctccctgctcccagcacatctcccagaatccgtttggaggctcgcgtgtgactaggttcccttttttaactggcttgaggatcgtgttagcctcgatgggaagttcttgcaagattctttgtccacaacaacgcatgttgatgatttcacatctaggctcttatagattcacactacaatggtggaaataaataacgaggagaatattcgctaggggttgcaccgatcacattatatgctggatttacaaacaaattctcttcttcatatatagctcaacaccatttctacatcatttcctgggcttggatccttagtaagtaatcttcacaggaccttaattaatcagcatggacatctattaagtctggaaccaaagacggttcctggaaatgtggctagcagtacatttgctg

SEQ ID NO: 23000 - protein, 87 aa, Panicum virgatum
  misc_feature: Ceres CLONE 1824812
  misc_feature: SWISSPROT Homolog: EC 6.3.2.3 Glutathione synthase
IIISDWVPIPANCDDPFRDRARAALGGSRRGERHGPRGRRGVRTARPPRLAPRPPEITLVPGVGLVHAPFSLLPAHLPESVWRLACD

SEQ ID NO: 23001 - DNA, 1871 bp, Panicum virgatum
  misc_feature: Ceres CLONE 1824813
  misc_feature: Encodes the peptide sequence at SEQ ID NO. 23002
ggcccacctgtcagccaacgtggcacggccgcgatccagctcctcttcctcgtctctcctccggccctcctctccttgccaccgacggcggccgtcctcgcctctcctctccccctccgctgaggccggccgagatcaagcggcttcattctccttctaaaccataatctctccccgcctcgccctcaatttgacgcaaacccctcccggtccaatcccagcgagcggaccagattggatccggctcgacgagatggatcccgaggagagcgccgcgccggtgctgaaccaaggtgaagaagcggcggaggcagcggagcctgcgccggctgaagaacagagggcgccgccggtgcaggaagtgccggcgggggagggcagcccgggtagcgggggcgaggcggcggtgcaggcccaccccgaggaggaggaggagctcgcgcggcaggtcatggaggtcgacctccagaacgagtaccttaggtcccaaattgccggcgcccagccggcgggcggtgcggacgagggctcggagctcgtcagaggcttgaaggagcaggtggagaagctgaccagggaggtgcaggagcagcggctgacgcgagaggccacggagaaggccctggagcacgtcaacgtagcctacgccgaggccgacggcaaggtccaggagctcaccgccaagctctcccaagctgaacagaaaatgggaaaggaacttaaagaacgtgacgacaaatatgttgagctggacgctaagttccagaggcttcacaagcgtgcaaaacaacgtatacaagatatacaaaaggaaaaagatgatctggaagctcgatttaatgaagtcaatcagaaggctgagcaggctgcttctctacaattagtggcacaacaggaactggaacgtgctcgtcaacaggctagcgaggccttacggtcaatggatgttgaaaggcagcagttgcggacagtgaacagcaagttgagagctaacctcgatgagacacgtctcgccttggaggccagaaacaattccctcgagaaactgcaacaatcagtgcttgaaaaagagcagttgctagagaaagttcaaggatcccttcaatctgctgaagataagaggatggcaacaatttcagagctcactgctaagcatcagaagcaattagaaagcttgcaggcacagctagctgaagtttctgcagaaaggatgaaggcatctgaaaccatacagtctctacaggcggtgctaacagagaaagactcagaaatagctgaaatcgaagcagcgtcaactggtgaagctgcccggcttagagcttctctggaggaggttaaaggagagcttgctcttctaaaggataaacatgaaagagaaaggcaaagctgggaggctacttgtgaatctcttaggtcaaacctggaagcatcagagaatgcatgccttaaatctgaaatagaatctgccaaagttaaaagtcaattggagttagagttgtcaacacaaaatcagttgttacaaaccaaagattctgatctaatggcagcaaaacaagagattagtcgactggaaagtgaattttctgcgtacaaggtccgggcacatgcacttctacaaaagaaggatgctgagcttagtgcagctaaaagttcagatttggttaaagaacatgaagaggcaataagggaagccgaaaaggaggtggcagctgctttagcagaacgagataaagcaatccatgatcttcaagaagcgcaatccagacattgcgatgagattgaggcaagagatatggctcttgctgatgctgagaaaaagctaaagaatataatgaagaagttagattctgtttcttctaatttcatcacag

SEQ ID NO: 23002 - protein, 539 aa, Panicum virgatum
  misc_feature: Ceres CLONE 1824813
  misc_feature: SWISSPROT Homolog: EC 2.7.11.1 Non-specific serine/threonine protein kinase
MDPEESAAPVLNQGEEAAEAAEPAPAEEQRAPPVQEVPAGEGSPGSGGEAAVQAHPEEEEELARQVMEVDLQNEYLRSQIAGAQPAGGADEGSELVRGLKEQVEKLTREVQEQRLTREATEKALEHVNVAYAEADGKVQELTAKLSQAEQKMGKELKERDDKYVELDAKFQRLHKRAKQRIQDIQKEKDDLEARFNEVNQKAEQAASLQLVAQQELERARQQASEALRSMDVERQQLRTVNSKLRANLDETRLALEARNNSLEKLQQSVLEKEQLLEKVQGSLQSAEDKRMATISELTAKHQKQLESLQAQLAEVSAERMKASETIQSLQAVLTEKDSEIAEIEAASTGEAARLRASLEEVKGELALLKDKHERERQSWEATCESLRSNLEASENACLKSEIESAKVKSQLELELSTQNQLLQTKDSDLMAAKQEISRLESEFSAYKVRAHALLQKKDAELSAAKSSDLVKEHEEAIREAEKEVAAALAERDKAIHDLQEAQSRHCDEIEARDMALADAEKKLKNIMKKLDSVSSNFIT

SEQ ID NO: 23003 - DNA, 1728 bp, Panicum virgatum
  misc_feature: Ceres CLONE 1824827
  misc_feature: Encodes the peptide sequence at SEQ ID NO. 23004
atttccgctccggccgtagctcggaaagcaagcaccggctcacttgatttgctcggggctccaaaaccctcgagatctctcggcgggtgcctggtggtggcgtcctcctcggctccttccccttcgcgcgagggctcccccgcctccgaagcttcgatctcgactccccgccggcgagcactgcagcgaccagcggcgggtccgagatgcgccccaacatcatcaccgaggctgggattccaactaggttgaatcagtggtggagcagcattccgttcattacttctggtgttgtcttgatatgtggagtaatttatctgctgtgcttgttggttggctatgactcctatgacacgatatgcttcttgccttctgcagtagcatcacattttcaagtttacaggttctacacatctgttctttttcatggttctttgcttcatgtgctattcaacatgcttgcattggtacccttgggcacggagttggaaagaattatgggatcagtccgtctcttattcttgatgttccttcttgcatcaacaaatgcaattctccatctcacaattgctttcttggttgcttacaatcctttgtaccctgccctgtatcttgtgaatgaatgctccattggcttttctggagttatattcgcaatgattgtcattgaaacaagtctgagtggtgtgcaatcgcgaagtgtcttcggtctcttcaatgttcctgcgaaatggtatgcatggattttactggtactttttcagtttcttgcaagcaatgtttcattgctggggcacctgtgcggcatcttgtcgggatttgcatacacttatgggcttttcaactacttgcttcctggaccatcattttattctaaaattgagggcttgtcagcactatctgtttgtgtgaggcggcctggttttattctatgtactggagggactacatatggccagcttcctacatactctaacacgtctgccgcaccaagtgctctcataaatggaaatttcttgagaaatatatcttcatggatgccaaacaggcagacacccactgttcaggaaggagaagaccccaggtttccagggagagcacgaacacttggttctgcaggtgctgaacccgctgcaagggaggcaagtgcgaatttgcatgcgaggcatacagttgcaaacacagtcagagctgatgcaacggtaacagcagatcaggttgatacatttgatgaagaacttaagaaactggttgggatgggttttgagaagactcaggctgaagttgcacttgctgcagctgatggagatccaaacgttgccattgaaattctgatgagtcagcagggctgaagtttaatcgtacactacaaattcaagggaagcacggatgtcgagccaatttttttcttcttatgaaagttcgaaagttagctttgattagaatctaggaatggagcatggggtgactggattgtgctttggtggttgctgaaaaggatgcccgcaatcatgggcagcagcctagttgtatttctcagggctgtctccagaatatatgtaaagtagaaatcaacgctggaggattggtcgaactttgacatactatctggacaatgctgcattgaatcctaaaacacctagtggttaatgacaattggacctcaagtctggccaacttcttaaaagagaaactgcaggccagtccggttgctgcaccttaatagcc

SEQ ID NO: 23004 - protein, 381 aa, Panicum virgatum
  misc_feature: Ceres CLONE 1824827
  misc_feature (58)..(216): Pfam Name: Rhomboid Pfam Description: Rhomboid family
  misc_feature (340)..(376): Pfam Name: UBA Pfam Description: UBA/TS-N domain
  misc_feature: SWISSPROT Homolog: EC 3.4.21.105 Rhomboid protease
MRPNIITEAGIPTRLNQWWSSIPFITSGVVLICGVIYLLCLLVGYDSYDTICFLPSAVASHFQVYRFYTSVLFHGSLLHVLFNMLALVPLGTELERIMGSVRLLFLMFLLASTNAILHLTIAFLVAYNPLYPALYLVNECSIGFSGVIFAMIVIETSLSGVQSRSVFGLFNVPAKWYAWILLVLFQFLASNVSLLGHLCGILSGFAYTYGLFNYLLPGPSFYSKIEGLSALSVCVRRPGFILCTGGTTYGQLPTYSNTSAAPSALINGNFLRNISSWMPNRQTPTVQEGEDPRFPGRARTLGSAGAEPAAREASANLHARHTVANTVRADATVTADQVDTFDEELKKLVGMGFEKTQAEVALAAADGDPNVAIEILMSQQG

SEQ ID NO: 23005 - DNA, 1173 bp, Panicum virgatum
  misc_feature: Ceres CLONE 1824831
  misc_feature: Encodes the peptide sequence at SEQ ID NO. 23006
agttcgcatctgctcctccactccactccgctccgctcatctcttctccgaggcgagcgcaaacccgcctcgcttctcttcaaaccctagctccccgttcgcccgcgtcgctgccgccccggatcaagcccgcacagcgcacgagcgtgagtctccctcccggattcgagcggcggcggcgggatggggtccgactccaaggagctgctggggatcgagcccctcgagctccgattcccattcgagacaaagaagcagatctcatgctctatgcagctagcgaacagaacggatgactatatcggcttcaaggttaagacaacgagcccgaagaagtactgtgtccgaccaaacagcgacattgtgccaccacggtccaccagcgatgtcattgtgacaatgcaagagcaaaaggaggcaccgccggatatgcaatgcaaggacaagtttctcgtgcaaagtgttattgtggctgaagacacgtcagcaaaggacataactggagatatgtttaccaaaaaatcaggtaatgtggtggatgaggtgaagttgagggttgtctacgtcccaccacccaaaccgccatccccggtgcgtgagggatctgaagaaggctcgtcacctagacattcattgtctgatggaagcaacttgaattatcaagagacaacaagggaaccagatgatccactatctttggctgctgtaaaatctcaaaaagaccaagaaggctttacctctgaggcatatgatcagcatctcaatatgatacttggagatgttaaagagatgacatctgctttgatttcaaagttgacagaggagaggaactctgccattcagcagaacaataagcttcgacaggagctggaccttgtaaggagggagctcagcaagcagaacggtggtttctcatttgcggtcgtagcggccattgctctcctagggattctgctaggatttatcatgaagagatagatgagccagtgttaatctgcatcttcttagaccgtttccctcgcgagattgtattcggtccaatgcatctattcacatgtactacagcgctactccatagcatattcgggatctggtgtcttcagtaattgcgtgcgtagtggctacctcacccaggcaacaaacctgtctccttgatattgtgttagctcttag

SEQ ID NO: 23006 - protein, 264 aa, Panicum virgatum
  misc_feature: Ceres CLONE 1824831
  misc_feature (8)..(115): Pfam Name: Motile_Sperm Pfam Description: MSP (Major sperm protein) domain
MGSDSKELLGIEPLELRFPFETKKQISCSMQLANRTDDYIGFKVKTTSPKKYCVRPNSDIVPPRSTSDVIVTMQEQKEAPPDMQCKDKFLVQSVIVAEDTSAKDITGDMFTKKSGNVVDEVKLRVVYVPPPKPPSPVREGSEEGSSPRHSLSDGSNLNYQETTREPDDPLSLAAVKSQKDQEGFTSEAYDQHLNMILGDVKEMTSALISKLTEERNSAIQQNNKLRQELDLVRRELSKQNGGFSFAVVAAIALLGILLGFIMKR

SEQ ID NO: 23007 - DNA, 616 bp, Panicum virgatum
  misc_feature: Ceres CLONE 1824867
  misc_feature: Encodes the peptide sequence at SEQ ID NO. 23008
acacaccagcccgaactcacccgacttgctctgcacatgaacatgcttatggcttccccgtcaccggccgccgccgccgccgcccctgccattcatgtctctcggcccccagtgaccccagtttcacgccgggtgcccgcgccgagggtctccccctcagctgcggccgcctgcacggcgggggccaaggcaggggagtcgggcagcgcgggcgtcttccaacccttcgaggagatgaagggggagctctccctcgtggcccagaccgcagacaattccctcgcgagccagaagatcttctaggaatgctaggcggccatcatcgagcagagcaatggggagaacaatgcctcgtatgcgtaccattccctctttgcctacttccaccgcgacaacgtggatctcacaggatttgacaaggtcttgagggaatcaagtgatgaggagagacagcatgctgaaaagttcaagaactaccacaacaaacgtgaaggcaggctcagtctgaagtccaatgtctctcccttggaacactttgaccaccctgagagaagccatgcttagttcgccatggacctggctctggctctggagagattggttaatgagaagctgc

SEQ ID NO: 23008 - protein, 86 aa, Panicum virgatum
  misc_feature: Ceres CLONE 1824867
  misc_feature: SWISSPROT Homolog: EC 1.16.3.1 Ferroxidase
MLMASPSPAAAAAAPAIHVSRPPVTPVSRRVPAPRVSPSAAAACTAGAKAGESGSAGVFQPFEEMKGELSLVAQTADNSLASQKIF

SEQ ID NO: 23009 - DNA, 688 bp, Panicum virgatum
  misc_feature: Ceres CLONE 1824878
  misc_feature: Encodes the peptide sequence at SEQ ID NO. 23010
acacacagagccccacgcacaagcctgaaaccgtaaagctattcgatcgtctggtgccatggcgggcggtggagaaggcggcgccggcggcggcgttgttcacgtcgtcatgttcccctggctggccttcggccatataagcccgttcgtgcagctggcgcgcaggctgctgctggtctcctccggcgaggccggggtccgcgtgacgttcctcacggccgccgggatcgcgccgcgcgtcgaggccatgctggagtccgccgccggcgcggtgagggtcctgcccctgagcctgcccgaggtccccggcctgcccgcgggggcggcgagcaccgccgacgtctccgccgactgcgccgagctgctgaagctcgccctcgacggcacccggcccgaggtgcgcgcgctgctcgccaagctccgcccggacgccgtgctggtcgacttcgccaccccctgggtctgcgacctcgccgcgcccctcggcgccaaggtgctctacttcgacgtcttctccgccgtcaccttcgcctacgtcgaggtcgcggtcgcggtcgcggtcgccgccgcccacctcgccgacgggcagcggccgtcctccgccgccggattatttcctgcgggctcggcgctcgcctccgtgcccgtgctgccccacccgggacacgggctggcagcgggcctggcg

SEQ ID NO: 23010 - protein, 209 aa, Panicum virgatum
  misc_feature: Ceres CLONE 1824878
  misc_feature: SWISSPROT Homolog: EC 2.4.1.115 Anthocyanidin 3-O-glucosyltransferase
MAGGGEGGAGGGVVHVVMFPWLAFGHISPFVQLARRLLLVSSGEAGVRVTFLTAAGIAPRVEAMLESAAGAVRVLPLSLPEVPGLPAGAASTADVSADCAELLKLALDGTRPEVRALLAKLRPDAVLVDFATPWVCDLAAPLGAKVLYFDVFSAVTFAYVEVAVAVAVAAAHLADGQRPSSAAGLFPAGSALASVPVLPHPGHGLAAGL

SEQ ID NO: 23011 - DNA, 608 bp, Panicum virgatum
  misc_feature: Ceres CLONE 1824880
  misc_feature: Encodes the peptide sequence at SEQ ID NO. 23012
actctcctccgcttgaatccagtggctctgctttgttcgtcctcactcgtctctctcgcgagcgggactggctcttccgacaggggttggaggctcgtgaggaccgaataattatattgtgttctccccctggagcagcacaacggacggagcggtttctgcgcccgccgccgccgccgccgacgggaccggggagctgatctggtacgtctacgtgcgcgtgccgagcgcgcgggacatccagaacgtctgcctctcccgcaaccccgacgtgtacgcgcgggtgtctctgccgggcgactgcgcgccgtgtggcgtccgccctcgcggttaacggcggcggccgcaacccggtgtgctaccctccgctgcgtctcggcctgcgcgcgggggacctccaccccccgctcccctgcctggtctggatgctcagccggatcgagaactacctggaggaccagctgctggggttcgcgctcgtgccgctcccggacgtcatcgccgccgacggccgcacgctcgtgcgggagttcccgctcaccaccagcgacctcttccaaacgacctcgcggttcctccagctccagctgtcctacatccgcgtcgtg

SEQ ID NO: 23012 - protein, 60 aa, Panicum virgatum
  misc_feature: Ceres CLONE 1824880
  misc_feature: Useful for making plants with modulated biomass
MLSRIENYLEDQLLGFALVPLPDVIAADGRTLVREFPLTTSDLFQTTSRFLQLQLSYIRV

SEQ ID NO: 23013 - DNA, 483 bp, Panicum virgatum
  misc_feature: Ceres CLONE 1824883
  misc_feature: Encodes the peptide sequence at SEQ ID NO. 23014
gacccaccctccgcggaggcccaagtgggggagatggccgtccccgtccctgtccgcctcgccgccgcctccctcgtgctcctcctcgccctgctagcaccgctcctcgcgtccgcctgcgaccgctgcgtccaccgctccagggccgcctaccacgcctcctcgctcaccctcgccggcggctcctgcgggtacggcgccgaggcggcggccatgggcggcggcttcctcgccgccgcgggccccgcgctgtaccgggccggcgtcggctgcggcgcatgcttcccggtccggtgcagggacaggaagctctgcgccgcggcgggcgcccgggtggtcgtctcggaccgcgccaggacctaccgctccgacctcgtgctcagcagcccggccttcgccgccatggcgcgccccggcatgggctcgcgcctcgcctagctccgcaccgtcgacgtcgagtacaagagggtgccgtgcgagtac

SEQ ID NO: 23014 - protein, 134 aa, Panicum virgatum
  misc_feature: Ceres CLONE 1824883
  misc_feature (66)..(130): Pfam Name: DPBB_1 Pfam Description: Rare lipoprotein A (RlpA)-like double-psi beta-barrel
  misc_feature: Useful for making plants with altered carbohydrate content
MAVPVPVRLAAASLVLLLALLAPLLASACDRCVHRSRAAYHASSLTLAGGSCGYGAEAAAMGGGFLAAAGPALYRAGVGCGACFPVRCRDRKLCAAAGARVVVSDRARTYRSDLVLSSPAFAAMARPGMGSRLA

SEQ ID NO: 23015 - DNA, 1504 bp, Panicum virgatum
  misc_feature: Ceres CLONE 1824897
  misc_feature: Encodes the peptide sequence at SEQ ID NO. 23016
actccacccccgatcccctccctcctctccaaggccaaaacccaactgctcgatctcccgcaacctcccagatctctaaccctcgccaccgccgcccgccgccgctttctccccgatcgccgcggccatggcgaaggagttcccggtgccgccggtggtcttcacgccgtccaccccgacgcaccgccgccatcctgccccgggcgtgggggcctcccctccgcctgcgttcgcgccgccgcgcccctccacctcgtccgccgccaacccgctccccttcatgtcgttcgacgtctccgccgccgcggcctcctcctcctccgcgccgcccctctacgcgggtcccatcggcgtcggcggctccggcgcatccttcgaggacgagccgcctctcctcgaggagctcggcatcaacacgcgccagatctggcggaagacgatctccatcctccacccgctccgcacggcggacccctcgctccacgccgacgccgacctctcgggcccgttccttttcctcctctcctttggactcttccagctccttgcggggaagttccacttcgggatcgtgctcggttgggtcaccgtcgcgtccctcttcctctacttcgtcttctccatgctgtcaggcggccgccgcggggacctcgatctctacaggtgcgtcagcctcgtcggatactgcatgctgcccatggtcatcttctccgcggtctccctcttcctgccgcggggcggcgggctcatatttggagtggggatggcgttcgtgctatggtcgaccagggtctgcaccaggctgctcgcagagcttgcatccagtggcgacgaacacaggggcctcatcgcctatgcgtgctggctcgtctacatgctcttctcgctgctcgtcatcttctgataccgtttatggtacagagattatgttcggaatttgtttggcggatggagtggactgccttttaaccagtcactggggtgtttctgctgggaccttgcagaactacttatgatacggccagtggggaaatgtcctgtaatgatctgtcacttttgatcctttggttccagtgggcgtggtgggtgctcagtgtagatcttggtaaagaaaaggaagtaattaggttttgccgaagtattggtggaaatctgactttctaaaggggagttgttgtcgtggtctgtgcaaattgttcattgtgattacttaccacgactggtttattttaggatctccaagcgtagtttcctttatgtttcactgttcaattttcagcgttgcaatttataaaagagataattgtccactctttaggtgttgtgctatttactggttcaaaaattaaaggaaggttagctacacttctttggaaatgtccgacttttgttaaggacaagtcgatcctttgtgttgtttggtagttctaacttctatatgatacattgatacctgtatttgtgccgtcgtatggctatgtgaaaatatttcattcgcggattt

SEQ ID NO: 23016 - protein, 258 aa, Panicum virgatum
  misc_feature: Ceres CLONE 1824897
  misc_feature (93)..(241): Pfam Name: Yip1 Pfam Description: Yip1 domain
MAKEFPVPPVVFTPSTPTHRRHPAPGVGASPPPAFAPPRPSTSSAANPLPFMSFDVSAAAASSSSAPPLYAGPIGVGGSGASFEDEPPLLEELGINTRQIWRKTISILHPLRTADPSLHADADLSGPFLFLLSFGLFQLLAGKFHFGIVLGWVTVASLFLYFVFSMLSGGRRGDLDLYRCVSLVGYCMLPMVIFSAVSLFLPRGGGLIFGVGMAFVLWSTRVCTRLLAELASSGDEHRGLIAYACWLVYMLFSLLVIF

SEQ ID NO: 23017 - DNA, 686 bp, Panicum virgatum
  misc_feature: Ceres CLONE 1824911
  misc_feature: Encodes the peptide sequence at SEQ ID NO. 23018
ccccccgcgccgcggccgcgcacaccggtcccgagcacgggtcatcgccgtctgcccgcgtccgcacgcacgcacgctcgctcacctccagagcagagcgctccggctccgcttgccccgctcccagaaggtccggccgcggcggcgggcgatggcgcggaagaagatccgggagtacgactccaagcgcctcctccgggagcacctcaagcgcctcgtcggcatcgacctccagatcctctccgcgcaggtcacacaatcaacggatttcactgagcttgcaaaccaggagccatggctctcatctatgaagttggtcgtgaagccagacatgctgtttggtaaacgtgggaagagtggacttgtggccctcaacctagaccttgcccaagttcgccaatttgttaaggagcggctgggagttgaggtcgagatgggtggctgcaaagctccaattacaaccttcatagttgagccatttgtgccccatgatcaagagtactacctttcgattgtatcagaaaggcttggctgcacaattagtttctccgagtgtggaggtattgagattgaggagaactgggacaaggttaagacaatctttcttcccacagagaagcaaatgatacctgatgcatgtgctcccttgattgccaccttgccattggaggtccgcacaaaaatag

SEQ ID NO: 23018 - protein, 178 aa, Panicum virgatum
  misc_feature: Ceres CLONE 1824911
  misc_feature (5)..(175): Pfam Name: ATP-grasp_2 Pfam Description: ATP-grasp domain
  misc_feature: SWISSPROT Homolog: EC 2.3.3.8 ATP citrate synthase
  misc_feature: Useful for making plants with modulated root development
MARKKIREYDSKRLLREHLKRLVGIDLQILSAQVTQSTDFTELANQEPWLSSMKLVVKPDMLFGKRGKSGLVALNLDLAQVRQFVKERLGVEVEMGGCKAPITTFIVEPFVPHDQEYYLSIVSERLGCTISFSECGGIEIEENWDKVKTIFLPTEKQMIPDACAPLIATLPLEVRTKI

SEQ ID NO: 23019 - DNA, 1511 bp, Panicum virgatum
  misc_feature: Ceres CLONE 1824940
  misc_feature: Encodes the peptide sequence at SEQ ID NO. 23020
ttctcttctcgcctcaaatcccacgcccccgcaccaaaccaaaccaaatcccccacctcctcggctcctcctccatttccacccgcagccccaacccttgtaacctcccgatggccggaggaggcggcggcgcaggcgcaggcgctggctcgtcggcgggcgggtcgggttccggcggcggcgggggcggaggcggtcgcgagggcgactgggactgcggtggctgcggcaaccgcaactacgccttccgctcgctctgcaaccgctgcaagcagccgcgcctcctcgtcgaccccaacaccccgcgcgactccaagtggctgccccgcgccagggactggatctgcaccggttgcagtaacaataattatgcatccagaaagaactgcaaaaagtgtggcctgcccaaggaggaagcagcaatgccagcattgcaaatggcagggatggcaatgccagcttatgcagcttatattgcaagactacaaagccttgctgcttctgcttctgcatataagatgaactttgggatggctgccaattcacctttgcagcagcaactacttgcaaatgcaaactggtcctatgggttggctggtagatatgggatgcagtcttctggttggccatttggaaacaacaacacaaatcagtttccaggtgtcccaaaggactggcgtaatggagattggctctgtagctgtggttttcataactattcatctcgtactcagtgcaaagagtgcggtgcacctgtaccatcaggcatgccctccacaacaatgaaaactacaacatcagatgcctcttccacgttaggaactaagcgattggcatcagaggaacttgccaatgactgggataataaaaggctaaatccaggaaatgacaattatccgctctcgacagcaggcactaataatttgtttttgggtattgagcaaggagctggaagcagcaatggccaggcagccttttccaagtttgacaatgggagctcaatggcactaccatctgggcaggcaatgtctggtctaatgggaaaaggggcaaaatggcgcgacggagactggatatgcagcaactgcaacaatcacaattatgcatctcgtgcgttttgcaacaggtgcaaaactcagaaagaatcggcagttcaccctggtgtgctatagcttgcttgcgcctgatcatagcgctctaaatcattttgaagtttccaggatatgttgctgccggattctagctcctttgtcgagactgcggtttgagttttttttattattctgcagtgcccttctcaaatgtgtctcggcatttgactagtgccggttgaagttcctgatttatttatggtaagcgcttgaataaaatgtttccggaaagtaccgtctactatctggattttggcgaataattgagttgtgtaatgaggcaatggtgatagactgtaatgttgtacttttttctcataattctggaatattagagcaccaaattaaagttttgtggtc

SEQ ID NO: 23020 - protein, 353 aa, Panicum virgatum
  misc_feature: Ceres CLONE 1824940
  misc_feature (317)..(346): Pfam Name: zf-RanBP Pfam Description: Zn-finger in Ran binding protein and others
  misc_feature (30)..(59): Pfam Name: zf-RanBP Pfam Description: Zn-finger in Ran binding protein and others
  misc_feature (190)..(218): Pfam Name: zf-RanBP Pfam Description: Zn-finger in Ran binding protein and others
  misc_feature (73)..(102): Pfam Name: zf-RanBP Pfam Description: Zn-finger in Ran binding protein and others
MAGGGGGAGAGAGSSAGGSGSGGGGGGGGREGDWDCGGCGNRNYAFRSLCNRCKQPRLLVDPNTPRDSKWLPRARDWICTGCSNNNYASRKNCKKCGLPKEEAAMPALQMAGMAMPAYAAYIARLQSLAASASAYKMNFGMAANSPLQQQLLANANWSYGLAGRYGMQSSGWPFGNNNTNQFPGVPKDWRNGDWLCSCGFHNYSSRTQCKECGAPVPSGMPSTTMKTTTSDASSTLGTKRLASEELANDWDNKRLNPGNDNYPLSTAGTNNLFLGIEQGAGSSNGQAAFSKFDNGSSMALPSGQAMSGLMGKGAKWRDGDWICSNCNNHNYASRAFCNRCKTQKESAVHPGVL

SEQ ID NO: 23021 - DNA, 686 bp, Panicum virgatum
  misc_feature: Ceres CLONE 1824951
  misc_feature: Encodes the peptide sequence at SEQ ID NO. 23022
gcaagccagaagctgctgcagcatccatccatccttcccatcctgctctcgagctccaagcctcaaacccgtccgcgcctgctcaggctcagctagccggggacgaattaaccgagcagcatccatggcggccgtgttggtggcgaggcaggggcgcgagctgcagcgctacagccagcgcaccggcgggcgcatcgtggtggggtgcatcccgtaccgcgtgcggtgcgacggcgagctggaggtgctggtgatcacgtcgcagaaggggcacggcatgatgttccccaagggcgggtgggaggaggacgagtccatggacgaggccgcccggcgcgaggccctcgaggaggccggcgtcctcggcgacaccgagccggtgctcggcttctggcactacaagagccgccgctacgtcgaccagacctacgagggcttcatgttcccgctccgcgtcgccgacgaggtccaccagtggcccgagatggcctcccgcaagcgcacctgggtgagtagtcgacgacaccatttcaccaattcgttcgctcgcggcacgcgctgcccaatgcaattccacccccaaaaccaatgccaggacatgtcatctgacccctcgattgtatggaacaacaggcaacggtgaaccaggtgatggacgggtgcccgcacttgtggatgcgggaggc

SEQ ID NO: 23022 - protein, 172 aa, Panicum virgatum
  misc_feature: Ceres CLONE 1824951
  misc_feature (22)..(142): Pfam Name: NUDIX Pfam Description: NUDIX domain
  misc_feature: SWISSPROT Homolog: EC 3.6.1.52 Diphosphoinositol-polyphosphate diphosphatase
MAAVLVARQGRELQRYSQRTGGRIVVGCIPYRVRCDGELEVLVITSQKGHGMMFPKGGWEEDESMDEAARREALEEAGVLGDTEPVLGFWHYKSRRYVDQTYEGFMFPLRVADEVHQWPEMASRKRTWVSSRRHHFTNSFARGTRCPMQFHPQNQCQDMSSDPSIVWNNRQR

SEQ ID NO: 23023 - DNA, 1213 bp, Panicum virgatum
  misc_feature: Ceres CLONE 1824964
  misc_feature: Encodes the peptide sequence at SEQ ID NO. 23024
agcagcagcaccaagatcgtctgacctgactgcctcataggctgcaagctcagctgagcacagcacagcaccgatggcctccaccaccaccgccttcctctccaccctcgccagggccaccgccagcctgagcagcagcaccatgccgtccggcggcgccaaggtcatccggttcttgcccgcgcagaccagccgcgggcggcgcgcggtgctgtccgcgccgagggcggcggtctcgggcaccgagaaggcgcagccggcgcgggcgtccgacaagggcaagagcaaggacgagcgcgtggtgaaggtgaacagaatcgaggagttcgacggcgcgctgaaggccgccaagaaccggctagtggtggtggagttcgcggcgagcgacagcgagagcagcagccagatctacccgaccatggtgcagctgagccgcacctgcggcgacgtggacttcctgctggtgatgggcgacgagtcggaggccaccaaggagctgtgccgccgggagggcgtcacgcaggtgccccacttcaacttctacaagggcgccgagaaggtgcacgaggaggaggccattggccccgagcggctcgccggcgacgtgctctactacggcgacagccactcggcggtggtgcagctgcactcgcgggaggacgtggaggcgctcatcaacgagcaccgcggcgacaaggggaagctcgtcgtgctcgacgtcggcctcaagcactgcgggccctgcgtcaaggtgtaccccaccgtcgtgaagctgtcgcgctccatggccgagaccacggtgttcgcgcgcatgaacggcgacgagaacgacagctgtatccagttcctcagagacatggacgttgtcgaggtgcccaccttcgtcttcatcagggacggcaagatcgtcggccgctacgtcggctccggcaagggtgaactcgtcggcgagatcctcagatacaacggcgtcagggtcacctactgaagaagcggttcacacatgaatggagaatagtatgcaaaaattgaaaatgcaaaatgtaaagttactgcaacattcatacatcgatgattggtcgatgttttagactgtttactagaactataggcacggcgttgccgcgccatgctacatctggccagcatatatcttgtagcatgtgtcggtcgtgttttctgtagctatttggagtatcaaagaattttgagc

SEQ ID NO: 23024 - protein, 281 aa, Panicum virgatum
  misc_feature: Ceres CLONE 1824964
  misc_feature (165)..(274): Pfam Name: Thioredoxin Pfam Description: Thioredoxin
  misc_feature: SWISSPROT Homolog: EC 1.8.1.9 Thioredoxin-disulfide reductase
MPSGGAKVIRFLPAQTSRGRRAVLSAPRAAVSGTEKAQPARASDKGKSKDERVVKVNRIEEFDGALKAAKNRLVVVEFAASDSESSSQIYPTMVQLSRTCGDVDFLLVMGDESEATKELCRREGVTQVPHFNFYKGAEKVHEEEAIGPERLAGDVLYYGDSHSAVVQLHSREDVEALINEHRGDKGKLVVLDVGLKHCGPCVKVYPTVVKLSRSMAETTVFARMNGDENDSCIQFLRDMDVVEVPTFVFIRDGKIVGRYVGSGKGELVGEILRYNGVRVTY

SEQ ID NO: 23025 - DNA, 663 bp, Panicum virgatum
  misc_feature: Ceres CLONE 1824969
  misc_feature: Encodes the peptide sequence at SEQ ID NO. 23026
agccatgagcgaacagttcacccgctccaaggaccaatcgcctctgacgatgagctccttctcgtggttggcgaccgtggtcgccctgctgggcttgctggcgcggccgtccgagtgcacccgcgccttcttcgtgttcggcgactcgctggtggacaacggcaacaacaactacctcatgaccacggcccgcgccgactcgccgccgtacgggatcgacttcccgacgcaccgcgccaccggacgcttctccaacggcaagaacatccccgacatcatcagcgagcacctcggcgcggagcccacgcttccgtacctgagccccgagctccgcgggcagaagctgctcgtcggcgccaacttcgcgtcggccggcgtcgggatcctgaacgacaccggcatccagttcgtggacatcctgaggatgagccggcagctgcggttcttcggcgagtaccagcgcaggctccgcgcgctggtgggcgcggcccgggcgcggcagctggtgcgccgctcgctcacgctcatcaccctcggcggcaacgacttcgtcaacaactactacctcgtccccttctccctgcgctcccgccagttcgcgctcccggactacgtgcgctatctcgtctccgagtacaggaagatcctcatcaggctgtacgc

SEQ ID NO: 23026 - protein, 204 aa, Panicum virgatum
  misc_feature: Ceres CLONE 1824969
  misc_feature (27)..(203): Pfam Name: Lipase_GDSL Pfam Description: GDSL-like Lipase/Acylhydrolase
  misc_feature: SWISSPROT Homolog: EC 3.2.1.51 Alpha-L-fucosidase
MSSFSWLATVVALLGLLARPSECTRAFFVFGDSLVDNGNNNYLMTTARADSPPYGIDFPTHRATGRFSNGKNIPDIISEHLGAEPTLPYLSPELRGQKLLVGANFASAGVGILNDTGIQFVDILRMSRQLRFFGEYQRRLRALVGAARARQLVRRSLTLITLGGNDFVNNYYLVPFSLRSRQFALPDYVRYLVSEYRKILIRLY

SEQ ID NO: 23027 - DNA, 682 bp, Panicum virgatum
  misc_feature: Ceres CLONE 1824975
  misc_feature: Encodes the peptide sequence at SEQ ID NO. 23028
atccctccgcaccctcttatctgctccgcctccgcgctcccgctcctcccccacctccaccaccatggccacggccgcggcggcctccgcctcctcctcgctcctcgcgccggctgccagcacggcgccggccgcgcccaacgcgctgctgttcccctcctccgtgccgacgctgcgcgcctacccgcggctgctcctctcgttccgccgccccgcggccgccgccgtcgccgacccgcagggggccgtgctcgaggaggaggaggccgaggccgaccagcgcggccggtacgacgacgaggatgaggacgacgggtacgagggcggccgcggctccgcgttcacgccccccacgcgcccgcgcaccggcaaggccgccctgccgctcaagcgcgaccgcacgcggtcgaaaaggttcctcgagatacagaagctcagggagagcaagaaggagtacgacgtgcccaagggaacaggccagtcggtgaagattgcagtcctcacacaaggtgagaagatagatgaagctagagctgcaggagctgatatagttggtggagatgacttgatcgaacaaataaaaggagggtttatggactttgacaaattgatttcatcacctgatatgatgcctaaggttgctggcttgggtaagattctaggaccaagaggactgatgcct

SEQ ID NO: 23028 - protein, 205 aa, Panicum virgatum
  misc_feature: Ceres CLONE 1824975
  misc_feature (100)..(205): Pfam Name: Ribosomal_L1 Pfam Description: Ribosomal protein L1p/L10e family
MATAAAASASSSLLAPAASTAPAAPNALLFPSSVPTLRAYPRLLLSFRRPAAAAVADPQGAVLEEEEAEADQRGRYDDEDEDDGYEGGRGSAFTPPTRPRTGKAALPLKRDRTRSKRFLEIQKLRESKKEYDVPKGTGQSVKIAVLTQGEKIDEARAAGADIVGGDDLIEQIKGGFMDFDKLISSPDMMPKVAGLGKILGPRGLM

SEQ ID NO: 23029 - DNA, 628 bp, Panicum virgatum
  misc_feature: Ceres CLONE 1824980
  misc_feature: Encodes the peptide sequence at SEQ ID NO. 23030
accagagctttactgcaagaaacagagcaacgcaatccagccagcaagtgcctgcaaaatggggcgccgggaagtgatcccgctgatggccgcgttcaagatggggccgttcgagctctcccaccgcgtggcgctcgcgcccatgacccggtgccgggccgacggctacgtgccgcggccgcacgccgccgtgtactactcgcagcgcgccacccggggcggcctgctcatcgcggagggcacgcgcgtgtccgccaccgcgcagggcttcccggggtcccccggcatctggacgccggagcaggtcgcggcgtggaggcccgtcgtcgacgccgtccaccgcaagggcgcgctcttcttctgccagatcgcgcacgtcggcagggtctccaccaacgattttcagccaggcggtcaggcgccgatctcgagcacggacaagcaggtctcccccgaccccgagtccgccacggtgtactccaagccgcggcggctgcgggcggacgagatctcgggggtcgtcgacgacttccggcgcgccgcgcggaacgcagtcgaggccgggttcgacggcgtcgagatccacggcgcgcacgggttcctcttcgagcagttcatgaaggacggc

SEQ ID NO: 23030 - protein, 189 aa, Panicum virgatum
  misc_feature: Ceres CLONE 1824980
  misc_feature (8)..(189): Pfam Name: Oxidored_FMN Pfam Description: NADH:flavin oxidoreductase / NADH oxidase family
  misc_feature: SWISSPROT Homolog: EC 1.3.1.42 12-oxophytodienoate reductase
  misc_feature: Useful for making plants with modulated water use efficiency
MGRREVIPLMAAFKMGPFELSHRVALAPMTRCRADGYVPRPHAAVYYSQRATRGGLLIAEGTRVSATAQGFPGSPGIWTPEQVAAWRPVVDAVHRKGALFFCQIAHVGRVSTNDFQPGGQAPISSTDKQVSPDPESATVYSKPRRLRADEISGVVDDFRRAARNAVEAGFDGVEIHGAHGFLFEQFMKD

SEQ ID NO: 23031 - DNA, 1115 bp, Panicum virgatum
  misc_feature: Ceres CLONE 1824992
  misc_feature: Encodes the peptide sequence at SEQ ID NO. 23032
atcatcccacaaacatcataaacacaagaaaactactgtgtggcgggaggagaagaagaagaagaacgatggcggcgccaaaacccgagttcacggattccttcgtcgtgcaaaccggcaactacggcgacttcgtccgcctgtgccggcaaaatgtgatcaaatactgcagcaacgtcacgggcatcgctcagcccgtgctgccgcaggagcagccgatccccaagcgctggttccacgtcctcctccgcaccgagaccagctccctcacgctggccgtgcgcatggacaacctctacctcgtcggcttcaggaccccagccggggtgtggtgggagttcaacaacgagcaaggcaagcacctcatcacgggcgccaggtggctcggcttcggcggccggtaccaggatctcatcggccagaaggcgctggagaccgtcacgctgggccgtttccagatgaccgaagccgtcaatgtcctggcgaagcaccccggcggcacacctgctgcggtggcggaggagctgcagccgcagggcggcgtattggtatcggcggagggtggcgttcagcaggccgacccgtccgccgaggccaagagcaagctggcgaagctggtgatcatgatctgcgaggggctgcgcttcctcactgtgtccggcacggtggacaaggagttcgagaaccccgcggcgacggtgacccagatgcaggggaagcaggtgaataagtgggataggatctcggcggcggtgttcaagtgggctcaggacccgactgctgagttccccgatctggaggaggtgggcgtcgaggacagaaacgatgcagccaggatcgtcgcgctcgtcaaatttcagaaggccaactagctagtagtaactagctagtaccagtggtggttacctgtacctgcacgtctacgtcgttacgtatatgcgcgtgcgcgccgtacgcgctggctagtaggacgtgtgcatccacaaataagtacaccggcctgccggtgtcgttccagcagctctttgcgttggtggcttgcttgccaccttaattaactgtatccctctattgttatatataaataatataaataaataaactcccgcgggctc

SEQ ID NO: 23032 - protein, 267 aa, Panicum virgatum
  misc_feature: Ceres CLONE 1824992
  misc_feature (3)..(267): Pfam Name: RIP Pfam Description: Ribosome inactivating protein
  misc_feature: SWISSPROT Homolog: EC 3.2.2.22 rRNA N-glycosylase
MAAPKPEFTDSFVVQTGNYGDFVRLCRQNVIKYCSNVTGIAQPVLPQEQPIPKRWFHVLLRTETSSLTLAVRMDNLYLVGFRTPAGVWWEFNNEQGKHLITGARWLGFGGRYQDLIGQKALETVTLGRFQMTEAVNVLAKHPGGTPAAVAEELQPQGGVLVSAEGGVQQADPSAEAKSKLAKLVIMICEGLRFLTVSGTVDKEFENPAATVTQMQGKQVNKWDRISAAVFKWAQDPTAEFPDLEEVGVEDRNDAARIVALVKFQKAN

SEQ ID NO: 23033 - DNA, 1178 bp, Panicum virgatum
  misc_feature: Ceres CLONE 1825010
  misc_feature: Encodes the peptide sequence at SEQ ID NO. 23034
atcgtcatcgtgccctgctcgcatcgcatcgcatcgcctcgcatcgcccagcgtcaatctctcaacagcaacccggtctcctctcctcccgccccccattccctcgttcctcggttcctcctcctcggccctcgcccagcccggccggcgcccgcgctccgcatgtcaatccatgggctgatcctggaagtcagagtcaccgggtgccggaagctgcgggacacggagttcttcacccgccaggacccctacgtcgtgctcgagtacgccaccaccaagctccgcacccgcacctgtaccgatgggggaagaaacccaactttcgatgagaagttccatatacccctcattgaagggctccgcgagttgaatgttatcgtttggaacagcaacacattatcccacgatgacttcatcggcagtggcagagtatatctgcacaaggtgctcgcaaatggatatgatgattcctcatggccacttcagacacgccacatgagatctgctggggaagtgaagctcattatgcatgttgatgtctcagcaatgaagaacaaaatgggtaaaagtatcggtgcagcaagtacacattctgttcctccaccttcagtgccagccggagtcccagtcccagctgcagccgcagcaccagcactagcatcagcagttccatacactggggttccaccctcatatccacctgctccagcatatcctgcggcatctgcataccctgcttacccaactcctagccaatcaccatataccactacagaatatccaccacctccgcagcaagcatacccacccccttcggcaggatatcctccatcatatccaccgcagccatatgggcaaccatatccgccacaaccatatggtcaaccatacccaccccctccagaagcacagtccccatatccatctgcgccttaccctggtacctatccaccaagaccttattgatgtatcagcttcagtaaccacaagcaggggcatcaaaagcagcaaacaacaatggttattgctatatgatgtgtgcccgtgtttgggttctttgtttctagttatttggttattcttcctaactgaattctacatacgctgctgaactgttacatcgatctcaagtcaggtaaaggtctggatgggaaatcaaaaagaaatgtcatgaattc

SEQ ID NO: 23034 - protein, 267 aa, Panicum virgatum
  misc_feature: Ceres CLONE 1825010
  misc_feature (8)..(89): Pfam Name: C2 Pfam Description: C2 domain
  misc_feature: Useful for making plants with altered carbohydrate content
  misc_feature: Useful for making plants with altered cell wall content and/or composition
MSIHGLILEVRVTGCRKLRDTEFFTRQDPYVVLEYATTKLRTRTCTDGGRNPTFDEKFHIPLIEGLRELNVIVWNSNTLSHDDFIGSGRVYLHKVLANGYDDSSWPLQTRHMRSAGEVKLIMHVDVSAMKNKMGKSIGAASTHSVPPPSVPAGVPVPAAAAAPALASAVPYTGVPPSYPPAPAYPAASAYPAYPTPSQSPYTTTEYPPPPQQAYPPPSAGYPPSYPPQPYGQPYPPQPYGQPYPPPPEAQSPYPSAPYPGTYPPRPY

SEQ ID NO: 23035 - DNA, 1400 bp, Panicum virgatum
  misc_feature: Ceres CLONE 1825024
  misc_feature: Encodes the peptide sequence at SEQ ID NO. 23036
ggatgctccacccaggccaggctagggttgcggcggcgccgccaccagccgcccaccctcatcccatggacccaagccgccgagcgccggccgtctcccgcatcctcgccgaccaccccggccccggcctccgcttctgcatcccgtcgcacctcgtcgtcaaccaccccgccactgtggacgcctggctgcgctccccggcgctcgacggcctccaggagcttgacttcagttggagccggtttgaatggtcgcgccgagagccgccgccgtctactttccgcttcgcggccaccctccgtgaggctaccttttgccagctcgacctcccggatgccacggttgatgcgcttcacttcccccggctcacgcacctcgcacttcgacattccagcatgtccaagcgctccctgcacgccatgatttccagttccacctgccctgtcctggaatgcttgctgctcgaagactgctacgggtgccgccggctccgggttacctcaaacagcctcagaagcattgccgtcagtgctcaatgccatgccggcaagccccggttaaaggaagtcatccttgtcaacgccccttcccttgaaaggttcctctatattagcataaacgaggcaatcaatgtgtctgtaattattgcgccgaaactggagaccttaggctgtcttgatgatgagctcgattcctccagactcgtgtttggcaccacggttcttcagggattccttgttgtgagcttgactacggtggtgcgcagtgtcaagattcttgctctcaaatcactttatattaaacttgatacgattattgacttgatgaaatgttttccatgtttagagaagttgtacatcaagtcttgtgtttcaggccaagaaatgaatcgctggcgtcgtaaacataaggatttcattaaatgctctgatatccgtctcaagacaatagtgttggagcagtatcaaggcattagatcacaagtcaactttgcctcattctttctattgaatgcgagagagctagagttaatgacacttgaggttgaaagcgaagattacaatgaggagttttttgcagaacaacataggatgcttcagatggagaaaaaggcttcaaaaggtgctcggttacattttacggcaaatggatgtcagcgttttcttatgcacgttgaccatatccgtgatttgtctataaccgatccctttgaatgtagatgttaaaattagccttggtcgtgacccttttatgatttttcctttgcactctcatttggtactttatttaaacaactgtgtcatgactgtagcaggctggcaattagatgctatcttttcaatgtattgtagcaactaaggttaccaagtggtgatattcatttcttctacttccgcatc

SEQ ID NO: 23036 - protein, 386 aa, Panicum virgatum
  misc_feature: Ceres CLONE 1825024
  misc_feature (276)..(327): Pfam Name: FBD Pfam Description: FBD
MDPSRRAPAVSRILADHPGPGLRFCIPSHLVVNHPATVDAWLRSPALDGLQELDFSWSRFEWSRREPPPSTFRFAATLREATFCQLDLPDATVDALHFPRLTHLALRHSSMSKRSLHAMISSSTCPVLECLLLEDCYGCRRLRVTSNSLRSIAVSAQCHAGKPRLKEVILVNAPSLERFLYISINEAINVSVIIAPKLETLGCLDDELDSSRLVFGTTVLQGFLVVSLTTVVRSVKILALKSLYIKLDTIIDLMKCFPCLEKLYIKSCVSGQEMNRWRRKHKDFIKCSDIRLKTIVLEQYQGIRSQVNFASFFLLNARELELMTLEVESEDYNEEFFAEQHRMLQMEKKASKGARLHFTANGCQRFLMHVDHIRDLSITDPFECRC

SEQ ID NO: 23037 - DNA, 561 bp, Panicum virgatum
  misc_feature: Ceres CLONE 1825046
  misc_feature: Encodes the peptide sequence at SEQ ID NO. 23038
catcaggtccgtcgtggaggatgcggggatgggcggcggcgccggcgcgccggcgtgcagccaggcggagccgacgacgcgcatcgtggggccggaggggcggtgcgtggacatgccctacaactggtactaccgcgggaaccaggtgcagctgtggccgtgccagtccaacggcgacgctaaccagctctggaccttccggcgcgacggccccgtccggtccggcgggatgtgcctggccgccgccgccgccggcgccggcgcccgcgtcgtggtggacgcgtgcccgcctcgcgtccctgcggcgcgcgccgtctgggaggcgcgcgccgacggcacggtggcgctgcgggctagcgggctggtcctgtccgtgacctcgtcgtcggcgttcgccggcgtcgcggtgcggcgcgacgaccgcggcacgggccagtcgtggacgcccaccaacgagaccgcgccgctgaccgactccgtcgtcgggttcggcgaccgctgcctgcacgcggacggggtgggggcggtctccctcgcggcctgcggcggcgggatggcgtg

SEQ ID NO: 23038 - protein, 186 aa, Panicum virgatum
  misc_feature: Ceres CLONE 1825046
  misc_feature (22)..(147): Pfam Name: Ricin_B_lectin Pfam Description: Ricin-type beta-trefoil lectin domain
  misc_feature: SWISSPROT Homolog: EC 3.2.2.22 rRNA N-glycosylase
IRSVVEDAGMGGGAGAPACSQAEPTTRIVGPEGRCVDMPYNWYYRGNQVQLWPCQSNGDANQLWTFRRDGPVRSGGMCLAAAAAGAGARVVVDACPPRVPAARAVWEARADGTVALRASGLVLSVTSSSAFAGVAVRRDDRGTGQSWTPTNETAPLTDSVVGFGDRCLHADGVGAVSLAACGGGMA

SEQ ID NO: 23039 - DNA, 1006 bp, Panicum virgatum
  misc_feature: Ceres CLONE 1825057
  misc_feature: Encodes the peptide sequence at SEQ ID NO. 23040
atcctggagagacacattgtcgaacacatggcgcgcgcgctcctccgccgcgcctgcgcactctccgccgccgccgccgcgccgcccagacttgccagcgccttggcttccacctccacagtagcgccgctgcgctcacccctcgacgaccgcctccaccgcctcctccgctccgagatcacctacctcgcagagcgccgccctccctacccgccgccgaggagcttcaagtcgttcgccgtggaggaccgtcccggggagcagtgggtgcgcctccgctcccgcgcgggagccgatgaggaggtcaaggtcgaggccaccatgttcgacggcgccgcggagccgctccccgaggacgcgcccctcttccgccgcgtggagtccctcgagcgcggcccgcgcctccacctcagcctcatcgtcgaggtcacccggggcgaccgcgtcctcggcttcatctgctccgcctggcccgacgagctcgccgtccgccacgtgctcgccctcagggctggcagtggcggcgccagtagcgatggcgctcgtggtggtggtggtcgcagtttcgtgaagctgggtgctggggagagggaagcagtgacgaagttcttgaaggagagggaggtggacgaggagctcgctgaattcttgcatggttacatggcgaacaaagagaagatggagcttctccggtggttgaagaccgtagaatcattccttgacaagtaggataagaacacagacataacaggcaccctgctgtttgaagcacgatttcccctaggatgatctcctgcagtccctgtgcattatcctccttaatgccgtgctatatgtctgtttactcattttgttgctgaagaagttttattttttcacttttcatagtagctcggtgctcatggagatcgatggcctgaatatcctaccgtattgtcatttccttgtgatcaagaatgttgtcaatcgtgtatccgttgaaatatgtgccgtttgactttttgcg

SEQ ID NO: 23040 - protein, 233 aa, Panicum virgatum
  misc_feature: Ceres CLONE 1825057
  misc_feature (47)..(231): Pfam Name: MAM33 Pfam Description: Mitochondrial glycoprotein
MARALLRRACALSAAAAAPPRLASALASTSTVAPLRSPLDDRLHRLLRSEITYLAERRPPYPPPRSFKSFAVEDRPGEQWVRLRSRAGADEEVKVEATMFDGAAEPLPEDAPLFRRVESLERGPRLHLSLIVEVTRGDRVLGFICSAWPDELAVRHVLALRAGSGGASSDGARGGGGRSFVKLGAGEREAVTKFLKEREVDEELAEFLHGYMANKEKMELLRWLKTVESFLDK

SEQ ID NO: 23041 - DNA, 651 bp, Panicum virgatum
  misc_feature: Ceres CLONE 1825060
  misc_feature: Encodes the peptide sequence at SEQ ID NO. 23042
aggtcactcacttggccactagccactcgcttcgtccgttctcgctcatcagtcatcaccaccagagcaagctcttccgtgggcttcgccgctccgagcctccgacccgtcctctccgtccggcgatcgcagcgcgcggccggccgggcgggatagatggggcggtcgccgtgctgcgagaaggaggccgggctgaagaagggcccctggacgccggaggaggaccagaagctgctcgccttcatcgagcagcacggccacggctgctggcgctcgctgccggccaaggctgggctgcggcggtgcggcaagagctgccggctccggtggaccaactacctgcggccggacatcaagcggggcaagttcacgctccaggaggagcagaccatcatccagctccacgcgctcctcggcaacaggtggtcggcgatcgcgacgcacctgcccaagcgcacggacaacgagatcaagaactactggaacacgcacctcaagaagcgcctcgccaagatgggcatcgaccccgtcacgcacaagccccgcgccgacgccggcggcgcctcctccggcgcgcgctacagggccgccgcgcacctcagccacacggcgcagtgggagagcgcgcggctcgaggcggaggcgcgcctg

SEQ ID NO: 23042 - protein, 164 aa, Panicum virgatum
  misc_feature: Ceres CLONE 1825060
  misc_feature (15)..(62): Pfam Name: Myb_DNA-binding Pfam Description: Myb-like DNA-binding domain
  misc_feature (68)..(113): Pfam Name: Myb_DNA-binding Pfam Description: Myb-like DNA-binding domain
  misc_feature: The sequence is a functional homolog of SEQ ID NO 296 in the 11/479,226 US patent application
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
  misc_feature: The sequence is a functional homolog of SEQ ID NO 1684 in the 11/479,226 US patent application
  misc_feature: The sequence is a functional homolog of SEQ ID NO 2582 in the 10/374,780 US patent application
  misc_feature: The sequence is a functional homolog of SEQ ID NO 30 in the 11/375,241 US patent application
  misc_feature: The sequence is a functional homolog of SEQ ID NO 854 in the 10/412,699 US patent application
  misc_feature: The sequence is a functional homolog of SEQ ID NO 824 in the 10/412,699 US patent application
  misc_feature: The sequence is a functional homolog of SEQ ID NO 1052 in the 11/479,226 US patent application
  misc_feature: The sequence is a functional homolog of SEQ ID NO 456 in the 10/412,699 US patent application
  misc_feature: The sequence is a functional homolog of SEQ ID NO 2564 in the 10/374,780 US patent application
  misc_feature: The sequence is a functional homolog of SEQ ID NO 276 in the 10/225,066 US patent application
  misc_feature: The sequence is a functional homolog of SEQ ID NO 818 in the 10/412,699 US patent application
  misc_feature: Useful for making plants with altered alkaloid content
  misc_feature: Useful for making plants with altered lignin content
  misc_feature: Useful for making plants with modulated nitrogen use efficiency
  misc_feature: The sequence is a functional homolog of SEQ ID NO 110 in the 10/412,699 US patent application
  misc_feature: The sequence is a functional homolog of SEQ ID NO 259 in the 11/479,226 US patent application
  misc_feature: The sequence is a functional homolog of SEQ ID NO 2572 in the 10/374,780 US patent application
  misc_feature: The sequence is a functional homolog of SEQ ID NO 636 in the 10/225,066 US patent application
  misc_feature: The sequence is a functional homolog of SEQ ID NO 838 in the 10/412,699 US patent application
  misc_feature: The sequence is a functional homolog of SEQ ID NO 134 in the 10/412,699 US patent application
  misc_feature: The sequence is a functional homolog of SEQ ID NO 321 in the 11/479,226 US patent application
  misc_feature: The sequence is a functional homolog of SEQ ID NO 1041 in the 11/479,226 US patent application
  misc_feature: The sequence is a functional homolog of SEQ ID NO 112 in the 10/225,066 US patent application
  misc_feature: The sequence is a functional homolog of SEQ ID NO 20 in the 11/375,241 US patent application
  misc_feature: The sequence is a functional homolog of SEQ ID NO 2052 in the 10/374,780 US patent application
  misc_feature: The sequence is a functional homolog of SEQ ID NO 450 in the 10/412,699 US patent application
  misc_feature: The sequence is a functional homolog of SEQ ID NO 168 in the 10/412,699 US patent application
  misc_feature: The sequence is a functional homolog of SEQ ID NO 377 in the 11/479,226 US patent application
  misc_feature: The sequence is a functional homolog of SEQ ID NO 1011 in the 11/479,226 US patent application
  misc_feature: The sequence is a functional homolog of SEQ ID NO 434 in the 10/412,699 US patent application
  misc_feature: The sequence is a functional homolog of SEQ ID NO 271 in the 11/479,226 US patent application
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: The sequence is a functional homolog of SEQ ID NO 442 in the 10/412,699 US patent application
  misc_feature: The sequence is a functional homolog of SEQ ID NO 18 in the 11/375,241 US patent application
  misc_feature: The sequence is a functional homolog of SEQ ID NO 426 in the 10/374,780 US patent application
  misc_feature: The sequence is a functional homolog of SEQ ID NO 458 in the 10/225,066 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: Useful for making plants with altered carbohydrate content
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 569 in the 10/374,780 US patent application
  misc_feature: The sequence is a functional homolog of SEQ ID NO 1002 in the 11/435,388 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 1004 in the 11/435,388 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: Useful for making plants with altered cell wall content and/or composition
  misc_feature: The sequence is a functional homolog of SEQ ID NO 1010 in the 11/435,388 US patent application
  misc_feature: The sequence is a functional homolog of SEQ ID NO 1094 in the 10/225,066 US patent application
  misc_feature: The sequence is a functional homolog of SEQ ID NO 386 in the 10/374,780 US patent application
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: The sequence is a functional homolog of SEQ ID NO 1073 in the 10/374,780 US patent application
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: The sequence is a functional homolog of SEQ ID NO 136 in the 10/412,699 US patent application
  misc_feature: The sequence is a functional homolog of SEQ ID NO 325 in the 11/479,226 US patent application
  misc_feature: The sequence is a functional homolog of SEQ ID NO 58 in the 10/666,642 US patent application
  misc_feature: The sequence is a functional homolog of SEQ ID NO 792 in the 11/435,388 US patent application
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: The sequence is a functional homolog of SEQ ID NO 593 in the 10/374,780 US patent application
  misc_feature: The sequence is a functional homolog of SEQ ID NO 782 in the 11/435,388 US patent application
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: The sequence is a functional homolog of SEQ ID NO 788 in the 11/435,388 US patent application
  misc_feature: The sequence is a functional homolog of SEQ ID NO 592 in the 10/374,780 US patent application
  misc_feature: The sequence is a functional homolog of SEQ ID NO 786 in the 11/435,388 US patent application
  misc_feature: The sequence is a functional homolog of SEQ ID NO 1074 in the 10/412,699 US patent application
  misc_feature: The sequence is a functional homolog of SEQ ID NO 590 in the 10/374,780 US patent application
  misc_feature: The sequence is a functional homolog of SEQ ID NO 1031 in the 11/479,226 US patent application
  misc_feature: The sequence is a functional homolog of SEQ ID NO 1804 in the 10/412,699 US patent application
  misc_feature: The sequence is a functional homolog of SEQ ID NO 2050 in the 10/374,780 US patent application
  misc_feature: The sequence is a functional homolog of SEQ ID NO 444 in the 10/412,699 US patent application
  misc_feature: The sequence is a functional homolog of SEQ ID NO 598 in the 10/225,066 US patent application
  misc_feature: The sequence is a functional homolog of SEQ ID NO 620 in the 11/435,388 US patent application
  misc_feature: The sequence is a functional homolog of SEQ ID NO 726 in the 11/435,388 US patent application
  misc_feature: Useful for biocontainment applications
  misc_feature: The sequence is a functional homolog of SEQ ID NO 156 in the 10/412,699 US patent application
  misc_feature: The sequence is a functional homolog of SEQ ID NO 164 in the 10/412,699 US patent application
  misc_feature: The sequence is a functional homolog of SEQ ID NO 1754 in the 10/412,699 US patent application
  misc_feature: The sequence is a functional homolog of SEQ ID NO 1978 in the 10/374,780 US patent application
  misc_feature: The sequence is a functional homolog of SEQ ID NO 353 in the 11/479,226 US patent application
  misc_feature: The sequence is a functional homolog of SEQ ID NO 369 in the 11/479,226 US patent application
  misc_feature: The sequence is a functional homolog of SEQ ID NO 40 in the 10/374,780 US patent application
  misc_feature: The sequence is a functional homolog of SEQ ID NO 776 in the 10/225,066 US patent application
  misc_feature: Useful for making plants with modulated low light sensitivity
  misc_feature: The sequence is a functional homolog of SEQ ID NO 794 in the 11/435,388 US patent application
  misc_feature: The sequence is a functional homolog of SEQ ID NO 1411 in the 11/479,226 US patent application
  misc_feature: The sequence is a functional homolog of SEQ ID NO 2492 in the 10/374,780 US patent application
  misc_feature: The sequence is a functional homolog of SEQ ID NO 52 in the 10/225,066 US patent application
  misc_feature: The sequence is a functional homolog of SEQ ID NO 122 in the 10/412,699 US patent application
  misc_feature: The sequence is a functional homolog of SEQ ID NO 126 in the 11/375,241 US patent application
  misc_feature: The sequence is a functional homolog of SEQ ID NO 148 in the 10/286,264 US patent application
  misc_feature: The sequence is a functional homolog of SEQ ID NO 34 in the 10/374,780 US patent application
  misc_feature: The sequence is a functional homolog of SEQ ID NO 438 in the 10/225,066 US patent application
  misc_feature: The sequence is a functional homolog of SEQ ID NO 1118 in the 10/225,066 US patent application
  misc_feature: The sequence is a functional homolog of SEQ ID NO 1396 in the 11/479,226 US patent application
  misc_feature: The sequence is a functional homolog of SEQ ID NO 2488 in the 10/374,780 US patent application
  misc_feature: The sequence is a functional homolog of SEQ ID NO 658 in the 10/412,699 US patent application
  misc_feature: The sequence is a functional homolog of SEQ ID NO 822 in the 10/412,699 US patent application
  misc_feature: The sequence is a functional homolog of SEQ ID NO 743 in the 10/666,642 US patent application
  misc_feature: The sequence is a functional homolog of SEQ ID NO 184 in the 10/412,699 US patent application
  misc_feature: The sequence is a functional homolog of SEQ ID NO 397 in the 11/479,226 US patent application
  misc_feature: The sequence is a functional homolog of SEQ ID NO 46 in the 10/374,780 US patent application
  misc_feature: The sequence is a functional homolog of SEQ ID NO 590 in the 11/435,388 US patent application
  misc_feature: The sequence is a functional homolog of SEQ ID NO 6 in the 10/225,068 US patent application
  misc_feature: The sequence is a functional homolog of SEQ ID NO 790 in the 11/435,388 US patent application
  misc_feature: Useful for making plants with altered terpenoid content
  misc_feature: The sequence is a functional homolog of SEQ ID NO 836 in the 10/412,699 US patent application
  misc_feature: The sequence is a functional homolog of SEQ ID NO 594 in the 10/374,780 US patent application
  misc_feature: The sequence is a functional homolog of SEQ ID NO 784 in the 11/435,388 US patent application
  misc_feature: The sequence is a functional homolog of SEQ ID NO 796 in the 11/435,388 US patent application
  misc_feature: The sequence is a functional homolog of SEQ ID NO 1072 in the 10/412,699 US patent application
  misc_feature: The sequence is a functional homolog of SEQ ID NO 1073 in the 10/412,699 US patent application
  misc_feature: The sequence is a functional homolog of SEQ ID NO 588 in the 10/374,780 US patent application
  misc_feature: The sequence is a functional homolog of SEQ ID NO 589 in the 10/374,780 US patent application
  misc_feature: The sequence is a functional homolog of SEQ ID NO 730 in the 11/435,388 US patent application
  misc_feature: The sequence is a functional homolog of SEQ ID NO 116 in the 10/412,699 US patent application
  misc_feature: The sequence is a functional homolog of SEQ ID NO 280 in the 11/479,226 US patent application
  misc_feature: The sequence is a functional homolog of SEQ ID NO 263 in the 11/479,226 US patent application
  misc_feature: The sequence is a functional homolog of SEQ ID NO 478 in the 11/435,388 US patent application
  misc_feature: The sequence is a functional homolog of SEQ ID NO 54 in the 10/666,642 US patent application
  misc_feature: The sequence is a functional homolog of SEQ ID NO 1071 in the 10/412,699 US patent application
  misc_feature: The sequence is a functional homolog of SEQ ID NO 587 in the 10/374,780 US patent application
  misc_feature: The sequence is a functional homolog of SEQ ID NO 728 in the 11/435,388 US patent application
  misc_feature: The sequence is a functional homolog of SEQ ID NO 112 in the 11/375,241 US patent application
  misc_feature: The sequence is a functional homolog of SEQ ID NO 2398 in the 10/374,780 US patent application
  misc_feature: The sequence is a functional homolog of SEQ ID NO 466 in the 10/412,699 US patent application
  misc_feature: The sequence is a functional homolog of SEQ ID NO 580 in the 10/225,066 US patent application
  misc_feature: The sequence is a functional homolog of SEQ ID NO 2394 in the 10/374,780 US patent application
  misc_feature: The sequence is a functional homolog of SEQ ID NO 544 in the 10/225,066 US patent application
  misc_feature: The sequence is a functional homolog of SEQ ID NO 999 in the 11/479,226 US patent application
  misc_feature: The sequence is a functional homolog of SEQ ID NO 1901 in the 11/479,226 US patent application
  misc_feature: The sequence is a functional homolog of SEQ ID NO 310 in the 10/374,780 US patent application
  misc_feature: The sequence is a functional homolog of SEQ ID NO 842 in the 10/225,066 US patent application
  misc_feature: Useful for making plants with modulated biomass
  misc_feature: The sequence is a functional homolog of SEQ ID NO 1680 in the 11/479,226 US patent application
  misc_feature: The sequence is a functional homolog of SEQ ID NO 202 in the 10/666,642 US patent application
  misc_feature: The sequence is a functional homolog of SEQ ID NO 852 in the 10/412,699 US patent application
  misc_feature: The sequence is a functional homolog of SEQ ID NO 1917 in the 10/374,780 US patent application
  misc_feature: The sequence is a functional homolog of SEQ ID NO 148 in the 10/412,699 US patent application
  misc_feature: The sequence is a functional homolog of SEQ ID NO 2266 in the 10/374,780 US patent application
  misc_feature: The sequence is a functional homolog of SEQ ID NO 341 in the 11/479,226 US patent application
  misc_feature: The sequence is a functional homolog of SEQ ID NO 58 in the 11/375,241 US patent application
  misc_feature: The sequence is a functional homolog of SEQ ID NO 428 in the 10/374,780 US patent application
  misc_feature: The sequence is a functional homolog of SEQ ID NO 54 in the 11/375,241 US patent application
  misc_feature: The sequence is a functional homolog of SEQ ID NO 870 in the 10/225,066 US patent application
  misc_feature: The sequence is a functional homolog of SEQ ID NO 1033 in the 10/412,699 US patent application
  misc_feature: The sequence is a functional homolog of SEQ ID NO 540 in the 10/374,780 US patent application
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: The sequence is a functional homolog of SEQ ID NO 2570 in the 10/374,780 US patent application
  misc_feature: The sequence is a functional homolog of SEQ ID NO 634 in the 10/225,066 US patent application
  misc_feature: The sequence is a functional homolog of SEQ ID NO 832 in the 10/412,699 US patent application
  misc_feature: The sequence is a functional homolog of SEQ ID NO 1656 in the 11/479,226 US patent application
  misc_feature: The sequence is a functional homolog of SEQ ID NO 834 in the 10/412,699 US patent application
  misc_feature: The sequence is a functional homolog of SEQ ID NO 1100 in the 10/225,066 US patent application
  misc_feature: The sequence is a functional homolog of SEQ ID NO 158 in the 10/412,699 US patent application
  misc_feature: The sequence is a functional homolog of SEQ ID NO 2268 in the 10/374,780 US patent application
  misc_feature: The sequence is a functional homolog of SEQ ID NO 357 in the 11/479,226 US patent application
  misc_feature: The sequence is a functional homolog of SEQ ID NO 480 in the 11/435,388 US patent application
  misc_feature: The sequence is a functional homolog of SEQ ID NO 178 in the 10/412,699 US patent application
  misc_feature: The sequence is a functional homolog of SEQ ID NO 389 in the 11/479,226 US patent application
  misc_feature: The sequence is a functional homolog of SEQ ID NO 1681 in the 10/374,780 US patent application
  misc_feature: The sequence is a functional homolog of SEQ ID NO 1075 in the 10/412,699 US patent application
  misc_feature: The sequence is a functional homolog of SEQ ID NO 591 in the 10/374,780 US patent application
  misc_feature: The sequence is a functional homolog of SEQ ID NO 1056 in the 11/479,226 US patent application
  misc_feature: The sequence is a functional homolog of SEQ ID NO 144 in the 10/374,780 US patent application
  misc_feature: The sequence is a functional homolog of SEQ ID NO 458 in the 10/412,699 US patent application
  misc_feature: The sequence is a functional homolog of SEQ ID NO 756 in the 10/225,066 US patent application
  misc_feature: The sequence is a functional homolog of SEQ ID NO 2 in the 10/225,068 US patent application
  misc_feature: The sequence is a functional homolog of SEQ ID NO 22 in the 10/225,068 US patent application
  misc_feature: The sequence is a functional homolog of SEQ ID NO 230 in the 10/225,066 US patent application
  misc_feature: The sequence is a functional homolog of SEQ ID NO 258 in the 10/374,780 US patent application
  misc_feature: The sequence is a functional homolog of SEQ ID NO 442 in the 11/435,388 US patent application
  misc_feature: The sequence is a functional homolog of SEQ ID NO 842 in the 10/412,699 US patent application
  misc_feature: The sequence is a functional homolog of SEQ ID NO 98 in the 11/375,241 US patent application
  misc_feature: The sequence is a functional homolog of SEQ ID NO 446 in the 10/412,699 US patent application
  misc_feature: The sequence is a functional homolog of SEQ ID NO 126 in the 10/412,699 US patent application
  misc_feature: The sequence is a functional homolog of SEQ ID NO 186 in the 10/412,699 US patent application
  misc_feature: The sequence is a functional homolog of SEQ ID NO 2178 in the 10/374,780 US patent application
  misc_feature: The sequence is a functional homolog of SEQ ID NO 1563 in the 10/374,780 US patent application
  misc_feature: Useful for making plants with modulated drought sensitivity
  misc_feature: Useful for making plants with modulated flowering time
  misc_feature: The sequence is a functional homolog of SEQ ID NO 1564 in the 10/374,780 US patent application
  misc_feature: The sequence is a functional homolog of SEQ ID NO 36 in US patent 7193132
  misc_feature: The sequence is a functional homolog of SEQ ID NO 156 in the 10/225,068 US patent application
  misc_feature: The sequence is a functional homolog of SEQ ID NO 262 in the 10/374,780 US patent application
  misc_feature: The sequence is a functional homolog of SEQ ID NO 282 in the 10/225,066 US patent application
  misc_feature: The sequence is a functional homolog of SEQ ID NO 1916 in the 10/412,699 US patent application
  misc_feature: The sequence is a functional homolog of SEQ ID NO 2176 in the 10/374,780 US patent application
  misc_feature: The sequence is a functional homolog of SEQ ID NO 1672 in the 11/479,226 US patent application
  misc_feature: The sequence is a functional homolog of SEQ ID NO 846 in the 10/412,699 US patent application
  misc_feature: The sequence is a functional homolog of SEQ ID NO 2696 in the 10/374,780 US patent application
  misc_feature: The sequence is a functional homolog of SEQ ID NO 344 in the 10/225,066 US patent application
MGRSPCCEKEAGLKKGPWTPEEDQKLLAFIEQHGHGCWRSLPAKAGLRRCGKSCRLRWTNYLRPDIKRGKFTLQEEQTIIQLHALLGNRWSAIATHLPKRTDNEIKNYWNTHLKKRLAKMGIDPVTHKPRADAGGASSGARYRAAAHLSHTAQWESARLEAEAR

SEQ ID NO: 23043 - DNA, 1105 bp, Panicum virgatum
  misc_feature: Ceres CLONE 1825112
  misc_feature: Encodes the peptide sequence at SEQ ID NO. 23044
aacggagaaagccgcccgcaagcaaatcctatctcgaatctgtgaaccccaaccaaatgacgccgacggcgagcctcctcctcccggctccccccttcgtctccatctccgatgtgcgccgcctccagttcctcccgcgcggccgccgccgacctctcctctgctggagcggcgcggtgtggggctctgtgcggacccagatgctgtcttctttcgtcgggagcagaagatcgagccgcagaagcgttatctgcgcttccctgtttggggttggtgctcccgaagcattggtcattggagtggttgccttgttggtgttcggccccaagggtctagcagaggtagccaggaatttggggaagactttgcgtgctttccaaccaaccattagagagttacaggatgtatcaagggagttcaggagcacacttgaacgagaaattggaattgatgaggttcccccctccacgaattataggcccacaaccacgaataacaacgaacaacctgccgccaacccaaatgttaagcctgaagctgctccttatactagcgaggaactcatgaaagtaactgaagaacaaattgctgcatcagcggctgctgcctggaatactcaacctgccccatcacaagagcaagaagcagcacccccaattcaaagtaccggcgctgctacatcaggaggtaatgatggtcccgcagctcctgctcctgcaaccgagtctggtccaagcgaagcaaatcagtctgagaaggtggaaagcgagcgaagcaaatcagtctgagaggcggaaagcgagcgataaagccagtggatgggaagagcaaatcagggcgaggaattttgctcagttttttttccctgaggcgggcgaggttgtatgaaatgcttatagtgcttaggcctattctgtttatcttgtgctgctgttgtagatgttgaagaaggctgtgtatatttcctggtagtgcgtctcacgctgccacggctgctgttgtgccgtcgtcagccttgtaacatttctgagcctgtcgtagccacgagagtttgttgtatggagcaatgagtttaatcatgactcaacggagaggcgattgattc

SEQ ID NO: 23044 - protein, 243 aa, Panicum virgatum
  misc_feature: Ceres CLONE 1825112
  misc_feature (72)..(154): Pfam Name: MttA_Hcf106 Pfam Description: mttA/Hcf106 family
MTPTASLLLPAPPFVSISDVRRLQFLPRGRRRPLLCWSGAVWGSVRTQMLSSFVGSRRSSRRSVICASLFGVGAPEALVIGVVALLVFGPKGLAEVARNLGKTLRAFQPTIRELQDVSREFRSTLEREIGIDEVPPSTNYRPTTTNNNEQPAANPNVKPEAAPYTSEELMKVTEEQIAASAAAAWNTQPAPSQEQEAAPPIQSTGAATSGGNDGPAAPAPATESGPSEANQSEKVESERSKSV

SEQ ID NO: 23045 - DNA, 694 bp, Panicum virgatum
  misc_feature: Ceres CLONE 1825125
  misc_feature: Encodes the peptide sequence at SEQ ID NO. 23046
gtgagtgagccctcttcttccccttctcaggcgaccggagctcagcaatgtcgctcggcgacacgaagaggacggcgtgcgtgaccggagggaacgggtacatcgcctcggctctcgtcaagatgctgctggagaagggctacgccgtcaagacgacggtcaggaaccccgatgacatggagaagaactcccacctcgaggaccagcaggcgctcggatccctggaggtcttccgcgccgacctggacgaagaaggcagctttgacgaagccatcgccggctgcgactacgccttcctcgtcgccgctccggtgaacatccacgcaaagaatcctgagaaagagctgatcaagcccgctgtcaggggaactctgaacgtgctgcggtcgtgcgtgaaggcggggacggtgaagcgcgtggtcctgacctcgtcggtggccgcggtcaccagcaggccgctgcaaggcgacgggcacgtcctggacgaggactcctggtccgacgtcgagcacctcgccgccaccaactctccttaccggggatacccggtgtccaaggtgctcctggagaaggcggcgaccaggttcgcggaggagcacggcatcagcctcgtcaccctctgccccgtcgtcaccgtcggcgcggcgccggcgccgagcgcccgcaccagcgtccccaactgcctctcccttct

SEQ ID NO: 23046 - protein, 215 aa, Panicum virgatum
  misc_feature: Ceres CLONE 1825125
  misc_feature (10)..(214): Pfam Name: Epimerase Pfam Description: NAD dependent epimerase/dehydratase family
  misc_feature: SWISSPROT Homolog: EC 1.3.1.77 Anthocyanidin reductase
MSLGDTKRTACVTGGNGYIASALVKMLLEKGYAVKTTVRNPDDMEKNSHLEDQQALGSLEVFRADLDEEGSFDEAIAGCDYAFLVAAPVNIHAKNPEKELIKPAVRGTLNVLRSCVKAGTVKRVVLTSSVAAVTSRPLQGDGHVLDEDSWSDVEHLAATNSPYRGYPVSKVLLEKAATRFAEEHGISLVTLCPVVTVGAAPAPSARTSVPNCLSL

SEQ ID NO: 23047 - DNA, 689 bp, Panicum virgatum
  misc_feature: Ceres CLONE 1825140
  misc_feature: Encodes the peptide sequence at SEQ ID NO. 23048
cccacctacataacacggccttcccactcccctcgcccgccgccgcctgcgcccacctccgacctccactcaccccgcgtcctccctctcgcgcgcggctcgtcgagatgtcgcccgaggcggcgaaggtggcggtgccggagtcggtgctccgcaagcagaagcgcgaggagcagtgggcggccgacaagaaggagaaggccctggtagagaagaagaagtccatcgagagccgcaagctcatctccagccgcgccaagcagtacgccgaggagtacgacgctcaggagaaggagctggtgcagcttaagcgtgaggcccggttgaagggtggtttctatgtcagtcctgaggcaaagctgctgtttgtgatccgcatccgtggtatcaatgccatgcacccgaagaccaggaagatcttgcagcttttgcggttgaggcagatcttcaatggtgtgttcctgaaggtcaacaaggctaccattaacatgctgcgcagggttgagccttacgttgcatatgggtacccgaacttgaagagcgtcagggagttgatctacaagcggggctatggaaaactgaacaagcagaggattcctctgtccaacaaccaagtcattgaggagggcttgggcaagcacaacatcatctgcattgaggatcttgttcacgaggtcatgactgttggg

SEQ ID NO: 23048 - protein, 193 aa, Panicum virgatum
  misc_feature: Ceres CLONE 1825140
  misc_feature (13)..(83): Pfam Name: Ribosomal_L30_N Pfam Description: Ribosomal L30 N-terminal domain
  misc_feature (85)..(136): Pfam Name: Ribosomal_L30 Pfam Description: Ribosomal protein L30p/L7e
MSPEAAKVAVPESVLRKQKREEQWAADKKEKALVEKKKSIESRKLISSRAKQYAEEYDAQEKELVQLKREARLKGGFYVSPEAKLLFVIRIRGINAMHPKTRKILQLLRLRQIFNGVFLKVNKATINMLRRVEPYVAYGYPNLKSVRELIYKRGYGKLNKQRIPLSNNQVIEEGLGKHNIICIEDLVHEVMTV

SEQ ID NO: 23049 - DNA, 1170 bp, Panicum virgatum
  misc_feature: Ceres CLONE 1825159
  misc_feature: Encodes the peptide sequence at SEQ ID NO. 23050
atcatcgatcgacgaccacaccggccagtgccagtacgtaccacgacatgatgatggcagccgcctactacaagcaggtgtcctcccgcgccgtcgccgctgcgctactctgcctgctcctggctcatggcaccagctgcggcggctccaagcacaagaccgggcggcacaaggccgccgccgccgcaccgacgacgacaccaccaccgaattccagcgccggcgacgggtcgtggctcaacgcccgagcgacgtggtacggcgcccccaacggcgccggcccggacgacaacggcggcgcctgcggcttcaagggcgtgaacctgccgcccttctcggccatgacgtcctgcgggaacgagccgctcttcaaggacggcaaaggatgcggctcctgctaccagatccgctgcgttgcccaccctgcttgctccggcatcccggagacggtcatcatcacggacatgaactactacccggtggcgccctaccacttggacctcagcggaacagccttcggcgccatggccaaggacgaccgcaacgacgagctcaggcacgccggcatcatcgacatacagttcaagagagttgcttgccagtaccctggtctgacggtgaccttccacatcgagcgcggctccaaccccaactacctggcggtgcttgtggagtactccaacggcgacggcgacgtggtgcaggtggacctcatggagtcgcgggcggaggacggcgagccgacgggggtgtgggagccgatgcgcgagtcgtgggggtccatctggcggatggacacccgccgcccgctgcaggggcccttctcgctgcgcgtcaccaacgagtccggcaagacgctggtggcggaccaggtcatccccgccgactggcagccggacaacgtctacagctccatcgtccagtttgattgacgattcttcatcattatcatcgcagccatgcattttgcatttgcgctccatgcatgcgtgacgattatatatacatgtatacatatactactactaggtgacgtcgcttgtgatgtccgtccgatcccatcctagctagtgcgttgcgttgaatgttgctgcttaatttgtgactttgttacatgtgtgctagcaagacatatatgttagttggttgtaccaactttctttactactg

SEQ ID NO: 23050 - protein, 294 aa, Panicum virgatum
  misc_feature: Ceres CLONE 1825159
  misc_feature (191)..(278): Pfam Name: Pollen_allerg_1 Pfam Description: Pollen allergen
  misc_feature (100)..(179): Pfam Name: DPBB_1 Pfam Description: Rare lipoprotein A (RlpA)-like double-psi beta-barrel
  misc_feature: Useful for making plants with altered carbohydrate content
MMMAAAYYKQVSSRAVAAALLCLLLAHGTSCGGSKHKTGRHKAAAAAPTTTPPPNSSAGDGSWLNARATWYGAPNGAGPDDNGGACGFKGVNLPPFSAMTSCGNEPLFKDGKGCGSCYQIRCVAHPACSGIPETVIITDMNYYPVAPYHLDLSGTAFGAMAKDDRNDELRHAGIIDIQFKRVACQYPGLTVTFHIERGSNPNYLAVLVEYSNGDGDVVQVDLMESRAEDGEPTGVWEPMRESWGSIWRMDTRRPLQGPFSLRVTNESGKTLVADQVIPADWQPDNVYSSIVQFD

SEQ ID NO: 23051 - DNA, 1234 bp, Panicum virgatum
  misc_feature: Ceres CLONE 1825172
  misc_feature: Encodes the peptide sequence at SEQ ID NO. 23052
aaaccccatcagaggcagaggaaagcttcgagaagggagacacagagatggagaacggcggcggcggcggcggcggcggcagaagcgacgtccccgacgacgccaacgagcattgccctggaacgcagtcagaggatgcggggaaggcggatgcctgcgccggatgccccaaccagcagatttgcgccactgcccccaagggccctgatcccgatgtggttgctattgttgagcggctggctatggtgaagcacaagatactagttctgtctggaaagggaggtgttggaaagagcacgttctcagctcagctctcatttgccctagctgaaatggagcatcaggttggccttcttgacatagatatctgtggccctagcatcccaaaaatgttagggctggagggtcaggatattcatcaaagcaaccttggctggtccccggtctatgtcgagtcaaaccttggtgttatgtcaattggtttcatgctgcctaacccagatgatgctgtcatatggaggggtccccgcaagaatggactgataaagcagttcttaaaggatgttgactggggggagatcgactatcttgtagtggatgcacctccaggaacctctgatgaacacatctcgattgtgcagtacctccaggccacaggaattgatggtgcgataattgtcacgactccgcagcaggtctctctaattgatgtgaggaaggagataaatttctgcaagaaggtcggtgttccggtgttgggtgttgtggagaacatgagtggcctgaggcagccgctttcagatctcaggttcatgaagtcaggtgagtcgggcgagacagacgctacggagtgggtgctgaactgtatcagggagaaagcgcccgagcttctatcggttgtggcatgcagcgatgtgtttgacagcagtaagggcggcgcagagagtatgtgcattgaaatgggggtccctttcctcggtaaggtgcccatggatcctcaactgtgcaaggcggccgaggaagggagatcatgcttcgctgatcagaagtgcagcgccagtgctccggctcttcagagcattgtgaagaagttgatcaagactgagtgagaaaatagtgttggcccgccgtggatcgggcgcatgtgacaatgccaaagttcttactatgtatgttgctgtgtaacacactgaatttgttttagtgctggtattggatccagtaagtttttgtc

SEQ ID NO: 23052 - protein, 353 aa, Panicum virgatum
  misc_feature: Ceres CLONE 1825172
  misc_feature (71)..(269): Pfam Name: CbiA Pfam Description: CobQ/CobB/MinD/ParA nucleotide binding domain
  misc_feature: SWISSPROT Homolog: EC 2.7.10.2 Non-specific protein-tyrosine kinase
MENGGGGGGGGRSDVPDDANEHCPGTQSEDAGKADACAGCPNQQICATAPKGPDPDVVAIVERLAMVKHKILVLSGKGGVGKSTFSAQLSFALAEMEHQVGLLDIDICGPSIPKMLGLEGQDIHQSNLGWSPVYVESNLGVMSIGFMLPNPDDAVIWRGPRKNGLIKQFLKDVDWGEIDYLVVDAPPGTSDEHISIVQYLQATGIDGAIIVTTPQQVSLIDVRKEINFCKKVGVPVLGVVENMSGLRQPLSDLRFMKSGESGETDATEWVLNCIREKAPELLSVVACSDVFDSSKGGAESMCIEMGVPFLGKVPMDPQLCKAAEEGRSCFADQKCSASAPALQSIVKKLIKTE

SEQ ID NO: 23053 - DNA, 1157 bp, Panicum virgatum
  misc_feature: Ceres CLONE 1825176
  misc_feature: Encodes the peptide sequence at SEQ ID NO. 23054
accccattagaccaccacccgttggctcggcttggctttctcccctcgccccggggaacgcggccgccgatcccctcccctcccccttccgccgcccgatcccaccaaacccgcgcccgcagctgcctcaattcgattccctagctcgattggcgccacccgatcagccgcggggcaggccgtatttggtttgattcgattggattgggtcccgtgcggagctgtggatccccaattgagttgccgctagggtttcggcgggctcggtcgccgtgtgggcgggcgggaggggttctaccatggcggagaagagctgccttaagcggctccagaaggagtaccacgcgctctgcaaggagccgccgccgcagatcgtggctcgcccgctgtccaacgacatattggagtggcactatgttcttgaaggaagtaaaggcacaccctttgaaggcggatattactacgggaaacttaaatttccaccagattatccttttaaacctccaagtatcagcatgacaactccaagcggcaggtttgccccacacaaaagaatatgcctgtcaatgagtgactttcatcctgaatcttggaatcctatgtggtctgtagcaagcattcttactgggctcttgtcgttcatgatggatgatgctctgacaactggaagcatcaagacttcagatgcagagaagagacgcttagcaaaagcttcccttgcatacaattgtgagagcaaaaactgcccgcacttcaggaaactgttcccagagtacgttgagaagtacaaccaacaacaacaattggagaacaccgccgcggaaccagagccccgtgagaatcctgctgcccctgctcctcctgcagttcagcaagctccagttgtggccaatagagcgcagccagtggcagaggcacgtcgcgagaagaaccagaagaaagcggtgcccttctggatggttctggtcatgttttcagtttttggtgccgtgatggccttgcccctaatgcaactttgagaataataaatgactttgaaagtgtgatactggggcgtaattttgtatagtttctattggtttgtgtgactcaattgtcctcttggagtcatgttggtaaacatgtgatggtaaatctgtagaaccgtattctctctc

SEQ ID NO: 23054 - protein, 239 aa, Panicum virgatum
  misc_feature: Ceres CLONE 1825176
  misc_feature (9)..(160): Pfam Name: UQ_con Pfam Description: Ubiquitin-conjugating enzyme
  misc_feature: SWISSPROT Homolog: EC 6.3.2.19 Ubiquitin--protein ligase
MAEKSCLKRLQKEYHALCKEPPPQIVARPLSNDILEWHYVLEGSKGTPFEGGYYYGKLKFPPDYPFKPPSISMTTPSGRFAPHKRICLSMSDFHPESWNPMWSVASILTGLLSFMMDDALTTGSIKTSDAEKRRLAKASLAYNCESKNCPHFRKLFPEYVEKYNQQQQLENTAAEPEPRENPAAPAPPAVQQAPVVANRAQPVAEARREKNQKKAVPFWMVLVMFSVFGAVMALPLMQL

SEQ ID NO: 23055 - DNA, 1287 bp, Panicum virgatum
  misc_feature: Ceres CLONE 1825205
  misc_feature: Encodes the peptide sequence at SEQ ID NO. 23056
cgctcgcctattggccgccgcctccgggcgagcctccgcgcccagtgaaacagaacagaacagcgacgacctggacgacgcggccggcggggctgcgagggtgatcaccgagcatcatggagtcgcgcccgggcggaacgaacctggtggagcccagagggcagggtgccgcgctgccttcgggcggcgcggcgatgcagaagccgtggtggacgagctccggggccgggctcggtgcagtgtcgcctgccgttgtggcgccggggagcggggcagggatcagcctgtcgagcagcccggtaggtggtggtggtgggtggtggtgccggggcggccaaaggcgctgcgagtgacgagagcagcgaggattcacggagatctggggaaccaaaagatggtagtgctggtcaagaaaagaaccacgccacatcacagatgcctgctttgatgtcagagtatttgacaccatattcacagctggaactgaaccaatcaattggttcagcagcatatcagtacccagatccttactacgctggcatgattcctccctatggcactcaagcggtggctcatttccagctaccaggattatcccactctcgcatgccattacctcttgaagtatcggaggagcctgtttatgtaaatgcaaagcagtaccatggaattctaagacgaaggcaatcacgtgccaaggctgaacttgagaaaaaggtggtcaaaaccaggaagccctatcttcatgagtctcgtcatcaacacgcaatgagaagggcaagaggaaatgggggacgcttcctgaacacaaagaaaagtgataatggtactccgaatggtaatgctgaacctaagaaaggagatcaaaactacgagcatctccatgtccctcctgacttactacagctacgacagaacgaggcatgaagtagtggtcttgcatcctagaacagtggtttcttcccgagacataggcacttgagagaccggactcctgcccctgcgccgcgctgccatcttagcgacctgccttggttgtgcaaggcggcccaaggctcgttcagctgagtgagcttggtaccaggtcctggcagagcgcgctgggggcgctggtgtccgtagaagtgtctgctgccatggccaggtctgctgttttcaggcaactcattcttggctttcgcatcccgcccctgtgttgtaaactggtgtgtttcaagtgaaactaatgttgtgttcggttgtcggcgtcctgcggaacatctgtataattaagatcaattttgtcgg

SEQ ID NO: 23056 - protein, 163 aa, Panicum virgatum
  misc_feature: Ceres CLONE 1825205
  misc_feature (66)..(122): Pfam Name: CBFB_NFYA Pfam Description: CCAAT-binding transcription factor (CBF-B/NF-YA) subunit B
  misc_feature: The sequence is a functional homolog of SEQ ID NO 1518 in the 10/666,642 US patent application
  misc_feature: The sequence is a functional homolog of SEQ ID NO 472 in the 10/666,642 US patent application
  misc_feature: The sequence is a functional homolog of SEQ ID NO 2852 in the 10/374,780 US patent application
  misc_feature: The sequence is a functional homolog of SEQ ID NO 696 in the 10/225,066 US patent application
  misc_feature: The sequence is a functional homolog of SEQ ID NO 112 in the 10/225,068 US patent application
  misc_feature: The sequence is a functional homolog of SEQ ID NO 156 in the 10/666,642 US patent application
  misc_feature: The sequence is a functional homolog of SEQ ID NO 192 in the 10/374,780 US patent application
  misc_feature: The sequence is a functional homolog of SEQ ID NO 1263 in the 10/374,780 US patent application
  misc_feature: The sequence is a functional homolog of SEQ ID NO 1342 in the 11/479,226 US patent application
  misc_feature: The sequence is a functional homolog of SEQ ID NO 624 in the 10/412,699 US patent application
  misc_feature: The sequence is a functional homolog of SEQ ID NO 1733 in the 11/479,226 US patent application
  misc_feature: The sequence is a functional homolog of SEQ ID NO 230 in the 10/225,068 US patent application
  misc_feature: The sequence is a functional homolog of SEQ ID NO 268 in the 10/374,780 US patent application
  misc_feature: The sequence is a functional homolog of SEQ ID NO 2132 in the 10/374,780 US patent application
  misc_feature: The sequence is a functional homolog of SEQ ID NO 668 in the 10/225,066 US patent application
  misc_feature: Useful for making plants with altered alkaloid content
MPALMSEYLTPYSQLELNQSIGSAAYQYPDPYYAGMIPPYGTQAVAHFQLPGLSHSRMPLPLEVSEEPVYVNAKQYHGILRRRQSRAKAELEKKVVKTRKPYLHESRHQHAMRRARGNGGRFLNTKKSDNGTPNGNAEPKKGDQNYEHLHVPPDLLQLRQNEA

SEQ ID NO: 23057 - DNA, 699 bp, Panicum virgatum
  misc_feature: Ceres CLONE 1825220
  misc_feature: Encodes the peptide sequence at SEQ ID NO. 23058
ctcacccaccatcaccgagctctgcatctctctcggcacgcacgcgcgcgagctctccttactcgtcgaggtgcattgatggcgaccgaagtggctgacgctccggtgccgctgccggaggcgggccccgacgccgccgcggaggcccctgccgcggatgccgccgcggccaccggcgacgcgaagccggccaaggccaagaaggccgccgcgccgcggaagcgcgcgaacccgacccacccgccgtacgccgagatgatctcggaggcgatcacgtcgctcaaggagaggacggggtcgagccagtacgcgatcgccaagttcctggaggacaagcacaaggacaagctgccgcccaacttccgcaagatgctgctcgtgcagctgaagaagctcgccgccgccggcaagctcaccaaggtcaagaactcctacaaggtgccgtcggggcgcgccccggccgccgacaagcccaaggccaagaagcctgctgccgccaagccgaagccgaagcccgctgcgaagaagcccaaggccgccgccaagcccaaggccaaggcgcccgccaagaccaagcccgctgcgaagccgaaggccgccgccaagcccgcggccaagccgaaggctgtagctacgaagacgaagccagccgccaagccggctgcgaagccgaagccagccgccaagccggctgccaag

SEQ ID NO: 23058 - protein, 206 aa, Panicum virgatum
  misc_feature: Ceres CLONE 1825220
  misc_feature (53)..(123): Pfam Name: Linker_histone Pfam Description: linker histone H1 and H5 family
  misc_feature: Useful for making plants with modulated nitrogen use efficiency
  misc_feature: Useful for making plants with modulated oxidative stress sensitivity
MATEVADAPVPLPEAGPDAAAEAPAADAAAATGDAKPAKAKKAAAPRKRANPTHPPYAEMISEAITSLKERTGSSQYAIAKFLEDKHKDKLPPNFRKMLLVQLKKLAAAGKLTKVKNSYKVPSGRAPAADKPKAKKPAAAKPKPKPAAKKPKAAAKPKAKAPAKTKPAAKPKAAAKPAAKPKAVATKTKPAAKPAAKPKPAAKPAA

SEQ ID NO: 23059 - DNA, 663 bp, Panicum virgatum
  misc_feature: Ceres CLONE 1825238
  misc_feature: Encodes the peptide sequence at SEQ ID NO. 23060
attcgccgtgcgcctgctgcctcctcccgctgctccgctagcacctccgccacgaggcccacgcgcgcgatggcgaccatcaccacgcacctccgctccgcgctcctcgccccgggcggcgggcgccgccgcgcgccctcctccgtgcgcgtgcgctgcgacgcctccccgccgtcctcctcctcctccgcggccgcggccgcctcgctcgacccggacttcgacaagaaggccttccgccacaacctcacccgcagcgacaactacaaccgcaagggcttcggccacaagaaggagacgctcgagctcatgagccaggagtacaccagtgatgtgatcaagacgctcaaggagaatgggaaccagcacacctggggccccgtcaccgtgaagctggcggaggcatacggcttctgctggggcgtcgagcgcgccgtgcagatcgcctacgaggcgcgcaagcagttccccgaggagcgcatctggctcaccaacgaaatcatccacaaccccaccgtcaacaagaggttggatgagatgggcgtagaaatcattcctgttgacgcaggcatcaaggatttcaatgttgttgaaaaaggcgatgttgttgtgctgcctgcattcggagctgctgtggaggagatgtactcactgaatgataag

SEQ ID NO: 23060 - protein, 197 aa, Panicum virgatum
  misc_feature: Ceres CLONE 1825238
  misc_feature: SWISSPROT Homolog: EC 1.17.1.2 4-hydroxy-3-methylbut-2-enyl diphosphate reductase
  misc_feature: Useful for making plants with modulated nitrogen use efficiency
MATITTHLRSALLAPGGGRRRAPSSVRVRCDASPPSSSSSAAAAASLDPDFDKKAFRHNLTRSDNYNRKGFGHKKETLELMSQEYTSDVIKTLKENGNQHTWGPVTVKLAEAYGFCWGVERAVQIAYEARKQFPEERIWLTNEIIHNPTVNKRLDEMGVEIIPVDAGIKDFNVVEKGDVVVLPAFGAAVEEMYSLND

SEQ ID NO: 23061 - DNA, 688 bp, Panicum virgatum
  misc_feature: Ceres CLONE 1825263
  misc_feature: Encodes the peptide sequence at SEQ ID NO. 23062
ttcaagccaagaagcctcaaaccttcttaatctgcctcgaagcagccaattaatggcatcagagggatggccttcaaaaaggatggctgtggaaccccttgctaatcttgaagctcaatccgtacagcacaagcttgagaaagtgagtcaccagagtaatgtatctcacatttctggcaccttggcaccactatcagcaagagacggttctagtgctcaggcacttagtacaaatgttcagagtcacctgctttcttcatcatttgcaatccatgatggcatgacaactgtcaggggtgatggtgttggcagtgggactgatgcaataaccatagcttcattgagatatagtgatgtgaatttgctacctgaaaactccttagcaacttccagttgtttgggtgaatcaggaacttttaattctctcaatgatgtttgtggcgtgaacccatcacaaggtggaacctttgtgaaggtttacaaatcagggtccctcgggagatcgctcgatattaccagattcagcagctactatgagttacgtagcgagctggagcgattatttggtcttgaaggccaattggaggaccctgtaagatcaggctggcagcttgtattcgtcgaccgggaaaatgacattcttctcgtcggcgacgacccgtggcaggagtttgtgaatagcgtgtgg

SEQ ID NO: 23062 - protein, 228 aa, Panicum virgatum
  misc_feature: Ceres CLONE 1825263
  misc_feature: The sequence is a functional homolog of SEQ ID NO 1424 in the 10/666,642 US patent application
  misc_feature: The sequence is a functional homolog of SEQ ID NO 1826 in the 10/412,699 US patent application
  misc_feature: The sequence is a functional homolog of SEQ ID NO 2070 in the 10/374,780 US patent application
SSQEASNLLNLPRSSQLMASEGWPSKRMAVEPLANLEAQSVQHKLEKVSHQSNVSHISGTLAPLSARDGSSAQALSTNVQSHLLSSSFAIHDGMTTVRGDGVGSGTDAITIASLRYSDVNLLPENSLATSSCLGESGTFNSLNDVCGVNPSQGGTFVKVYKSGSLGRSLDITRFSSYYELRSELERLFGLEGQLEDPVRSGWQLVFVDRENDILLVGDDPWQEFVNSV

SEQ ID NO: 23063 - DNA, 1098 bp, Panicum virgatum
  misc_feature: Ceres CLONE 1825267
  misc_feature: Encodes the peptide sequence at SEQ ID NO. 23064
agcttgagcaagtcggacatccgaagaagcatcacccacgcagcctcgcgaagcaaacgacggggagatggcttcggcggcagcgtgggagggaccgacggccgcggagctgaaggcggcgggggcggaggcgatccccggcggcgtgagggtgaaggggtgggtcatccagtcccacaagggccccatcctcaacgccgcctctctccaacgctttgaagatgaacttcaaacaacacatttacctgagatggtttttggagagagtttcttgtcccttgaacatactcaaactagtatcaaatttcatttcaacgcacttgatgcactcaaggcatggaaggaagaggcattgccacctgttgaggtccctgctgcagcaaaatggaagttcagaagtaagccttctgatcaagtgatacttgattatgactacacatttacgacgccatactgtgggagtgatgccgtggttctgaactcaggcactacacaaacaagtttagatggatgcggcactttgtgctgggaggatactaatgatcggattgaccttgttgccctttcagcaaaagaggcaattcttttctacgatgaggttatcttgtatgaagatgagttagctgacaatggaatctcatttcttgcagtgcgagtgagggtaatgccgaccggttggtttctgcttttgcgtttttggcttagggttgatggtgtactgatgagattgagggacactcgattacattgttcttttggaaattgtggtgaagccaaaccagtggtactccgtgaatgctgctggagggaagcaacatttgctagtctgtctgcgaaaggatatccttccgactccgcagcatatgcagacccgaatcttattgcccagaaacttcctattgtgatgcagaagacccagaacctgaaaatacccaactgacccaaatgctccttgtgtacatcatgacacttatattgtggcctcttttgcttgccacatgttgtaggtgcacgcttctgctacattaatattgattgaatatttgaacttcttgttataacccatcatacccatgtcgagttcgcttgttgactgct

SEQ ID NO: 23064 - protein, 290 aa, Panicum virgatum
  misc_feature: Ceres CLONE 1825267
  misc_feature (62)..(256): Pfam Name: TIP41 Pfam Description: TIP41-like family
MASAAAWEGPTAAELKAAGAEAIPGGVRVKGWVIQSHKGPILNAASLQRFEDELQTTHLPEMVFGESFLSLEHTQTSIKFHFNALDALKAWKEEALPPVEVPAAAKWKFRSKPSDQVILDYDYTFTTPYCGSDAVVLNSGTTQTSLDGCGTLCWEDTNDRIDLVALSAKEAILFYDEVILYEDELADNGISFLAVRVRVMPTGWFLLLRFWLRVDGVLMRLRDTRLHCSFGNCGEAKPVVLRECCWREATFASLSAKGYPSDSAAYADPNLIAQKLPIVMQKTQNLKIPN

SEQ ID NO: 23065 - DNA, 425 bp, Panicum virgatum
  misc_feature: Ceres CLONE 1825290
  misc_feature: Encodes the peptide sequence at SEQ ID NO. 23066
ccggggttttatacagggctgagctccgtttgacctccaagagaggccagacaaccctagggtcgactgccgagaccacgatgaagggggataagttgtaccacttcaaccacgaccaccttagcggccgatcggctcgaccgcgcattgacttctcgtccatatttggggcggcgaatccaattgttgaggatggccgggtgcgatgcgatgctgccgggaacgattattcgtacaagtttgaccacggcacgctcgatgatgttgctgtgctggtaagagatctaccagatacctagcctgatacggctgcgagggaaggcatgcacattgcagatgacactatatataccttccatgtctcaccaaagtcacccgagaagagcgctgacaatacgacagtggcactgccgtcttgacttcat

SEQ ID NO: 23066 - protein, 98 aa, Panicum virgatum
  misc_feature: Ceres CLONE 1825290
  misc_feature: SWISSPROT Homolog: EC 1.1.1.23 Histidinol dehydrogenase
GVLYRAELRLTSKRGQTTLGSTAETTMKGDKLYHFNHDHLSGRSARPRIDFSSIFGAANPIVEDGRVRCDAAGNDYSYKFDHGTLDDVAVLVRDLPDT

SEQ ID NO: 23067 - DNA, 1284 bp, Panicum virgatum
  misc_feature: Ceres CLONE 1825314
  misc_feature: Encodes the peptide sequence at SEQ ID NO. 23068
gtcctctctctcctctcttctttttttttttgggaacctctctctcctctcttcgattcccaattcgaaggctatacccaacctgcgccggtaggtggcggcgccgaggctagagggttcccctgaggcggcagcgatggcggccacggcgaagtacaaccgtagcaacccggcggtgaagcggatcctgcaggaggtcaaggagatgcagtccaacccctcccccgacttcatggccctccccctcgaggaggacatcttcgagtggcaatttgctatcctgggtcctcgcgacagtgagtttgagggtggaatctaccacggcaggatccagctgccctctgactatccgttcaagccaccttccttcatgctgctcacaccaagtggacgctttgagattaagaagaagatttgtttgagcatatccaattaccaccctgagcactggcaaccatcatggagtgtgcgcactgcactagtagccctgattgcattcatgccaacaaaccctggtggggcgctgggctctctggactacaaaaaggaagataggcaagcacttgctataaaatcacgtgaagcaccaccgaaatttggctccccagaacgccaaaaactaattgacgagatccatgagcaaatgctcagtaaggctcctcctgttccccaagtgctaccgaatgggacaaatgaggagtctaaccatttacccgcacctgactctttcgttgagaatgcagacagggcagatgaaggtggcaacacagtggggtctgtgtcaggctccttgaatgaccttactgggcctgaatctgaaatgggagttgcagaaaacactgttgaacccccagttgctgaggttaccaaccctcatctgcctgaagcgagccacagagaaaacagtccaagagttcctttggcgccgcagaatcctgttgtagcaatccagaagccaaagcatgacaggctgttgaccttagccgcatttgggcttacccttgctattatggccctcgtgattaagaagttcttgaaaatcaatggcctggcaggtttcatcgagggcaagttctgagtaggtttgtgcatacgttggataagagatgccccattccttgtgacttgtgagtggctatactatccgctgctataatttatataaccccttcaggtttgtaaatggctgttttctagttatagatgaaatcaaagtgggatgggactatcaataccccattgtatgtagtacactgattgaaaaattgctgagggttttgcttc

SEQ ID NO: 23068 - protein, 313 aa, Panicum virgatum
  misc_feature: Ceres CLONE 1825314
  misc_feature (16)..(149): Pfam Name: UQ_con Pfam Description: Ubiquitin-conjugating enzyme
  misc_feature: SWISSPROT Homolog: EC 6.3.2.19 Ubiquitin--protein ligase
MAATAKYNRSNPAVKRILQEVKEMQSNPSPDFMALPLEEDIFEWQFAILGPRDSEFEGGIYHGRIQLPSDYPFKPPSFMLLTPSGRFEIKKKICLSISNYHPEHWQPSWSVRTALVALIAFMPTNPGGALGSLDYKKEDRQALAIKSREAPPKFGSPERQKLIDEIHEQMLSKAPPVPQVLPNGTNEESNHLPAPDSFVENADRADEGGNTVGSVSGSLNDLTGPESEMGVAENTVEPPVAEVTNPHLPEASHRENSPRVPLAPQNPVVAIQKPKHDRLLTLAAFGLTLAIMALVIKKFLKINGLAGFIEGKF

SEQ ID NO: 23069 - DNA, 1062 bp, Panicum virgatum
  misc_feature: Ceres CLONE 1825317
  misc_feature: Encodes the peptide sequence at SEQ ID NO. 23070
atctcgctccgcgcgccctcggctttcggcggctccagcccgctggccacagagacgacctgtcctgcagtcctggtggctggtgctggacttagtgggaagccgacgagcgacccgcgagagtgcgtgaggcagcccggccggcggacgcacccaggcagcgagcgcagcagcctcacgcttgggctcagcatggcgctggacaccccggccgccgtggtgctggagctcatgaccatggggcagcagtccgcagagcacctcggggacctgctccgggccgcgtccccggcgtcgccgcaccaggagctcgccgccgagatcctccgctgctgcggccgcgtcatcgacgcgctcagggccaccagcggcgcccggaagaggaaggcggccgagtaccaagcgccggcgccaggagcctggtctcctcctccggggccaccgcccaaaagaaggggtcgcggcgcggaggccgtcaaggaggtggtgacgagcgtcacgacggtggacggcttcatctggcgcaagtacgggcagaaggacatcaacgggcgcaagcacccgaggctctactaccgctgcgcgcaccgccagcagggctgcaacgccacccggcgggtgcagcggacgcgggaccaccccgcggcctacgagatcgcctactacggggagcacacgtgccggggcgccaccacgggccacccgcagggaggggcgccgccgcccgccgtcgtcgacttcggctccagctccttgggctccgccgacgcggcgtccatgtcgcaggggcagcaggggggctggtcgccgccgtcggtctcggcgtcgccgtcgtcggaggcggggctcgagctcgagggcgcccacgcgcacgagtgggagtggcacgacgcggcgacgatcgacgagctgatcggagcggctccttgctacggttcggatccggtgacggagttccttgacgggtgcctcggctgggaggccgtcctcaacgatcccctcgacttcgctggtctccatcgcattgctaggtttcagtagctctagcagctcagagttttc

SEQ ID NO: 23070 - protein, 282 aa, Panicum virgatum
  misc_feature: Ceres CLONE 1825317
  misc_feature (104)..(165): Pfam Name: WRKY Pfam Description: WRKY DNA -binding domain
MALDTPAAVVLELMTMGQQSAEHLGDLLRAASPASPHQELAAEILRCCGRVIDALRATSGARKRKAAEYQAPAPGAWSPPPGPPPKRRGRGAEAVKEVVTSVTTVDGFIWRKYGQKDINGRKHPRLYYRCAHRQQGCNATRRVQRTRDHPAAYEIAYYGEHTCRGATTGHPQGGAPPPAVVDFGSSSLGSADAASMSQGQQGGWSPPSVSASPSSEAGLELEGAHAHEWEWHDAATIDELIGAAPCYGSDPVTEFLDGCLGWEAVLNDPLDFAGLHRIARFQ

SEQ ID NO: 23071 - DNA, 1311 bp, Panicum virgatum
  misc_feature: Ceres CLONE 1825340
  misc_feature: Encodes the peptide sequence at SEQ ID NO. 23072
gctgcctccgcgtcgtgccgtcgcttccccctgctgcccaagcgcccggaggctccagcggagcggttgcaagccccgcggcgccgcagaggcctccgccggcgatggccggccaggaggcgccgctgggcacgctcaacctggccgagtacgcccccgccggcgcgcgcaccgtcgactgctacaggcgcatccgcaagatcggcgagggcacctacggcgaggtgtttgaggctgtggatattattactggggaaagagcagcacttaagaaaataaaactggatgatggcaaagaagggtttccacgccaaatcttgcgtgagattaaactattaaaaaagctggatcatgagaacatcatcagattgaaagagattgtagtatctcctggttctgcagatggaacaggaggatctgataataatcagatgtataggggagatatctacatggtttttgaatacatggaccatgatttgaagaaagtattgcaccatagtaccccgtcccaagtcaaggtttatatggaccagctgctaaaaggattgcactactgccatgtcaataatgtacttcatcgtgatatcaaaggggctaatcttctaataagtggtggtaagcttttgaagctcgctgattttggccttgcaaggccatttactagagaaggaactttgacaaatcatgtcatcactttatggtaccgacccccggagttgcttcttggtgctacaaattatgctgaagctgtggatatttggtctgttggttgcatttttgctgaattttttcttaaaaaaccattgtttcctggcagaaccgagcaagaccagctgtccaaaatatttgaactctgtggatctccaaatgaggaaaactggccaggtgtatccaagctaccattgtacaagactatggctatccatcctgtgacgcctaccaagcgacgcctgagagatatgttacagaacttcgaccatcatgctgtcgatttaattgaacgcatgttgatccttaatcctacacagagaatttatgcacaagatgctcttgctgcggcttacttcaccaactaaacttgtgtagatcgagttttttttgaccttatcagaccttgtctggtgatctcattggtgtaagtactacatgaagactgaagtcttgtttctcctgttgaccttgggttagggctagcgagcagttttaactttgtctgttttagctctaaacatatatatagatgatgtacattgttactcgtgacaaactgtaattgatcatcaattcattacaagtttattgaatgct

SEQ ID NO: 23072 - protein, 324 aa, Panicum virgatum
  misc_feature: Ceres CLONE 1825340
  misc_feature (27)..(322): Pfam Name: Pkinase Pfam Description: Protein kinase domain
  misc_feature (27)..(288): Pfam Name: Pkinase_Tyr Pfam Description: Protein tyrosine kinase
  misc_feature: SWISSPROT Homolog: EC 2.7.11.22 Cyclin-dependent kinase
MAGQEAPLGTLNLAEYAPAGARTVDCYRRIRKIGEGTYGEVFEAVDIITGERAALKKIKLDDGKEGFPRQILREIKLLKKLDHENIIRLKEIVVSPGSADGTGGSDNNQMYRGDIYMVFEYMDHDLKKVLHHSTPSQVKVYMDQLLKGLHYCHVNNVLHRDIKGANLLISGGKLLKLADFGLARPFTREGTLTNHVITLWYRPPELLLGATNYAEAVDIWSVGCIFAEFFLKKPLFPGRTEQDQLSKIFELCGSPNEENWPGVSKLPLYKTMAIHPVTPTKRRLRDMLQNFDHHAVDLIERMLILNPTQRIYAQDALAAAYFTN

SEQ ID NO: 23073 - DNA, 1880 bp, Panicum virgatum
  misc_feature: Ceres CLONE 1825347
  misc_feature: Encodes the peptide sequence at SEQ ID NO. 23074
gggcaaggaaggagcagcgagcgccggagagcttgagctgagacttgcgcctgcgcgctacccgttcagcgagtgaagatccaaatggcgcggagatcagctcacgccgctctctgctcacttgctctgctcctcctgcttccagccgcgtggtccgcgacgttcacgatgaccaacaactgcggctacacggtgtggcctggcctgctgtcgggcgccggcacggccccgctgtccacgacggggttctcgctggcgcacggcgcgtcggcgacggtggacgcccccgcgagctggtcgggccgcatgtgggcgcgcacgctctgcgccgccgacgccgccacgggcaagttcacctgcgccacgggcgactgcggctccggcagcgtccagtgcaacggcggcggcgccgcgccgcccgccacgctggccgagttcacgctcgacggctccggcggcctcgacttcttcgacgtcagcctcgtcgacgggtacaacgtcccgatgctcatcgtcccgcagggcgccgccgccggcggcagcaacgggtccgccgactccggcaagtgcatggccacgggctgcctcgtcgacctcaacggcgcgtgccctgccgatctgagggtcatggccaccgcctcggcgtccacgggcgccggcgccagcggcggggccgtggcgtgccgcagcgcgtgcgaggcgttcgggacgccgcagtactgctgcagcggcgcctacggcaaccccaacacgtgcaagccgtcgacctactcgcagttcttcaagacggcgtgcccgcgcgcctacagctacgcctacgacgactccacctccaccttcacttgcgccgccggcaccagctacgccatcaccttctgcccgagcaccaccagcgggaagtactccggcgagaacccgcaggccgcgggcctgcagcccacgaacggcagcatggtctacctcggcggcgagcagctcgacaccggcgacgcccgcatcggcgccacccattcctcgccgctcatcttcgcggccgccgccctcgccgccgtcgcgctgctctgagccggccgggcagccgccactccgtgtgaaacggcggggcaagagtcgtcgccgactcgccgttgtacagcagcgagcgcacccgccacctgctggcgcgccttgtccttgtccggcgcgccgcttccggcctgacgggggcagagataagattcgagaggacaaaatggggggctcgccccgccctgcccataaggatggattcggatgtctgaacatccgaattatccgtattcgtatccgcttaaaacgtaaatatgaatatccgtatccgtattcgaatttaatatggatgtcatatggatgcatccgaattcgattttaagaacttttctctatccgattccgtattcgtattcgaagaatatccgatcacatccgtatccatccgtatccgcaaagaaaaaatgactagtgagacaatcttaaacttatctttatacctattacttaatgatgtacactatttaaattatttagaaagctagataactaataatatatttattaaaattaataatgatataaaaattaactttaactatttaatatatttatttcatgattaaaattatttaatacgagtcaaattaattaattatttaatgataaaatcttttttatatatcgtaattattaagtatttaaacatttatttattttacatttataattagtattatatatttaatataaaagctatgcatagataattatatttttttttattagctatctcctaatcctttactccctacttgtataatgattttgatctgctataaaattattgaaaaaataaatatacttatgat

SEQ ID NO: 23074 - protein, 298 aa, Panicum virgatum
  misc_feature: Ceres CLONE 1825347
  misc_feature (3)..(238): Pfam Name: Thaumatin Pfam Description: Thaumatin family
MTNNCGYTVWPGLLSGAGTAPLSTTGFSLAHGASATVDAPASWSGRMWARTLCAADAATGKFTCATGDCGSGSVQCNGGGAAPPATLAEFTLDGSGGLDFFDVSLVDGYNVPMLIVPQGAAAGGSNGSADSGKCMATGCLVDLNGACPADLRVMATASASTGAGASGGAVACRSACEAFGTPQYCCSGAYGNPNTCKPSTYSQFFKTACPRAYSYAYDDSTSTFTCAAGTSYAITFCPSTTSGKYSGENPQAAGLQPTNGSMVYLGGEQLDTGDARIGATHSSPLIFAAAALAAVALL

SEQ ID NO: 23075 - DNA, 326 bp, Panicum virgatum
  misc_feature: Ceres CLONE 1825457
  misc_feature: Encodes the peptide sequence at SEQ ID NO. 23076
accggtagcaaacttctctactctaccctcgccggctagtccatgttactgtgcgttcccgcacctaccccacccaacccactcccacacagccacaatggatggggcgtcgcacccccttcgtcggccgccttcctggcgctggcggcggcggttcctgtcgcggtggggcacgcgccgggccccgcaccgggcccgatcgggcccccaaacatgacagctatcctggagaagggagagtgtgacactaccttcgtcctgttgatgaaagagatccatgacgacacacaattcagatcccagctctatgcctccctccgtaacaa

SEQ ID NO: 23076 - protein, 94 aa, Panicum virgatum
  misc_feature: Ceres CLONE 1825457
  misc_feature: Useful for making plants with altered carbohydrate content
MLLCVPAPTPPNPLPHSHNGWGVAPPSSAAFLALAAAVPVAVGHAPGPAPGPIGPPNMTAILEKGECDTTFVLLMKEIHDDTQFRSQLYASLRN

SEQ ID NO: 23077 - DNA, 1411 bp, Panicum virgatum
  misc_feature: Ceres CLONE 1825484
  misc_feature: Encodes the peptide sequence at SEQ ID NO. 23078
caccttctcaatccccagctcgaggccaatcgaaaagaccaccaccaccagcacaaccatcgcaggagcagcagccgagcgagcaactaaccaaccaaccacggggaaagggaatagagaagaagccatggcggcgatcgccgtgacgagcggccactggaggaggctccgcacactgggccgcggcgcgtcaggcgccgtggtgtccctcgcggcggacgccgcgtcgggggagctgttcgcggtcaagtcggcggccgcgggcgccgcggcggaggcgctgaggcgggagcgcggcgtgctggcggggctgcgctcgccccacgtcgtgcgctgcgccggcgccgccgagggcgccgacggctcctaccagctcctcctcgagtacgcccccggcgggtcgctcgccgacgaggcggcccggaatggaggcgccctcggggagcgcgccgtgcgggcgtacgcggccgacgtcctgcgcgggctggcctacctccacgggcgctccgtcgtgcacggggacgtcaaggcgcggaacgtggtggtcggcgccgacgggcgcgccaagctcgccgacttcgggtgcgcgcgggcgcccggcgccgcgcggcgcgcgatcggcggcacgccggcgttcatggcgcccgaggtggcgcgcggggaggaccagggccccgccgccgacgtctgggcgctcgggtgcacggtcgtcgagatggccaccggccgcgcgccgtggggcgacgcggacgacgtcctcgccgccctccaccggatcgggtacacggacgccgtgccggaggtgccgcgctggctgtccgcggaggccaaggacttcctggcccgctgcttcgcgagggacgccgccgaccggccggccgcggcgcagctcctggagcacccgttcgtggcattcgccggctgcgacgacaaggcccggtgggtgtcccccaagagcacgctggacgccgcgttctgggagtcggagtccgacgacgaggcggacgagatgccggagggcggcgcggcggagaggatcaagtccctggcgtgccccgcctcgggcttccccgactgggactgcgaggaaggctggatcgacgtgctccgcgagcagcagcagcagcagagcgaggtccaggtggcgcgcggcgcgccaagcaaggtgtcgggcgccgcggcggtgccagctggaggcatggctgtcggcggcggcggattcagcgatgatgaactggaaacagaggaggacgtgccgttcggtggcgatgctcccgcagctgatgcttcagttgggcgccagagcaaacgctgcccgggttcagactgtcatgtaggagcactgccacttcagctagtgctttgctgtaacggagttactgatgatggaataaaattatggtttcccacg

SEQ ID NO: 23078 - protein, 427 aa, Panicum virgatum
  misc_feature: Ceres CLONE 1825484
  misc_feature (11)..(261): Pfam Name: Pkinase Pfam Description: Protein kinase domain
  misc_feature: SWISSPROT Homolog: EC 2.7.11.25 Mitogen-activated protein kinase kinase kinase
MAAIAVTSGHWRRLRTLGRGASGAVVSLAADAASGELFAVKSAAAGAAAEALRRERGVLAGLRSPHVVRCAGAAEGADGSYQLLLEYAPGGSLADEAARNGGALGERAVRAYAADVLRGLAYLHGRSVVHGDVKARNVVVGADGRAKLADFGCARAPGAARRAIGGTPAFMAPEVARGEDQGPAADVWALGCTVVEMATGRAPWGDADDVLAALHRIGYTDAVPEVPRWLSAEAKDFLARCFARDAADRPAAAQLLEHPFVAFAGCDDKARWVSPKSTLDAAFWESESDDEADEMPEGGAAERIKSLACPASGFPDWDCEEGWIDVLREQQQQQSEVQVARGAPSKVSGAAAVPAGGMAVGGGGFSDDELETEEDVPFGGDAPAADASVGRQSKRCPGSDCHVGALPLQLVLCCNGVTDDGIKLWFP

SEQ ID NO: 23079 - DNA, 1216 bp, Panicum virgatum
  misc_feature: Ceres CLONE 1825497
  misc_feature: Encodes the peptide sequence at SEQ ID NO. 23080
ccacctccgtcctgttcgcctctccaccatctgctccccaacaacccaaaaccctagctaaacctcggcctccgcagccgccgacctcctccggcgagatgagcttcaagggagcgaagatgccgagcgcgccggtgggcgggagtgcgctcttgaaggtggggctgcttggcggcgcggggctctatgccgtcctcaacagcttctacaacgtggagggcggccaccgcgccatcgtcttcaaccgcatcgagggcatcaaggataaggtttaccccgaaggaactcacctgatgatcccgtggattgagaggccgatcatctacgacgtccgcgcccgacccaacctcgtcgagagcacctccggaagccgggatctccagatggtgaaaattggccttcgtgttctcacacggcccatgccaaaccagctacctaaaatttacaggaaccttggggaaaacttcaatgagagggttttgccttcaatcattcatgaaacactcaaagctgtggttgcgcaatacaatgccagtcagctgatcacacaaagagaggctgtaagcagggagatcaggaagattctgactgagagggccaacaacttcaatattgcactggatgatgtgtccatcacaagcctcagctttgggaaagagtttactcatgccattgaagcgaaacaggttgctgcacaagaagctgagcgtgccaagttcattgttgagaaggctgagcaagacaagcgaagtgcgatcatcagggctcagggtgaggctaagagtgcagagctgattggtcaagccattgccaacaaccctgctttcctcgctctgagacagattgaagctgcaagggagatctctcacaccatggcgagctcaaacaacagggtgttccttgattccaatgaccttttgcttggactccagcagctgaatgttagcggcaaacaaaagaagtgaagtgatcatcaagtcccaagtcactgtggaagagtttaagaggaagtatcttttatatagttttgctcgatggtttatctgatccagaaccataatgcacttgcagatgaacaaagttgccccttgttactgcaacttttggctgtatctacatttttctgtgcgaatcactgattcactgggggagatttagtgcggaatgattttgtttctggaatatgatccgttagtacatattgatatattctgtt

SEQ ID NO: 23080 - protein, 288 aa, Panicum virgatum
  misc_feature: Ceres CLONE 1825497
  misc_feature (37)..(216): Pfam Name: Band_7 Pfam Description: SPFH domain / Band 7 family
  misc_feature: Useful for making plants with modulated biomass
MSFKGAKMPSAPVGGSALLKVGLLGGAGLYAVLNSFYNVEGGHRAIVFNRIEGIKDKVYPEGTHLMIPWIERPIIYDVRARPNLVESTSGSRDLQMVKIGLRVLTRPMPNQLPKIYRNLGENFNERVLPSIIHETLKAVVAQYNASQLITQREAVSREIRKILTERANNFNIALDDVSITSLSFGKEFTHAIEAKQVAAQEAERAKFIVEKAEQDKRSAIIRAQGEAKSAELIGQAIANNPAFLALRQIEAAREISHTMASSNNRVFLDSNDLLLGLQQLNVSGKQKK

SEQ ID NO: 23081 - DNA, 1011 bp, Panicum virgatum
  misc_feature: Ceres CLONE 1825510
  misc_feature: Encodes the peptide sequence at SEQ ID NO. 23082
acctcatcacatcgatcaagcaggtccactactgcagcagcaagggaacctagcggccaggcaggaactgatccagtcaagctgcgatccggcatggcgagctcagcggcgacgacgacgtcgagggtcctgctggccctcgggctggcgctcctctgcgccgccggcccggccgccgcgcagaacgtggccagcgtcgtcaccgacgccttcttcaacggcatcaagaaccaggccccgggctcgtgcgagggcaagagcttctacacgcggagcgcgttcctgagcgccgtcaactcgtacccgggcttcgcgcacggcggctccgagacccagggcaagcgcgagatcgccgccttcttcgcgcacgtcacgcacgagaccggacacctctgctacatcagcgagatcaacaagagcaacagctactgcgaccccaacaacaggcagtggccgtgcgcggcggggaagaagtactacgggcgcggcccgctgcagatctcgtggaactacaactacgggccggcggggaggagcatcggcttcgacgggctcgggaacccggacagggttgctcaggaccccgtgatcgcgttcaagacggcgctctggttctggatgaacaacgtgcacggggtgatgccgcaggggttcggcgccaccaccagggccatcaatggcgccctcgagtgcaacgggaggaaccccgaccagatgaacgcgcgcgtgcgatactacaggcagtactgccagcagctcggcgtcgaccccgggagcaacctaacctgctagaggtgttgcttgggttcatggatgcctgcttggctcctgaagaataaagggatgatgctcggcgtcgcatacttgtaatggcgccgggagtgaaacccagagcttatgtactagtactttagtagtagcaacaataaaaatgcagggctgggactgtataattcgacctaagctaataataataataaaaagcactgtgcggcgagctgagcacttggc

SEQ ID NO: 23082 - protein, 232 aa, Panicum virgatum
  misc_feature: Ceres CLONE 1825510
  misc_feature (35)..(232): Pfam Name: Glyco_hydro_19 Pfam Description: Chitinase class I
  misc_feature: SWISSPROT Homolog: EC 3.2.1.14 Chitinase
  misc_feature: The sequence is a functional homolog of SEQ ID NO 12 in US patent 7087810
MASSAATTTSRVLLALGLALLCAAGPAAAQNVASVVTDAFFNGIKNQAPGSCEGKSFYTRSAFLSAVNSYPGFAHGGSETQGKREIAAFFAHVTHETGHLCYISEINKSNSYCDPNNRQWPCAAGKKYYGRGPLQISWNYNYGPAGRSIGFDGLGNPDRVAQDPVIAFKTALWFWMNNVHGVMPQGFGATTRAINGALECNGRNPDQMNARVRYYRQYCQQLGVDPGSNLTC

SEQ ID NO: 23083 - DNA, 669 bp, Panicum virgatum
  misc_feature: Ceres CLONE 1825511
  misc_feature: Encodes the peptide sequence at SEQ ID NO. 23084
atctagtcatgtacagccgagcaaataagagagcagttgctgaatctggtggtgtccaggtcctgcttgaccttatcagttcaagcaatcctgacacttctgttcaggcagcaatgtttgtcaaacttctgttcaacaatcacactatacaagagtatgcaaccagtgaaacagtgagagttataactgcttctattgagaaggatatatgggcatctggaagtgctaatgaggagtatcttaaagcacttaacgctttacttagcaattttcctcgtctaagggtcactgaacctgctacattatgcattcctcatcttgtaacgtcccttaaaactggttctgaggcaactcaagaagcagcactggattcactatatcttctcaggcaagcttggtcagcttgcccagctgaagtattcaaagctcagtctgtggctgcctctgaggctattcctttacttcagtacttgatacagtctggcccaccccggtttcaagaaaaagcagaactgcttcttcagtgcttgcccgggacacttacagttaccataaagcgcggcaacaatctaagacaatcagttggaaatcctagtgcattctgcaagcttactcttggaaataatacgccgaggctgaacaagattgtatccactggcgcaactcctg

SEQ ID NO: 23084 - protein, 222 aa, Panicum virgatum
  misc_feature: Ceres CLONE 1825511
  misc_feature: Useful for making plants with altered cell wall content and/or composition
LVMYSRANKRAVAESGGVQVLLDLISSSNPDTSVQAAMFVKLLFNNHTIQEYATSETVRVITASIEKDIWASGSANEEYLKALNALLSNFPRLRVTEPATLCIPHLVTSLKTGSEATQEAALDSLYLLRQAWSACPAEVFKAQSVAASEAIPLLQYLIQSGPPRFQEKAELLLQCLPGTLTVTIKRGNNLRQSVGNPSAFCKLTLGNNTPRLNKIVSTGATP

SEQ ID NO: 23085 - DNA, 513 bp, Panicum virgatum
  misc_feature: Ceres CLONE 1825518
  misc_feature: Encodes the peptide sequence at SEQ ID NO. 23086
gctgctatcaaaagaaggaggccgtccccgcggcggcagcgaagccggccatacattccccagcctcgacagtcaaacgggaacaaaagcccacccgacctcaacctcctcactgaaagggcatggacacagtagagcgcttgaagagcgggttcgagcatgtcaagacccacgtctatgacaagaagccggagctgttccagccgctcaaggccggccaatcccccatgtacatggttttcgcctgcaccgactcccgctgctgcccgtcagtgaccctgggcctgcaccccggcgaggccttcaccatgagcaaaatcaccgccatggtcccgccctacaacaagaacaagtacgccggcatcggggccaccatcgagtacgccgtctgcacgctcaaggtggaggtcctcaccgtcattggccacagccgctgcggtggcatcaatgcgctcctctccctccaggacggcgcagactacaccttccacttcgtcgaggactgggttagga

SEQ ID NO: 23086 - protein, 130 aa, Panicum virgatum
  misc_feature: Ceres CLONE 1825518
  misc_feature (30)..(130): Pfam Name: Pro_CA Pfam Description: Carbonic anhydrase
  misc_feature: SWISSPROT Homolog: EC 4.2.1.1 Carbonate dehydratase
MDTVERLKSGFEHVKTHVYDKKPELFQPLKAGQSPMYMVFACTDSRCCPSVTLGLHPGEAFTMSKITAMVPPYNKNKYAGIGATIEYAVCTLKVEVLTVIGHSRCGGINALLSLQDGADYTFHFVEDWVR

SEQ ID NO: 23087 - DNA, 653 bp, Panicum virgatum
  misc_feature: Ceres CLONE 1825525
  misc_feature: Encodes the peptide sequence at SEQ ID NO. 23088
atcaaacgcccgagctccaaacccgatccggcgaccggcgtgcgtgggcggacagcggacagagcgagagcgagagagagagagagagtcggcggcggtgaccggcggccggcggggcgacgagatggcgaaggggttcgcgtcgtacctggcgatgaagacgggcccggaggccggggactcgtcggcggcggtgcaggcgctcatcgacgccgacctgcgggagatcggcgtcgccgcgcggaagctcgccaaccacgccttcgtcctcggcggcgggctcggcttcggcacctccttcctcaagtggtttgccttcgtcgccgcagtgtacctcttgatattggaccgcacaaactggaagaccaacatgatgacggctctcttggttccctatgttttcttcacactacctcatgtgcttttttctctgataagaggagaggtaggaaaatggattgcaattgttgcagttattctgcggctcttcttcccacgccacttcccagattggttagagctgcccggcgccatcatcctgctcacagttgtcgcccccagcctctttgcggacaccttcaggggtgacctggtcggcatcttcatatgccttgcgatcggatgctacctgctttcagagcacatcaaggcgt

SEQ ID NO: 23088 - protein, 176 aa, Panicum virgatum
  misc_feature: Ceres CLONE 1825525
  misc_feature (9)..(176): Pfam Name: WCOR413 Pfam Description: Cold acclimation protein WCOR413
MAKGFASYLAMKTGPEAGDSSAAVQALIDADLREIGVAARKLANHAFVLGGGLGFGTSFLKWFAFVAAVYLLILDRTNWKTNMMTALLVPYVFFTLPHVLFSLIRGEVGKWIAIVAVILRLFFPRHFPDWLELPGAIILLTVVAPSLFADTFRGDLVGIFICLAIGCYLLSEHIKA

SEQ ID NO: 23089 - DNA, 701 bp, Panicum virgatum
  misc_feature: Ceres CLONE 1825532
  misc_feature: Encodes the peptide sequence at SEQ ID NO. 23090
agaccaagaactcattcgaaaaactgagcactagcagagcggagcagaggagcaagaggggcagccatggagatgggagacagcttcgagtactactgggagatgcagcgcttattcgaatccgacgagctcagcgtctacctgaatggcgcgcaggacgacgcgctgtcctgctacgactccagctcgccggacgggtccatgtccaactcgtcctgggcgccggcgccggcggcgaccgcggcggacgacgccaagggacccggcgcggacgcggccgcggccgagggcggcgcggcggaggcggcggccaggaacatcatcatggagcgcaaccgccggcgcaagctgaacgagaagctctacgcgctgcgcagcgtcgtgcccaacatcacaaagatggacaaggcgtcgatcatcaaggacgccatcgagtacatccagcagctgcaggcggaggagcggcgggcgctgcgggagctcgaggccgccggcggcgcgcagcgtatggacgagtacgggtacgacgagggcgtcctcctgcaggcggagcgggcgaagagactgaggcgcgcgcggcccgtcgccccggcggggcccgtggaggtcctggagctgcgcgtggcggaggtgggcgagcgcgtgctggtggtgagcgtgacgtgcggcagggccgcgacgccatggcccgcgtgtgccgc

SEQ ID NO: 23090 - protein, 211 aa, Panicum virgatum
  misc_feature: Ceres CLONE 1825532
  misc_feature (82)..(129): Pfam Name: HLH Pfam Description: Helix-loop-helix DNA-binding domain
MEMGDSFEYYWEMQRLFESDELSVYLNGAQDDALSCYDSSSPDGSMSNSSWAPAPAATAADDAKGPGADAAAAEGGAAEAAARNIIMERNRRRKLNEKLYALRSVVPNITKMDKASIIKDAIEYIQQLQAEERRALRELEAAGGAQRMDEYGYDEGVLLQAERAKRLRRARPVAPAGPVEVLELRVAEVGERVLVVSVTCGRAATPWPACA

SEQ ID NO: 23091 - DNA, 1544 bp, Panicum virgatum
  misc_feature: Ceres CLONE 1825537
  misc_feature: Encodes the peptide sequence at SEQ ID NO. 23092
acagtcactctcgctctcagctcgccggctctgttcattcttatcccctcgcctctcttcacctccctagctgtacctttccccgccccacctcgtccgtgtccgtgtccttcctcccggcccgggggcagcaggacagccggggcaggcgcggccggtgatcttggtgggctcctggagtcctggtgggggtgttgtgtgcggcgagggcggcggcggagctgggccggaggcagcagggagccggagaggggatggaggcggtggtggacgtcaagtacatgcccacgctgttcctgaacggcggcggcgcggcggctgcggcgccgggcaagaagacgaggcccgcggttgcggcgtggggcgccggcgaggcgtgggtgtaccgggagtgcctcaagaaccacgcggcgagcctgggcgggcacgccctcgacgggtgcggcgagttcatgccgtcgccggaggccgaccccgccgacccgggctcgctgcggtgcgccgcgtgcggctgccaccgcaacttccaccgccgggtccacgaggcgccgccctcgccgcccctcctcgcgctgcccccgcccccgccgcagccgtccgccgcgccgcacgtcgcgcgtgacgcccgcgcgccgcggggcgaggaggcgccagaggaccgcctgccggcggccgccttcgacgacgagaccgagtcgtcggacgaggaggggtcggacttcgacgaggaccgcccgctgtcgccgctgccggcgccggtggtggggatgccgggctacctcccgccggcgccgcacatgcacctcgcgctgggcaccggcgtgccgggcgcctctacccccgtggccgcgccaaggccgcccgcgcccccgggcccggcgggttcgcccggcgccgcggcggcgcggaagcggttccgcaccaagttcagcccggagcagaagcagcggatgcaggcgctgtcggagcggctcgggtggcggctgcagaagcgcgacgaggcggtggtcgacgagagctgccgcgagatcggcgtcaccaagggcgttttcaaggtctggatgcacaacaacaagcacaacttcgtcgccggccacagcgcgcgccgcagctcctcgtcctcctcccccgccgccgccgcccctcctgccgccccggcgcctcctcccccgccgccgcgcgcgcccgtccacgccgacttcaacatcaacggcaccgccgactacttccgcgtcgtccatccggtgccatcgacggcgagcggcgccgactccccgctgtccgcctcgtcgcgctaatcagtcgtggctctcttcgtagcctcgtgtctaattaaccaaccaaccaaccaaccctaatgcatggcgctggtgaagctcgctggtctttgttaatggtggagcccaagaaagatgtaccaaaacgtgggctttcgggatctgacgatgtaatgatgattcaggattagcgctgatgagtacagcactagcaggtggtagattggtgcttagccgtagcaaattgttcgtgttcttgagctgtgg

SEQ ID NO: 23092 - protein, 347 aa, Panicum virgatum
  misc_feature: Ceres CLONE 1825537
  misc_feature (39)..(100): Pfam Name: ZF-HD_dimer Pfam Description: ZF-HD protein dimerisation region
  misc_feature: The sequence is a functional homolog of SEQ ID NO 114 in the 10/714,887 US patent application
  misc_feature: The sequence is a functional homolog of SEQ ID NO 114 in the 11/435,388 US patent application
  misc_feature: Useful for making plants with modulated low light sensitivity
MEAVVDVKYMPTLFLNGGGAAAAAPGKKTRPAVAAWGAGEAWVYRECLKNHAASLGGHALDGCGEFMPSPEADPADPGSLRCAACGCHRNFHRRVHEAPPSPPLLALPPPPPQPSAAPHVARDARAPRGEEAPEDRLPAAAFDDETESSDEEGSDFDEDRPLSPLPAPVVGMPGYLPPAPHMHLALGTGVPGASTPVAAPRPPAPPGPAGSPGAAAARKRFRTKFSPEQKQRMQALSERLGWRLQKRDEAVVDESCREIGVTKGVFKVWMHNNKHNFVAGHSARRSSSSSSPAAAAPPAAPAPPPPPPRAPVHADFNINGTADYFRVVHPVPSTASGADSPLSASSR

SEQ ID NO: 23093 - DNA, 541 bp, Panicum virgatum
  misc_feature: Ceres CLONE 1825542
  misc_feature: Encodes the peptide sequence at SEQ ID NO. 23094
ctagccggaaactccgagcccaactccggaggtcgaaatggcggcggcggcggcggcggcgaagcccgtggcggtgcggcgcgcggaggagctggtggggagggagatggccgggcgcgacgcgtcccacgacgccgcgcacgcgctccgggtccgcgacctcgcgctctcgctcgccgccgaggagggcctctccgcccccgcccgcctcctcaccgtggaactgtccgctctcctgcacgacgttggagattacaagtacaccaagaacaatgtggaggatatgagtgtcgtcgagatgtttcttgaagaggtaggattggaggaagggcagaaggatgaaatagtgtcaattattaaggggatgggattcaaaaatgaagtttccaagaagtctattgctgatcccactcttgagtttgcaattgtacaagatgcagatcgcctggatgcaattggtgcaattggtattgcaagatgctttacgtatggtgggagcaagaacagcgcattgcatgatcctagaatacttccgcgtgat

SEQ ID NO: 23094 - protein, 167 aa, Panicum virgatum
  misc_feature: Ceres CLONE 1825542
  misc_feature (32)..(140): Pfam Name: HD Pfam Description: HD domain
MAAAAAAAKPVAVRRAEELVGREMAGRDASHDAAHALRVRDLALSLAAEEGLSAPARLLTVELSALLHDVGDYKYTKNNVEDMSVVEMFLEEVGLEEGQKDEIVSIIKGMGFKNEVSKKSIADPTLEFAIVQDADRLDAIGAIGIARCFTYGGSKNSALHDPRILPR

SEQ ID NO: 23095 - DNA, 654 bp, Panicum virgatum
  misc_feature: Ceres CLONE 1825567-R
  misc_feature: Encodes the peptide sequence at SEQ ID NO. 23096
cgcgaaaacactgacggggaagagcatcacactcgaggccgaaagcaccgacaccatckacaakgtcaaggccaagatccaggacaaggagggcrttcccccaswccagcaaaggcggatttttgctggtaagcaattggaagatgggagaacattagctgattacaacattcagaaggagycgacacttcatttggtcctgaggskcaggggtggaactatgatcaaggtgaaracacttacagggaaggaaattgagattgacattgagcccactgacacaattgataggatcaaggagcgtgttgaggagaaagagggtatcccacctgttcagcagaggctcatttatgctggcaagcaacttgctgatgacaaaactgccaaggattacaacatcgaaggtggttcggtgctccatcttgtgcttgctctgaggggtggccagtagattcaacttctacccgtagcttatgttattgtgatttctacctatagttggttgagactttaagccttgtattgggtggttgattgaagtggattagtggactaagagtcaggtgtcatctgtgctggatatgaaaggcttgaattgtgtttatcagctgtcatctgattgcccaaatactcctttcatgggttcactttgac

SEQ ID NO: 23096 - protein, 149 aa, Panicum virgatum
  misc_feature: Ceres CLONE 1825567-R
  misc_feature (78)..(146): Pfam Name: ubiquitin Pfam Description: Ubiquitin family
  misc_feature (2)..(70): Pfam Name: ubiquitin Pfam Description: Ubiquitin family
  misc_feature: Useful for making plants with modulated nitrogen use efficiency
  misc_feature: Useful for making plants with modulated cold sensitivity
  misc_feature: Useful for making plants with modulated flowering time
  misc_feature (20)..(20): Xaa is any aa, unknown, or other
  misc_feature (21)..(21): Xaa is any aa, unknown, or other
  misc_feature (32)..(32): Xaa is any aa, unknown, or other
  misc_feature (35)..(35): Xaa is any aa, unknown, or other
  misc_feature (61)..(61): Xaa is any aa, unknown, or other
  misc_feature (69)..(69): Xaa is any aa, unknown, or other
AKTLTGKSITLEAESTDTIXXVKAKIQDKEGXPPXQQRRIFAGKQLEDGRTLADYNIQKEXTLHLVLRXRGGTMIKVKTLTGKEIEIDIEPTDTIDRIKERVEEKEGIPPVQQRLIYAGKQLADDKTAKDYNIEGGSVLHLVLALRGGQ

SEQ ID NO: 23097 - DNA, 619 bp, Panicum virgatum
  misc_feature: Ceres CLONE 1825567
gtcggctctctatctctatctccctcgctagccgctgtacgttatttcctctctagctagccattagcaggagcaagctagctagctagctccacagatcgaccgcgcgtgtggctggtgatcgtgatcggtagcaaggacgatcgatcgatcgacatgctgcttccgacggcgcggacgccgcaccaccacccgggctgcagcagcaaggcgccggcggatgatggcgcgtcggtgggggacctcaagagagggaacccggcggcggcggcgggccggcgggaggaagcggtggtcgtcatcgccgaggccgccgtggacgtgtgcctcacggcggcggccgtggccggcgcggcgctgctggcgtggtgggccgtcgcgttccaccccgcctacgcccacctctggatggtgcccgtcggcctcgtgctcgcctgcaccccgcccctcgtctgcctcgcgctccgcttctccggcgacggcggccaagcaggctccgcgggcgcgccgccgccgttggccgccgtggtcgtccacaagtagtgcgtgcgtcgtcattcgatcaatttcaattggggttgggagtgtatatagtgtatatatatgttgcatatatcct

SEQ ID NO: 23098 - DNA, 469 bp, Panicum virgatum
  misc_feature: Ceres CLONE 1825583
  misc_feature: Encodes the peptide sequence at SEQ ID NO. 23099
aaatccacctcctcctctcccctccagatcccctggcaggcatatactatccagagctagcgcaaccgcctccctatttgatgatcccactgacctcctcttcttccggcaagacaggatagaggactaaagaattctattccgaggccagaaagagaatctttgaggcagatcaacatccctggcgggggtgatgggggcgaggcaggggcgggagctacagcgagatagcgacaggaccggtgggcgcgtagtggtggggtgcatcgagtaccggctccgctcgggaggcgaggtggaggtgctggtgatcagctcgcaaaacaaaggccccgcggggggcgtgctaatccgcaggggcgggtgggagctggaccattccatggacgatgcggtgcggcgcgaggccgctgatgacgccggcgtggtcggggagacgggacccgcgctggggcggtggtgctaccgc

SEQ ID NO: 23099 - protein, 91 aa, Panicum virgatum
  misc_feature: Ceres CLONE 1825583
  misc_feature: SWISSPROT Homolog: EC 3.6.1.52 Diphosphoinositol-polyphosphate diphosphatase
MGARQGRELQRDSDRTGGRVVVGCIEYRLRSGGEVEVLVISSQNKGPAGGVLIRRGGWELDHSMDDAVRREAADDAGVVGETGPALGRWCY

SEQ ID NO: 23100 - DNA, 1264 bp, Panicum virgatum
  misc_feature: Ceres CLONE 1825587
  misc_feature: Encodes the peptide sequence at SEQ ID NO. 23101
aagcgtaaccgaagtccaatagaaggctacggcgctctctccattgtcgcctgccttctttttcctctcctcctctcgtctcgttccccgcacgagtcacgacctcgcccaaacggccaacccgccgaagagtttgctggtggaagaggggaggaggaagaggacgagatggcgagggaggacaggttcccggtgtgggaggcggcgctgctcgccgccgtggccgccgtcttcgccgcggcgctggccggcgtctacgtctccatgccccactccgactacagcttcctcaagctgcctcgtaaccttcaggagctccaagtcctcaccaaccatttggagggctacaccagtgactacaccatccaggtgctggtgggctactgcgctgtgtacatcttcatacagacattcatgatcccagggactattttcatgtccctgcttgccggggccctcttcgggcagctcggtggtctggccctagtgatctttgctgccactgccggtacttcttcctgctacttcctgtccaagctggtcggcaaaccactggtcttctcgttgtggccggacaagctcatgttcttccaaaagcaggttgcaaagaggagagagaacttgctgaattacatgctgttcctgagagtcactccaacacttccgaatactttcatcaattttgcttcacctatagtggatgtgccctaccatatcttcttcttagcgacagccattggccttatcccagctgcctatgtgactgtcagggcaggaattgctctgagcgacctgagatcgctgaacgacctatacgatccgaagtcgattgctgtgctgttcctgatcgggcttgtttcggtgacaccaacattgctgggcaagaacgagacgcaaagcagagcaccagcagacattgcagctagcaccaactgatcgcttgcacgccaccccagcgccctccttccctatacataccgaagctcagcgtctggtggtggctccatgacttcggatcaaatggaacctgtcgcgggccacgaacatggcgagggtcccagcccatctccacttgcggggaaacttttgcgctgatattgtgaaagggatgcatcatggtcgcctcatactgaatcttgcaagcgaaacggacatcagagcagactgctttcggttcttgtgtttaactaattcactgattattgtatcttggacacgttaaccagattcaatctgaatcaatacagctcattcagtgattcat

SEQ ID NO: 23101 - protein, 255 aa, Panicum virgatum
  misc_feature: Ceres CLONE 1825587
  misc_feature (84)..(205): Pfam Name: SNARE_assoc Pfam Description: SNARE associated Golgi protein
MAREDRFPVWEAALLAAVAAVFAAALAGVYVSMPHSDYSFLKLPRNLQELQVLTNHLEGYTSDYTIQVLVGYCAVYIFIQTFMIPGTIFMSLLAGALFGQLGGLALVIFAATAGTSSCYFLSKLVGKPLVFSLWPDKLMFFQKQVAKRRENLLNYMLFLRVTPTLPNTFINFASPIVDVPYHIFFLATAIGLIPAAYVTVRAGIALSDLRSLNDLYDPKSIAVLFLIGLVSVTPTLLGKNETQSRAPADIAASTN

SEQ ID NO: 23102 - DNA, 596 bp, Panicum virgatum
  misc_feature: Ceres CLONE 1825591
  misc_feature: Encodes the peptide sequence at SEQ ID NO. 23103
acgcagagcgcgcaaggcgatccaattgaagaccgagcactgtcgatggcatcggccaagctcctcgtcaccgccctcgcggccctgctggcggccgccggtggcgccggcgcgagggagttgaggcggctcgagatgccgtccgccgagatgatcgccgacgccggcggcatgccgctgatccacatgctccgcccgctgcggggctccggcggccgcctgggccggcgagccggcgtgccgtgcgacagctggcggttcgccgtggagaccaactccgtgcgcggctggagcaccatccccgcccgctgcgagagctacgtcggcaactacatgatgggcggccactaccggcgcgactcccgcgctgtcgtcgacgaggccgtcgcctacgccgagggcctgcagctcgccggcgacggcagggaggtctgggtgttcgacgtcgacgagaccacgctctccaacctcccctactacgccaagcacggcttcgggtgcgtacggttatatatccgccggcgtcgacctctctctctctctctctctctctctgctctatctaaactgccgccatggccgcgcgcgcgcgatgc

SEQ ID NO: 23103 - protein, 183 aa, Panicum virgatum
  misc_feature: Ceres CLONE 1825591
  misc_feature (51)..(178): Pfam Name: Acid_phosphat_B Pfam Description: HAD superfamily, subfamily IIIB (Acid phosphatase)
  misc_feature: SWISSPROT Homolog: EC 3.1.3.2 Acid phosphatase
MASAKLLVTALAALLAAAGGAGARELRRLEMPSAEMIADAGGMPLIHMLRPLRGSGGRLGRRAGVPCDSWRFAVETNSVRGWSTIPARCESYVGNYMMGGHYRRDSRAVVDEAVAYAEGLQLAGDGREVWVFDVDETTLSNLPYYAKHGFGCVRLYIRRRRPLSLSLSLSALSKLPPWPRARD

SEQ ID NO: 23104 - DNA, 1562 bp, Panicum virgatum
  misc_feature: Ceres CLONE 1825592
  misc_feature: Encodes the peptide sequence at SEQ ID NO. 23105
gccgtctctctatctctctctctctctctccattgtgaaaagctaaacgaaagctacggcgccgccgccttggtgactccctctcctctcctctcctctcagctacgcatcctacctccgacggccaacgcagcctcctccgtggacggcgcttcgttcgatcaagagtgcagacagaacatcacagacaggaagcttcaatgcttggcaatggagatgagggctcgggaatctgtaaacatgtcggaggacctaactggggcaattgcaccttacgccaccgccctacatgatgtgttcctccactcccattgctcatcatgcttcagcaagttaccaccacaatccccctacaccatgtcttgcacaatgtgctgctctgttcgatactgctgctcggagtgcttaagctcagattcattggtgcattcttcttctggtgaatgttgcttttttatggaccacctcaagagagcttcccctaactatgttactgaaggaacaagtgatttacgtgctgccctccgacttctttatgtgcttgagatgcatgatcttgtttcatctgattcaatcagccagtacagtaggattggtggtctttcagcaagtggtattgaggaagctcaggaggaagatgaggagattgctgagaggatattggaggggagcctactgatgtcatcttctagagaatcaagggcactgtcttatgttagtttacctgatggagttaaagttgagaggatggcattatgggcagtgattacaaatagtgttgaggtacagcttagcgaagggctggttatgggaattgctgtgtatggcccaagtttctcatggttcaaccacagctgctttcccaatgcttcgtacagatttgtattggctccgaagaatgaaaactgtatttcacaccaatcaaaatcatgtgtagtccctgctagcaaaggagttgcagctgatgtgtggcatgcttggcagtatgaggaagctgattgtaccaacgcactctgcaaatatggtccaagagttattgttcgctgcacaaaaccaattaacaagggagatgaagtttgcataacatacattgatcttctccagaccaaggaagcaaggcattcggatctgtggttaaagtataaattcatttgttcttgcaaccgctgtatatcattaccagagccttatgtggatcttcttttgaattgtgatgctagggacttaaataaaccagaggatgctgttgcagctccaacagttaaggatttggatgatggcttacaacaagcaatatctgaatactcatcaggcgaagatgccaaagcttgctgtgatatgattgaaagcatgctttctgaaaacttgatgagagatttgcagaaaggggaactttcagggagaaaacatatactacaccctcttcatcgtgtctgttttactgcttacatagcacttgcctctgcttaccgatttcgtgccctaagttacaaaacgggcagtttgtatggagaaaaaagtgatgatcttttcagagtggccaaagctgcagctgcttattc

SEQ ID NO: 23105 - protein, 450 aa, Panicum virgatum
  misc_feature: Ceres CLONE 1825592
  misc_feature: SWISSPROT Homolog: EC 2.1.1.43 Histone-lysine N-methyltransferase
MEMRARESVNMSEDLTGAIAPYATALHDVFLHSHCSSCFSKLPPQSPYTMSCTMCCSVRYCCSECLSSDSLVHSSSGECCFFMDHLKRASPNYVTEGTSDLRAALRLLYVLEMHDLVSSDSISQYSRIGGLSASGIEEAQEEDEEIAERILEGSLLMSSSRESRALSYVSLPDGVKVERMALWAVITNSVEVQLSEGLVMGIAVYGPSFSWFNHSCFPNASYRFVLAPKNENCISHQSKSCVVPASKGVAADVWHAWQYEEADCTNALCKYGPRVIVRCTKPINKGDEVCITYIDLLQTKEARHSDLWLKYKFICSCNRCISLPEPYVDLLLNCDARDLNKPEDAVAAPTVKDLDDGLQQAISEYSSGEDAKACCDMIESMLSENLMRDLQKGELSGRKHILHPLHRVCFTAYIALASAYRFRALSYKTGSLYGEKSDDLFRVAKAAAAY

SEQ ID NO: 23106 - DNA, 424 bp, Panicum virgatum
  misc_feature: Ceres CLONE 1825593
  misc_feature: Encodes the peptide sequence at SEQ ID NO. 23107
actcaacaagccaacgcaagcttgagaagcatgtgccggcggcatagtattctgaaagctgagctatttccgttggttggccggcctggcgaaggacatcaaggcgtcggggccctatgcgggcgagtactcggccgaggcactacactgaccccccgccggcgtctgtgatcccacgtcgtacgagctcaccaagatggtccctgtccccgcggccatcgccgagttcatcacgaccctcctcttgctctacatcaccgcggacaccgtgatccggtacaaccaccacacggacgcgtcggcgtccgggcccgactctgcgtgcggcggcgtgggcgtcctcggaatcgcgtgggcctcccgcggcatgatcttcatcctcctctactgcaccggcggcatctcgggctggcaggtctacccg

SEQ ID NO: 23107 - protein, 75 aa, Panicum virgatum
  misc_feature: Ceres CLONE 1825593
  misc_feature: Useful for making plants with modulated cold sensitivity
  misc_feature: Useful for making plants with modulated drought sensitivity
  misc_feature: Useful for making plants with modulated water use efficiency
MVPVPAAIAEFITTLLLLYITADTVIRYNHHTDASASGPDSACGGVGVLGIAWASRGMIFILLYCTGGISGWQVY

SEQ ID NO: 23108 - DNA, 605 bp, Panicum virgatum
  misc_feature: Ceres CLONE 1825595
  misc_feature: Encodes the peptide sequence at SEQ ID NO. 23109
aacttgatcggccctggcctaggctcatagtcctagctagctagctgaaaaaaagtaagaaacattctgccccccccccccccccccagctgcagagcgcacacggctctccgctgcgtccagaaaaaccaggttcctcgccagctctagccggcgccccccaccacggcgagccggccgaccatgggggagctcagcggcggcggcggcgacggcgacgcgcaggcgccgttcccgtggaagctggtggtgctgtgcgcggtggccgcgtggtgcgccttgcgcgcggtggagtgggcgtggtggcggccgcggcgccgggcgcgggcgctgcggtcgcaggggctccgcggcacggcgtaccgctccctggcgggggacgcgccgctgacggagcggctcgaccgtgaggccaggtcccggcccatgccgctgggatgccacgacgtcgtgccccgggcgatgccgctgttccaccagaccatgaaggagcagggcaaaacgtccatcacctggttcgggccggtgccgagggtgaccatcaccaagcccgagctggtgcgcgaggttctgtccatcaagttcggtcacttctagaagatcag

SEQ ID NO: 23109 - protein, 137 aa, Panicum virgatum
  misc_feature: Ceres CLONE 1825595
  misc_feature: SWISSPROT Homolog: EC 1.3.3.9 Secologanin synthase
MGELSGGGGDGDAQAPFPWKLVVLCAVAAWCALRAVEWAWWRPRRRARALRSQGLRGTAYRSLAGDAPLTERLDREARSRPMPLGCHDVVPRAMPLFHQTMKEQGKTSITWFGPVPRVTITKPELVREVLSIKFGHF

SEQ ID NO: 23110 - DNA, 1243 bp, Panicum virgatum
  misc_feature: Ceres CLONE 1825619
  misc_feature: Encodes the peptide sequence at SEQ ID NO. 23111
caattttttggtaaacatttggagatccctgtccttgaggagagtaagacttgtctttttcatacaaatgcgtagctgttgagttaaaggcttatattgagttttgaaatttgggattgcacctgggatttttgaaaggaattgaagaaaactgtgaatcgacatgcaaattgtgcgagattcaacaaaggatatgtttcctgacatgcatctccaactcttaaaacataaattgcatgctttttctttctgaattgttttgttcacattttctttctgaattgttttgttcagagagtattctgcattttcataaaatatttagccatatgtttgctttgtgcacattatagattggaaattctatctatatactgtgcctgtttcagttatacacagactataaagatgtgttcacaatgtaagagtcttttgtaggctaaatgcatatggcttgtttgaagtgcgagtagctggtgatggaaattgtcagtttcgtgcactctcagaccagctgtaccgttcacctgattatcacaggcatgttcgaaaggagattgtaaagcagctcaaggaatgtaactccttgtacgaaggttatgttccaatgaaatataaacagtattgcaagaaaatgaagaaatctggtgaatggggtgaccatgtcacacttcaagcagctgctgacaagtttgctgcgaagatctgtcttctaacatcattcagagatacatgttttgttgaaattgttccacaatatcaaacaccacagagggagatatggctaagtttctggtcagaagttcactacaactcactgtatgatgctcgagatatacctagcaagtacaagcctagaaagaagcactggttattgttttgataacgagggattttgctccatacatgtgggtccatatacttcgctatgacaccattgttggctggtggcatcctggggacaacccttatgtggatttatcccctatagctctgagtgaacaatccatgtcgcctgctccttgggacagcatcaaacatgcatacagcagcagatacagttacagttacaatgctgacctgagccttgtgaatataaatacacgtactttttgaaggggaagatacaccctgtaccaacaaacaggttgattgtatacttttgcgtatttgttcgttgttttattctttatacagctacacattggtgctattcatcagttcattattcacttcattttac

SEQ ID NO: 23111 - protein, 91 aa, Panicum virgatum
  misc_feature: Ceres CLONE 1825619
  misc_feature (1)..(68): Pfam Name: OTU Pfam Description: OTU-like cysteine protease
MKYKQYCKKMKKSGEWGDHVTLQAAADKFAAKICLLTSFRDTCFVEIVPQYQTPQREIWLSFWSEVHYNSLYDARDIPSKYKPRKKHWLLF

SEQ ID NO: 23112 - DNA, 1363 bp, Panicum virgatum
  misc_feature: Ceres CLONE 1825621
  misc_feature: Encodes the peptide sequence at SEQ ID NO. 23113
ccccctcctctccctccgcccggccttctactccaatggaatctcgcgtcctcgattagcccgccccgctccagtccgccgactcgagctcaacccaaagatcgcgcctttatttctgcgcgtgcgcgcgcggcggcggcggcggtaggtgtcgccgtcagggatcagcggggggggggaaagaaattagttcttgggttgaccattcagggtgggttattaggatggaggcggcgaaggagcctgctgtggcgaagccgcggctgccgccggggttccggttccggccgacggacgaggagttggtggtgcactacctccggcggcgcgcgctggcggccccgctccccgccgccgtggacatccccgacgtgcgcatcctggcgcacgacccctcggacctgctgcccccagggtggagcgagcaggagcgctacttcttcacgtgcaaggaggccaagtacgtcaaggggcggcgcgcgaaccgcgccacgggggccgggtactggaaggccacgggcaaggagaagcccgtggcggtggcggtgccggtgccggcgaggggccaggcggcgcaggccgtgctggtgggcatgaagcggtcgctggtgttctaccgcgggaagccgccgacggggagcaagacggactgggtgatgcacgagtaccgcctcgcgggcgccgggctggcgccgtgccgccgcgccggcgcgggggcggcggcgcggccggccgagggctgggtgctctgccgcgtgttccggaagaaggggtccgcgtccgccaacgccgcggcggccgacccggggagcgacggcgaggcggaggaggccgaggaggagcagcaggaggaggaggtgggcgccgcggggggcgcgcgggcgttcatcgacttcttcgcgcgcgcggacgcggtcgcggcggggcggcgcgagcagcagcagcaggggcagcagcagcggcgcgcgtcgtcgccggtggtgtcgtcgagctgcctgacggacgcgtcgcacgagcagcacgggcgggagcaggagaccaccagccgcggcgcgtgagggaggccaagctagctagctgccatggtccgtggagggagcgagcgaggccaggcagggccgaggcgagcggagagagagaggagggaagctttgtactgtgcagccgcagagagcctaatggtgttcgttcactgtcgagaccagtgagtaggagtaagattaggagagcaaatggctggcaggctcctcggagccggtcagcgagtccggtcgagtcttagcgtagatgcagctgctgctggaacaactaatgtaccaccaccaccaccacctgatgaatcatcccaaccctcctcctcatc

SEQ ID NO: 23113 - protein, 277 aa, Panicum virgatum
  misc_feature: Ceres CLONE 1825621
  misc_feature (14)..(151): Pfam Name: NAM Pfam Description: No apical meristem (NAM) protein
  misc_feature: The sequence is a functional homolog of SEQ ID NO 1012 in the 11/435,388 US patent application
  misc_feature: Useful for making plants with modulated nitrogen use efficiency
  misc_feature: The sequence is a functional homolog of SEQ ID NO 891 in the 10/374,780 US patent application
MEAAKEPAVAKPRLPPGFRFRPTDEELVVHYLRRRALAAPLPAAVDIPDVRILAHDPSDLLPPGWSEQERYFFTCKEAKYVKGRRANRATGAGYWKATGKEKPVAVAVPVPARGQAAQAVLVGMKRSLVFYRGKPPTGSKTDWVMHEYRLAGAGLAPCRRAGAGAAARPAEGWVLCRVFRKKGSASANAAAADPGSDGEAEEAEEEQQEEEVGAAGGARAFIDFFARADAVAAGRREQQQQGQQQRRASSPVVSSSCLTDASHEQHGREQETTSRGA

SEQ ID NO: 23114 - DNA, 1086 bp, Panicum virgatum
  misc_feature: Ceres CLONE 1825665
  misc_feature: Encodes the peptide sequence at SEQ ID NO. 23115
atcgggagggcacggcgacggcggcgagatattaccgagatgaagacggtcagcctaggcgcctccaggccctccaccgtcaacttccgcatgccgacgagggacaacctggtgccgatacgcgtcgacctcgaggtggacgggcagcgctacagggacgccttcacctggaacccgcgagaccccgactcggagatcatcagcttcgccaagcggacggcaaaggacctcaagctgccggccaatttcgtcccccagatgctccagtccatacaggggcaacttgcggagttccgctcctacgaggggcaggagatgcagatcaaggagaagattgtgcctctcaagattgacctccgagtgaacaacactgtaataagagaccagttcttatgggatattggcaaccttgatagtgaccctgaggaatttgcgaggatgctatgtgacgatttgaacatcacagatcctgaagtcgggccggcaatagctgtttccatccgtgagcagctttatgagattgctagtcagagtgtctctgttatgagagagaagcaattgtcaaagaagggaaggcgagcaccagagttttcttcgaatagcaaagccgtgaacaacgcggtggacttattcaagtattttggcagcaaaggaagcgtcattcggaaaaggaaggaatggtatctgtatgagcctgttgtcgacgttgtagctaatgaggaaggtggaaaagaggagcctaataattctagtaggccgaagaagcgagcagaagaagagaaagtcgcaagtcttcaatccctttgatccagacataggactgcagtcttgaagaggattgttgagcaagctgctgattgcctctaaccacaaagggtttccagccgaaccctgtctgccgtggggatggtgcctgcctgacattagtccaaggatatgcatgggttaattgttgtttgcatgtcttagtctatatatgtatgtatacagtgtgagggtttatcctgtgatgccatgccgcaacaccgtgacactgtgtactccttcaatcttcagtcacatgcatgcgagggattattggctggc

SEQ ID NO: 23115 - protein, 255 aa, Panicum virgatum
  misc_feature: Ceres CLONE 1825665
  misc_feature (2)..(242): Pfam Name: SNF5 Pfam Description: SNF5 / SMARCB1 / INI1
MKTVSLGASRPSTVNFRMPTRDNLVPIRVDLEVDGQRYRDAFTWNPRDPDSEIISFAKRTAKDLKLPANFVPQMLQSIQGQLAEFRSYEGQEMQIKEKIVPLKIDLRVNNTVIRDQFLWDIGNLDSDPEEFARMLCDDLNITDPEVGPAIAVSIREQLYEIASQSVSVMREKQLSKKGRRAPEFSSNSKAVNNAVDLFKYFGSKGSVIRKRKEWYLYEPVVDVVANEEGGKEEPNNSSRPKKRAEEEKVASLQSL

SEQ ID NO: 23116 - DNA, 641 bp, Panicum virgatum
  misc_feature: Ceres CLONE 1825670
  misc_feature: Encodes the peptide sequence at SEQ ID NO. 23117
atcccccacggcccaccggcccaggcgcccaatctccatccccacaccttcgtcgtcttcgtcttcgtcttctgctgccgctcggctcaccctggcggcctcgctgttcgatctcgcgctgcgatggagcggtacgaggtgatccgggacatcgggtcgggcaacttcggggtggccaagctggtgcgggacgtcaggaccgaggagctcttcgccgtcaagttcatcgagagaggccagatgattgatgagcatgttgaaagggagattatgaaccaccggtcactgaagcatccaaacataattagattcaaggaggttgtgctaactcccacacatttggcaatagttatggaatatgctgctggtggtgagctatttgaaaggatttgcaatgctgggaggtttagtgaggatgaggcaaggttcttcttccaacaactgatttcaggagtgagctattgtcattcaatgcaaatatgccatagagatctgaaactagaaaatactctcttagatggcagtgctgcacctcggctcaagatctgtgattttggttattccaagtcttctgtgttgcactctcaaccaaaatcaactgttggcacacctgcatacattgctccagaggtcctcactaa

SEQ ID NO: 23117 - protein, 172 aa, Panicum virgatum
  misc_feature: Ceres CLONE 1825670
  misc_feature (4)..(172): Pfam Name: Pkinase Pfam Description: Protein kinase domain
  misc_feature: SWISSPROT Homolog: EC 2.7.11.1 Non-specific serine/threonine protein kinase
  misc_feature: Useful for making plants with modulated water use efficiency
  misc_feature: Useful for biocontainment applications
  misc_feature: Useful for making plants with modulated biomass
  misc_feature: Useful for making plants with modulated time to senescence
MERYEVIRDIGSGNFGVAKLVRDVRTEELFAVKFIERGQMIDEHVEREIMNHRSLKHPNIIRFKEVVLTPTHLAIVMEYAAGGELFERICNAGRFSEDEARFFFQQLISGVSYCHSMQICHRDLKLENTLLDGSAAPRLKICDFGYSKSSVLHSQPKSTVGTPAYIAPEVLT

SEQ ID NO: 23118 - DNA, 702 bp, Panicum virgatum
  misc_feature: Ceres CLONE 1825678
  misc_feature: Encodes the peptide sequence at SEQ ID NO. 23119
atcccgtacgaagaaagggttcttgattcatccaacacctgacctgtcactcggtcgcgccattaatccgagctggcaagctagcatcgccgcccactccctctgcttgccagattcccgctgcacctggaaactgaagccgcgccccgtcgccgccgtcgcaagcatgcagccgaaggacgccgccgaggacatcgtcatcgcgggcgccggactggccggactcgcggcggcgctcggactgcacaggaaaggggtgaggagcctggtgctggagtcgtcgccatcgctgcgggcgtcggggttcgcgttcacgacgtggaagaacgccttccgggcgctcgacgccctcggggtgggcgacaagatcagggagcagcatctgcaggcccgggcgttgcgcgtcgtggcttccgccaccagagaaatcgtgggggaggctgacttcacgaagcaggggaaacgagggcccctggaaatccgttgcgtcaggcgcgacctgctgctgcaggccttggaggaggagctgccaaaaggcaccatccgctactcctccaagattgtctccatcgaggaggatggcaacatcaagatccttcaactagccgatggctcagttctgagagcaaaggtactgatcggatgcgacggcataaactccgtggtggcgaaatggctgggcctcgcgaagccttcctactc

SEQ ID NO: 23119 - protein, 178 aa, Panicum virgatum
  misc_feature: Ceres CLONE 1825678
  misc_feature: SWISSPROT Homolog: EC 1.14.13.1 Salicylate 1-monooxygenase
MQPKDAAEDIVIAGAGLAGLAAALGLHRKGVRSLVLESSPSLRASGFAFTTWKNAFRALDALGVGDKIREQHLQARALRVVASATREIVGEADFTKQGKRGPLEIRCVRRDLLLQALEEELPKGTIRYSSKIVSIEEDGNIKILQLADGSVLRAKVLIGCDGINSVVAKWLGLAKPSY

SEQ ID NO: 23120 - DNA, 641 bp, Panicum virgatum
  misc_feature: Ceres CLONE 1825714
  misc_feature: Encodes the peptide sequence at SEQ ID NO. 23121
atcaccagcactagctaattcaccgttgcacgagtaaaaaccaccgacagctagctggtaaaaatcatcagcacacggcacttcgtgcagccatccagctccagggttgtttacccagcggtaaaaacatggcaccaaccatcgccaagcctctgctcagcgatctcgtggcgcagacggggcaagtgccattgagccacgtcaggcctgtcggagaccgcccggacctcgcgagcgtcgacaacgaatccggcgccgggatcccgctaatcgacctcaacaagctcgacgggcccgagcgccgcacggtggtggaggccatcggcagggcctgcgaatccgacggcttcttcatggtgacgaaccacggcatccccgcgggggtcgtggaggggatgctgcgcgtggcgcgggagttcttccacctgccggagtcggagcggctcaagtgctactccgacgaccccaagaaggccatccggctctccaccagcttcaacgtgcgcaccgagaaggtcagcaactggcgagacttcctgcgcctgcattgctacccgctccagagcttcgtcgaccagtggccgtccaacccgccctcgttcaggcaagtggtgggcacctacgcgacggaggcgcgggcg

SEQ ID NO: 23121 - protein, 170 aa, Panicum virgatum
  misc_feature: Ceres CLONE 1825714
  misc_feature: SWISSPROT Homolog: EC 1.14.11.9 Flavanone 3-dioxygenase
  misc_feature: Useful for making plants with modulated oxidative stress sensitivity
MAPTIAKPLLSDLVAQTGQVPLSHVRPVGDRPDLASVDNESGAGIPLIDLNKLDGPERRTVVEAIGRACESDGFFMVTNHGIPAGVVEGMLRVAREFFHLPESERLKCYSDDPKKAIRLSTSFNVRTEKVSNWRDFLRLHCYPLQSFVDQWPSNPPSFRQVVGTYATEAR

SEQ ID NO: 23122 - DNA, 528 bp, Panicum virgatum
  misc_feature: Ceres CLONE 1825737
  misc_feature: Encodes the peptide sequence at SEQ ID NO. 23123
gatgcctccctcccgtccgtcccgctcccgccgaaaccgacaccaacagttgattggggaccatgtggaccgagagcccgctggtccccgaccccggcgcccccctgctccccggactccccgtggcagtcctgctccgcttctgggaggaggtcccccaccgcgcgctgctggaacagaaactttgcaggaaactggtgcacataactgttggattagtgtatctcctcatgtggcctttgttcagttcagatgatgtctttgccccatttcttgctccgcttattatcgaaatcaacatcataaaggtgacagtaattgggctcggtgttgttaaagatgagggcgtggtttactcgatgaccaggcatggggactacagggaactactcaagggccccctgtattatgcgtgtgctataactctgacaacaatagtcttctggaggacatcccccatctcaatcgccgtgatctgcaatttgtgtgcgggagatggtgttgctgacatagctgggagacgattcg

SEQ ID NO: 23123 - protein, 155 aa, Panicum virgatum
  misc_feature: Ceres CLONE 1825737
  misc_feature: Useful for making plants with modulated nitrogen use efficiency
MWTESPLVPDPGAPLLPGLPVAVLLRFWEEVPHRALLEQKLCRKLVHITVGLVYLLMWPLFSSDDVFAPFLAPLIIEINIIKVTVIGLGVVKDEGVVYSMTRHGDYRELLKGPLYYACAITLTTIVFWRTSPISIAVICNLCAGDGVADIAGRRF

SEQ ID NO: 23124 - DNA, 438 bp, Panicum virgatum
  misc_feature: Ceres CLONE 1825771
  misc_feature: Encodes the peptide sequence at SEQ ID NO. 23125
taaattttaattgagacacctattccatgacagattttaacttaccctctattttcctgcctttagtaggcttagtatttcccgcaattgccatggcttccttatttctttatgtgcagaaaaataagattgtccagaaaccgccgggccaaattttcttaatgtatttcccggatcctaataccgatatttttttgtgtaagtaatataatatgatagggtatgtagctcctttcacacacaaatgaaaaacgtctatggatgcagatataggctacgagcataaatgcatgcatatgcgtagccaagtatagcgagttttttttaagtggatccacgaattgaattcgttttgaatagaaagtcaatgtatctaaccaattatttcacaggactactagctactgaaggctatttcagaataaaaaaaagtacagt

SEQ ID NO: 23125 - protein, 59 aa, Panicum virgatum
  misc_feature: Ceres CLONE 1825771
  misc_feature (6)..(30): Pfam Name: PSI_8 Pfam Description: Photosystem I reaction centre subunit VIII
MTDFNLPSIFLPLVGLVFPAIAMASLFLYVQKNKIVQKPPGQIFLMYFPDPNTDIFLCK

SEQ ID NO: 23126 - DNA, 1067 bp, Panicum virgatum
  misc_feature: Ceres CLONE 1825777
  misc_feature: Encodes the peptide sequence at SEQ ID NO. 23127
atcgacagccgatcgactcgaacccccgggtagcagtctccgtctcgcgctttccactcccaccgagctctatccacaccgttccatttccaccacctgctcctcgtcatcgtccatggagggcaaggacggcaagcacgacgcctccgccgcgccccctgccggcgcgccgcagccgcccgaggcggcgcggtggggcacgcggcagatgggcccgccggcggcgcccggggcgcacccggagaaccaggaggcggcgcggtggacggcggcgcgcggggaccaggagctgccgccttacgtcgtcgtgggggagcccgtgccgcagcagcagaggcagaaaggggacagccccatagagcacatcctcgacttcttcaacacctggagccgcaaggccgaggagctcgcatccaacatctggttcaacctgaagactgcgccgtcgatgtcggacgcggcgatgggtaagctgagcctgggcgccaaggcgttgtcggagggcgggttcgagaagctgtacaggcagaccttctcctcgggccccgacgagcagctgaggaagaccttcgcgtgctacctgtcgacggcgaccggccccgtcgccggcacgctctacctgaccagcgcgaacgtcgccttctgcagcgaccggccgctctccttcgccgcgccgtccggccagaccgcctggagctactacaaggtgatgatcccgctggagaaggtcgcggcggtggagccggtgacgatgaaggagagcccgccggagaagtacgtgcacgtcgtcaccgtcgactcccacgacttctggttcatgggcttcgtcagctacgacaaggccgtgcaccacctcatcgaggccgtctcccaccgctcgtcatcccagcagcagggcgtcgccggcgccaccgctgccggcaccaagtgatgagggtccctccgttcgccggagagatggcagagagtagggctttgtgccctgcttgttgcttgagatggacggtttaccgagttctgtgtgtctggggatggatgtttttgactgtgtggttcgtttccgtggc

SEQ ID NO: 23127 - protein, 271 aa, Panicum virgatum
  misc_feature: Ceres CLONE 1825777
  misc_feature (134)..(212): Pfam Name: GRAM Pfam Description: GRAM domain
MEGKDGKHDASAAPPAGAPQPPEAARWGTRQMGPPAAPGAHPENQEAARWTAARGDQELPPYVVVGEPVPQQQRQKGDSPIEHILDFFNTWSRKAEELASNIWFNLKTAPSMSDAAMGKLSLGAKALSEGGFEKLYRQTFSSGPDEQLRKTFACYLSTATGPVAGTLYLTSANVAFCSDRPLSFAAPSGQTAWSYYKVMIPLEKVAAVEPVTMKESPPEKYVHVVTVDSHDFWFMGFVSYDKAVHHLIEAVSHRSSSQQQGVAGATAAGTK

SEQ ID NO: 23128 - DNA, 1270 bp, Panicum virgatum
  misc_feature: Ceres CLONE 1825780
  misc_feature: Encodes the peptide sequence at SEQ ID NO. 23129
ggcacctgtttgttgctctgcaagtagcctttcagaaggcagtgcacacggtaggtcagaggcccttaggccaaccccaaacagcgacatcttcctctcaaaatcaaaagaaaaaaaggagcagaaaacagcgacatctggtggctaataccctgccaagtggcaaccggatatcgatgaagcatgattgatccctaatggaagaagagtcctgagctctggccacctcgctatgcaagcaagctactcgcataaagtccaagagagacgcggcgcggcacatggcgcccatcatcaacaccaaccaacaccacggcgacgcacaccgctgctccagtctagaatcttcccctcgacctcaccctccacctttcccgcgcctccgctctagcttcgttgcccgggttttcgttcgatcattcgcgccatggacgccgccacctcggtgcagcgacggcggtggctgccgtgggcgcggcgccgtacctggcggcgaccgggggaggcggcggcgacgggctggcggcgtcggcggtgtccgcggcgcgggtcgtggcgtgcttcctggccgtgatggtgagcacggcggtgtgggcggtggtgatgctgctgctcctgccgcggccctgcgagcgcatccgccagagcaacgcctacggccacgtcaccgggcgcatgctgctgtggatcctggggaacccaatcaaagtggaaggcttggagcacctccgcgcgaggggaatcttcatctgcaaccacgcctcgccgctggacatcttcctcgtcatgtggctcgcccccaccggcaccgtcgggatcgccaagaaggagatcatctggtacccgctgttcgggcagctctacgtgctggccaaccacctgcgcatcgaccgctccaaccctgccgccgccatcaggtccatgaaagaggttgctcgtgaagtggtcaagaacaacctgtcgctcatcttgttcccggagggcacacgatcaagagacgggaggctgcttcccttcaaaaaggggttcgtgcacgccgccctgcagacgaggctgcccatcgtgccgatcgggacgcaccaggcgtggaggaacaacagcgtacgggtgcgcccggtgccgctcaccgtgaacagtgcggaggaccatggtggccgcctatggcgcctgccataccttgtttttttccgtggtagtccactgctgtaaattctagttcacttctacacttatactatgacgcacaacatgttgcgagttttattatttg

SEQ ID NO: 23129 - protein, 211 aa, Panicum virgatum
  misc_feature: Ceres CLONE 1825780
  misc_feature (43)..(169): Pfam Name: Acyltransferase Pfam Description: Acyltransferase
  misc_feature: SWISSPROT Homolog: EC 2.3.1.51 1-acylglycerol-3-phosphate O-acyltransferase
MVSTAVWAVVMLLLLPRPCERIRQSNAYGHVTGRMLLWILGNPIKVEGLEHLRARGIFICNHASPLDIFLVMWLAPTGTVGIAKKEIIWYPLFGQLYVLANHLRIDRSNPAAAIRSMKEVAREVVKNNLSLILFPEGTRSRDGRLLPFKKGFVHAALQTRLPIVPIGTHQAWRNNSVRVRPVPLTVNSAEDHGGRLWRLPYLVFFRGSPLL

SEQ ID NO: 23130 - DNA, 1532 bp, Panicum virgatum
  misc_feature: Ceres CLONE 1825805
  misc_feature: Encodes the peptide sequence at SEQ ID NO. 23131
gccacgcagcacccgcagccaccacaacgcagccccaacaatgcctcttccccttcttcttctcctcttctcagtccttgcctccgcttcgccggagctggacgtgtacgcgctcatcaagatgaaagcggcgctactggtcccggctacctccaccgcgctcgccgactgggacccttccgccacgccccccgcgcactgctccttctcgggcgtgtcctgcgacgcggccgcacgcgtcgtcaggatcaacctcacgagcatgccgctgcgtgggggcgtcctcccgcccgaggtcgcgctgctcgacgccctcgtgaacctcacagtcgccgcctgctccctggcggggagcctcccggcgtcgctcgccgcgctgccggcgctccgccacctcaacgtctccaacaacaacttcagcgggccgttccccgcgccggccggcgccggagagccctatttcccggtgctggaggtcgtcgacgcctacaacaacaacctctccggccctctgcccccgttcggcgccgcgcacgcgcgcctccgctacctccacctcggcgggaactacttctcgggcgccgtacgggaaagctacgcggacctcgcggcgctcgagtaccttggactcaacggtaactcgctctccggccaggtgcccgcgtcgctcgcgcgcctcaagcggctgcgggagatgtacatcggctacttcaacctgttcaacggcggcatcccgccagagctcggcgagcttgactcgctcgtccgcctcgacatgagcagctgtaacctcacgggccccatcccgacggagctcggacggctcgcgcgcctcgacacgctcttcctgcagatgaatcgcctttccggggaaatacccacgcagttaggcgacctcaaggatctcaagtcgctggacctctccatgaaccagctcgtcggcgagataccggccggcctcgctaatctcaccagcctcaggcttctacacttgttccgcaaccacctccacggcaacataccagcgttcatggccgacttaccgcacctggaggtgctgcaactgtgggagaataacctcaccggtcaccttccggccggattaggaaagaacagcccactcaagatgctggacgtggccaccaaccacatcacgggcaagataccgcctgacctctgcgcgggcaggaagctggagatcctcgtgctgatggagaacggcctgtccggtcccgttccagagtcactggccgcatgcaagacgctgaagcgcatcctccttggcaagaacatgctcagcggctctgtgccggctcgtctctttgaactccccgacgcaggcgaacaagcttgaggttgccgacgctctcgttggtgaacactctaatgtattgttagtttggcgctgtgctaggcatgggggcagcacctgctatagcacctccctactaaacgcctaggctgcaaccagttccgtgatatttaaataacaagtcagtgggggcgcacacgcactaaggtaaaaatgacac

SEQ ID NO: 23131 - protein, 437 aa, Panicum virgatum
  misc_feature: Ceres CLONE 1825805
  misc_feature (18)..(62): Pfam Name: LRRNT_2 Pfam Description: Leucine rich repeat N-terminal domain
  misc_feature: SWISSPROT Homolog: EC 2.7.11.1 Non-specific serine/threonine protein kinase
MPLPLLLLLFSVLASASPELDVYALIKMKAALLVPATSTALADWDPSATPPAHCSFSGVSCDAAARVVRINLTSMPLRGGVLPPEVALLDALVNLTVAACSLAGSLPASLAALPALRHLNVSNNNFSGPFPAPAGAGEPYFPVLEVVDAYNNNLSGPLPPFGAAHARLRYLHLGGNYFSGAVRESYADLAALEYLGLNGNSLSGQVPASLARLKRLREMYIGYFNLFNGGIPPELGELDSLVRLDMSSCNLTGPIPTELGRLARLDTLFLQMNRLSGEIPTQLGDLKDLKSLDLSMNQLVGEIPAGLANLTSLRLLHLFRNHLHGNIPAFMADLPHLEVLQLWENNLTGHLPAGLGKNSPLKMLDVATNHITGKIPPDLCAGRKLEILVLMENGLSGPVPESLAACKTLKRILLGKNMLSGSVPARLFELPDAGEQA

SEQ ID NO: 23132 - DNA, 624 bp, Panicum virgatum
  misc_feature: Ceres CLONE 1825809
  misc_feature: Encodes the peptide sequence at SEQ ID NO. 23133
taccaaacccaaaacggagaagaagaaaagattatttttcaagaaagcagaaaatccctctcctgcctacgccctgggtgaaattgaggaaggtgttcccggtgctgacgttgagaaggctggaattgtaaatcatcagaagctccaaaagaagtttgggcaatcttctgtatttgttgcatcaacacttcttgagaatggtgggaccttgaaggatgcaagtccagcttctctactgaaggaagctatacatgttatcagctgcggttatgaagacaagactgactgggggaaagagattggctggatttatggatcaattacagaagatatcttgactggatttaagatgcactgccatggttggcggtctatttactgcatcccaaagaggcctgcattcaaaggttctgcacctctgaatctttctgatcgtcttcaccaggtccttcggtgggctcttggatctgttgaaattttcttcagcaagcactgcccactttggtatgggtatggtggtgggctaaaatttttggagaggttctcttatattaactctatcgtatacccctggacatccattccgctgttggcttactgcacattgcctgccatatgcttgct

SEQ ID NO: 23133 - protein, 207 aa, Panicum virgatum
  misc_feature: Ceres CLONE 1825809
  misc_feature: SWISSPROT Homolog: EC 2.4.1.12 Cellulose synthase (UDP-forming)
  misc_feature: The sequence is a functional homolog of SEQ ID NO 26 in US patent 7312377
  misc_feature: Useful for making plants with modulated biomass
  misc_feature: Useful for making plants with altered cell wall content and/or composition
  misc_feature: Useful for making plants with altered carbohydrate content
  misc_feature: The sequence is a functional homolog of SEQ ID NO 6 in US patent 7285702
  misc_feature: The sequence is a functional homolog of SEQ ID NO 2 in US patent 7049481
TKPKTEKKKRLFFKKAENPSPAYALGEIEEGVPGADVEKAGIVNHQKLQKKFGQSSVFVASTLLENGGTLKDASPASLLKEAIHVISCGYEDKTDWGKEIGWIYGSITEDILTGFKMHCHGWRSIYCIPKRPAFKGSAPLNLSDRLHQVLRWALGSVEIFFSKHCPLWYGYGGGLKFLERFSYINSIVYPWTSIPLLAYCTLPAICL

SEQ ID NO: 23134 - DNA, 577 bp, Panicum virgatum
  misc_feature: Ceres CLONE 1825824
  misc_feature: Encodes the peptide sequence at SEQ ID NO. 23135
gtctctctcatctctccttctctacctctcatctctcccccctctcccccggccttatctctgggagactgggagcggaggggcgcccgagcgcccccgccgcgggagggcgcgcgggcgccgggcgccgccgcgggagccgcagagaggggcgcgcgaggcgccgcccccgagggagccgagcgcggcccgccccagccgggcttggccctccgcctctccgctaccttcgtcctggcgggcagcaccccgctgccctggctcctccccggcggcgtcccggcgttcttcccgctgcggcactgctgcgacgtgaggctgtaccaggacgtgcatgtcggggccggccagctgggcggcgagcccgggcggtgctgggaggagctgtgcctggcggtgctgggcgtgcagcacatcgtctacgtggcgggctggtcagcgttcaccagggtccggctgtgcggggtgccatgtcgccggagatggcggccaaggcggccgaggtgagggcgctgggcggcgtggcggtggaggacatgagccctggccacctgctccagtacaagtcccaggaggg

SEQ ID NO: 23135 - protein, 168 aa, Panicum virgatum
  misc_feature: Ceres CLONE 1825824
  misc_feature: SWISSPROT Homolog: EC 3.1.4.4 Phospholipase D
VSLISPSLPLISPPSPPALSLGDWERRGARAPPPREGARAPGAAAGAAERGARGAAPEGAERGPPQPGLALRLSATFVLAGSTPLPWLLPGGVPAFFPLRHCCDVRLYQDVHVGAGQLGGEPGRCWEELCLAVLGVQHIVYVAGWSAFTRVRLCGVPCRRRWRPRRPR

SEQ ID NO: 23136 - DNA, 663 bp, Panicum virgatum
  misc_feature: Ceres CLONE 1825837
  misc_feature: Encodes the peptide sequence at SEQ ID NO. 23137
aaaattaaatccaatggggaactgctgctgcacgggatctgcctccacccctccatttgaatcaaaggtgacaagaaggagcagcacgtcctcctcgtccaacaattcgggtgcgtgtaccaagctcctcaagtccttgagcatcagcgacctccgcgcggcgaccaagaacttcgggcccagctcgtacctgggcgagggcggcttcgggtgcgtgtacaaggggtggatggacgaggcgacgctggccccgaccaggcccggcgtcggccggatggtggccatcaagaagctcaagaaggagagcttccagggccacaaggagtggctggcggaggtcacctacctgggcgagctccaccaccagaacctggtcagcctggtgggctactgctgctccgacgacgtgaacaccagcaagctgctgctggtgtacgagtacatgccgcggggcagcctgaagaaccacctcttccgccggggcacgcagccgctgtcgtggccgatgcgcgtgtccatcgccgtggacgtcgcgcgcggcatctccttcctgcacgcccaggacaaccccgtcatcttccgtgacctcaagtccctcaatgtcctcctcgacgccgatttccgggccaagctgtctgatttcgggctcgccagggacgggcc

SEQ ID NO: 23137 - protein, 216 aa, Panicum virgatum
  misc_feature: Ceres CLONE 1825837
  misc_feature (42)..(216): Pfam Name: Pkinase_Tyr Pfam Description: Protein tyrosine kinase
  misc_feature: SWISSPROT Homolog: EC 2.7.11.1 Non-specific serine/threonine protein kinase
  misc_feature: Useful for making plants with modulated drought sensitivity
  misc_feature: Useful for making plants with modulated heat sensitivity
MGNCCCTGSASTPPFESKVTRRSSTSSSSNNSGACTKLLKSLSISDLRAATKNFGPSSYLGEGGFGCVYKGWMDEATLAPTRPGVGRMVAIKKLKKESFQGHKEWLAEVTYLGELHHQNLVSLVGYCCSDDVNTSKLLLVYEYMPRGSLKNHLFRRGTQPLSWPMRVSIAVDVARGISFLHAQDNPVIFRDLKSLNVLLDADFRAKLSDFGLARDG

SEQ ID NO: 23138 - DNA, 684 bp, Panicum virgatum
  misc_feature: Ceres CLONE 1825841
  misc_feature: Encodes the peptide sequence at SEQ ID NO. 23139
aagtctttccgctgtcacagaatggcgtcctgctccgtcttcaccccaccggcgctctcagcgtcggcgccgtccggccacggccgtcagcgcgcgaccgcggccgtatgtctccccggtgttcgcggcagccggcccgcgtcccgcggcgtgcggtgcagcgccgggcagggcggcgtcaaggtcccggcgaagctgtcggagctgtgggccgcggcgaaggacgcgcctacgctggccgtgctcgcgggcgtggccgcggcggtggcgatctacaaggttgggtccggtctcctcgcgccgcgccctccgccgccgcgtcgggtggagacccagacggccccaccgcctccggtgccggagccggtgcaggtgggtgagataacggaggaggagctgcggcagtacgacgggtccgaccccgagaagccgctgctgatggccatcaaggggcagatctacgacgtctcccagagcataatgttctatggacctggtggggcatatgcattgtttgctggaaaagatgccagcagggcattggccaagatgtccttcgaacagcaggatctaaatggtgatatatctgaccttacacctatggagctcggttccttgaacgactgagagtacaagttcaccagtaagtatgtgaaggtaggaaccgtaagaggggcagcgcct

SEQ ID NO: 23139 - protein, 201 aa, Panicum virgatum
  misc_feature: Ceres CLONE 1825841
  misc_feature (120)..(197): Pfam Name: Cyt-b5 Pfam Description: Cytochrome b5-like Heme/Steroid binding domain
  misc_feature: Useful for making plants with modulated nitrogen use efficiency
MASCSVFTPPALSASAPSGHGRQRATAAVCLPGVRGSRPASRGVRCSAGQGGVKVPAKLSELWAAAKDAPTLAVLAGVAAAVAIYKVGSGLLAPRPPPPRRVETQTAPPPPVPEPVQVGEITEEELRQYDGSDPEKPLLMAIKGQIYDVSQSIMFYGPGGAYALFAGKDASRALAKMSFEQQDLNGDISDLTPMELGSLND

SEQ ID NO: 23140 - DNA, 624 bp, Panicum virgatum
  misc_feature: Ceres CLONE 1825860
  misc_feature: Encodes the peptide sequence at SEQ ID NO. 23141
gcccaaaacgggggagaaggggacgggggcgggggcggcagtcaggctctcaatccttcatcgaccgaaacagagtgtggagggtcagaccgacaggccatggagagctcgccgcccaccatcaccgtccaggtcaagttcgcccggcggaccatccccgtggaggtaccggccgccgcgaccaccgcggagctgaagcgcctcctccagccgctcaccaacgtcctcccccgcggccagaggcttgtctgcaaaggcaaagtgctccaggatgccgcgagcctgagctcgatgcaggtggtagacggatccaaggtcatgctcatcgcctcgctgggtctccatcagggggcagtgccggaagaagtctgggactgtgccccctcagtacggatattagatgccagcaacaactgtatcaaggaaattccgcataaaattgctgctcttaaatctttaaataaattgctcctaactgccaatgatgtagatgatgagaacatcagctgggaaggtctatcatgccttcaaaaattattaaatctgtctttaagccagaaccgactggttagcttgccatcgacattgggctcactgacttctctgcgcgaatttcgtattgca

SEQ ID NO: 23141 - protein, 174 aa, Panicum virgatum
  misc_feature: Ceres CLONE 1825860
  misc_feature (11)..(80): Pfam Name: ubiquitin Pfam Description: Ubiquitin family
  misc_feature: SWISSPROT Homolog: EC 3.1.2.15 Ubiquitin thiolesterase
MESSPPTITVQVKFARRTIPVEVPAAATTAELKRLLQPLTNVLPRGQRLVCKGKVLQDAASLSSMQVVDGSKVMLIASLGLHQGAVPEEVWDCAPSVRILDASNNCIKEIPHKIAALKSLNKLLLTANDVDDENISWEGLSCLQKLLNLSLSQNRLVSLPSTLGSLTSLREFRI

SEQ ID NO: 23142 - DNA, 1170 bp, Panicum virgatum
  misc_feature: Ceres CLONE 1825864
  misc_feature: Encodes the peptide sequence at SEQ ID NO. 23143
atcatcacccgccgccgccgccgccgccgccgacatagccgaagcaccagcgcttgagcgtagttcaggagcgaggattggagtgatgtccgctgaggaggctgccgctgccgcgaccgaggtccccgagaccgaggtcgagtccgaggccccggccgccgaggaggcggaggccaagcccgccaaggccaagaaggcgccgaaggagaagaaggcgcccaaggagaagaaggcccccaaggagaagaaggagaagaagcccgccgcggcgaggaagacggccgcccacccgccgtacgccgagatgatctcggaggcgatcgcggcgctcaaggagaggaccgggtcgagctcggtggccatcggcaagtacgtggaggagaagcacggcgcgaagctgccgcccaacttccgcaagctgctggccgggcagctcaagaagctcgccgccgcggggaagctgacccgcgtcaagaactcgttcaagctgccggccgccgccgacgccaagcccaaggcggccaagcccgccgccgcggccaagccgaagccagccaaggccgccaagcccgcggtcaagcccaaggcgtccccgaaggccaaggccaagatcgccgccaagaccaagacggccgccgcctcccccaagcccaaggccaaggccgcccccgccgcggcgcccaggccccgcggccgcccgcccaaggccgccaagacctccgccaaggcctcccccgccaaagccgccgccaagaaggagaagcccgccgccgctgctaagaaggagaagaaggccgcggcgatgcccaagaagggtgccgcggcacccaagaaggccgccgcatccccggccaggaagggcgcggcgaggaaggccaagaagtaggccgcctccctcccgtccgtcctcgtcgccggcgagcccgccattccgcctatagatgctcccccttctccctggattttgcaatccattcgtcgtagcttcatcgtctggaaatgaaaatgaaatcggtgcctagctctagcagatccgtcggtagtagcatcagcagtagtcgttctgtaaaatcttgaggtgccggtcgcgtcccgtcccgtcccatcgatcggcatgctcctctctcttgcctgtatgatgaactgagttattattataccagtaatgtc

SEQ ID NO: 23143 - protein, 266 aa, Panicum virgatum
  misc_feature: Ceres CLONE 1825864
  misc_feature (67)..(137): Pfam Name: Linker_histone Pfam Description: linker histone H1 and H5 family
MSAEEAAAAATEVPETEVESEAPAAEEAEAKPAKAKKAPKEKKAPKEKKAPKEKKEKKPAAARKTAAHPPYAEMISEAIAALKERTGSSSVAIGKYVEEKHGAKLPPNFRKLLAGQLKKLAAAGKLTRVKNSFKLPAAADAKPKAAKPAAAAKPKPAKAAKPAVKPKASPKAKAKIAAKTKTAAASPKPKAKAAPAAAPRPRGRPPKAAKTSAKASPAKAAAKKEKPAAAAKKEKKAAAMPKKGAAAPKKAAASPARKGAARKAKK

SEQ ID NO: 23144 - DNA, 637 bp, Panicum virgatum
  misc_feature: Ceres CLONE 1825875
  misc_feature: Encodes the peptide sequence at SEQ ID NO. 23145
accgaccccctccccacccccaccacacacaatggcggcggcagctgcggcggcgacctcctcctccccctccgcccgctgggaaaggaccagaaccagatcctgggcctggtccgcccgcccttcgctcgtctccctccgctccggagccctgctcagggtccgcgccgccgccgaacccgccccggccttccagtccgtgacggccttcgcgcccgccaccgtggccaacctcggcccgggcttcgacttcctcggttgcgccgtcgccgacgcctccctctccctcggcgacacgctgacggtcaccctggacccaaccctgccccccggcaccgtctccatcgcctccgtcacctccccgtcccgcccccacctcgccgcccgcctctccaaggacccgctccgtaactgcgcgggcgtggccgccatcgcggcgctccgcgccctcggcgtccggtcacacgccgtgtccatccagctgaccaagggcctgccgctgggctcgggcctgggctcctccgcggcttccgccgctgccgccgccaaggccgtggacgccctcttcgggtcgcgcctcaggcgcgacgacctcgtcctggcgggcctcgagtccgagaaggccgtcatcggcttc

SEQ ID NO: 23145 - protein, 201 aa, Panicum virgatum
  misc_feature: Ceres CLONE 1825875
  misc_feature (148)..(201): Pfam Name: GHMP_kinases_N Pfam Description: GHMP kinases N terminal domain
MAAAAAAATSSSPSARWERTRTRSWAWSARPSLVSLRSGALLRVRAAAEPAPAFQSVTAFAPATVANLGPGFDFLGCAVADASLSLGDTLTVTLDPTLPPGTVSIASVTSPSRPHLAARLSKDPLRNCAGVAAIAALRALGVRSHAVSIQLTKGLPLGSGLGSSAASAAAAAKAVDALFGSRLRRDDLVLAGLESEKAVIG

SEQ ID NO: 23146 - DNA, 325 bp, Panicum virgatum
  misc_feature: Ceres CLONE 1825905
  misc_feature: Encodes the peptide sequence at SEQ ID NO. 23147
agtctttactgctcccatccatcgcatctaccacccaaacccaagcaatggcttcctccacccagggtcaggtcatcacctgcaaagcggcggtggcgtacgagccgaacaagccgctcgtgatcgaggacgtgcaggtggcgccgccgcaggccggcgaggtccgcatcaaaatcttctccaccgcgctctgccacaccgaccactacacctggagtggaaaggaccctgagggtctcttcccctgcattcttggccacgaagctgctggagttgttgaaagtgtcggtgaaggagtaactgatgtgcagcctggggatcatgt

SEQ ID NO: 23147 - protein, 92 aa, Panicum virgatum
  misc_feature: Ceres CLONE 1825905
  misc_feature (36)..(92): Pfam Name: ADH_N Pfam Description: Alcohol dehydrogenase GroES-like domain
  misc_feature: SWISSPROT Homolog: EC 1.1.1.284 S-(hydroxymethyl)glutathione dehydrogenase
  misc_feature: Useful for making plants with modulated heat sensitivity
MASSTQGQVITCKAAVAYEPNKPLVIEDVQVAPPQAGEVRIKIFSTALCHTDHYTWSGKDPEGLFPCILGHEAAGVVESVGEGVTDVQPGDH

SEQ ID NO: 23148 - DNA, 610 bp, Panicum virgatum
  misc_feature: Ceres CLONE 1825913
  misc_feature: Encodes the peptide sequence at SEQ ID NO. 23149
gggacttgggagccgtactcctcccttttgcttgcctccccaccagcggaaagaagaggccagggaggtagaaagggggaggaaagaggaggcggagagggggaggaagggggaagcaaatctttgaggggagtcgagagatccctgtggtggaggaggagaagcgcgagcggagcgtagggaggcagctcaatagatctacgaccgcttatgtgagttgatgccaagctgagttggcattggtgtagccctgtcttcttgagcgatggcatcagcaggtgtagctccggctgggtgcaagaacagcagccgcacaagccttggtgctgataagttgcaggatcccatgaacgagctaaagattagagatgataaggaagttgaagtcaccataattaatgggaaaggtacagaaactgggcacataattgtgactactactggtggaaagaatggtctaccaaagcagacagtgagctacttggctgaacgcattgtaggtcaaggttcttttgggattgtcttccaggctaaatgcttggagacgggtgagactgttgccataaagaaggtccttcaggataaacgttacaagaaccgtgagctgcca

SEQ ID NO: 23149 - protein, 114 aa, Panicum virgatum
  misc_feature: Ceres CLONE 1825913
  misc_feature: SWISSPROT Homolog: EC 2.7.11.1 Non-specific serine/threonine protein kinase
  misc_feature: Useful for making plants with modulated water use efficiency
  misc_feature: Useful for making plants with modulated biomass
MASAGVAPAGCKNSSRTSLGADKLQDPMNELKIRDDKEVEVTIINGKGTETGHIIVTTTGGKNGLPKQTVSYLAERIVGQGSFGIVFQAKCLETGETVAIKKVLQDKRYKNREL

SEQ ID NO: 23150 - DNA, 692 bp, Panicum virgatum
  misc_feature: Ceres CLONE 1825918
  misc_feature: Encodes the peptide sequence at SEQ ID NO. 23151
gaccgacttgctctgcctttccccagcagagagagagagagagagagagagagagagagagagagaggagcgatggcgccgcggaagctgtacgggatgcccctgtcggcgaacgtgatacgcgttgcccccgtgctcaacgagaagggcctcgacttcgagatcgtccccgtcgacctccgcaccggcgcccacaagaacccggaattcctcgccctcaacgtacgcccgctcccttcaattcggcttccgttgcttttcggccagatcctcatgtgctgttgttccctcctcgcagcctttcggccagatccctgcgctggaggacggagatgaagttctctacggtatgtaactgacggacatcgctgctcgttcaccgctcagttgtttactagtagttgatagttccccctcgcaattgattaatgattattatcagctcacactcgccatttcaaatgaaccactagatcctgatctaggaacagtatctccgttgtaccttactactagttccgtgattattttttaaaaaaatgagcctaatgcttgctagttgactactagtactttgatgattctctctgtctggtgaaaaattggtcgaaatgagatcgaattcatcttactgtccccaactcccacctttgttgacctgacgtctgcatcgaatcgagtcacccaaagcc

SEQ ID NO: 23151 - protein, 87 aa, Panicum virgatum
  misc_feature: Ceres CLONE 1825918
  misc_feature: SWISSPROT Homolog: EC 2.5.1.18 Glutathione transferase
MAPRKLYGMPLSANVIRVAPVLNEKGLDFEIVPVDLRTGAHKNPEFLALNVRPLPSIRLPLLFGQILMCCCSLLAAFRPDPCAGGRR

SEQ ID NO: 23152 - DNA, 608 bp, Panicum virgatum
  misc_feature: Ceres CLONE 1825926
  misc_feature: Encodes the peptide sequence at SEQ ID NO. 23153
tcgccgccgccgcagcctccccctcccgcgcattccctcgagcgccccgcctccatgccgggggccggggacgcggccgcctcgccgcggcggcgggcgcgtccgggcccgggcccgggccttcgtcgccggagccgtaccccccggagtccgacgacgggctggtggagctcccgctgttcccgctcccgctcgtgctcttcccggacgccacccacgcgctgcacatcttccagttccgctaccgcatcatgatgcacacggtgctgcagaccgacctccgcttcggcgtcgtcttcgccggctccggcggctcggccgccgaggtgggatgcgtcggcgtggtcgtcaagcacgagcgcctcgccgacgaccggttcttcctcatctgcaagggccagcagcggttccgcgtcgcccgcgtcgtgcgcaccaagccctacctcgtcgccgccgtgcagtggctcgaggaccgcccgcccgccgaggccccggcccccggggaggacgccgaggcgctcgccgccgacgtcgaggccctcatgcgggacgtcatacgcatcgccaaccgcctcaacgggaagcccgagaaggaggtgggcgacctg

SEQ ID NO: 23153 - protein, 201 aa, Panicum virgatum
  misc_feature: Ceres CLONE 1825926
  misc_feature (56)..(197): Pfam Name: LON Pfam Description: ATP-dependent protease La (LON) domain
AAAAASPSRAFPRAPRLHAGGRGRGRLAAAAGASGPGPGPSSPEPYPPESDDGLVELPLFPLPLVLFPDATHALHIFQFRYRIMMHTVLQTDLRFGVVFAGSGGSAAEVGCVGVVVKHERLADDRFFLICKGQQRFRVARVVRTKPYLVAAVQWLEDRPPAEAPAPGEDAEALAADVEALMRDVIRIANRLNGKPEKEVGD

SEQ ID NO: 23154 - DNA, 1203 bp, Panicum virgatum
  misc_feature: Ceres CLONE 1825955
  misc_feature: Encodes the peptide sequence at SEQ ID NO. 23155
agctagaaatccaccgtccctcagcacccgtttgtccttacatggccggggctagacgtcgtagcagccctctctcccgcacgcgcattccgaactcccgcttccaactcctccccagatcgccgcttctccactagagccgagccgatcgatggatcacgagcagcggcgccagcgcagttccaggggcaatgctcccgggagcgggagcggcggcgcgttgtctgggaagcacaagggtggaggcggcaagggcgggggcaggaagcagatcaaggtggtgtacatctccaaccccatgcgcgtcaagaccagcgccgcgggcttccgcgccctcgtgcaggagctcaccggccgcgacgccgacccctcaaagtacagccccgacgagctcggcggcgtgggtggcgcgggcgccgaggacgccaccgcggccgctgatctcgactgcggcaccgcgcatgggctcatgctcagccccaggggtgcggtcgcgtcggcgtgcgacaccgtcgtcgccagcccgagccctgccgcggcggaccaccatcccgacgccgccgccgcggccgcgccgtacggcggggactacgacgacgacctggaggaagaggacgggttcaggtcgcagccgcttctggagaacaactacgcagtgttctcgccgccgacgctgctctacgaccaccacccgcacagcaagtacccattctgttagccgcagaagcagttctgacgcgagaggtgcgtcttgaatttttactacacaaatactgggatgaatccgtaggtgatgatggtccgcatgcaactgctcatcaggatcttcattcgcagaaggatgtgaatatatgcgggggtctggtgatcagcaattggtcgtgttatttgttgccggtcgtagcaggagtgttagggctgcgtaggaatgtctctggtgcttgtccccgcggtgtcgtttggttgataagctgatggctcggctctctgagcttttagtaatcaaccagatttgtctatgtggattcactgacgaaaagataaaaggtcgcagacatgggaacatcctcagatgaagggagctaacaactactgttgatgtatcttctcaatagttgtgctgatgatcgtactctacttttccatgcatgtttaaaagttatgagtcgctgggaggttcagaagctgatcaatgttgggctg

SEQ ID NO: 23155 - protein, 188 aa, Panicum virgatum
  misc_feature: Ceres CLONE 1825955
  misc_feature (45)..(75): Pfam Name: VQ Pfam Description: VQ motif
MDHEQRRQRSSRGNAPGSGSGGALSGKHKGGGGKGGGRKQIKVVYISNPMRVKTSAAGFRALVQELTGRDADPSKYSPDELGGVGGAGAEDATAAADLDCGTAHGLMLSPRGAVASACDTVVASPSPAAADHHPDAAAAAAPYGGDYDDDLEEEDGFRSQPLLENNYAVFSPPTLLYDHHPHSKYPFC

SEQ ID NO: 23156 - DNA, 656 bp, Panicum virgatum
  misc_feature: Ceres CLONE 1825956
  misc_feature: Encodes the peptide sequence at SEQ ID NO. 23157
agagctcgcgtcgcgtggcgcgtgcgcgtgcgggggcggagcagcacagcgccgcactaccctcgcgcgtcgctcgcgcgcgcgcgttctcgatggccgacggcgagccttccctcacgcgctggaccttcgaggacttccaggcctactacgaggcgcgcctcggcgtccgccgcgagcccgcggaagacggcgacgatggtccccagccgcgcggatccgaccacctggccggcagcccctccatgccacgcgccaacggcggcgcggacctcgccgtcttcgagcagttcgagcggatggtgctggagaggaaggtggaggcgcgcaatggggctatagaggatgggccgccgctgaaacctctacttccttcatttgaatctgcagaaatgcgtaacttagctgagacattgttgagggatataattcgtgggagcccagatgtcaagtgggaaagcataaaaggtctggagaatgcaaagcggctcctcaaagaagcagttgtcatgcccattaaatatcccaagtacttcacaggcctattatcaccttggaaaggtatattattatttggtccacccggaacaggaaagacgatgcttgcaaaagctgtggctactgaatgcaaaactacctttttcaatatttctgcc

SEQ ID NO: 23157 - protein, 187 aa, Panicum virgatum
  misc_feature: Ceres CLONE 1825956
  misc_feature: SWISSPROT Homolog: EC 3.6.4.3 Microtubule-severing ATPase
MADGEPSLTRWTFEDFQAYYEARLGVRREPAEDGDDGPQPRGSDHLAGSPSMPRANGGADLAVFEQFERMVLERKVEARNGAIEDGPPLKPLLPSFESAEMRNLAETLLRDIIRGSPDVKWESIKGLENAKRLLKEAVVMPIKYPKYFTGLLSPWKGILLFGPPGTGKTMLAKAVATECKTTFFNIS

SEQ ID NO: 23158 - DNA, 669 bp, Panicum virgatum
  misc_feature: Ceres CLONE 1825961
  misc_feature: Encodes the peptide sequence at SEQ ID NO. 23159
atcccaaccggactagcttgggtcagcttcagcaaccccatcccatggctgctccaccgctccctgccctcgtcctcctcctcgtcgccatcccactctcagccgcggcagtggtattccccacggaagccctgccgacgaaatcgggctacctcccaatctcgcccgccaacgcctcgctcttcttcgccttctacgaggccacccaaccgctagccgcgccggcctccacgccgctcctcctctggctgcagggcgggcctggctgctccggcctcatcggcaacttcttcgagctcggcccctacttcgtcagccccgacaccgtctccctctcgcgcaaccccttcgcgtggaaccgccgcttcgggctcctcttcatcgacagcccgctcggcacgggcttcagcaccgcgctgtcccccgccgacatccccaccaaccagtccgtcgtcgccgcgcacatccttgccgcgctgcagtcgttcctcgccctggagcccagcttccgcgcgcggccgttcttcatcaccggcgagagctacgccggcaagtacgtccccgcggcgggggcgcacatcctggacgtgaacccgacgctgccggaggcgcttcgggtcaacctccgcggcgtggccatcggcaacgggctcacgcaccccgtcgcgc

SEQ ID NO: 23159 - protein, 208 aa, Panicum virgatum
  misc_feature: Ceres CLONE 1825961
  misc_feature (26)..(208): Pfam Name: Peptidase_S10 Pfam Description: Serine carboxypeptidase
  misc_feature: SWISSPROT Homolog: EC 3.4.16.5 Carboxypeptidase C
MAAPPLPALVLLLVAIPLSAAAVVFPTEALPTKSGYLPISPANASLFFAFYEATQPLAAPASTPLLLWLQGGPGCSGLIGNFFELGPYFVSPDTVSLSRNPFAWNRRFGLLFIDSPLGTGFSTALSPADIPTNQSVVAAHILAALQSFLALEPSFRARPFFITGESYAGKYVPAAGAHILDVNPTLPEALRVNLRGVAIGNGLTHPVA

SEQ ID NO: 23160 - DNA, 1064 bp, Panicum virgatum
  misc_feature: Ceres CLONE 1825965
  misc_feature: Encodes the peptide sequence at SEQ ID NO. 23161
aatacttgtcttcttcttctctctcccctcacccacccacccgagatctccccctctgtcttatcgcgccggttctctctctacctctttgatccggcaatggccgcccccgctcctgccaccaccggcgagctgctacgcatcgaccctctcgagctccgcttcccattcgagttgaagaagcagatctcgtgctccatgcagctgtcgaatctcagcaacgactacatcgccttcaaggtgaaaactacaagtccaaagaagtattcagtgcgaccaaacacgggggttgtcttgccacggtctacttgcgatgtcgttgtgacaatgcaagcacaacgggagacccctcctgacatgcagtgcaaagataagttcttagtccaaagcatcgttgcacctgctggtattactgtgaaggatgtcacaggggagatgtttacgaaggagtcagagaataagatggaagaggtcaaattgcgagtgacctatgttgctcctccacagccaccctctccagttccggaggaatctgaagaaggttctccatctagggcttctgaatcagaaaatggagatggccctgctggaggattcaccagagcactgagagagcgcattgatcctcaagaaaaatctttagaggctggagctttgatttccaaactaactgaagaaaagaactctgcgattcaacagaataatagacttagacaggaacttgatttggttagacgggagatcagcaagaggcgaggaggaggcttctcctttatcgttgtcataattgttgctttgatcggcatattcctgggctatctgatgaagtcataattctttcagccatatcaaagacattcatgcaagtaatgtttgggaactcaaaaagaccattcaagtcagatgtcttgaagttctccttcctgttttgtcgatataggagtgcgtatgtgatgaatgctgagccagtttaagcttttcatcttttgttgttattttccgttgggtgagtcgtgcgcattgctgacactgtaacttggaaaaatgcatggattgcttttgtc

SEQ ID NO: 23161 - protein, 244 aa, Panicum virgatum
  misc_feature: Ceres CLONE 1825965
  misc_feature (12)..(119): Pfam Name: Motile_Sperm Pfam Description: MSP (Major sperm protein) domain
MAAPAPATTGELLRIDPLELRFPFELKKQISCSMQLSNLSNDYIAFKVKTTSPKKYSVRPNTGVVLPRSTCDVVVTMQAQRETPPDMQCKDKFLVQSIVAPAGITVKDVTGEMFTKESENKMEEVKLRVTYVAPPQPPSPVPEESEEGSPSRASESENGDGPAGGFTRALRERIDPQEKSLEAGALISKLTEEKNSAIQQNNRLRQELDLVRREISKRRGGGFSFIVVIIVALIGIFLGYLMKS

SEQ ID NO: 23162 - DNA, 633 bp, Panicum virgatum
  misc_feature: Ceres CLONE 1826000
  misc_feature: Encodes the peptide sequence at SEQ ID NO. 23163
gcctccaccgcacacccacacaccaaccggcaggcaccgcaccagcagcaccgcccaccaccatggccgccgcctcgccgcgcctcgccatcctgctggcgctcctggcggcgtcgtcggcgctggccgcggcgcagaaggccaaggcgaagccggcgcccgggccggccggggcggcggacgcggccccgccgacggacgtgaacaaggcgctcaaggacgaccagttcagcgagttcaagcagctgctccacgacacgcgcgtggacacccagatcaacgcgcagctgacggacagctacaacgggctgaccatcttcgcgcccaccaacgctgccttcgacaagctcaaggccggcgtgctcaacgggctgtcgccacaggaccagatccagctggtgctctactgcgtgctccccaggttctacagcctctccatgctcggcaccctcgacggcaaggtcaacacgcagggctccggccacgacggcccctacaagtacgacatcaagcgcgcgggcaacaacgtcaacgtctccaccggcgtcaactccatgctcctggggagccccgtgagcaaggacttcccgctccccgtctaccccgtccacaaggtgccgctccccgtaccag

SEQ ID NO: 23163 - protein, 190 aa, Panicum virgatum
  misc_feature: Ceres CLONE 1826000
  misc_feature (55)..(188): Pfam Name: Fasciclin Pfam Description: Fasciclin domain
  misc_feature: Useful for making plants with altered carbohydrate content
MAAASPRLAILLALLAASSALAAAQKAKAKPAPGPAGAADAAPPTDVNKALKDDQFSEFKQLLHDTRVDTQINAQLTDSYNGLTIFAPTNAAFDKLKAGVLNGLSPQDQIQLVLYCVLPRFYSLSMLGTLDGKVNTQGSGHDGPYKYDIKRAGNNVNVSTGVNSMLLGSPVSKDFPLPVYPVHKVPLPVP

SEQ ID NO: 23164 - DNA, 510 bp, Panicum virgatum
  misc_feature: Ceres CLONE 1826003
  misc_feature: Encodes the peptide sequence at SEQ ID NO. 23165
gttgatcccctccatttcccatcccccgcgcttgtcatcgttgccctcgccgccgccgtgcccagagactgggaccttcaaagagcaaccggactcatggaggctggagacgcaagaaaccgttctcgcgcagcggcccagataaagggaagtggggatgatgcctcctgcaaaccgctgcctccttgctgcgtcaaggccaacgcaggcgtgcctgaagctgacgcccagtgccatgataccgttgtttcgggctggttcactgaaccccggtcacgcttccgcaaaacaagcaaactgcagtactaccacaaccctatgtggcctgcagaggctcactcactgaacgtggacaagattttgtaccaacggaaatcgccctaccaagagattttagtttttgagtcttcaacctatggacacgttcttgtgcttgatggtatagttcagcttgactgaccaggatgaacgcgcataccaggaaatggttactcaccttcccctgtgctc

SEQ ID NO: 23165 - protein, 120 aa, Panicum virgatum
  misc_feature: Ceres CLONE 1826003
  misc_feature: SWISSPROT Homolog: EC 2.5.1.16 Spermidine synthase
MEAGDARNRSRAAAQIKGSGDDASCKPLPPCCVKANAGVPEADAQCHDTVVSGWFTEPRSRFRKTSKLQYYHNPMWPAEAHSLNVDKILYQRKSPYQEILVFESSTYGHVLVLDGIVQLD

SEQ ID NO: 23166 - DNA, 566 bp, Panicum virgatum
  misc_feature: Ceres CLONE 1826030
  misc_feature: Encodes the peptide sequence at SEQ ID NO. 23167
atcccccccagttccccatctctccatttccccaatcccccagaagacccgagcagagaagttccctccgatcgccttgcccagatgccgatctttgtgaagaccctccctggccagactatcccccttgaggtggagtcttctgacccaattgacaatgtcaaggcaaagatccaggacaaggaagggattcctccagaccagcagcgccttatcttcgctggcaagcagcttgaggatggccgtacacttgcagattacaacattcagaaggagtccacactgcaccttgtcctcaggctgcgtggaggcatgcagattttcgtgaagaccctcactggcaagacgatcaccctggaggtggagtcatctgacaccatcgacaatgtgaaggcaaagatccaggacaaggagggcatcccccctgaccagcagcgcctcatctttgcaggcaagcagttggaggatgggcgaactctggctgactataatatccagaaagagtccacccttcacctcgtcctccgcctgcgaggtggcatgcagatctttgtgaagacgctgac

SEQ ID NO: 23167 - protein, 160 aa, Panicum virgatum
  misc_feature: Ceres CLONE 1826030
  misc_feature (82)..(150): Pfam Name: ubiquitin Pfam Description: Ubiquitin family
  misc_feature (6)..(74): Pfam Name: ubiquitin Pfam Description: Ubiquitin family
  misc_feature: Useful for making plants with modulated nitrogen use efficiency
  misc_feature: Useful for making plants with modulated cold sensitivity
  misc_feature: Useful for making plants with modulated flowering time
MPIFVKTLPGQTIPLEVESSDPIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTL

SEQ ID NO: 23168 - DNA, 450 bp, Panicum virgatum
  misc_feature: Ceres CLONE 1826042
  misc_feature: Encodes the peptide sequence at SEQ ID NO. 23169
attgccatgctatctccgcccccaggagactgaagtctctgagttccccttctttcctccggcacttctctcttttgatttttccttcttttttacctttcccctaatttccccctgttcttctggatcttaaacgagtatgcagaacttggacaagaactgcagggtttgcatggagtggcaagagcattgctactggagccacatgactgatgaccagaaacacttcttcaagcctatggttggggacttcactgaaaccatgagcatacctggcagattcgcaaacaatttcaacggccacatctcggaggtcgtcagtttgaagtccccaggtggcgaaacatggagcattcgagtaggcaacaatgccaatgacgaggtaatgctccagtctggctggaaagagttcgtcagtgctcacagcatcgaggaaggagactacctgct

SEQ ID NO: 23169 - protein, 103 aa, Panicum virgatum
  misc_feature: Ceres CLONE 1826042
  misc_feature (29)..(102): Pfam Name: B3 Pfam Description: B3 DNA binding domain
MQNLDKNCRVCMEWQEHCYWSHMTDDQKHFFKPMVGDFTETMSIPGRFANNFNGHISEVVSLKSPGGETWSIRVGNNANDEVMLQSGWKEFVSAHSIEEGDYL

SEQ ID NO: 23170 - DNA, 680 bp, Panicum virgatum
  misc_feature: Ceres CLONE 1826054
  misc_feature: Encodes the peptide sequence at SEQ ID NO. 23171
cgatcccaaagcccaagccagtcccccccgtccaagaaccagttccagtagctttgctgatctgttctgctgtttttagtttggaaagcctttagttccggcgatcatggaggacgagaggaaccccccgcccccccaggtcggcgaggcccaggagaaggccgccgatccggtggaggtgaaggacaggggcctcctggacactcttctcggcaggaagaagcccgaggaacaccaggaggaggagctggtgaccggcatggagaaggtcacggtggccgagccccagaagcacggcgagcacaaggaggagcacgagaccggggagaagaaggagagcctcctcgccaagttgcaccgcaccagctccagctccagctcgtcgagcgacgaggaagaggaggtgatcgacgagaacggagagattgtcaagaggaagaagaagaagggcctcaaggagaagatcaaggagaagctacccggccacaaggaccacgccgagggcgaccaccacacggccgtgccggccccggcgcccccgcccgtgggaacgcacgcttacaaggaggacgagcacaagccgtacgtgccggccccggctcccccgcccgcggtggagacgcacgccaccaccaccaccacgccgtcgtcgtccagaaggtccaggaccactccccccc

SEQ ID NO: 23171 - protein, 191 aa, Panicum virgatum
  misc_feature: Ceres CLONE 1826054
  misc_feature (37)..(157): Pfam Name: Dehydrin Pfam Description: Dehydrin
MEDERNPPPPQVGEAQEKAADPVEVKDRGLLDTLLGRKKPEEHQEEELVTGMEKVTVAEPQKHGEHKEEHETGEKKESLLAKLHRTSSSSSSSSDEEEEVIDENGEIVKRKKKKGLKEKIKEKLPGHKDHAEGDHHTAVPAPAPPPVGTHAYKEDEHKPYVPAPAPPPAVETHATTTTTPSSSRRSRTTPP

SEQ ID NO: 23172 - DNA, 557 bp, Panicum virgatum
  misc_feature: Ceres CLONE 1826058
  misc_feature: Encodes the peptide sequence at SEQ ID NO. 23173
cgctcccttccccccaactctaatgatagcctagagagaagacctacctcccggctcccggagctcgcggagaccgtgggcggagagcttcctcgctgcccccctacttccctggagatccgccccctcccatggaggagatccccccccagtacttcggagttggcgcaagcggccccggcccgccccaccacctgtggggatcctccctcagcgccgtcgtcgcgccgccgccgccgcagccgcggagcgcggggctgccgctcaccctgaacacggctgccaccgtgaacagcggcgccaacggcggcaacccggtgctgcagcttgccaacggcggcagcctcctcgacgcgtgcatcaaggcgaaggagccctcgtcgtcgtcgccctacgccggcgacgtcgaggccatcaaggccaagatcatgtcccacccgcactactactcgctcctcgccgcctacctcgagtgccagaaggtgggggcgccgccggaggtgtcggcgaggctggcggcgatgacgcaggagctggaagcccggcagcgcacggcg

SEQ ID NO: 23173 - protein, 141 aa, Panicum virgatum
  misc_feature: Ceres CLONE 1826058
  misc_feature (93)..(137): Pfam Name: KNOX1 Pfam Description: KNOX1 domain
  misc_feature: Useful for biocontainment applications
  misc_feature: Useful for making plants with modulated biomass
MEEIPPQYFGVGASGPGPPHHLWGSSLSAVVAPPPPQPRSAGLPLTLNTAATVNSGANGGNPVLQLANGGSLLDACIKAKEPSSSSPYAGDVEAIKAKIMSHPHYYSLLAAYLECQKVGAPPEVSARLAAMTQELEARQRT

SEQ ID NO: 23174 - DNA, 1283 bp, Panicum virgatum
  misc_feature: Ceres CLONE 1826062
  misc_feature: Encodes the peptide sequence at SEQ ID NO. 23175
ggggccaccggtgacgcttctctccctcctccccgccggctcggggcctgttcatcccaagctcccacgcctactgcctacatcgagcccccgctcccagcgcccggcgcgcgcgccgtctgggtccaggccgccttccacagaagcgcggcgcggcgcccacctcggaggaagtcgcctcctcgccttcccttccgcccctctactttgctgccgccaagtggagacccgccaggaatcggatcggctttcttgggtatatttggagtgttgttcgcaaggctctgagatggctgatggcgattcatctgacttcaccttctgcaaggttagttctgaagaaaatgacggacaattaggatctcctaaagccattcctgtggcaagtatgtcgctcgaggatgttcatgttgatcgtgcgaaaactgcaaagagtgatggcttgaaagccaatgactcagataaagataggtctggtaacagtgctagtgtttcaatacaagacagcaacatgaaagaaccaattacacaaacaagtggtggagcagaatcaaatgtgtcgtcacaggcaaaaccttcatcgaagaaacctgcagtacggaaaaaggttcctttcgagaagggctatagccaaatggattggttaaagctgacacgaacacatcctgatctagctgggctcaaggggcagtcaaatcgaaggttaatttctttggaagaagttaagcagcataaaactggagattgcatttggacagttctcaaaggccgtgtttataatattgctccatacatgaaatttcatcctggaggagttgatatgcttatgaaagctgctggaaaggactgcactgctttgttcaataaataccatgcttgggtaaatgcagagttccttttggagaagtgccttgtcggattccttgaccccaacgagtagatctcaaggttcacgccattgtggcattttaccacttctgcactactggactatttgtattaggcacactagtcgatgaattaaagaatgtaaatgttctattgtatcacaatgagagtacaataattcatttcgttcaaaaaagaaagagaaagaaataagcttagtgtctgttcgtccttgtagatgtgagaaaatccagggatatactggtatgttaatgagatgcgaggtaaattgcaacaaacagtcagaatgaggccattggccaagcccttgctcctgcagaattgaagttattgtggttgcatgatcatgtctataaacaaaacaagtggttttc

SEQ ID NO: 23175 - protein, 216 aa, Panicum virgatum
  misc_feature: Ceres CLONE 1826062
  misc_feature (139)..(213): Pfam Name: Cyt-b5 Pfam Description: Cytochrome b5-like Heme/Steroid binding domain
  misc_feature: SWISSPROT Homolog: EC 1.6.2.2 Cytochrome-b5 reductase
MADGDSSDFTFCKVSSEENDGQLGSPKAIPVASMSLEDVHVDRAKTAKSDGLKANDSDKDRSGNSASVSIQDSNMKEPITQTSGGAESNVSSQAKPSSKKPAVRKKVPFEKGYSQMDWLKLTRTHPDLAGLKGQSNRRLISLEEVKQHKTGDCIWTVLKGRVYNIAPYMKFHPGGVDMLMKAAGKDCTALFNKYHAWVNAEFLLEKCLVGFLDPNE

SEQ ID NO: 23176 - DNA, 432 bp, Panicum virgatum
  misc_feature: Ceres CLONE 1826066
  misc_feature: Encodes the peptide sequence at SEQ ID NO. 23177
gcccctcctccctctcctctcgtctcgggctccagatccgcgggatcggagcctccgccatggcgatggcgtcgtccagcgggctccggagctgcagggccgtgggcgtgccccgcctgctggcgccgtcctcccgctccggccggctgccgttctgcgccagcgccaccccctcgggccgcgtcaccatgtccgccgagtggatgcccggccagccccgccccgcccacctcgacggctcctcccccggggacttcggattcgaccccctcggcctcgccaccgtgccggagaacttcgagcggttcacggagtcggaggtgtaccactgccgctgggccatgctcgccgtgcccgggatcttggtgccggaggcgctggggcttggcaactgggtgaaggcgcaggagtgggcggccgtgcccggcgggc

SEQ ID NO: 23177 - protein, 124 aa, Panicum virgatum
  misc_feature: Ceres CLONE 1826066
  misc_feature (53)..(124): Pfam Name: Chloroa_b-bind Pfam Description: Chlorophyll A-B binding protein
MAMASSSGLRSCRAVGVPRLLAPSSRSGRLPFCASATPSGRVTMSAEWMPGQPRPAHLDGSSPGDFGFDPLGLATVPENFERFTESEVYHCRWAMLAVPGILVPEALGLGNWVKAQEWAAVPGG

SEQ ID NO: 23178 - DNA, 466 bp, Panicum virgatum
  misc_feature: Ceres CLONE 1826076
  misc_feature: Encodes the peptide sequence at SEQ ID NO. 23179
gagagagagagagaggaccccccctcgcccaggaagacaccccggcgagaggatgagagggaggaggaacggtcgagggccacccagatgagagagatcctccgcctccacctcggcccagccgggatcccggttgcccacgcctgctgggagctctattgcctcgagcacggcatcgagcccgatggcaccctgcccagtgatacctcggttggcgtcgcccctgatgccttcaacaccttcttcagcgagaccggttctggcaagcatgtgccgagcgccctcttcgtcgaccttgagcccactgtcttcgatgaggcgcgccctggctcgtaccgcctgctctttcacccacagcagcttatctccgggaaggaggatgcggctaacaactttgcccgtggccactacactgttgggaacgagattgtcgatctgtgcctcgaccgagtgcgcaagctagcag

SEQ ID NO: 23179 - protein, 126 aa, Panicum virgatum
  misc_feature: Ceres CLONE 1826076
  misc_feature: Useful for making plants with altered cell wall content and/or composition
MREILRLHLGPAGIPVAHACWELYCLEHGIEPDGTLPSDTSVGVAPDAFNTFFSETGSGKHVPSALFVDLEPTVFDEARPGSYRLLFHPQQLISGKEDAANNFARGHYTVGNEIVDLCLDRVRKLA

SEQ ID NO: 23180 - DNA, 566 bp, Panicum virgatum
  misc_feature: Ceres CLONE 1826083
  misc_feature: Encodes the peptide sequence at SEQ ID NO. 23181
gactgctcttatccctttcttcccttctctgctgtgctccccttccctcgggcggggaacgccgccccccgccgctcctcccgagcacctccgctccatcccgttggttagatatggcggccgggagtgcccgtgccccggcgtcgctctccgtcgcggcggcggcggcggccctgcgcgtgaggcggccgtgcgctggcgctcgcgcttgggtcccctcgcagccggcgcaacaagggtccctcctcaggctcaggccctgcgccgcactggcgccacatgcccctctgtggcgggcggagtcggatggcgcgcgcggcggggccggcgccggcgacgtcatgggcctcctcctccgggagcgcatcgtcttcctcggcaacgagatcgaggacttcctcgcagacgccgtcgtcagccagctcctcctcctcgacgcccttgacccggactccgacatccgcctcttcgtcaactcgcctgggggctcgctcagcgcaacaatggccatctatgatgtaatgcagcttgtgagggcagatgtatccactattggattgggcata

SEQ ID NO: 23181 - protein, 150 aa, Panicum virgatum
  misc_feature: Ceres CLONE 1826083
  misc_feature (68)..(150): Pfam Name: CLP_protease Pfam Description: Clp protease
  misc_feature: SWISSPROT Homolog: EC 3.4.21.92 Endopeptidase Clp
MAAGSARAPASLSVAAAAAALRVRRPCAGARAWVPSQPAQQGSLLRLRPCAALAPHAPLWRAESDGARGGAGAGDVMGLLLRERIVFLGNEIEDFLADAVVSQLLLLDALDPDSDIRLFVNSPGGSLSATMAIYDVMQLVRADVSTIGLG

SEQ ID NO: 23182 - DNA, 575 bp, Panicum virgatum
  misc_feature: Ceres CLONE 1826084
  misc_feature: Encodes the peptide sequence at SEQ ID NO. 23183
aagccaaagctccagcaatccaaccaccgtcccctaatcccccctccaatcaagcacccaacagccccccgatcccccgatagagctccccccccgcagcctctgcagcgagatggctcccgagattgcccgcaagatgaccgcccaggccgccgccgccgccgcggtgaagcccgcgaccagggcgtacgtgacgttcctggcgggcgacggcgactactggaagggcgtggtgggtctggccaagggcctgcgcaaggtcggctcggcgtacccgctggtggtcgccgtgctgcctgacgtgccggaggcccaccgccggatcctcgtctcgcagggctgcatcgtccgcgagatcgagcccgtgtacccgccggagaaccagacgcagttcgccatggcctactacgtcatcaactactccaagctccgcatctgggagttcgtggagtacgagcggatggtgtacctggacgcggacatccaggtgttcgataacatcgacgagctgttcgagctcgagaagggccacttctacgcggtgatggactgcttctgcgagaagacgtggagcc

SEQ ID NO: 23183 - protein, 154 aa, Panicum virgatum
  misc_feature: Ceres CLONE 1826084
  misc_feature (27)..(154): Pfam Name: Glyco_transf_8 Pfam Description: Glycosyl transferase family 8
  misc_feature: SWISSPROT Homolog: EC 2.4.1.186 Glycogenin glucosyltransferase
  misc_feature: Useful for making plants with altered carbohydrate content
  misc_feature: Useful for making plants with modulated water use efficiency
  misc_feature: Useful for making plants with altered cell wall content and/or composition
MAPEIARKMTAQAAAAAAVKPATRAYVTFLAGDGDYWKGVVGLAKGLRKVGSAYPLVVAVLPDVPEAHRRILVSQGCIVREIEPVYPPENQTQFAMAYYVINYSKLRIWEFVEYERMVYLDADIQVFDNIDELFELEKGHFYAVMDCFCEKTWS

SEQ ID NO: 23184 - DNA, 612 bp, Panicum virgatum
  misc_feature: Ceres CLONE 1826102
  misc_feature: Encodes the peptide sequence at SEQ ID NO. 23185
aactggcgctgcgcataaaacttgtcacggagagcggctcccatccatccccgaatccaccaggaaggcccccagcgcgcgcgcaggcaccaaagccaccaaccatggcggccgcctcgctcaagctcgccacccccaaacccctcgcccccgcgccgctcctccgcgggcgcggcgcggcccaggcgcgtcccctccccgcgcgccgcgtcccgccgcccgcccgcgtctccgtgcagccccccgccccgcgcatcggctccttcgacaaggtgctggaggcgctgatcggcgggaccgacttctcggaggaggacgcggaggccacgctgcggctgctgctggaggagaagaacgaggcgcgcatcgccgccttcctcgtcctcctcagggccaagggcgagacctacgaagagattgtggggctggcgaaggcgatgctgagctgctgcgtccgggtcgacgggctggacgacgccgtagacattgtcgggactggcggcgacggcgctgacaccgtcaacatctccaccggttccaccatcctcgccgccggcgccggcgccaaggtcgctaagcaagggagcaggtcgagctcgtcggcctgcggca

SEQ ID NO: 23185 - protein, 169 aa, Panicum virgatum
  misc_feature: Ceres CLONE 1826102
  misc_feature (53)..(117): Pfam Name: Glycos_trans_3N Pfam Description: Glycosyl transferase family, helical bundle domain
  misc_feature: SWISSPROT Homolog: EC 2.4.2.18 Anthranilate phosphoribosyltransferase
MAAASLKLATPKPLAPAPLLRGRGAAQARPLPARRVPPPARVSVQPPAPRIGSFDKVLEALIGGTDFSEEDAEATLRLLLEEKNEARIAAFLVLLRAKGETYEEIVGLAKAMLSCCVRVDGLDDAVDIVGTGGDGADTVNISTGSTILAAGAGAKVAKQGSRSSSSACG

SEQ ID NO: 23186 - DNA, 649 bp, Panicum virgatum
  misc_feature: Ceres CLONE 1826154
  misc_feature: Encodes the peptide sequence at SEQ ID NO. 23187
atcccccgcgagcgaagtcgccgagtcaacaacatccggcaccggcggcgcctaaccctccctcctcctcatcctccaaattccaaaaacccagctaggctcgcgctcgcggcgaaccctaatggtggcgcaggggatagcggaggccctgcaggcctacacgggcctcacgccgggggccgccgccaccatcctcgccctcatgctcgcgacctacctcctcgtctcctccctcttcgtcgcccccgccgccccctcccccgcggcgcctcccaagcagcccgagcagcagcgggaggaggagaggaaggggaaggagcaggaagaggaggaggaggcaccgatgcccttcgtgtttccggaccccgtcgaggtcggcgaggtcaccctcgagcagctcagggcgtacgacggcaaggaccccgccaagcagatcctcatcgccatctgcggccaggtctacgacgtctcgcgcgggaggctcttttatggccctcagggaccatactccttgtttgccgggagggatgcaacccgggccctggcattgatgtcatttgaccctaatgacctcaccggggatttggaccgcctaagccccgatgagctggaggtgttgcaggactgggaggaaaaattcaggagaggt

SEQ ID NO: 23187 - protein, 175 aa, Panicum virgatum
  misc_feature: Ceres CLONE 1826154
  misc_feature (87)..(159): Pfam Name: Cyt-b5 Pfam Description: Cytochrome b5-like Heme/Steroid binding domain
MVAQGIAEALQAYTGLTPGAAATILALMLATYLLVSSLFVAPAAPSPAAPPKQPEQQREEERKGKEQEEEEEAPMPFVFPDPVEVGEVTLEQLRAYDGKDPAKQILIAICGQVYDVSRGRLFYGPQGPYSLFAGRDATRALALMSFDPNDLTGDLDRLSPDELEVLQDWEEKFRR

SEQ ID NO: 23188 - DNA, 660 bp, Panicum virgatum
  misc_feature: Ceres CLONE 1826191
  misc_feature: Encodes the peptide sequence at SEQ ID NO. 23189
attcccggtagaacctgccgtgcagcagatgctctagcaccagctcgcgaggacacgagggggaggaggaaagaggccgaagcgcccagagtcgtgtgatttggcaacgataagcttaggtttgggcgagcgatgagcggggcgcaggggagcaggatgcagccgccggcgaggtcctcgtactacgccgtgctcggcgtccgcccgggcgcctccgccgccgagatacgcgccgcctaccaccgcctggccatgaggtggcacccggacaagatcgccagcggccgcgcggcggcggacccggcgcgcgcggaggaggccaagaccaggttccagcagatacacgaggcctaccaagtgctgtcggacgagaagaggagggcgctctacgactccgggatgtacgacccgctcgacgacgaccaggaggacgtggagggattccacgacttcctccaggagatgatctcgctcatggccaccgttggcagagaggagcccgtgtacagcctgggcgagctccagtccatgctggacgggatgatccaggactttgccgccccccagccggagcccagcggcttcttcgccggaggccagccgggcggcgcttccgcgcgcttgcatccccagggggtcggcgactcggcgtgcttcagc

SEQ ID NO: 23189 - protein, 175 aa, Panicum virgatum
  misc_feature: Ceres CLONE 1826191
  misc_feature (16)..(87): Pfam Name: DnaJ Pfam Description: DnaJ domain
MSGAQGSRMQPPARSSYYAVLGVRPGASAAEIRAAYHRLAMRWHPDKIASGRAAADPARAEEAKTRFQQIHEAYQVLSDEKRRALYDSGMYDPLDDDQEDVEGFHDFLQEMISLMATVGREEPVYSLGELQSMLDGMIQDFAAPQPEPSGFFAGGQPGGASARLHPQGVGDSACF

SEQ ID NO: 23190 - DNA, 601 bp, Panicum virgatum
  misc_feature: Ceres CLONE 1826193
  misc_feature: Encodes the peptide sequence at SEQ ID NO. 23191
acagcaggtcgaacaacacacacgccaaaacacaccccccgatcctcgtcctctgcgagcacggtgcatctcgcctagcacagaacccaaagctagctagagctgccaatggggggagcgggagccccagccagcgacgaggtgaaggtgctgggcgtgtggcccagcccgttcgtgatccctgtccgcatcgcgctcaacatgaaacgcctgtcctaccactacttggaggaggacctgtacaacaacagcttgctcctcgtgggctccaacccggagcacaaaaaagtgccggtgctcctccacggcggacgcgccatcaacgagtcccagatcatcctgcactacatccacaagttgtgggcggggacgcctgcgctgctgccgtcggacccctaccagcgcgcgacggcgcggctctgggcggcctaaatcgacgacaatgtgaggcccgcgtgagtcctgatagtgttcaagcataagaacaacgacgagtgagcggagggcgtggcgcgcgccggcgaggcgctcgacaccctgcagggccccttccgggactgctccgacgggaagtctttcttccgcggcgaccgcatcggca

SEQ ID NO: 23191 - protein, 107 aa, Panicum virgatum
  misc_feature: Ceres CLONE 1826193
  misc_feature (10)..(83): Pfam Name: GST_N Pfam Description: Glutathione S-transferase, N-terminal domain
  misc_feature: SWISSPROT Homolog: EC 2.5.1.18 Glutathione transferase
  misc_feature: Useful for making plants with modulated nitrogen use efficiency
  misc_feature: Useful for making plants with modulated biomass
  misc_feature: Useful for making plants with modulated drought sensitivity
MGGAGAPASDEVKVLGVWPSPFVIPVRIALNMKRLSYHYLEEDLYNNSLLLVGSNPEHKKVPVLLHGGRAINESQIILHYIHKLWAGTPALLPSDPYQRATARLWAA

SEQ ID NO: 23192 - DNA, 662 bp, Panicum virgatum
  misc_feature: Ceres CLONE 1826223
  misc_feature: Encodes the peptide sequence at SEQ ID NO. 23193
gagcaggattcgcgggggggaaggacttagcagcaagcaagcagcaaggggagagccgtcaactcaagaggatcgtcaagaacaagaagatgggcaccacgcagcggcagctgctcctgctcttcttcctatctgcggtcgccccgcaggtagttagagcactgaaaccaatcccaaattccaatcttggggtcgaggagggagacaattccataggaatcatacaggtctttctttcccttgaacccacctcatcttctcttgtagttgctcatggtgttgcatgtcgcagaaggacatcatagagacggtcaacaagcatcccgtttttgggtggacggctgcacacaatccttactttgccaactatactattgcacaatttaaacgtatccttggagtgaagcccacaccacagggtgtgctgaccgatgttcctgccaaaacttattcaagatcactgaaacttccaaaggagttcgacgccagatctaagtggtctcattgcagcacaattgggaacatacttgatcaaggtcattgtggctcctgttgggcatttggtgccgtggagtgcctccaggatcgtttttgcattcatatgaacatgaacatttcactatcagtcaatgacctagtggcatgctgcggttttatgtgcg

SEQ ID NO: 23193 - protein, 126 aa, Panicum virgatum
  misc_feature: Ceres CLONE 1826223
  misc_feature (3)..(45): Pfam Name: Propeptide_C1 Pfam Description: Peptidase family C1 propeptide
  misc_feature: SWISSPROT Homolog: EC 3.4.22.1 Cathepsin B
MSQKDIIETVNKHPVFGWTAAHNPYFANYTIAQFKRILGVKPTPQGVLTDVPAKTYSRSLKLPKEFDARSKWSHCSTIGNILDQGHCGSCWAFGAVECLQDRFCIHMNMNISLSVNDLVACCGFMC

SEQ ID NO: 23194 - DNA, 586 bp, Panicum virgatum
  misc_feature: Ceres CLONE 1826226
  misc_feature: Encodes the peptide sequence at SEQ ID NO. 23195
atcgaaatcgaagcgaagcggcctcccccgatcctctcaagaggcagatctttgttaagaccctcaccggcaagaccatcactttggaggttgagtcgtctgacaccattgacaatgtgaaggccaagatccaggacaaggagggcatccctccggaccagcagcgtctgatcttcgctggcaagcagcttgaggatggccgcaccctagcatactacaacatccagaaggagtccaccctccacctggtgctccgcctgcgtggtggtatgcagatctttgtgaattttttttttggcaagaccatcaccttggaggtggagtcttccgacaccatcgacaatgtgaaggcgaagatccaggacaaggagggcatccccccggaccagcagcgtctgatcttcgccggcaagcagctggaggatggccgcaccctggcggactacaacatccagaaggagtccaccctccacttggtactccgtctgcgtggtgggatgcagatctttgtgaagaccctcaccggccagaccatcaccttggaggtggagtcttctgaacccattgacgacgtgaaggcgaagat

SEQ ID NO: 23195 - protein, 194 aa, Panicum virgatum
  misc_feature: Ceres CLONE 1826226
  misc_feature (19)..(87): Pfam Name: ubiquitin Pfam Description: Ubiquitin family
  misc_feature (95)..(163): Pfam Name: ubiquitin Pfam Description: Ubiquitin family
  misc_feature: Useful for making plants with modulated nitrogen use efficiency
  misc_feature: Useful for making plants with modulated cold sensitivity
  misc_feature: Useful for making plants with modulated flowering time
RNRSEAASPDPLKRQIFVKTLTGKTITLEVESSDTIDNVKAKIQDKEGIPPDQQRLIFAGKQLEDGRTLAYYNIQKESTLHLVLRLRGGMQIFVNFFFGKTITLEVESSDTIDNVKAKIQDKEGIPPDQQRLIFAGKQLEDGRTLADYNIQKESTLHLVLRLRGGMQIFVKTLTGQTITLEVESSEPIDDVKAK

SEQ ID NO: 23196 - DNA, 1064 bp, Panicum virgatum
  misc_feature: Ceres CLONE 1826243
  misc_feature: Encodes the peptide sequence at SEQ ID NO. 23197
gtcacacagacaaagcaacaagctaacaaaacccttctttctagtgccaacccagtctcgaaacgttcttcgagcttagcaagacgatcttacagttccattcgatccacaagtctagcttctagcttttggcccagcgagttcgcgatggcttctcgtcaggagcaggctagctaccacgccggcgagaccaaggcccgtgccgaggagaaggcggggcaggcgatgggcgcggcgcaggagaaagggcgggaggccaagtccaaggcttccggcgccgcggaggccaccagggccaaggcgcgcgaggccgcggaccgcaccatgggtgtgggccgcgacgccacggaggccaccagggacaaggcctaccaggccaaggacgcggcctccgacgccgcgggccgcgccgaggacaagggccgcggcgccgcggaggccgccagggacaaggcctgcgaggccaaggacaaggagtccggcggcgcgcagcaggccgggggctacatctcgcagacggccgaggccgccaagcagaaggcggccggcgccgcgcagtacgccaagcagaccgtggtggccggcaaggacaagaccggcgccctcctgcagcaggcaggggagacggtgatgaacacggcggcgggggccaaggacaaggtggtgagcaccgccgtcggggccaaggacgccgtgatgaactcgctcgggatggccggagagaacgacgacggcaccaccaccaattccggcaaggacaccagtacctacaagcctggcagggactactaatccaaggatggagatgctcctgtgctgctgccaaactgttatcttgtttaggttcacagtttcagaggttcagttacgtatctacgtgtgcgtttctctttgctttgattccaacctgtgtttgcctcactggttatgtggaggtttgtaactttttttctttaattagaacagaggtgacgtaggggacattgtccaaccggacgcctctttggcctcttgtgttttcgtttcttgatctaataaaagttgcaaagctggtgttttgtttc

SEQ ID NO: 23197 - protein, 214 aa, Panicum virgatum
  misc_feature: Ceres CLONE 1826243
  misc_feature (45)..(88): Pfam Name: LEA_4 Pfam Description: Late embryogenesis abundant protein
  misc_feature: Useful for making plants with modulated water use efficiency
MASRQEQASYHAGETKARAEEKAGQAMGAAQEKGREAKSKASGAAEATRAKAREAADRTMGVGRDATEATRDKAYQAKDAASDAAGRAEDKGRGAAEAARDKACEAKDKESGGAQQAGGYISQTAEAAKQKAAGAAQYAKQTVVAGKDKTGALLQQAGETVMNTAAGAKDKVVSTAVGAKDAVMNSLGMAGENDDGTTTNSGKDTSTYKPGRDY

SEQ ID NO: 23198 - DNA, 1885 bp, Panicum virgatum
  misc_feature: Ceres CLONE 1826255
  misc_feature: Encodes the peptide sequence at SEQ ID NO. 23199
gagctagctcgcccagtcgttgccgccggcgtcgcgtccatggaaatgctggagtgctccctcgccgccacgctcgccccgcgaccgctgcccggccgggtccggaaggcccctccgcagccgggcgttcctgcggggaggacgaggcttcgggtgcggtcggcgaggcgagagcagcctccgccgccggagccggtggcagtccggggagattctgggacgggacacgggcacggtggccgggcggtgcggcaggcggcggcggggctcgccgcggcggccgtggtgtcgctgaccgggttcgcaggtgacgtgtccccgctgccgacgccgccagcccgggccgagtcgctcaccgtcgcgttccccgtcgcaaaggcgcgcgaggtgaaccgggtgcagaggacgctggtggaggcgtggggtttgatccgcgagaccttcgtggatcccaccttcaaccatcaagattgggatcagaaactgcagcaaaccatggtagaaatgtttccactgaaatcggctgacgcggcctacagtaaaatcagtgggatgctttccacgcttggagacccatttacaaggatcatcagcccgatggagtatcagagtttcaggataggaagcgatggaaatgtgcaaggggttggggtgttcataaacagggagccaagctctggacgcttgcttgttatggactgcattcaggggggcccagcagatcgagcaggcatacatgaaggcgatgagctagttgagatagatgggaaaagtgtttctggaatggatggagaggctgcggctcagaggcttagaggccgtgtaggaacaacagtgaaagtgaaactattagatggaactgacaatgataggggtggcaggaataggcaaaaagaggtccagctgtctcgtgaaatcatcaacctttcacctctatcaactacaattatctctcataggtctgacgatggccatcagtgcaagactgggtatgttagactagcttccttttctcagactgctgcagctgaaatggaaaatgctgtaaaaaggatggaggatgagggtgtcgagtcatatattctagacctgcggaataacccgggtggattagtaaaagctggtctcgatgtggctcaaatttggttggatggagatgaaactctcgtcaacactattgatcgtgagggaaatgtgctaccgataaatatgatccaagggcattcattaacacatgaccctcttgtagttcttgtcaatgaaggaagtgcaagtgcgagtgaaatcttggcaggggcattacatgacaatgggcgagctattctggtcggccacagaacctttggtaaaggaaaaattcagagcatcactgagttggatgatggttctgctctgtttatcacggttgcgaagtatctctctccagcactgcatgaaatcgatcaagtaggaatccagcctgacatacaatgcagccctgatatactatccttgccgagagcgccttcaccaagagaaaacagcgaagccacaagtttggagatggattcatgtatcatggtggcagagcaagcattggaaattgagcaaacaaaaggttctgcttcttagatgttcaggttataggctctgtatgctactgtagattgtattgctgatagtatagactgataaagcgctgtaacgctatgtgtataagctgactgcacatgtttgattttaggcatcatcaattaggcggttcacgggaatgtgtatgagttgaccttgtcacatgcctgtgttgcattgattctcaacatgtatcatcggaaattcagaattataggatgtaaattttgtaattggtctgttgattattgtgtaatgtttaatgttcatcagc

SEQ ID NO: 23199 - protein, 523 aa, Panicum virgatum
  misc_feature: Ceres CLONE 1826255
  misc_feature (315)..(478): Pfam Name: Peptidase_S41 Pfam Description: Peptidase family S41
  misc_feature (191)..(271): Pfam Name: PDZ Pfam Description: PDZ domain (Also known as DHR or GLGF)
  misc_feature: SWISSPROT Homolog: EC 3.4.21.102 C-terminal processing peptidase
MEMLECSLAATLAPRPLPGRVRKAPPQPGVPAGRTRLRVRSARREQPPPPEPVAVRGDSGTGHGHGGRAVRQAAAGLAAAAVVSLTGFAGDVSPLPTPPARAESLTVAFPVAKAREVNRVQRTLVEAWGLIRETFVDPTFNHQDWDQKLQQTMVEMFPLKSADAAYSKISGMLSTLGDPFTRIISPMEYQSFRIGSDGNVQGVGVFINREPSSGRLLVMDCIQGGPADRAGIHEGDELVEIDGKSVSGMDGEAAAQRLRGRVGTTVKVKLLDGTDNDRGGRNRQKEVQLSREIINLSPLSTTIISHRSDDGHQCKTGYVRLASFSQTAAAEMENAVKRMEDEGVESYILDLRNNPGGLVKAGLDVAQIWLDGDETLVNTIDREGNVLPINMIQGHSLTHDPLVVLVNEGSASASEILAGALHDNGRAILVGHRTFGKGKIQSITELDDGSALFITVAKYLSPALHEIDQVGIQPDIQCSPDILSLPRAPSPRENSEATSLEMDSCIMVAEQALEIEQTKGSAS

SEQ ID NO: 23200 - DNA, 340 bp, Panicum virgatum
  misc_feature: Ceres CLONE 1826266
  misc_feature: Encodes the peptide sequence at SEQ ID NO. 23201
gggcctctgatcttcgctggcaagcggctggaggacggccgctcgctggcggactgcagcatccggacatagtcctccctcgacgtggtgcgccgcgggcgcggcggcatgcacagctgggtgaagaccctcgccggctacactataaccgtggagggggagcctcgtgaccctgtccccggtgtgaaggctaaggtccacgacgcggcgggcctccccccggacgcgcatcctctgatcttccccggcgagcagctgggggatggccgcactctgacggactccaccctccggaaggaatccccccgccccttgatgctccgcctgcgtggcggtgtgc

SEQ ID NO: 23201 - protein, 77 aa, Panicum virgatum
  misc_feature: Ceres CLONE 1826266
  misc_feature (6)..(76): Pfam Name: ubiquitin Pfam Description: Ubiquitin family
  misc_feature: Useful for making plants with modulated nitrogen use efficiency
  misc_feature: Useful for making plants with modulated cold sensitivity
MHSWVKTLAGYTITVEGEPRDPVPGVKAKVHDAAGLPPDAHPLIFPGEQLGDGRTLTDSTLRKESPRPLMLRLRGGV

SEQ ID NO: 23202 - DNA, 1121 bp, Panicum virgatum
  misc_feature: Ceres CLONE 1826300
  misc_feature: Encodes the peptide sequence at SEQ ID NO. 23203
cctttccatcctctcctcttcgctctccctctacgccgcctccgctcgccgtccagatcggctcaccggccgcgccaggctcccatctccatgggtctcctctctaacaggattgggaaggagagcctcaaggcgggggatcacatctactcgtggaggtccgcctgggtctacgcgcatcacggaatatatgtgggtgatgataaggtgattcattttacaagaggaagggaccaggaggttggaacaggaactgtcattgatattcttcttgtgagttctgcacctaaacgaagcgacacgccatgtccggtatgcaccaacgaagacaatgacaccagcatggagacaaatggcgtggtatcctcttgcctcaactgcttcctggctgggggtgccctttaccgttttgattacgcagtcaacccagctctcttccttgccaaagcgcgaggaggaacgtgcacactcgctacctctgaccccgacgaagcagtggtccgccgtgccaaatacttgctgagtaatggtttcaggtgctacaacctattcaagagcaactgtgaggacttcgcaatatactgcaagactggcctccttgtggcggagcggggtgttgttgggcagagcgggcaggccatctcgatcattggtggacctctcgctgcagtgatctcaacgccgttccgcctggtgaccacaaacatctatggaatggcggtgatggccgtcggggtgtactgcgccagcaggtacgcggctgacattggcaaccgtcgtgatgtggtgaaagtggaagtcgaggacctgacagcaggcctggccagcggcaggatccgtgcggtggagaaccagctggtggttccaccagaaagcccggctgcctaaaatgcagcattgcttctgtaacatctgcaagatttacatcggccgagacctttactgctgctaagtgtatgaattgtttgttcgttgtggttaaaaatcttctgaaactctgttgaagtgaggtttccgttcggaaatgtctgtatgagtatcgtgtatggcttgtccagtgttgtgtatcaagataaaaattactgttgttgtgtcgcgtcgtaatatcgaacttggcttct

SEQ ID NO: 23203 - protein, 265 aa, Panicum virgatum
  misc_feature: Ceres CLONE 1826300
  misc_feature (108)..(178): Pfam Name: NC Pfam Description: NC domain
MGLLSNRIGKESLKAGDHIYSWRSAWVYAHHGIYVGDDKVIHFTRGRDQEVGTGTVIDILLVSSAPKRSDTPCPVCTNEDNDTSMETNGVVSSCLNCFLAGGALYRFDYAVNPALFLAKARGGTCTLATSDPDEAVVRRAKYLLSNGFRCYNLFKSNCEDFAIYCKTGLLVAERGVVGQSGQAISIIGGPLAAVISTPFRLVTTNIYGMAVMAVGVYCASRYAADIGNRRDVVKVEVEDLTAGLASGRIRAVENQLVVPPESPAA

SEQ ID NO: 23204 - DNA, 689 bp, Panicum virgatum
  misc_feature: Ceres CLONE 1826304
  misc_feature: Encodes the peptide sequence at SEQ ID NO. 23205
acgcgctcggctccgcccctggccggctacggttcttctcttggtggagcatccatccagagagaaagagaggcagagcaggaggaagaagaaagagggagaagaacagcggccgccaagaagaggaggagcaagatgctgcgcggcggcgcgagcatgctggggatcgtcaacttcatcacctttctgatctccatccccatcctgggcggcggcatctggctggcgtcccgggccaactccaccgactgcatccgcttcctgccgtggcccatcgtcgtcgtggggctcgtcctcgtggtcatctccctcatgggcttcgccggcgcctgctaccgccagacctggctcctccgcctctccctcttcgccatgttcttcgtcgtcctcgcgctcctcttcttcatcgtcttcgccttcgccgtcaccgaccgcggcgacggacaggtcgtcatgaaccgccgcttcctcgagtaccagctctccggctaccgcggctggctccgggaccgcgtcgccgacccgcactactgggcctccatctgcgcctgcctccgcgacggccacgcctgctccggcatgaggcgattcgcgcgcgcccccaacaccggcttgctcgtgtcggagacgtcggacatgttctacgcccgcaacctctcccccattcagtctggatgctgcaaaccatc

SEQ ID NO: 23205 - protein, 184 aa, Panicum virgatum
  misc_feature: Ceres CLONE 1826304
  misc_feature (6)..(183): Pfam Name: Tetraspannin Pfam Description: Tetraspanin family
  misc_feature: Useful for making plants with modulated nitrogen use efficiency
MLRGGASMLGIVNFITFLISIPILGGGIWLASRANSTDCIRFLPWPIVVVGLVLVVISLMGFAGACYRQTWLLRLSLFAMFFVVLALLFFIVFAFAVTDRGDGQVVMNRRFLEYQLSGYRGWLRDRVADPHYWASICACLRDGHACSGMRRFARAPNTGLLVSETSDMFYARNLSPIQSGCCKP

SEQ ID NO: 23206 - DNA, 650 bp, Panicum virgatum
  misc_feature: Ceres CLONE 1826328
  misc_feature: Encodes the peptide sequence at SEQ ID NO. 23207
ggtgaaccgcgcctttgtttggcctccggcgatcgacctccccgtcatggcggctccccacgtcctggccctgcccttccccgcccagggccacgtcatccctctgatgcagctcgcccaccggctcgtcgagcacggcgtccaggtcaccttcgtcaacaccgaggccaaccacgcgctcgtgctcgacggcatccacctggtgggcgtcccggaagggctgccggaaggcgacgaccgcaaggacctcggcaagctcatcgacgcgctctcgcggcacatgccgggctacctggaggaactcgtcaggaggggtgaggcgtccagggacaccaagatcagctggctcgtcgcccaaccggccatggggtgggcgttcgaagtcgccaggaaactcggcatcagggtcgcctgcttctggattgcgtccgccgccttcctcgcctcgatgttcagaattccgcagctggtataggacggcgtcatcgtcgagaaaggtgtcggaaaagaacggaacaatttctggcagtcaattgcttgatgatttgcgttttgattcctcattggtggcatgggcaaagtgcaagctggccgaagcggcaagagacgctccagttggcgcccgggatgccgccgctccacacgtcgcg

SEQ ID NO: 23207 - protein, 142 aa, Panicum virgatum
  misc_feature: Ceres CLONE 1826328
  misc_feature: SWISSPROT Homolog: EC 2.4.1.121 Indole-3-acetate beta-glucosyltransferase
  misc_feature: Useful for making plants with altered carbohydrate content
MAAPHVLALPFPAQGHVIPLMQLAHRLVEHGVQVTFVNTEANHALVLDGIHLVGVPEGLPEGDDRKDLGKLIDALSRHMPGYLEELVRRGEASRDTKISWLVAQPAMGWAFEVARKLGIRVACFWIASAAFLASMFRIPQLV

SEQ ID NO: 23208 - DNA, 1630 bp, Panicum virgatum
  misc_feature: Ceres CLONE 1826339
  misc_feature: Encodes the peptide sequence at SEQ ID NO. 23209
atcccctccgctaaactgatcgctcgtgctcggattcgtagatccacccatcgcacgcacacacacgaaccctacgggcagcggaggtccgagcagccacgccgcatccctcctcttctctgcgcacccttctcttcctctctatctctctctccttctctcccgtcgtcgccatttattactcctcttcgccgcaaaattcctgtcgcaataaagggccctgcgtccaccgtccacgtgggcggcggctgcggaggcggcggcggcgggcgccggagatgtgagagccgccgcgccgttggagatggctgcggcgggggcgggggccgggggcgaggggaagaagcggggcgcgtcgcggagctggatcctgttcgacgcggccggggaggagcgggtgctggacgccgacaagtacgccatcatgcaccgcgtcgacatcaacgcgcgcgacctccgcatcctcgacccgctgctgtcctacccctccaccatcctcgggcgcgagcgcgccatcgtgctcaacctcgagcatataaaggcgatcatcacttccgaggaggttttgcttagggatccatctgatgagaatgtaatccctgtggtagaggagctccggaggcgcttagcaccatcaaatgccactcagcatgatggaaaggagaacttaagtggccagcatgatgcagaaggggcggaagaggatgaatctccttttgagttccgtgcactggaggttactctggaagcaatatgcagtttccttgatgcacgcactactgaacttgagactgatgcttacccagctttggatgaattgacatccaagatcagcagtcgcaacttggatagggtacgaaagttaaaaagcggcatgacaagattgactgcaagggttcagaaggtgagagacgagcttgaacaattattggatgatgacgatgacatggctgatctttacttgtctagaaagttggctggggcatcttcccctgtcattggttctggaggaccaaattggttccccgcatccccaactattggttcaaaaatatcaagagcaagcagagccagtgcacctaccatacatggtaatgagaatgatgtggaagaactggagatgttgctagaggcatatttcatgcaaattgatggcactttaaacaaattgacaacgctgagagagtacattgatgacacggaagattacattaatatccagcttgacaaccaccgtaatcagttgattcagctagagttattcttgagttccgggaccgtatgcttgtcgctttactcattagttgctggaatctttggtatgaatataccatacacctggaacgacaaccatgggtatgtcttcaaatgggtggttctcgtatccgggcttttttgcgcctttatgtttgtctccattgttgcttatgcgaggcacaagggtctcgttggatcctgaatagctgaaataaccgcagcttgcttccctcaactgtaaattgagctagagagcatcaactttgcggtgcgattcatctcttgtaccaaattcattagtatcaaattggagatatcgaataggaacaataaatagaagaaaattaatgcaaaagaaatatatggcgatgtc

SEQ ID NO: 23209 - protein, 384 aa, Panicum virgatum
  misc_feature: Ceres CLONE 1826339
  misc_feature (16)..(382): Pfam Name: CorA Pfam Description: CorA-like Mg2+ transporter protein
MAAAGAGAGGEGKKRGASRSWILFDAAGEERVLDADKYAIMHRVDINARDLRILDPLLSYPSTILGRERAIVLNLEHIKAIITSEEVLLRDPSDENVIPVVEELRRRLAPSNATQHDGKENLSGQHDAEGAEEDESPFEFRALEVTLEAICSFLDARTTELETDAYPALDELTSKISSRNLDRVRKLKSGMTRLTARVQKVRDELEQLLDDDDDMADLYLSRKLAGASSPVIGSGGPNWFPASPTIGSKISRASRASAPTIHGNENDVEELEMLLEAYFMQIDGTLNKLTTLREYIDDTEDYINIQLDNHRNQLIQLELFLSSGTVCLSLYSLVAGIFGMNIPYTWNDNHGYVFKWVVLVSGLFCAFMFVSIVAYARHKGLVGS

SEQ ID NO: 23210 - DNA, 469 bp, Panicum virgatum
  misc_feature: Ceres CLONE 1826355
  misc_feature: Encodes the peptide sequence at SEQ ID NO. 23211
tccatccgactgcttcctgcccaaccattctcccccaatcttcgttggatctcccgtaccctccccgcgagcatccaccatgtcggcctactgtgcaaagtacaaggacgacctcatcaataatggtgcctactttggaacccctggaaagggtatccttgcatctgatgagtccactggaaccattggcaagcgtctttccagcctcagggttgagaatatcaaggataacccccctgcccccagtgagctcctgtcctgctgtcctgctgcccttacatacttaagcggtgtgatcgtcttgcaggacacctggtacaagaagaccaaggatggcaaccccttctttgatgtcctcaaggagggaggcgtcctccctgtgtccaaggttgacaaggcaaccattacggctgctggatctgcctgggaaaccaccacccagggccatgataaccttgtggagcgatgg

SEQ ID NO: 23211 - protein, 129 aa, Panicum virgatum
  misc_feature: Ceres CLONE 1826355
  misc_feature: SWISSPROT Homolog: EC 4.1.2.13 Fructose-bisphosphate aldolase
  misc_feature: Useful for making plants with modulated phosphate use efficiency
MSAYCAKYKDDLINNGAYFGTPGKGILASDESTGTIGKRLSSLRVENIKDNPPAPSELLSCCPAALTYLSGVIVLQDTWYKKTKDGNPFFDVLKEGGVLPVSKVDKATITAAGSAWETTTQGHDNLVER

SEQ ID NO: 23212 - DNA, 630 bp, Panicum virgatum
  misc_feature: Ceres CLONE 1826357
  misc_feature: Encodes the peptide sequence at SEQ ID NO. 23213
agttccatttggacctccgcctccttcctcccctcctcttcactctctcccttgcatcaccaacaagaaggctaacgcacaccaacccaagaacaaggaggggaagagaaggaaagggaaaaaaaaaaggaattttgatcgcccagagtgtggtagtagaatagcaatttgatctctcctcgttcgaggtcagtgcgcgaggcaataatggtggccgtggaggctgcggcggcggcggcggcggtggagggctcgatccgggcggaggccaaggtggcgccggagccggaggccgaggtggaggtgaagggcgatgccccggccgcgggggaggccgaggaggaggaggagaaggagtacaagagcgacatgaggaagctggaggagctcatgtccaagctcaacccctgcgcgcaggagttcgtgccgtcgtcgcgccgcgccgcggcgccggcggcgaagccggcggggggaggcgtgctctccgccgacgcaccggtgttcgtctccgccgccgagtactacggcgctgccggagggcacctgcaggtggccggcggcggcgctgccggcggcgggagccgggactccagcagcgacggatccagcaacggcagcggccaccctctg

SEQ ID NO: 23213 - protein, 140 aa, Panicum virgatum
  misc_feature: Ceres CLONE 1826357
  misc_feature (60)..(77): Pfam Name: PAM2 Pfam Description: Ataxin-2 C-terminal region
MVAVEAAAAAAAVEGSIRAEAKVAPEPEAEVEVKGDAPAAGEAEEEEEKEYKSDMRKLEELMSKLNPCAQEFVPSSRRAAAPAAKPAGGGVLSADAPVFVSAAEYYGAAGGHLQVAGGGAAGGGSRDSSSDGSSNGSGHP

SEQ ID NO: 23214 - DNA, 1399 bp, Panicum virgatum
  misc_feature: Ceres CLONE 1826372
  misc_feature: Encodes the peptide sequence at SEQ ID NO. 23215
ggcatgtggaccacgacgacacgccggcagacgcaaaaatcttccgcggtgtccgtttgcaactcagctactcaaactcaagcttcttcgttagcgtgctccatggttgtgaacacaagaagctgaggccaagggcaaaacgccagagggcagattgtttcaggcgacaggaacatagtgtgtaggcggcagcggcggcgtgctcagccatggagacggggacgcggccggcggagccgttcctgccgctgcggtgggagagcacgggcgaccagtggtggtacgcgacgcccatcgactgggcggcggccggcggccactacgacctcgtccgcgagctcctccgcctcgacgccaacctcctcgtcaagctcacctccctccgccgcatccgccgcctcgagtccgtctgggacgacgacgcgcgcctcgcgggcgccgccaggaaccgcgccgccgtcgcccgccacctcctcctcgactgcgacccccgcggcgccggccccggcaaccgcctcctccgggccgggtacggcggctggctcctctacacggcggccgcggccggggacgccgccttcgtccgggagctgctcgcggcgcagccgctgctcgtcttcggcgagggggagtacggcgtcaccgacatcctctacgccgcggccaggagcgggtgcgccgaggtgttccggctcctgctcgacgccgtgctgtccccggcgtcctgccctgtcgtcggtgaggaattcaggggcgagatgatgaaccgcgccgtgcacgccgcagcgaggggaggcagcctggaggtgctcagggacctcctgcgcggctgctccgacgccgcggcgtaccgagacgcgcagggatcgaccatcttgcacgccgccgctgcaaggggccaggttgaggttgtcaaggatctcgttgcatcttttgatatagtcaactctgtagatgaccaagggaatacagcgttgcatatagcagcttttaggggctatctgcctgtggttgaggctcttgttactgcatcatcatctcttgtatcagcaacaaatgaagctggtgacacgttccttcacatggcattgactggctttgggactcctggattccgaaggcttgatcgtcagatggagcttataaggcagttagttggtggagcgtttgtggatgtcagcagcattataaatgtgcaaaatgatgatggaaagacagttcttcacttagctgtggttggcaatttgcagtctaaccttgttgaactcttgatgagagcaccttctattgacctcaacatccgtgacaatgatggcatgactcctctggatttactcaggaaacaaccacgaacggcatcatcagaaatactgatcaaacaactgattttggtgggtgg

SEQ ID NO: 23215 - protein, 396 aa, Panicum virgatum
  misc_feature: Ceres CLONE 1826372
  misc_feature (251)..(283): Pfam Name: Ank Pfam Description: Ankyrin repeat
  misc_feature (218)..(250): Pfam Name: Ank Pfam Description: Ankyrin repeat
  misc_feature: SWISSPROT Homolog: EC 2.7.11.1 Non-specific serine/threonine protein kinase
METGTRPAEPFLPLRWESTGDQWWYATPIDWAAAGGHYDLVRELLRLDANLLVKLTSLRRIRRLESVWDDDARLAGAARNRAAVARHLLLDCDPRGAGPGNRLLRAGYGGWLLYTAAAAGDAAFVRELLAAQPLLVFGEGEYGVTDILYAAARSGCAEVFRLLLDAVLSPASCPVVGEEFRGEMMNRAVHAAARGGSLEVLRDLLRGCSDAAAYRDAQGSTILHAAAARGQVEVVKDLVASFDIVNSVDDQGNTALHIAAFRGYLPVVEALVTASSSLVSATNEAGDTFLHMALTGFGTPGFRRLDRQMELIRQLVGGAFVDVSSIINVQNDDGKTVLHLAVVGNLQSNLVELLMRAPSIDLNIRDNDGMTPLDLLRKQPRTASSEILIKQLILVG

SEQ ID NO: 23216 - DNA, 579 bp, Panicum virgatum
  misc_feature: Ceres CLONE 1826385
  misc_feature: Encodes the peptide sequence at SEQ ID NO. 23217
acaaattcccagaccatttcagttttgctcctcagctagctatctttaggctctggttgctgccagaagcaaggtaggcatggaggggaaggaggaggacgtccgcctgggcgccaacaagttctccgagcgccagcccatcggcccgtccgcgcaaggtaccgatgacaaggactaccaggagcccccgccggccccgctcttcgaccccggggagctcaagtcccgttccttctaccgccccggcatcgccgagttcgtcgccaccttcctcttcctctacatcaccatcctcaccgtcatgggcgtcagcaagtcccaatccaagtgcgccaccgtcggcatccagagcatcgcctggtccttcagctgcatgatcttcgccctcgtctactgcaccgctggcatctccagcggccacgtcaacccggcggtgaccttcggcctgttcctggcgaggaagctgtcgctcaccagggccatcttctacatggtcatgcactgcctgggcgccatctgcggcgccggcgtcgtcaacggcttccagtaggtgctgtacatgggcaacagtggcggcgc

SEQ ID NO: 23217 - protein, 156 aa, Panicum virgatum
  misc_feature: Ceres CLONE 1826385
  misc_feature (46)..(156): Pfam Name: MIP Pfam Description: Major intrinsic protein
  misc_feature: Useful for making plants with modulated water use efficiency
  misc_feature: Useful for making plants with modulated drought sensitivity
  misc_feature: Useful for making plants with modulated cold sensitivity
MEGKEEDVRLGANKFSERQPIGPSAQGTDDKDYQEPPPAPLFDPGELKSRSFYRPGIAEFVATFLFLYITILTVMGVSKSQSKCATVGIQSIAWSFSCMIFALVYCTAGISSGHVNPAVTFGLFLARKLSLTRAIFYMVMHCLGAICGAGVVNGFQ

SEQ ID NO: 23218 - DNA, 697 bp, Panicum virgatum
  misc_feature: Ceres CLONE 1826392
  misc_feature: Encodes the peptide sequence at SEQ ID NO. 23219
aaaccctccttcccccgggtcgctcccacttccacgggctccgaaactcccgcgccgcatctcgtcgtcctcccgcatggcggcgccgtccgccaccagccccatggcctccgtctcccgggtcctccgcccgcggcccgcctgcccgggtccccgtctagggcgcgggttgggaatcgcgtgctcgttgccgagtcatgggggaaggagcgagacgcgcgggttgggattgcccgtcgcgtctgcactatctgctactgccgctccggttctgaggagccgccaaattttgtgcaaggctgaagctaatgtatccagtaatcttccggagagcttgcctgtggcagttatgctaggaactgttattggcatctacaagccagctatggttacctggttgtcgaccgatcttttcactgttttgttaggattcctaatgctctccatgggattaacattgacatttgaagattttaggagatgcttgaggaacccatggacagttggtgtgggatttcttgcacagtatttgatcaaacctttgctaggattagctattgcctcgaccttgaacttatctgctcctcttgcaaccggccttattttggtctcatgttgccctggtggacaagcatcaaatgttgcaacttacatatcaaaggggaatgttgcgctttcagttcttatgaccacctgt

SEQ ID NO: 23219 - protein, 206 aa, Panicum virgatum
  misc_feature: Ceres CLONE 1826392
  misc_feature (114)..(206): Pfam Name: SBF Pfam Description: Sodium Bile acid symporter family
MAAPSATSPMASVSRVLRPRPACPGPRLGRGLGIACSLPSHGGRSETRGLGLPVASALSATAAPVLRSRQILCKAEANVSSNLPESLPVAVMLGTVIGIYKPAMVTWLSTDLFTVLLGFLMLSMGLTLTFEDFRRCLRNPWTVGVGFLAQYLIKPLLGLAIASTLNLSAPLATGLILVSCCPGGQASNVATYISKGNVALSVLMTT

SEQ ID NO: 23220 - DNA, 1109 bp, Panicum virgatum
  misc_feature: Ceres CLONE 1826397
  misc_feature: Encodes the peptide sequence at SEQ ID NO. 23221
gaaacggggacacgctagatggtgcccttgcgcagctgccaccgcttcgcccacctgcgcctcttctccttcctctccatggcggcgccccagcaacccggcaaaactcccctccgccccaacccctcgccttcccccaccggctcggcgcccaagaggtccaggacgatggccacggacgcagcggcggctggtcctccggcctccaagggatgcccagcgatgaaggccgagttcgccaagcacgccgagtacctcaatgccctgaacaataagagagaaaggcttgtgaaagcaagtcgggatatcacaatgaacagcaaaaaggtcatctttcaggtccacagggccagtaaagttaacaaggaagaggttctgtccaaggcagaaaatgatcttgctgcagtggttaaccagtacattggaaagttggtaaaagaattacaaggaactgacttctggaagctcagaagagcctacacctttggtgtacaagaatatgttgaagctgcaacgctgtgtagattttgcaagactggcacactattaagtcttgctgaaatcaatgattctttactagcactaagtgataaatctgttgagcccttacagataaatgtacttgactatcttttaggggttgctgatttgtcaggagagttaatgaggctagcgataggccgtatatctgatggggaagttgaatatgcaaaaaagatctgtgcatttgttcgtgacatttacagggagctgacccttgtggtgcctttaatggatgacaatagcgagatgaaaaagaaaatggaggttatgctgcaaagtgttgtgaaaattgagaatgcttgcttcagtgttcatgtaagaggttcagagtacattcctctacttggatcatctgcagatccagattattccttttttggtgcctcagactttgaccaatgaaggcttcgaagcaagagagcctgagtgttaattgggcaacttccgaagactagttgtgtcaaggctacttttaggctccatcctgtttagtgttggattttattgcaggtttatgttgcacatcctagagtctttaaattttggctcaacctgaatcatgtcac

SEQ ID NO: 23221 - protein, 258 aa, Panicum virgatum
  misc_feature: Ceres CLONE 1826397
  misc_feature (34)..(234): Pfam Name: Translin Pfam Description: Translin family
MATDAAAAGPPASKGCPAMKAEFAKHAEYLNALNNKRERLVKASRDITMNSKKVIFQVHRASKVNKEEVLSKAENDLAAVVNQYIGKLVKELQGTDFWKLRRAYTFGVQEYVEAATLCRFCKTGTLLSLAEINDSLLALSDKSVEPLQINVLDYLLGVADLSGELMRLAIGRISDGEVEYAKKICAFVRDIYRELTLVVPLMDDNSEMKKKMEVMLQSVVKIENACFSVHVRGSEYIPLLGSSADPDYSFFGASDFDQ

SEQ ID NO: 23222 - DNA, 1119 bp, Panicum virgatum
  misc_feature: Ceres CLONE 1826412
  misc_feature: Encodes the peptide sequence at SEQ ID NO. 23223
attgccttcctccgtctcgcatcccatccgccaggcctccgcgtgctccctcttcccttcagctccctcgctgcgcaagggttcgatccggtacgacgattaggaggacatacatggccgaggcgctgtgcaacggcgtcgtcgcgtcgccgtgcgccggggacgtgggcgtgggcgtggccgcccgggtcaggggcgccgtggcggcgctcgcggagtccgtgctgattggtggctacagcaccaagagctccttctccgccggcaggatggccatgacggacaggaaggccaggcccctgcctcggaccctcgaagcggcgccgggacagatgaacctgtcgtttcccaaggccatgcggtggtggcacaagggtctgcagcccaacatgagggagatcgagtccgcgcaggacctcgccgactccctgctcaacgccggcgacaagctcgtcgtcgtcgacttcttctcccctggttgcggcggctgccgcgccctccatcccaagattgcccagtttgccgagaggaacccagatgtcatgttcctgcaggtgaactacgagacgcacaagtccatgtgctacagcctccatgtccatgtcctccccttcttcaggttctacaggggagctgagggacgggtcagcagcttcagctgcacgaacgcaactatcaagaagttcaaggacgccctcgcgaagcacgggcctgaaaggtgcagcctcggccctgcacgggggctggaggagtcggagctcatggccttggctgcaaacaaggacctgcaattcacctacgagaagccggtccttgtcccacttgcagaagccattgccaaggaggctgcggcgccaggaggtccctggttcccattgcctgtgtccgcgacgcagttgctgctcactcagggaccagagaataattctttgctgtcatccggaagatagagcatcaagacggctcctttgtgtacagatttattccttcttcttaattagtctgttgatgtttgagacgcgggtgcggcaggcttaggcttttagtttataagcctgctgactattgtgtctgtgttgtaacatctagccattgctcaagcaggaaatcctttgcttg

SEQ ID NO: 23223 - protein, 278 aa, Panicum virgatum
  misc_feature: Ceres CLONE 1826412
  misc_feature (95)..(198): Pfam Name: Thioredoxin Pfam Description: Thioredoxin
  misc_feature: SWISSPROT Homolog: EC 1.8.1.8 Protein-disulfide reductase
MAEALCNGVVASPCAGDVGVGVAARVRGAVAALAESVLIGGYSTKSSFSAGRMAMTDRKARPLPRTLEAAPGQMNLSFPKAMRWWHKGLQPNMREIESAQDLADSLLNAGDKLVVVDFFSPGCGGCRALHPKIAQFAERNPDVMFLQVNYETHKSMCYSLHVHVLPFFRFYRGAEGRVSSFSCTNATIKKFKDALAKHGPERCSLGPARGLEESELMALAANKDLQFTYEKPVLVPLAEAIAKEAAAPGGPWFPLPVSATQLLLTQGPENNSLLSSGR

SEQ ID NO: 23224 - DNA, 1308 bp, Panicum virgatum
  misc_feature: Ceres CLONE 1826414
  misc_feature: Encodes the peptide sequence at SEQ ID NO. 23225
agccacagcccacaacccagatctgagcaacgaaatggcacacccggagggcagcactgaggacttgctctaaggtcatcttctgctcttgcacgagtccctcggctacatcaagtccgccgccctcgccgtcactctggacgtcggcattgccgacgccatccaccactacggcggcagcgccaccgctccccagatactcgccaagattgacgtcagcccgtccaagcaccggggcctgcgccggctgatgcgcatgctcacggtctcaggcatcttcgccgtcaggcacccagcatctgataatggagacgggtgcgaagctctctacgagctgacggcggcctcccgccgcctcctcggcgacgggagctcgacgacggcgagcctgacgcctcttctgaccatgctgctcgggccgctgctggcgtccccgctcgccgcggtcgtgagcgcgctggtccggcaggagcagcagccggacctgtccgcgttcggcatcgcgcacggcgacaccgtctggaacgtggcggaccaggaggccgccttcaacatctccctgcacgacgccatcgccgcggacacccgcttcctcatgcccatcgtcttcaaggagtgcggcgaggtctttcagggggtaggctcctcgctggtggacgtcggcggcggaccgtatggcagcgccgccgccgccatcgcggcggcgttcccgcatctgaggtgcagcgttcttgatctccctcatgtcgttgcccaggctgctcctcctgctgatggtagcaacgtgcagttcatcgccggcgacatgttcgagagcataccactggcagatgctgttttcctcaagtggattttgcacgattggggagacgatgagtgcgtcaagctgctgaagagatgcaaggaagccattcctccacgggatgctggaggaaaagtgataataatagatatggtactcggatcaggaccgtctgacgagaagcatagagagacacaggttttgttcgatctcctgatgatggctctcaatggagttgaacgagatgagcaggagtggaagaagattttcttcgaagcaggattcaaggactacagaattataccagttcttggtactcggtcgattattgagctttatccatgaacgttcgatcaacaagacgaccaaagaataagagcgtgttgaattaaaaaaggcacatggaagtcgtcatgaatctctgcaagcctaataaatgtgtcagtgacaagtgctgcattgcgcgagtatattttaataattgtaataaaatgctcaaacctgcc

SEQ ID NO: 23225 - protein, 298 aa, Panicum virgatum
  misc_feature: Ceres CLONE 1826414
  misc_feature (15)..(275): Pfam Name: Methyltransf_2 Pfam Description: O-methyltransferase
  misc_feature: SWISSPROT Homolog: EC 2.1.1.150 Isoflavone 7-O-methyltransferase
MRMLTVSGIFAVRHPASDNGDGCEALYELTAASRRLLGDGSSTTASLTPLLTMLLGPLLASPLAAVVSALVRQEQQPDLSAFGIAHGDTVWNVADQEAAFNISLHDAIAADTRFLMPIVFKECGEVFQGVGSSLVDVGGGPYGSAAAAIAAAFPHLRCSVLDLPHVVAQAAPPADGSNVQFIAGDMFESIPLADAVFLKWILHDWGDDECVKLLKRCKEAIPPRDAGGKVIIIDMVLGSGPSDEKHRETQVLFDLLMMALNGVERDEQEWKKIFFEAGFKDYRIIPVLGTRSIIELYP

SEQ ID NO: 23226 - DNA, 1365 bp, Panicum virgatum
  misc_feature: Ceres CLONE 1826422
  misc_feature: Encodes the peptide sequence at SEQ ID NO. 23227
atccctccgcaccctcttatctgctacgcctccgcgctcccgctcctcccccacctccaccaccatggccacggccgcggcggcctccgcctcctcctcgctcctcgcgccggctgccagcacggcgccggccgcgcccaacgcgctgctgttcccctcctccgtgccgacgctgcgcgcctacccgcggctgctcctctcgttccgccgccccgcggccgccgccgtagccgacccgcagggggccgtgctcgaggaggaggaggccgaggccgaggccgaccagcgcggccggtacgtcgacgaggacgaggacgacgggtacgagggcggccgcggctccgcgttcacgccccccacgcgcccgcgcaccggcaaggccgccctgccgctcaagcgcgaccgcacgcggtcgaaaaggttcctcgagatacagaagctgagggagagcaagaaggagtacgacgtgcccaccgccatctcgctgatgaagcagatggccagcgcgaaatttaaagagtcggccgaggcgcacttccgcatgaacctcgaccccaagtacaacgatcagcagctccgcgccacggtgaatttgcccaagggaacaggccagttggtgaagattgcagtcctcacacaaggtgagaagatagatgaagctagagctgcaggagctgatatagttggtggagatgacttgatcgaacaaataaaaggagggtttatggactttgacaaattgattgcatcacctgatatgatgcctaaggttgctggcttgggtaagattctaggaccaagaggactgatgcctaacccaaaagctggcactgtttctccgaacattactcaggctatcgaagagttcaagaaggggaaagttgaatacagagttgacaaaacagggattgtccatattccgttcggcaaggttgactttcctgaagaagatcttatcgctaacttcatggctgttgtgcgctctgttgagaggaacaagccatctggtgccaaggggatatactggaaaacggcgtacttgtgctcatccatgggaccttcaatcaagctaaacataaaagaaatgcttgactatggcacagaatcatcttagatgtcaccacaggcaccagttaagtcatctggcatttgggaccacctcccaggttttaaccatccgtccctgctacagatgagcacagaaacaatggtcgaggggtaattgggtatgatggcaggtaggtgcttagatacttttttttcggtttaatgggcacccatcatcagagcagtaaaactatgcccagattgacagagaggtgatctcgttgatcatgtatttatgagcaaatcatgcatggattc

SEQ ID NO: 23227 - protein, 349 aa, Panicum virgatum
  misc_feature: Ceres CLONE 1826422
  misc_feature (128)..(333): Pfam Name: Ribosomal_L1 Pfam Description: Ribosomal protein L1p/L10e family
MATAAAASASSSLLAPAASTAPAAPNALLFPSSVPTLRAYPRLLLSFRRPAAAAVADPQGAVLEEEEAEAEADQRGRYVDEDEDDGYEGGRGSAFTPPTRPRTGKAALPLKRDRTRSKRFLEIQKLRESKKEYDVPTAISLMKQMASAKFKESAEAHFRMNLDPKYNDQQLRATVNLPKGTGQLVKIAVLTQGEKIDEARAAGADIVGGDDLIEQIKGGFMDFDKLIASPDMMPKVAGLGKILGPRGLMPNPKAGTVSPNITQAIEEFKKGKVEYRVDKTGIVHIPFGKVDFPEEDLIANFMAVVRSVERNKPSGAKGIYWKTAYLCSSMGPSIKLNIKEMLDYGTESS

SEQ ID NO: 23228 - DNA, 1535 bp, Panicum virgatum
  misc_feature: Ceres CLONE 1826434
  misc_feature: Encodes the peptide sequence at SEQ ID NO. 23229
gaggcgcggtctacggtttgccaccactgtacaccacaccggcgcgctacccgcctgccctgctactgttcctccgtctccgcaccactgttgctttccccaatccgatcctccgtggtcgattgccgcggatggaggcgttgaagaagcacgccagcaagctccgggagcaagtctccaagcagcagaaggcggttttcaagcaattcagtgcgcgatataatcaagacccctctcttgtcgatgaagcggagcttgagtgccaccagaatctccagaggctttacagtactactagagccgctaagcatttccagcgaaatattgtacgaggcgtggaaggtttcattgccattagcaccaaacagatggagattgtgaaaagactagctgaggattgttgcaaatatggagtcgacaatgaacattttggttttgctcttgcaaaggcatctgtggagtttggtaattctcataaacaaatagagaaagagcgggaggatcttcttaaagttcttggagagcaggtttttgagcctctccgagaaatgataatgagtgctccccttgaagatgctcgcttgctaacttaccgttatcaacggatcagacaagacatggagtctcagatagctgatgtgacgagaaagcaacttaagtccaaggaaagtagtggcaacacagataactctgtaaaactgcaacatgcagaatcaaaattatcagatcttcgaactacactggcagcattaggaagagaagcaactgcagctatggaggctgtagaggctcagcaacagcaagctacatatgaacgtctccttgcaatggttgatgctgagagaacgtatcatcaaaacgctgctgatattctgaataaactccatgatgagatgctccttgcaaggcatcatagtgaaacaataaaacattatgatgaacagtcatcagagcctgaatcggaaactgctccagcgcaagtgcactcagatagcacatctgaagatccagtattaactaaacctagcgaatccacagggaatggtcaggaggtacaatttcttggggaggttattcatccattcgatgctcaggctgatggtgagctcagtctatccgtgggcgaatatgttgtggtccgccaggtggcatcaaacggttggtcggaaggggaatgcaagggaaaggctggctggttcccatctgcctatgtagagcggagggacaaagccccggcaagcaaggtgatagagcctggacttctgtctacttgatccatcacgtacttattggttctgacttgctgtcatcgtcctttgtcttcgtcattgtacatgacatgttggatgagcgattagtgttccgtagaactttttaccttcttgtgcagattattgttcttctactgagcttttcccttgcttggtaactgtatgtaaagtgtagttttgggccctaggatttctttttggtatacgaccatgtacagaactattggtgacgagaagctgtcaacttgccctttatattcggac

SEQ ID NO: 23229 - protein, 380 aa, Panicum virgatum
  misc_feature: Ceres CLONE 1826434
  misc_feature (310)..(364): Pfam Name: SH3_1 Pfam Description: SH3 domain
MEALKKHASKLREQVSKQQKAVFKQFSARYNQDPSLVDEAELECHQNLQRLYSTTRAAKHFQRNIVRGVEGFIAISTKQMEIVKRLAEDCCKYGVDNEHFGFALAKASVEFGNSHKQIEKEREDLLKVLGEQVFEPLREMIMSAPLEDARLLTYRYQRIRQDMESQIADVTRKQLKSKESSGNTDNSVKLQHAESKLSDLRTTLAALGREATAAMEAVEAQQQQATYERLLAMVDAERTYHQNAADILNKLHDEMLLARHHSETIKHYDEQSSEPESETAPAQVHSDSTSEDPVLTKPSESTGNGQEVQFLGEVIHPFDAQADGELSLSVGEYVVVRQVASNGWSEGECKGKAGWFPSAYVERRDKAPASKVIEPGLLST

SEQ ID NO: 23230 - DNA, 1507 bp, Panicum virgatum
  misc_feature: Ceres CLONE 1826438
  misc_feature: Encodes the peptide sequence at SEQ ID NO. 23231
atcccattccccttccttccagaggagagagagagagaagaaaagataagctcagctcggctcaggctcaggctcagctcgcaagcaagtggagatgcggagcccacgaggagcagcagcagccgggcgctgcggcgcccaggagcacgtcgacctgatcccgggcatccccgacgacgtcgccgtcgactgcctggcgcgcgttccccacgcgtcccaccgcgcgctccgccgcgtctgccgcggctggcgcagcgccgccgccaagccggccttcgcctcggcgcgcgccgccgcgggcgccaccgaggacctcgtctacctcttgcagttcggcaacccctccgccgccgacgacgacggggcgcctaaggacggcgccgacgcgccgccgcccagcgcgccggcctacggcgtcgccgtctacaacgtgaccacgggcgagtggcgccgggagcgcggcgcgccgcccgtgctccccgtcttcgcgcagtgcgccgcggtgggcacccgcgtggccgtgctcggcggctgggacccgcgcaccttcgagcccgtcgccgacgtgcacgtcctcgacgccgccaccggcgcgtggcgccgcgccgcgccgatgcggtccgcgcggtccttcttcgcgtgcgccgaggccggcggcaagatctacgtcgccggcgggcacgacaagcacaagaacgcgctcaagacggccgaggcctacgacgccggcgccgacgcctgggacccgctcccggacatgtcggaggagcgcgacgagtgcgacggcatggccaccgtggcgggcgaccgcttcctcgccgtcagcgggtaccgcacggcgcggcagggcgggttcgagcgcgacgccgagtggttcgaccccgccgcccgggagtggcggcggctggagcgcgtccgggcgccgccctccgcggcgcacgtcgtggtccggggccgcgtctggtgcatcgagggcagcgccgtgatggagtggatgggcacccgccgcgggtggcgcgaggtcgggccctacccgccggggctcaaggccggcacggcgcgcgccgtctgcgtcggcggcggcgagaaggtggtcgtcacgggggccctcgacggggagggcggccggcacgcgctctgggtgttcgacgtcaggaccaagagctggaccgtggtgcgcccgccgccggagttcgccggcttcgtcttctccgtcgcgtccgtccgcatctgaagatctggatctcggccgccccagccccgggccccgatccgcccccatcgaccaagaaacaaaagaagaaatcaaggctactacgactactagtgtgtgtccgtgcaccgtgcccgccattgctggatctgagatctgcgcgtcggccatggatctctgcatctgcttggatactagtatgcccgtcccataatcctacatcgaaggagttgaaggagagcccccgatcgacgccagatccacggatcgagccgtgggtgtgagaaaaaagcc

SEQ ID NO: 23231 - protein, 379 aa, Panicum virgatum
  misc_feature: Ceres CLONE 1826438
  misc_feature (177)..(223): Pfam Name: Kelch_1 Pfam Description: Kelch motif
  misc_feature (20)..(67): Pfam Name: F-box Pfam Description: F-box domain
  misc_feature: SWISSPROT Homolog: EC 1.1.3.9 Galactose oxidase
MRSPRGAAAAGRCGAQEHVDLIPGIPDDVAVDCLARVPHASHRALRRVCRGWRSAAAKPAFASARAAAGATEDLVYLLQFGNPSAADDDGAPKDGADAPPPSAPAYGVAVYNVTTGEWRRERGAPPVLPVFAQCAAVGTRVAVLGGWDPRTFEPVADVHVLDAATGAWRRAAPMRSARSFFACAEAGGKIYVAGGHDKHKNALKTAEAYDAGADAWDPLPDMSEERDECDGMATVAGDRFLAVSGYRTARQGGFERDAEWFDPAAREWRRLERVRAPPSAAHVVVRGRVWCIEGSAVMEWMGTRRGWREVGPYPPGLKAGTARAVCVGGGEKVVVTGALDGEGGRHALWVFDVRTKSWTVVRPPPEFAGFVFSVASVRI

SEQ ID NO: 23232 - DNA, 1326 bp, Panicum virgatum
  misc_feature: Ceres CLONE 1826443
  misc_feature: Encodes the peptide sequence at SEQ ID NO. 23233
atcctttccttcaccatcctcttctctctctgcctgctgctggtttggtgtcgctgccgcctgccggtccgtctggtctgctggtggtggtggtagttgttggaacgagagcgtcagctggcagtagagccaatcaatggcggggctggggaggtgaaggtcttcgccgcttcggctttagccagcccaggagaaggcgccggccccaaccccaaggaacaagaggggtctccaggtgggctgctgtagatccttcctccggcgatcgtttcttttctctctctgctcgtggtcgaggaattggggattttttccccgcagcaagtagcagcacgcttgaggctcgctgctgcaggtaggcggagcatgcgccacgtccgggtgtcctcccaccaggcccccgtccacaagctcggccacgcgcagatggtgctcacgcccaagttccgcctcgccaccgccgcccccgcgccgccctcgcccacggaggcccagcagccggcctgggagacgccgctgatcccggggatccccgacgacgccgcgctcggctgcctcctccgcctgcccgtcgaggcgcacgcggcctgccgcctcgtgtgccgccgctggcgccccctcctcgccgacaaggcgcgcttcttcgcgcagcggcggscgctgggcctccgcaccccctggctcttcaccctcgccttccaccgctgcacgggcaagatccagtggaaggtgctcgacctcggccacctcacctggcacgccatccccgccatgccgtgccgggaccgggcgtgcccccgggggttcggctgcgtcgccatccccagcgacggcacgctcctcgtctgcggcggcctcgtctccgacatggactgcccactgcacctggtgctcaagtatgacatctacaggaacaggtggaccgtcatgacgaggatgctcgccgcccgctccttctttgccggcggtgtgatcgatggccgggtttatgtcgccggaggctatagcaccaaccagtttgagctcaattccgcagaggttcttgatccggacaagggcgtttggcagccaatcgctagtatgggcatcaacatggcctcctcggactctgctgtcatcagtggtaggctctatgtcactgaaggttgcgcgtggccgttcttctcgtcgccgagaggacaggtttatgatccgaagatcgaccggtgggaggcaatgccggttggaatgcgtgaaggttggacgggacagagtgtggtcatcgatgggcatctgtttgtcatttcagagtatgagaggatgaaggttaagattctatgatcccca

SEQ ID NO: 23233 - protein, 297 aa, Panicum virgatum
  misc_feature: Ceres CLONE 1826443
  misc_feature (125)..(172): Pfam Name: Kelch_1 Pfam Description: Kelch motif
  misc_feature (174)..(220): Pfam Name: Kelch_1 Pfam Description: Kelch motif
  misc_feature (30)..(77): Pfam Name: F-box Pfam Description: F-box domain
  misc_feature (78)..(78): Xaa is any aa, unknown, or other
MVLTPKFRLATAAPAPPSPTEAQQPAWETPLIPGIPDDAALGCLLRLPVEAHAACRLVCRRWRPLLADKARFFAQRRXLGLRTPWLFTLAFHRCTGKIQWKVLDLGHLTWHAIPAMPCRDRACPRGFGCVAIPSDGTLLVCGGLVSDMDCPLHLVLKYDIYRNRWTVMTRMLAARSFFAGGVIDGRVYVAGGYSTNQFELNSAEVLDPDKGVWQPIASMGINMASSDSAVISGRLYVTEGCAWPFFSSPRGQVYDPKIDRWEAMPVGMREGWTGQSVVIDGHLFVISEYERMKVKIL

SEQ ID NO: 23234 - DNA, 1193 bp, Panicum virgatum
  misc_feature: Ceres CLONE 1826454
  misc_feature: Encodes the peptide sequence at SEQ ID NO. 23235
acgtccgtcccgctccacgacgcgttccgtccccccacccggcaacacaacacgcggcgggcgcaaatccccgcgaccccccacaccaatcggagctgggagccggcgccgatcgaatcgaccaccggaccccaatcccgaacccccgcctccaatcaggtcctccaatcctccgcgccgcgggccggggaggcgagagcgcgacgatgtcgggggccggggactaccaggagatggcggcgtcggtgccgccgtcgctgaaggccatcacgctgacgcacgtccggtaccggccgggcgacccgctgggcctcttcctcgcgtgggtctccctcgtcccggtcttcatcagcctcggcggcttcgtctcccacttcctcttccgccgggagctccagggcctctgcttcgccgcggggctcctcgtctcgcaggccctcaacgagctcatcaagcactccgtcgcgcagtcccgcccggcctactgcgagctcctcgaggcctgcgactcccacgggtggccgtccagccactcgcagtacaccttcttcttcgccacctacctcacgctcctctcgctccgccggtcgcgcgcgcgccgggtgatcgccgccgtgccgtggccgctagccttcctcaccatggtgtccagggtgtacctagggtaccacaccgtcgcgcaggttttcgcgggagcaatagtgggccttgtctttggtgctatctggtactggattgtcaacaccatgcttgttgattacttcccgatgattgaggagagtgcgatcgggaggtggttgtacatcaaggatacatctcatattccagacgtgcttaagtttgagtatgataatgcaagggcaacaaggaagaaagttgctactgattgagcttgttgtgcccccgtttttcattttgctcacagtgattataagaatgtgtgcggcatgttatttgcttcagttgctgcacacagacacatgtagcagcaatattttcagtagaagaaatgtctattacagcttggcattttgcttttcctgggcatatgctaatctttgctcagtcattttgtttctcgtaatggcagtttgatcataacttgactattgcttacatttagaaatgacatgtgaacaatacgtgaaattcatttccagcatcgagatgatctttcgttggttgtctgtgtg

SEQ ID NO: 23235 - protein, 227 aa, Panicum virgatum
  misc_feature: Ceres CLONE 1826454
  misc_feature (64)..(183): Pfam Name: PAP2 Pfam Description: PAP2 superfamily
  misc_feature: SWISSPROT Homolog: EC 3.6.1.43 Dolichyldiphosphatase
MSGAGDYQEMAASVPPSLKAITLTHVRYRPGDPLGLFLAWVSLVPVFISLGGFVSHFLFRRELQGLCFAAGLLVSQALNELIKHSVAQSRPAYCELLEACDSHGWPSSHSQYTFFFATYLTLLSLRRSRARRVIAAVPWPLAFLTMVSRVYLGYHTVAQVFAGAIVGLVFGAIWYWIVNTMLVDYFPMIEESAIGRWLYIKDTSHIPDVLKFEYDNARATRKKVATD

SEQ ID NO: 23236 - DNA, 683 bp, Panicum virgatum
  misc_feature: Ceres CLONE 1826463
  misc_feature: Encodes the peptide sequence at SEQ ID NO. 23237
acttcatcaccgcactcttcttcttccttgtcccgccttctccatcctctcccagcagcagctgctgacacctcttcgaactccaatcctgctcccacacactgctgttccagctagctcgcacgcgagatagagccgcagcgatatccctctgttctccggttttgatcgatcgacgatcgattatcagctgtaggatcaggaggggtgagagagggagagagaatctgatggatatggcgcacgagagagacgcgagcagcgaggaggaggtgatggccggcgagctccggcgcgggccgtggacggtggaggaggacctgctgcttgtcaactacgtcgcctcgcacggcgagggccgctggaattcgctcgcccgatcagcagggctgaagcgcaccggcaagagctgccgcctccggtggctcaactaccttcgccccgacctccggcgcggcaacatcacgccgcaggagcagctgctcatcctcgagctgcactcgcgctggggcaaccgctggtccaagatcgcgcagcacctccccggccgcaccgacaacgagatcaagaactactggcgcacgcgcgtgcagaagcacgccaagcagctcaagtgcgacgtcaacagccagcagttcaaggacgtgatgcgctacctctggatgccccgcctcgtcgagcgc

SEQ ID NO: 23237 - protein, 150 aa, Panicum virgatum
  misc_feature: Ceres CLONE 1826463
  misc_feature (22)..(69): Pfam Name: Myb_DNA-binding Pfam Description: Myb-like DNA-binding domain
  misc_feature (75)..(120): Pfam Name: Myb_DNA-binding Pfam Description: Myb-like DNA-binding domain
  misc_feature: The sequence is a functional homolog of SEQ ID NO 1566 in the 10/374,780 US patent application
  misc_feature: The sequence is a functional homolog of SEQ ID NO 1563 in the 10/374,780 US patent application
  misc_feature: Useful for making plants with modulated drought sensitivity
  misc_feature: The sequence is a functional homolog of SEQ ID NO 156 in the 10/225,068 US patent application
  misc_feature: The sequence is a functional homolog of SEQ ID NO 262 in the 10/374,780 US patent application
  misc_feature: The sequence is a functional homolog of SEQ ID NO 282 in the 10/225,066 US patent application
  misc_feature: The sequence is a functional homolog of SEQ ID NO 1564 in the 10/374,780 US patent application
  misc_feature: The sequence is a functional homolog of SEQ ID NO 2178 in the 10/374,780 US patent application
  misc_feature: The sequence is a functional homolog of SEQ ID NO 1565 in the 10/374,780 US patent application
  misc_feature: The sequence is a functional homolog of SEQ ID NO 196 in the 10/225,066 US patent application
  misc_feature: The sequence is a functional homolog of SEQ ID NO 2900 in the 10/374,780 US patent application
  misc_feature: Useful for making plants with modulated biomass
  misc_feature: Useful for making plants with modulated flowering time
  misc_feature: The sequence is a functional homolog of SEQ ID NO 1672 in the 11/479,226 US patent application
  misc_feature: The sequence is a functional homolog of SEQ ID NO 846 in the 10/412,699 US patent application
  misc_feature: The sequence is a functional homolog of SEQ ID NO 36 in US patent 7193132
  misc_feature: The sequence is a functional homolog of SEQ ID NO 1746 in the 10/412,699 US patent application
  misc_feature: The sequence is a functional homolog of SEQ ID NO 1970 in the 10/374,780 US patent application
  misc_feature: The sequence is a functional homolog of SEQ ID NO 452 in the 10/225,066 US patent application
  misc_feature: The sequence is a functional homolog of SEQ ID NO 584 in the 11/435,388 US patent application
  misc_feature: The sequence is a functional homolog of SEQ ID NO 2 in the 10/225,068 US patent application
  misc_feature: The sequence is a functional homolog of SEQ ID NO 22 in the 10/225,068 US patent application
  misc_feature: The sequence is a functional homolog of SEQ ID NO 230 in the 10/225,066 US patent application
  misc_feature: The sequence is a functional homolog of SEQ ID NO 258 in the 10/374,780 US patent application
  misc_feature: The sequence is a functional homolog of SEQ ID NO 442 in the 11/435,388 US patent application
  misc_feature: The sequence is a functional homolog of SEQ ID NO 842 in the 10/412,699 US patent application
  misc_feature: The sequence is a functional homolog of SEQ ID NO 98 in the 11/375,241 US patent application
  misc_feature: The sequence is a functional homolog of SEQ ID NO 1540 in the 10/374,780 US patent application
  misc_feature: The sequence is a functional homolog of SEQ ID NO 1634 in the 10/412,699 US patent application
  misc_feature: The sequence is a functional homolog of SEQ ID NO 1541 in the 10/374,780 US patent application
  misc_feature: The sequence is a functional homolog of SEQ ID NO 1635 in the 10/412,699 US patent application
  misc_feature: The sequence is a functional homolog of SEQ ID NO 126 in the 10/412,699 US patent application
  misc_feature: The sequence is a functional homolog of SEQ ID NO 1408 in the 11/479,226 US patent application
  misc_feature: The sequence is a functional homolog of SEQ ID NO 664 in the 10/412,699 US patent application
  misc_feature: The sequence is a functional homolog of SEQ ID NO 176 in the 10/412,699 US patent application
  misc_feature: The sequence is a functional homolog of SEQ ID NO 385 in the 11/479,226 US patent application
  misc_feature: The sequence is a functional homolog of SEQ ID NO 2696 in the 10/374,780 US patent application
  misc_feature: The sequence is a functional homolog of SEQ ID NO 344 in the 10/225,066 US patent application
  misc_feature: The sequence is a functional homolog of SEQ ID NO 2394 in the 10/374,780 US patent application
  misc_feature: The sequence is a functional homolog of SEQ ID NO 544 in the 10/225,066 US patent application
  misc_feature: The sequence is a functional homolog of SEQ ID NO 999 in the 11/479,226 US patent application
  misc_feature: The sequence is a functional homolog of SEQ ID NO 122 in the 10/412,699 US patent application
  misc_feature: The sequence is a functional homolog of SEQ ID NO 126 in the 11/375,241 US patent application
  misc_feature: The sequence is a functional homolog of SEQ ID NO 148 in the 10/286,264 US patent application
  misc_feature: The sequence is a functional homolog of SEQ ID NO 34 in the 10/374,780 US patent application
  misc_feature: The sequence is a functional homolog of SEQ ID NO 438 in the 10/225,066 US patent application
  misc_feature: The sequence is a functional homolog of SEQ ID NO 168 in the 10/412,699 US patent application
  misc_feature: The sequence is a functional homolog of SEQ ID NO 377 in the 11/479,226 US patent application
  misc_feature: The sequence is a functional homolog of SEQ ID NO 1917 in the 10/374,780 US patent application
  misc_feature: The sequence is a functional homolog of SEQ ID NO 186 in the 10/412,699 US patent application
  misc_feature: The sequence is a functional homolog of SEQ ID NO 2564 in the 10/374,780 US patent application
  misc_feature: The sequence is a functional homolog of SEQ ID NO 276 in the 10/225,066 US patent application
  misc_feature: The sequence is a functional homolog of SEQ ID NO 818 in the 10/412,699 US patent application
  misc_feature: Useful for making plants with modulated nitrogen use efficiency
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
  misc_feature: The sequence is a functional homolog of SEQ ID NO 168 in the 10/225,066 US patent application
  misc_feature: The sequence is a functional homolog of SEQ ID NO 2718 in the 10/374,780 US patent application
  misc_feature: The sequence is a functional homolog of SEQ ID NO 116 in the 10/412,699 US patent application
  misc_feature: The sequence is a functional homolog of SEQ ID NO 280 in the 11/479,226 US patent application
  misc_feature: Useful for making plants with altered lignin content
  misc_feature: Useful for making plants with altered cell wall content and/or composition
  misc_feature: The sequence is a functional homolog of SEQ ID NO 822 in the 10/412,699 US patent application
  misc_feature: The sequence is a functional homolog of SEQ ID NO 836 in the 10/412,699 US patent application
  misc_feature: The sequence is a functional homolog of SEQ ID NO 1011 in the 11/479,226 US patent application
  misc_feature: The sequence is a functional homolog of SEQ ID NO 434 in the 10/412,699 US patent application
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: The sequence is a functional homolog of SEQ ID NO 266 in the 10/374,780 US patent application
  misc_feature: The sequence is a functional homolog of SEQ ID NO 536 in the 11/435,388 US patent application
  misc_feature: The sequence is a functional homolog of SEQ ID NO 640 in the 10/225,066 US patent application
  misc_feature: The sequence is a functional homolog of SEQ ID NO 856 in the 10/412,699 US patent application
  misc_feature: The sequence is a functional homolog of SEQ ID NO 442 in the 10/412,699 US patent application
  misc_feature: The sequence is a functional homolog of SEQ ID NO 569 in the 10/374,780 US patent application
  misc_feature: The sequence is a functional homolog of SEQ ID NO 1684 in the 11/479,226 US patent application
  misc_feature: The sequence is a functional homolog of SEQ ID NO 2582 in the 10/374,780 US patent application
  misc_feature: The sequence is a functional homolog of SEQ ID NO 30 in the 11/375,241 US patent application
  misc_feature: The sequence is a functional homolog of SEQ ID NO 854 in the 10/412,699 US patent application
  misc_feature: The sequence is a functional homolog of SEQ ID NO 2574 in the 10/374,780 US patent application
  misc_feature: The sequence is a functional homolog of SEQ ID NO 278 in the 10/225,066 US patent application
  misc_feature: The sequence is a functional homolog of SEQ ID NO 1094 in the 10/225,066 US patent application
  misc_feature: The sequence is a functional homolog of SEQ ID NO 386 in the 10/374,780 US patent application
  misc_feature: The sequence is a functional homolog of SEQ ID NO 296 in the 11/479,226 US patent application
  misc_feature: The sequence is a functional homolog of SEQ ID NO 1434 in the 10/666,642 US patent application
  misc_feature: The sequence is a functional homolog of SEQ ID NO 1850 in the 10/412,699 US patent application
  misc_feature: The sequence is a functional homolog of SEQ ID NO 848 in the 10/412,699 US patent application
  misc_feature: Useful for making plants with altered alkaloid content
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 504 in the 10/666,642 US patent application
  misc_feature: The sequence is a functional homolog of SEQ ID NO 896 in the 11/435,388 US patent application
  misc_feature: The sequence is a functional homolog of SEQ ID NO 1052 in the 11/479,226 US patent application
  misc_feature: The sequence is a functional homolog of SEQ ID NO 456 in the 10/412,699 US patent application
  misc_feature: The sequence is a functional homolog of SEQ ID NO 200 in the 10/666,642 US patent application
  misc_feature: The sequence is a functional homolog of SEQ ID NO 830 in the 10/412,699 US patent application
  misc_feature: The sequence is a functional homolog of SEQ ID NO 428 in the 10/374,780 US patent application
  misc_feature: The sequence is a functional homolog of SEQ ID NO 54 in the 11/375,241 US patent application
  misc_feature: The sequence is a functional homolog of SEQ ID NO 870 in the 10/225,066 US patent application
  misc_feature: The sequence is a functional homolog of SEQ ID NO 593 in the 10/374,780 US patent application
  misc_feature: The sequence is a functional homolog of SEQ ID NO 782 in the 11/435,388 US patent application
  misc_feature: The sequence is a functional homolog of SEQ ID NO 271 in the 11/479,226 US patent application
  misc_feature: The sequence is a functional homolog of SEQ ID NO 136 in the 10/412,699 US patent application
  misc_feature: The sequence is a functional homolog of SEQ ID NO 325 in the 11/479,226 US patent application
  misc_feature: The sequence is a functional homolog of SEQ ID NO 592 in the 10/374,780 US patent application
  misc_feature: The sequence is a functional homolog of SEQ ID NO 786 in the 11/435,388 US patent application
  misc_feature: The sequence is a functional homolog of SEQ ID NO 134 in the 10/412,699 US patent application
  misc_feature: The sequence is a functional homolog of SEQ ID NO 321 in the 11/479,226 US patent application
  misc_feature: Useful for making plants with modulated low light sensitivity
  misc_feature: The sequence is a functional homolog of SEQ ID NO 1033 in the 10/412,699 US patent application
  misc_feature: The sequence is a functional homolog of SEQ ID NO 540 in the 10/374,780 US patent application
  misc_feature: The sequence is a functional homolog of SEQ ID NO 794 in the 11/435,388 US patent application
  misc_feature: The sequence is a functional homolog of SEQ ID NO 1074 in the 10/412,699 US patent application
  misc_feature: The sequence is a functional homolog of SEQ ID NO 590 in the 10/374,780 US patent application
  misc_feature: The sequence is a functional homolog of SEQ ID NO 726 in the 11/435,388 US patent application
  misc_feature: The sequence is a functional homolog of SEQ ID NO 2556 in the 10/374,780 US patent application
  misc_feature: The sequence is a functional homolog of SEQ ID NO 272 in the 10/225,066 US patent application
  misc_feature: The sequence is a functional homolog of SEQ ID NO 528 in the 11/435,388 US patent application
  misc_feature: Useful for making plants with altered carbohydrate content
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 110 in the 10/412,699 US patent application
  misc_feature: The sequence is a functional homolog of SEQ ID NO 259 in the 11/479,226 US patent application
  misc_feature: The sequence is a functional homolog of SEQ ID NO 796 in the 11/435,388 US patent application
  misc_feature: The sequence is a functional homolog of SEQ ID NO 792 in the 11/435,388 US patent application
  misc_feature: The sequence is a functional homolog of SEQ ID NO 263 in the 11/479,226 US patent application
  misc_feature: The sequence is a functional homolog of SEQ ID NO 478 in the 11/435,388 US patent application
  misc_feature: The sequence is a functional homolog of SEQ ID NO 54 in the 10/666,642 US patent application
  misc_feature: The sequence is a functional homolog of SEQ ID NO 184 in the 10/412,699 US patent application
  misc_feature: The sequence is a functional homolog of SEQ ID NO 397 in the 11/479,226 US patent application
  misc_feature: The sequence is a functional homolog of SEQ ID NO 46 in the 10/374,780 US patent application
  misc_feature: The sequence is a functional homolog of SEQ ID NO 590 in the 11/435,388 US patent application
  misc_feature: The sequence is a functional homolog of SEQ ID NO 6 in the 10/225,068 US patent application
  misc_feature: The sequence is a functional homolog of SEQ ID NO 790 in the 11/435,388 US patent application
  misc_feature: The sequence is a functional homolog of SEQ ID NO 1118 in the 10/225,066 US patent application
  misc_feature: The sequence is a functional homolog of SEQ ID NO 1396 in the 11/479,226 US patent application
  misc_feature: The sequence is a functional homolog of SEQ ID NO 2488 in the 10/374,780 US patent application
  misc_feature: The sequence is a functional homolog of SEQ ID NO 658 in the 10/412,699 US patent application
  misc_feature: The sequence is a functional homolog of SEQ ID NO 824 in the 10/412,699 US patent application
  misc_feature: The sequence is a functional homolog of SEQ ID NO 58 in the 10/666,642 US patent application
  misc_feature: Useful for making plants with altered terpenoid content
  misc_feature: The sequence is a functional homolog of SEQ ID NO 1031 in the 11/479,226 US patent application
  misc_feature: The sequence is a functional homolog of SEQ ID NO 1804 in the 10/412,699 US patent application
  misc_feature: The sequence is a functional homolog of SEQ ID NO 2050 in the 10/374,780 US patent application
  misc_feature: The sequence is a functional homolog of SEQ ID NO 444 in the 10/412,699 US patent application
  misc_feature: The sequence is a functional homolog of SEQ ID NO 598 in the 10/225,066 US patent application
  misc_feature: The sequence is a functional homolog of SEQ ID NO 620 in the 11/435,388 US patent application
  misc_feature: The sequence is a functional homolog of SEQ ID NO 2570 in the 10/374,780 US patent application
  misc_feature: The sequence is a functional homolog of SEQ ID NO 634 in the 10/225,066 US patent application
  misc_feature: The sequence is a functional homolog of SEQ ID NO 832 in the 10/412,699 US patent application
  misc_feature: The sequence is a functional homolog of SEQ ID NO 116 in the 11/375,241 US patent application
  misc_feature: The sequence is a functional homolog of SEQ ID NO 1648 in the 11/479,226 US patent application
  misc_feature: The sequence is a functional homolog of SEQ ID NO 2566 in the 10/374,780 US patent application
  misc_feature: The sequence is a functional homolog of SEQ ID NO 632 in the 10/225,066 US patent application
  misc_feature: The sequence is a functional homolog of SEQ ID NO 650 in the 11/435,388 US patent application
  misc_feature: The sequence is a functional homolog of SEQ ID NO 826 in the 10/412,699 US patent application
  misc_feature: The sequence is a functional homolog of SEQ ID NO 1916 in the 10/412,699 US patent application
  misc_feature: The sequence is a functional homolog of SEQ ID NO 2176 in the 10/374,780 US patent application
  misc_feature: The sequence is a functional homolog of SEQ ID NO 1015 in the 11/479,226 US patent application
  misc_feature: The sequence is a functional homolog of SEQ ID NO 138 in the 10/374,780 US patent application
  misc_feature: The sequence is a functional homolog of SEQ ID NO 436 in the 10/412,699 US patent application
  misc_feature: The sequence is a functional homolog of SEQ ID NO 60 in the 11/375,241 US patent application
  misc_feature: The sequence is a functional homolog of SEQ ID NO 160 in the 10/412,699 US patent application
  misc_feature: The sequence is a functional homolog of SEQ ID NO 214 in the 10/225,068 US patent application
  misc_feature: The sequence is a functional homolog of SEQ ID NO 2270 in the 10/374,780 US patent application
  misc_feature: The sequence is a functional homolog of SEQ ID NO 361 in the 11/479,226 US patent application
  misc_feature: The sequence is a functional homolog of SEQ ID NO 462 in the 10/225,066 US patent application
  misc_feature: The sequence is a functional homolog of SEQ ID NO 482 in the 11/435,388 US patent application
MDMAHERDASSEEEVMAGELRRGPWTVEEDLLLVNYVASHGEGRWNSLARSAGLKRTGKSCRLRWLNYLRPDLRRGNITPQEQLLILELHSRWGNRWSKIAQHLPGRTDNEIKNYWRTRVQKHAKQLKCDVNSQQFKDVMRYLWMPRLVE

SEQ ID NO: 23238 - DNA, 678 bp, Panicum virgatum
  misc_feature: Ceres CLONE 1826469
  misc_feature: Encodes the peptide sequence at SEQ ID NO. 23239
cgcaccccacccccgccgcgcctcccgtcgcttcctccgccgctcgccgccgcgctcccgttcgtgctggtgggcggccggccccgtcgaggagatggactcggtcatggccgcccccgacgcgccgccgcaggccgtcgtgctcgtctccgccggcgccagccattccgtcgcgctgctcacgggcaatgcgctgtgctcgtggggcaggggcgaggacgggcagctcgggcacggcgacgcggaggaccggctcgtgcccacggtgctgagcggcttcgacgcgcccgggatcgcgtcggtcatctgcggcgccgaccacaccaccgcctactccgaggaggagctgcaggtctacagctgggggtggggagacttcgggaggctggggcatggcaactccaccgacgtcttcacgccccagccggtcaaggcgctgcaggggctcaagatcaagcagattgcctgcggggacagccattgtctcgccgtcaccatggccggagaagtgcagagttggggccgtaaccaaaatggacagctaggccttggaactactgaagactcgctgctcccacagaagattcaggcttttgagggtgtttgtgtcaaaatgattgctgccggtgccgaacatacttccgctataactgaagatggcgacctctatggatgggg

SEQ ID NO: 23239 - protein, 194 aa, Panicum virgatum
  misc_feature: Ceres CLONE 1826469
  misc_feature (136)..(185): Pfam Name: RCC1 Pfam Description: Regulator of chromosome condensation (RCC1)
  misc_feature (84)..(133): Pfam Name: RCC1 Pfam Description: Regulator of chromosome condensation (RCC1)
  misc_feature: SWISSPROT Homolog: EC 2.7.11.1 Non-specific serine/threonine protein kinase
MDSVMAAPDAPPQAVVLVSAGASHSVALLTGNALCSWGRGEDGQLGHGDAEDRLVPTVLSGFDAPGIASVICGADHTTAYSEEELQVYSWGWGDFGRLGHGNSTDVFTPQPVKALQGLKIKQIACGDSHCLAVTMAGEVQSWGRNQNGQLGLGTTEDSLLPQKIQAFEGVCVKMIAAGAEHTSAITEDGDLYGW

SEQ ID NO: 23240 - DNA, 671 bp, Panicum virgatum
  misc_feature: Ceres CLONE 1826473
  misc_feature: Encodes the peptide sequence at SEQ ID NO. 23241
ataaaagaagggaagggtccagaatcccctcctatcttctcctcttcttctctcccaagaagaacaagacacgagaggggagagagagagagagtaggaaggagtaatggcgtccgacggcaacggcagcggcgtggtcactgtctacggcaacaacggcgccgccctgctggagccctccaagcagtccaagtcggccaccttctccgtcaaggtgggcctggcgcagatgctgcgcgacggcgtcatcatggacgtcgtcacgccggagcaggcgcgcatcgccgaggaggccggggcctgcgccgtcatggcgctggagcgcgtccccgccgacatccgcgcgcagggcggcgtggcgcgcatgtccgacccgggcctcatccgcgaaatcaagcgcgccgtcaccatcccggtcatggccaaggcgcgcatcggccacttcgtcgaggcccagatcctggaggccgtcggcgtcgactacgtggacgagagcgaggtgctcaccctcgccgacgacgcgcaccacatcaacaagcacaacttccgcgtccccttcgtgtgcggctgccgcgacctcggcgaggcgctgcgccgcatccgcgagggcgccgccatgatccgcaccaagggggaggccggcacgggcaacgtcatcgaggccgtgcgcc

SEQ ID NO: 23241 - protein, 188 aa, Panicum virgatum
  misc_feature: Ceres CLONE 1826473
  misc_feature (31)..(188): Pfam Name: SOR_SNZ Pfam Description: SOR/SNZ family
MASDGNGSGVVTVYGNNGAALLEPSKQSKSATFSVKVGLAQMLRDGVIMDVVTPEQARIAEEAGACAVMALERVPADIRAQGGVARMSDPGLIREIKRAVTIPVMAKARIGHFVEAQILEAVGVDYVDESEVLTLADDAHHINKHNFRVPFVCGCRDLGEALRRIREGAAMIRTKGEAGTGNVIEAVR

SEQ ID NO: 23242 - DNA, 1504 bp, Panicum virgatum
  misc_feature: Ceres CLONE 1826474
  misc_feature: Encodes the peptide sequence at SEQ ID NO. 23243
atgacgtgggcgcggagatgccggacccacgtgtcagcgtcgctgtaacagcctgttccaccgcgccgtccgccggagcaccgccgcgccggagctgtcgtcctgcgcctccgtcccttcgctcacggagaagtcgcagcaggccgctgcacggttgtctcggtggccggcggagctgctacctggccagaaggcgaagaggccgtcgcttccccaggtttttgccagttccgatcagaatattcgcgtcacggagaagccaccaccacctcgggaatctcgcgtcgccgcgatgaaggtggagctcgcagcgcgcacctcccagaccggcaaggcggaggagactccgccaccgtccccggcagccgctgccgcgccatccgcggcggaggacgcgccgctcctccccgacgggggcgtgcggcgccgggcggggtgcgggcggttcgcgcgcagcggctccttccgccgcgaggtcagccgcgccgccgctgagaccttcctcctcacgaggctcaccttgatcctgctccgttacctcgggataggctatagatggatccggcagtttctagccctctgctgttatactttcctgctgttgccaggttttattcaagttgtatattattatttcttctctagccaagtttataggagtgttgtatatggagaccagccaagaaacagattggacttgtatatacccactagtacgacagggttaaagccagtcgtggcatttgtgactggtggagcatggatcatagggtacaaaggttggggggcccttttaggcaggcgcttagcagaaaggggcatcatagttgcatgcattgattacagaaactttcctcaagggaccattggtgacatggtagaagatgcttctcaaggaatctcttttgtttgtaacaatatagcaagttatggaggtgatcctaacaggatttatcttgtgggacaatcagctggtgcacatattgctgcatgtgccctcttaaaccaggccattagcgaatgcggtgaaggagatactttgtcttggagtgtttctcaaataaaagcttactttggcatttctggcgggtacaatctccttaatttggttgatcatttccatagacgtggcctttaccgatccatctttctcagtattatggaaggtgaagagtcactccagaaattttctccacaagtgatgattaaggagtcatctgctagatctgcagtttctttgttgccccatattatccttttccatggaacaagtgactattcaataccatcagctgamagccaagcattcgctgatgctttacaacagcatggtgcaaaagcagacctattcttgtatgaaggaaagacgcatactgatgtattccttcaggatcctcttcgtggtggtagagataaaatgctctaagagatcgccagtgtgatacacatcgaaaatccagacgtatctgccgaccaactcgtcgttcctgctgcacggcttctt

SEQ ID NO: 23243 - protein, 377 aa, Panicum virgatum
  misc_feature: Ceres CLONE 1826474
  misc_feature (149)..(366): Pfam Name: Abhydrolase_3 Pfam Description: alpha/beta hydrolase fold
  misc_feature: SWISSPROT Homolog: EC 3.1.1.3 Triacylglycerol lipase
  misc_feature (335)..(335): Xaa is any aa, unknown, or other
MKVELAARTSQTGKAEETPPPSPAAAAAPSAAEDAPLLPDGGVRRRAGCGRFARSGSFRREVSRAAAETFLLTRLTLILLRYLGIGYRWIRQFLALCCYTFLLLPGFIQVVYYYFFSSQVYRSVVYGDQPRNRLDLYIPTSTTGLKPVVAFVTGGAWIIGYKGWGALLGRRLAERGIIVACIDYRNFPQGTIGDMVEDASQGISFVCNNIASYGGDPNRIYLVGQSAGAHIAACALLNQAISECGEGDTLSWSVSQIKAYFGISGGYNLLNLVDHFHRRGLYRSIFLSIMEGEESLQKFSPQVMIKESSARSAVSLLPHIILFHGTSDYSIPSAXSQAFADALQQHGAKADLFLYEGKTHTDVFLQDPLRGGRDKML

SEQ ID NO: 23244 - DNA, 574 bp, Panicum virgatum
  misc_feature: Ceres CLONE 1826526
  misc_feature: Encodes the peptide sequence at SEQ ID NO. 23245
atatcctctcatctgtcggagcgcataaccccccgcttctaatccaaatcgctcttctcgtgaccctcggcgatccttcccccgtttcaagatgcagatctttgtgaataccttgaccggcaagactatcaccctcgaggtggagtcctccgacaccattgataacgtcaaggcaaagatccaggacaaggagggcatccccccggaccagcagaggcttatcttccccggcaagcagctggaggatggccggactcttgcggactacaacatccagaaggagagcaccctccacctggtgctccgcctgaggggaggcatgcagatcttcatgaagactttgaccggcaagactatcaccctcgaggtggagtcctccgacaccattgacaacgtcaaggcaaagatccaggacaaggagggcatccccccggaccagctgaggcttatcttcgccggcaagcagctggaggatggccgcactcttgcggactaccacatccagaaggagagcaccctccacctggtgctccgtctgaggggaggcatgcagatcttcctgaagaccttgacc

SEQ ID NO: 23245 - protein, 160 aa, Panicum virgatum
  misc_feature: Ceres CLONE 1826526
  misc_feature (82)..(150): Pfam Name: ubiquitin Pfam Description: Ubiquitin family
  misc_feature (6)..(74): Pfam Name: ubiquitin Pfam Description: Ubiquitin family
  misc_feature: Useful for making plants with modulated nitrogen use efficiency
  misc_feature: Useful for making plants with modulated cold sensitivity
  misc_feature: Useful for making plants with modulated flowering time
MQIFVNTLTGKTITLEVESSDTIDNVKAKIQDKEGIPPDQQRLIFPGKQLEDGRTLADYNIQKESTLHLVLRLRGGMQIFMKTLTGKTITLEVESSDTIDNVKAKIQDKEGIPPDQLRLIFAGKQLEDGRTLADYHIQKESTLHLVLRLRGGMQIFLKTL

SEQ ID NO: 23246 - DNA, 1601 bp, Panicum virgatum
  misc_feature: Ceres CLONE 1826538
  misc_feature: Encodes the peptide sequence at SEQ ID NO. 23247
ccacccaggcacccaacgccagataaaatcgctcgcccccattatcgggcgcacgcgtcttccctcttccgaactcgacggcaccgtcccgctagcgaaaccccaaccctaatccgtctccgatctcgcccgccatggccggaaagacgaaggagttcgacggcgccagccccgccaagatcttcatcggcgggcttcccaaggacacaagcatgggtacattcaaagagcattttgggaagtatggggatataactgatgctgtcataatgaaggaccgctacactcaaaagcccagaggctttggatttattaccttcgcagatcctgctgttgttgacagagtgattgaagatgatcatgttatcaatggaaagcaggttgaaattaaaagaactatccccaagggtgctgcccccttgaaagatttcaagacaaagaagatttttgttggtggattaccctctgctctaaaagaagatgagttcaaggagttcttttcaaagtttggaaaggtggtggagcatgaaatcattcgtgaccatgcaaccaaccggtcacgtggatttggttttatagtctttgatgcagaaaaaactgtagatgagttattagctaagaaaggcaatatgattgatctaaatggttctcaggtggaaatcaagaaggcagaaccaaagaaaccctctaacccaccacctcgttcaattgatagcgaacctaggggccgtccatatgcggacagttatgatggatttggcagctcctataactatggtggtagttttggcccctatagatcacctggaagttttggtgctaggcctggcggctacagtagtgcttatggtcctgttgactatggtagtggctatggtgcatatggtggagcattaggaggaggatacaggggagaatcctcactctattctagtcgttttggtagcacttatggaggaagctttggtggcggatatggtggtggtggcagttatgctggtggattagctggtgcttatgggcgtgatgctgggggttatggtggttctagctatgggcctagttatgattcttcaggtgctagtgctggttctggtgctgggtatggcacaggtggactctacggtgctaggacaggctatggtagcactggtggcagtagtgctgctggtcgttaccatccatatggaagatagaaaagcatcagaggctgctgtttgctagagaagcttgcagaagatcaattctagatgtgttttcaagagagatttgtctgcatctagaaaggcctattgaagttcaatatgctcagtttgctgtactacttttagataaacttgtagaacttaaagccactattttagtgtttggaatttaagcatacttaagactgcatatgcgcttttatagatagacaattcagtgacgtaaagctagccactaatttagtttgtgctcttgagattgttgtctttttaggtcttttatggttaaacctgatggttttatgtgttggttctttgttagaatagatgatttccttgtgtttatgaagattgttgtagcttgtctgacttgccattgttgatggtggttactcc

SEQ ID NO: 23247 - protein, 353 aa, Panicum virgatum
  misc_feature: Ceres CLONE 1826538
  misc_feature (16)..(85): Pfam Name: RRM_1 Pfam Description: RNA recognition motif. (a.k.a. RRM, RBD, or RNP domain)
  misc_feature (104)..(176): Pfam Name: RRM_1 Pfam Description: RNA recognition motif. (a.k.a. RRM, RBD, or RNP domain)
MAGKTKEFDGASPAKIFIGGLPKDTSMGTFKEHFGKYGDITDAVIMKDRYTQKPRGFGFITFADPAVVDRVIEDDHVINGKQVEIKRTIPKGAAPLKDFKTKKIFVGGLPSALKEDEFKEFFSKFGKVVEHEIIRDHATNRSRGFGFIVFDAEKTVDELLAKKGNMIDLNGSQVEIKKAEPKKPSNPPPRSIDSEPRGRPYADSYDGFGSSYNYGGSFGPYRSPGSFGARPGGYSSAYGPVDYGSGYGAYGGALGGGYRGESSLYSSRFGSTYGGSFGGGYGGGGSYAGGLAGAYGRDAGGYGGSSYGPSYDSSGASAGSGAGYGTGGLYGARTGYGSTGGSSAAGRYHPYGR

SEQ ID NO: 23248 - DNA, 1403 bp, Panicum virgatum
  misc_feature: Ceres CLONE 1826549
  misc_feature: Encodes the peptide sequence at SEQ ID NO. 23249
atcttgacaggccaccgaattaccgaaacaaaattctctctctaggcgggagagagagagagagcggtcgcagccgccggccatggcggaggcggcgggagcccaagccccggcgcatggccccgaggaggcgcccctcgacgtgggctccatcaggagcctgcctcccaattccacctccaagctccgatccatggcgtctcacgatcaccaccaccaccactcccacgaccacgatcaccaccaccatcactcccacggggatggcggtggcaatgcagaggggggatcgtgggtcggggaggacggtcgcgtgtggcactcccacgacggcctcgcgccgcactcccacgagcccatctactcccccggcgacttcaccaagcgcgcgccgccgctcgcctcgcgtgccttcaccgaccgcgccttcaccgtcggaattggcggccccgtcggcacggggaaaactgccctgatgttagcactgtgcagattcctacgtgataaatatagtcttgctgcggtcacaaacgacattttcacaaaagaagatggggaattcttagtcaagcatggagcactcccagaagagcgcatacgtgcagtggaaactggagggtgccctcatgcagctatacgtgaagacatcagtataaatcttggtcctctagaggagctatcgaacttgtacaaagctgatttgctactctgtgaatctggaggagataacttggctgctaactttagccgagaattggcagactacataatctacataattgatgtctctggtggggacaagataccaagaaaaggtggccctgggataacccaagctgatcttttggtgataaataagacagaccttgccccggctgttggagctgatctggctgtaatggaacgagatgcgcttcgcatgcgggaaggagggccttttgtgtttgcacaggtgaaacacggagtgggtgtggaggatatcgtgaatcatattctgcaagcatgggaaattgcaaccgggaataaacgccgataaaagatctcatgacatagctttatatttggcgtgcagctgatgcactttatcattcagcatgcataaaccatccattggttttcgaataaatttcgcatcatttggtgctgatgtactggagacgtggagtttcaaaatttccttttcatgttggaagagaaaggtagatcatgccctcaaatttggacgaggggtcgagaatgatatgagttggggactccaataacgagcagaactgcaatacgggctcagtgaagtaggaagttgaaaaataattttgcagaagaattatcgaccccaccccatatgtctctgtttttctgttaagagtactggggatgacctctcagtgaaaaataggaagttc

SEQ ID NO: 23249 - protein, 317 aa, Panicum virgatum
  misc_feature: Ceres CLONE 1826549
  misc_feature (116)..(288): Pfam Name: cobW Pfam Description: CobW/HypB/UreG, nucleotide-binding domain
MAEAAGAQAPAHGPEEAPLDVGSIRSLPPNSTSKLRSMASHDHHHHHSHDHDHHHHHSHGDGGGNAEGGSWVGEDGRVWHSHDGLAPHSHEPIYSPGDFTKRAPPLASRAFTDRAFTVGIGGPVGTGKTALMLALCRFLRDKYSLAAVTNDIFTKEDGEFLVKHGALPEERIRAVETGGCPHAAIREDISINLGPLEELSNLYKADLLLCESGGDNLAANFSRELADYIIYIIDVSGGDKIPRKGGPGITQADLLVINKTDLAPAVGADLAVMERDALRMREGGPFVFAQVKHGVGVEDIVNHILQAWEIATGNKRR

SEQ ID NO: 23250 - DNA, 660 bp, Panicum virgatum
  misc_feature: Ceres CLONE 1826554
  misc_feature: Encodes the peptide sequence at SEQ ID NO. 23251
aatcttcgattcgcttctcttctcctctcgagcgctgtggtttctccccgtcgcgagctctctcttctctccccccccccccccccttccttcctcgagcgcggtttcggccatggcggcggcggcccaggcggtcgcgaaggggagcgtggtgtcgccgagcggcaaccgggccgcgccggggctcctgggccggcggatggcgccatcggcggtgcggatcggggcgccctggaggaagaccgcgttcctcggcggcgggaggctggcggtcgggcccatgagatccaggtccgcgtcccggactctcgtcgcgtcgccggtgcagatgaacatgaaccttgcgattgggaaatccatgaggtggtgggagaaggggctgcagcccaacatgcgggaggtcgagtccgctcaggacctcgccgattcattggccaacgccggcgacaggctcgtcatcgtagacttcttctcccctggctgcggaggttgccgtgctcttcacccaaagatttgccagtttgcggagcagaatccggatgtgctgttcttgcaagtgaactatgaggagcacaagtctatgtgctacagcctccatgtccatgtcctacctttcttcaggttctacaggggagctcagggacgtctctgcagcttcag

SEQ ID NO: 23251 - protein, 182 aa, Panicum virgatum
  misc_feature: Ceres CLONE 1826554
  misc_feature: SWISSPROT Homolog: EC 3.5.1.52 Peptide-N(4)-(N-acetyl-beta-glucosaminyl)asparagine amidase
MAAAAQAVAKGSVVSPSGNRAAPGLLGRRMAPSAVRIGAPWRKTAFLGGGRLAVGPMRSRSASRTLVASPVQMNMNLAIGKSMRWWEKGLQPNMREVESAQDLADSLANAGDRLVIVDFFSPGCGGCRALHPKICQFAEQNPDVLFLQVNYEEHKSMCYSLHVHVLPFFRFYRGAQGRLCSF

SEQ ID NO: 23252 - DNA, 680 bp, Panicum virgatum
  misc_feature: Ceres CLONE 1826560
  misc_feature: Encodes the peptide sequence at SEQ ID NO. 23253
cgctcgcgttcgtgtcggctcgcacgcgagatcgggggagggaggcggtggactggtggttggtgcccggtcggcggcgaggctcggggcctagggtgggctcggatccgcggcccatcccatgggatccgaaggcttcgtggccgccgcggccgcttgcccggccgccgccgaggccttcgccaagtactacggtattgtgtcaggaggtacaaatgcgaaggcaagacaaggattggttgagctttcacaagctatagatggaattgaaggaatgagagatgcgatatttgcagatatcccaaatctgatgtcatttattgatttggaggatacatgcctattcagttgcttctacgactttgtcttcttcatctgtcgtgaaaaggggcaaaagagtgtcaccattcagagagctgtaacagcttggaagattgttctaaatggaaggttccggttgcttgatcgatggtgtaattttgttgagaagtaccaacgtcacaacatatctgaggatacctggcagcagctgctagctttcagcaggtgtgtaaatgaagacctggaaggttatgacccacgaggtgcttggcctgttctgattgatgattttgtggagcaaatgcacagaatttatcactccaccgactgcagcagtgctatggaatcacaatgtacct

SEQ ID NO: 23253 - protein, 186 aa, Panicum virgatum
  misc_feature: Ceres CLONE 1826560
  misc_feature: Useful for making plants with modulated biomass
MGSEGFVAAAAACPAAAEAFAKYYGIVSGGTNAKARQGLVELSQAIDGIEGMRDAIFADIPNLMSFIDLEDTCLFSCFYDFVFFICREKGQKSVTIQRAVTAWKIVLNGRFRLLDRWCNFVEKYQRHNISEDTWQQLLAFSRCVNEDLEGYDPRGAWPVLIDDFVEQMHRIYHSTDCSSAMESQCT

SEQ ID NO: 23254 - DNA, 628 bp, Panicum virgatum
  misc_feature: Ceres CLONE 1826597
  misc_feature: Encodes the peptide sequence at SEQ ID NO. 23255
gttgcggcacccggacacaaggacagggcagagcggggagcagcaccagagcaccggccccccggcctctcgtcctcgtcctctcctccggcgatcgcacccgatcccatcgttctgccgccggggaagcacttttcatttggcagcagcagccagcaagacaagaaagggctctgcagcaaccagttattctgtagaaatggctgatggtgaggacatccagcctcttgtctgcgacaatgggactggaatggctggttttgctggggatgatgcaccaagggctgttttccctagcatcgttggccgtcctcgccacactggtgtcatggtagggatgggacagaaggatgcatatgttggtgatgaggcacagtccaagagaggtattctcacactgaaatacccgattgagcacggcattgtaagcaactgggatgacatggagaaaatctggcatcacactttctacaatgagcttcgtgttgcaccggaggagcaccctgtgctgctcactgaagctcctttaaaccccaaagctaacagggagaagatgacccagattatgtttgagactttcaatgttccagccatgtacgttgcaattcaagctgtgctctccctctat

SEQ ID NO: 23255 - protein, 142 aa, Panicum virgatum
  misc_feature: Ceres CLONE 1826597
  misc_feature (4)..(142): Pfam Name: Actin Pfam Description: Actin
  misc_feature: SWISSPROT Homolog: EC 2.7.10.2 Non-specific protein-tyrosine kinase
  misc_feature: Useful for making plants with modulated biomass
  misc_feature: Useful for making plants with modulated flowering time
MADGEDIQPLVCDNGTGMAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSL

SEQ ID NO: 23256 - DNA, 687 bp, Panicum virgatum
  misc_feature: Ceres CLONE 1826606
  misc_feature: Encodes the peptide sequence at SEQ ID NO. 23257
attccaccaccatttcagaaacacagccaaagcagctcagcctgttggtacactcactgcaccatggctcctctgctcttcagggacatgaagggcctctcgtgctcgtcgccggcgtccaccgcgatatgccccagcctggagcggcagccgatggtccggtcacacaaggccattgccagtgccagccctctgtctcaggttcccacggagcccaggacgcacaggcatgacggcaagaaagggcagcagcacaaggctgtcgtcgtcgcaaacggcggtggcctcgtcagccccgccggctcgtccaggtaccttttgagcggccgcgcccccgcgtccgcagccatcgaggagatccaggaggtggatgctgccccggccgttgatgccaagctggaggaagcaagtgaggaagccgttgatgacaagagcagacaggcgcaggagcaggtggttgtgctgaaggtatccctgcactgcaaagcatgcgctgggaaagtgaagaagcacctctccaagatggaaggtgtgacatcgttcgacatcgacttcgcggcgaagaaggtgacggtggtcggcgacgtgacgcccctgggggtgctgaacagcgtgtccaaggtgaagaacgcccagctctgggcggcgccagcgccggcgccggcgatgatagcggcctgaaggacg

SEQ ID NO: 23257 - protein, 205 aa, Panicum virgatum
  misc_feature: Ceres CLONE 1826606
  misc_feature (132)..(192): Pfam Name: HMA Pfam Description: Heavy-metal-associated domain
MAPLLFRDMKGLSCSSPASTAICPSLERQPMVRSHKAIASASPLSQVPTEPRTHRHDGKKGQQHKAVVVANGGGLVSPAGSSRYLLSGRAPASAAIEEIQEVDAAPAVDAKLEEASEEAVDDKSRQAQEQVVVLKVSLHCKACAGKVKKHLSKMEGVTSFDIDFAAKKVTVVGDVTPLGVLNSVSKVKNAQLWAAPAPAPAMIAA

SEQ ID NO: 23258 - DNA, 433 bp, Panicum virgatum
  misc_feature: Ceres CLONE 1826630
  misc_feature: Encodes the peptide sequence at SEQ ID NO. 23259
acacagcaaatccccaccccgtcgttttttgactcctcaccggcgccgcccgccatggccgcagatccgccgccggcgagcgcgctgatggaggagctcgtcgaggaggtcctcctgcggttcccgcccgcggacccatcccgcctcgtcggggccgcgctcgtctgccggcgctggtgcgcgctcgtctcgggcgccggcttccgccgccggttccgggagctccaccgcgcgccgcccctgctcggcctcctctgcaacgccggcaccggggcgcgcttcgtccccgccgccgccttccgcccgcccgggctccccgcgggcggttcttctccgcggctggcgggccctcatcgcgcgccacggccgcgtcctcctccgctgggaccccgcccgcgaagccgcctgccccacgcttgtcgtctgggacccc

SEQ ID NO: 23259 - protein, 126 aa, Panicum virgatum
  misc_feature: Ceres CLONE 1826630
  misc_feature (6)..(56): Pfam Name: F-box Pfam Description: F-box domain
MAADPPPASALMEELVEEVLLRFPPADPSRLVGAALVCRRWCALVSGAGFRRRFRELHRAPPLLGLLCNAGTGARFVPAAAFRPPGLPAGGSSPRLAGPHRAPRPRPPPLGPRPRSRLPHACRLGP

SEQ ID NO: 23260 - DNA, 1744 bp, Panicum virgatum
  misc_feature: Ceres CLONE 1826643
  misc_feature: Encodes the peptide sequence at SEQ ID NO. 23261
atgatgtcctcggcgcctccgccggagccgcccgccggcgccggcgccggcgacgacgacatggagtccctccccctcgccgccgcctccgactacgcctccgtcgcctccaccttcgaccccctcctctcctccgcctccgcttccgtcgcctcgccccgctcccctccggcgcgcgccgcctacacgctctccgcgacctcgtcctcctcgttcgtcgacccgccttcctacgccgacgccaccggcgccgccgccggctcctcctccccgcgctccgcctcctcgcccgcctccgcctcgccgagatccgcgcgcgcggctgcctccgagtacgccctgctcgccgtctccgacccggagaccgaggctgagcccgccgccacctcgctcgtccccggatccgcgcccacctacgtctcctacctcgtcaccagcgtccgccgcggggaccccgcccagcgccgccacgccgtgcgccgccgcttccgggacttcgtcacgctcgccgaccgactcgccgaggccttccgaggccacttcgtgccgccgcggcccgacaagaacaccgtcgagagccaggtcatgcagaaggacgagttcgtggcgcagcgccgtgccgcccttgagcggtacctgtggcggctcgccgagcaccccgccatcgggcccagcgacgagctccgcgtcttcctgcaggccgagggcaagatgccgctgccaggcagcactgacgtggcatcgcggatgcttgatggtgcagcaaggctgccacggcagctcatcgccggggaggaggccgtcgctgcaccacaagacgtcgtgcagccagctaagggtggcagggacctgctcaggatattcaaggagatcaagcagtctgtggtcactgactggggtggtgtgaagcctccgcttgtggaggaggatcgggaattcctggagaagaaggagaagctgcaggagtgggagcagcagctcactgcttcgtcacaacaggcagaagcacttgtcaaggctcaacaagatatgggtgaaacaatgggagcgcttggattggcatttgttagactgacaaagttggagactgaggaggcaatgtgtgattcccagaggataagagcagctgacagcaggcgtgtagccactgcagctgttaaagctagcagggcatgccgagatctgaatgctcaaactgttaaatatctggatacgctgcatggacatttaagcataatgttgtctgtccacattgcattttctgatcgggcaagtgcattattgactgtacaaacactgatgtcagatttggcatcattacagtccaggattgagaaactcgaagctgcatcctcaaagatatttggtggtgatagagctaggattcgcaaagtggaggagctaagggaaacaatcagggctactgaagatgctaagttctgtgctttaagagaatatgagagaattaaggaaaataacagaagtgaactccagcgactagacagagaaagaaaagaagatttcctggtgatgctaaaaggatttgttgcaagccaggcggcctacgctgagaaaattgtggatggttgggagacggtggccgaggagacgagtggatattcgcgaggaactaacaacatgccatcgtatatggattaacaggccatcttccccatatttggttggatgacactgtttgtacaatgtaatctaggatatgaattgcgaaatagaaagttgcacc

SEQ ID NO: 23261 - protein, 357 aa, Panicum virgatum
  misc_feature: Ceres CLONE 1826643
  misc_feature (92)..(341): Pfam Name: Vps5 Pfam Description: Vps5 C terminal like
MQKDEFVAQRRAALERYLWRLAEHPAIGPSDELRVFLQAEGKMPLPGSTDVASRMLDGAARLPRQLIAGEEAVAAPQDVVQPAKGGRDLLRIFKEIKQSVVTDWGGVKPPLVEEDREFLEKKEKLQEWEQQLTASSQQAEALVKAQQDMGETMGALGLAFVRLTKLETEEAMCDSQRIRAADSRRVATAAVKASRACRDLNAQTVKYLDTLHGHLSIMLSVHIAFSDRASALLTVQTLMSDLASLQSRIEKLEAASSKIFGGDRARIRKVEELRETIRATEDAKFCALREYERIKENNRSELQRLDRERKEDFLVMLKGFVASQAAYAEKIVDGWETVAEETSGYSRGTNNMPSYMD

SEQ ID NO: 23262 - DNA, 1347 bp, Panicum virgatum
  misc_feature: Ceres CLONE 1826651
  misc_feature: Encodes the peptide sequence at SEQ ID NO. 23263
agcactcgcattcatccagagagagagagagagagaaataaaaaggagaggggcgagccggcgagagagcgctagaggccaaacagctcgagagcttctccgcgaaaccccacccctagcgccgccccttcccctccccggccctccccgggcatcctccccgcgctccgatccaagatgtataagctggggagaggaaaccgcgacaaggtgcagcagttcatgaccataaccggcgccagtgagaaggttgcccttcaggcactgaaagctagtgattggcacttggaaggtgctttcgacttcttctatagccaacctcagatttctgcagtcaatactcggcatcttgaagacattttcaatagatacaaagaacctgatgctgatatgatcatggttgagggagtatctcaactttgcaatgatctgcaggtggatcctcaggatattgtcatgcttgtcatatcatggcacatgaaagccgccacaatgtgtgaatttactcgccaggaattcattggtggactgcagtctattggggtagattcaattgagaaatttcgtgcaaagttaccatcattacgagctgaactaaaagatgacaaattggcttgtggagtgaaatgatttccttttcatttccatatccaactggtgtgtttacacatttctcactcagataagttccgtgagatatacaacttcgcgttcacttgggcaagagaaaagggtcaaaagtctctttcactggagactgctattgggatgtggcagttgctatttgctgacaggaactggcctcttctggatcattggtgccagtttttacaggtcaggcacaataaagccatatctagagacacgtgggcacaactgctggaatttgtaaagtcgattgatccacagctatccaactatgacgacgaaggtgcttggccctacctcatagatgaatttgtggaatacctgactgagaatgggttggttcagcgcaaaaagtgaactgcaacggggaggcctcgttcctcaccgaacaatggttgggctgtacaaacacaattcatctcggtgtatacgatgcccaggacccgatgttggcactcctgctcaatccactcgccaaactgttggcctatcattgcatgactgaaatttgctgataaacgcggagaaaacgcaacctagcctgggaagtggtggtcccgagcctgccatcgtgaactcatccaaaatgcaatggggagtttgggactctggttaacgtatgagttgtttcggatgtatcactgtcactgctatatttctaccatccctcatcctgtcgggtgtggctattttacggtc

SEQ ID NO: 23263 - protein, 150 aa, Panicum virgatum
  misc_feature: Ceres CLONE 1826651
  misc_feature: Useful for making plants with altered lignin content
MYKLGRGNRDKVQQFMTITGASEKVALQALKASDWHLEGAFDFFYSQPQISAVNTRHLEDIFNRYKEPDADMIMVEGVSQLCNDLQVDPQDIVMLVISWHMKAATMCEFTRQEFIGGLQSIGVDSIEKFRAKLPSLRAELKDDKLACGVK

SEQ ID NO: 23264 - DNA, 1149 bp, Panicum virgatum
  misc_feature: Ceres CLONE 1826676
  misc_feature: Encodes the peptide sequence at SEQ ID NO. 23265
acaccacaccatccatcgcaaaggaatcgggtttcctagaacgccagaggcggcgggcggcggctggtgctgtgctggggtctccattattcaattctccaagcgatagatagatagatagatagagagagatagatgccggctgcgacggcttctggtccctccagcaggctcgtgatgagaacgctgctgctgctcgtggtgctcggcgcggcgctgatcgccggcgcctcgagcgcgtccggcaacttctaccaggacgtggacatcacctggggcgacggccgcggcaagatcctcagcggcggccagctcctgacgctgtccatggaccgctcctcggggtcgggcttccagtcccgggcccagtacctctacggccggttcgacatgcagctgaagctcatccccggcgactccgccggcacggtcaccaccttctacctctcgtcgcaggggagcgcccacgacgagatcgacttcgagttcctggggaacgcgagcggcgagccctacacggtgcacaccaacgtgtacagccagggcaagggcggccgcgagcagcagttccgggcgtggttcgaccccacggccgacttccacacctactccgtggtgtggaaccccgagcacatcgtcttctacgtggacggcgtgcccatccacgacttccgggccagcgccgccgccgccgccggggtgccgttcccggcgagccagccgatgcgggtgtacgccagcgtgtgggacgccgaggagtgggccacgcagggcggccgcgtcaggacggactggtcccgggcgccgttcgtggcgtcgtaccgcgggttcgccgccgccgggtgcacgtcgccggacgcggcggcgtgcgcgcggtccaacggcgcgtggatgttccaggagctggacgccgcggggcaggagcagctccgccgggcgcaggccagctacatgatctacgactactgcgccgacaagtaccggttcccgcagggcccgccgcccgagtgctcggccaagtagaagaagaattcaagaagaagaacccgtgcgcgtctggaatttggatggatcacacacacagagagtatgtatacataattcatcgattggaatacatgcatatacgcgacctatacgtatacgtat

SEQ ID NO: 23265 - protein, 295 aa, Panicum virgatum
  misc_feature: Ceres CLONE 1826676
  misc_feature (39)..(222): Pfam Name: Glyco_hydro_16 Pfam Description: Glycosyl hydrolases family 16
  misc_feature (245)..(292): Pfam Name: XET_C Pfam Description: Xyloglucan endo-transglycosylase (XET) C-terminus
  misc_feature: SWISSPROT Homolog: EC 2.4.1.207 Xyloglucan:xyloglucosyl transferase
  misc_feature: Useful for making plants with altered carbohydrate content
  misc_feature: Useful for making plants with altered cell wall content and/or composition
MPAATASGPSSRLVMRTLLLLVVLGAALIAGASSASGNFYQDVDITWGDGRGKILSGGQLLTLSMDRSSGSGFQSRAQYLYGRFDMQLKLIPGDSAGTVTTFYLSSQGSAHDEIDFEFLGNASGEPYTVHTNVYSQGKGGREQQFRAWFDPTADFHTYSVVWNPEHIVFYVDGVPIHDFRASAAAAAGVPFPASQPMRVYASVWDAEEWATQGGRVRTDWSRAPFVASYRGFAAAGCTSPDAAACARSNGAWMFQELDAAGQEQLRRAQASYMIYDYCADKYRFPQGPPPECSAK

SEQ ID NO: 23266 - DNA, 690 bp, Panicum virgatum
  misc_feature: Ceres CLONE 1826686
  misc_feature: Encodes the peptide sequence at SEQ ID NO. 23267
agtgaacgaatctggtccgctaatcttacccacctccgcgtttcgtgaaagcgcgcggcggcgagaggagcggaagcggcgacaagcagagagatggccggcggtggcgccgccgccgccgcgtcggcgctttcgagcccctggagggcgctgctccagcgagctttggacgccaacgcccacctcaggcactccacctatttccaacttgccacggtgggcgccggcggcaggcccgccaatcgcaccgtcgtgttcaggggtttccaggaacattctgataagattcagattaacacggatgcccgaagcaacaagattggtgagataaggaattgccccttcggagagatttgttggtacttcacagacagctgggagcaattccgtatcagtggaagcatagatgcgattgatggctccagtgcagaccctgccaagctccaggttatgctatgctatatggcgagatacataagatatcagtgtgcgggttctatgagttagtttagattagcttcacttcgacaacagccagttgttctatgagttagtttagattagcttcacttcatgttcactcctgaggtctgttcatgtactaagactgagagatatgttcctgtcacctaaactttcgccaccacaagcttttgtatgtgcttatccgtgacagcattatcttttact

SEQ ID NO: 23267 - protein, 137 aa, Panicum virgatum
  misc_feature: Ceres CLONE 1826686
  misc_feature (25)..(111): Pfam Name: Pyridox_oxidase Pfam Description: Pyridoxamine 5'-phosphate oxidase
  misc_feature: SWISSPROT Homolog: EC 1.4.3.5 Pyridoxal 5'-phosphate synthase
MAGGGAAAAASALSSPWRALLQRALDANAHLRHSTYFQLATVGAGGRPANRTVVFRGFQEHSDKIQINTDARSNKIGEIRNCPFGEICWYFTDSWEQFRISGSIDAIDGSSADPAKLQVMLCYMARYIRYQCAGSMS

SEQ ID NO: 23268 - DNA, 976 bp, Panicum virgatum
  misc_feature: Ceres CLONE 1826693
  misc_feature: Encodes the peptide sequence at SEQ ID NO. 23269
gagagcgctcgctccgactctgcctcgtcgccaccaccctctcttctccctctccccccatccacctcgcaaggccagccgcgccgcactggcatggcctcgttctgcctcgcctcgccggccggcgccgcgctctgccgcccgcggcggccgaggcgccgcgtggcgtgctcggcggcggccgacgcgggcggaaagagcaccgaggcggcgtggctctcggcggccgggggcaagagcgccggccgcctcgcgtgcggcgtgctggcggcctgggccgtcgcgtccgcgtccaacccggccattgccgcgagccagagattgcctccactctcaactgagccaaacagatgtgagcgtgcattcgtggggaacacaattggtcaggcaaatggggtgtatgacaagccccttgatctccggttctgtgattacacgaatgagaaaactaatctgaaaggcaagtctctagctgcggcgttgatgtccgatgcaaagtttgatggcgccgacatgtctgaagttgtcatgtccaaagcttatgctgttggggcaagcttcaaaggaaccgacttcacgaatgcagtgatagaccgtgtcaatttcgagaaggctgatctcacaggggcaatcttcaagaatacagtcttgtcaggatcgaccttcgatgatgctaagatggaagatgttgtgtttgaggacacaatcattggctacgttgaccttcagaagctgtgcgcaaacaccagcatcagcgcagacagtagattagagctgggctgcaggtgattcagcagattccatctaatcatccccaatcgttcatgttaatatgttgatgagatcgtttgatgagtgttcatgcctgtctatagagccaccatgacaagatgcgacgatttttctccatgcctatgaccctatgtacaaacatctgtatatcttatatatcagcagcaatgcaaccatgtttctt

SEQ ID NO: 23269 - protein, 231 aa, Panicum virgatum
  misc_feature: Ceres CLONE 1826693
  misc_feature (164)..(203): Pfam Name: Pentapeptide Pfam Description: Pentapeptide repeats (8 copies)
  misc_feature (119)..(158): Pfam Name: Pentapeptide Pfam Description: Pentapeptide repeats (8 copies)
MASFCLASPAGAALCRPRRPRRRVACSAAADAGGKSTEAAWLSAAGGKSAGRLACGVLAAWAVASASNPAIAASQRLPPLSTEPNRCERAFVGNTIGQANGVYDKPLDLRFCDYTNEKTNLKGKSLAAALMSDAKFDGADMSEVVMSKAYAVGASFKGTDFTNAVIDRVNFEKADLTGAIFKNTVLSGSTFDDAKMEDVVFEDTIIGYVDLQKLCANTSISADSRLELGCR

SEQ ID NO: 23270 - DNA, 234 bp, Panicum virgatum
  misc_feature: Ceres CLONE 1826709
  misc_feature: Encodes the peptide sequence at SEQ ID NO. 23271
cgggccgcgccgagaacggcccaaacaagcccagcgccggagccaggaccccgggcacccgccacaagaccacccagaccgccgcccccagcgagacccccaccgcgcccggcgccgaggaccgcaggagcccccgcaacaaccccgccacgcaggaccacgccgccgccgccaacgcgcgcgacgccgccgcggccgccgcaaggaagggggagacgcacgaggagcacaggg

SEQ ID NO: 23271 - protein, 77 aa, Panicum virgatum
  misc_feature: Ceres CLONE 1826709
  misc_feature: SWISSPROT Homolog: EC 3.3.1.1 Adenosylhomocysteinase
GRAENGPNKPSAGARTPGTRHKTTQTAAPSETPTAPGAEDRRSPRNNPATQDHAAAANARDAAAAAARKGETHEEHR

SEQ ID NO: 23272 - DNA, 1184 bp, Panicum virgatum
  misc_feature: Ceres CLONE 1826723
  misc_feature: Encodes the peptide sequence at SEQ ID NO. 23273
atccgcgtcttgcactctgcagcaacagtcgcaacgccatgagctatctattccggaccaggagtgaaaaagcgacgcaacaaaagccagagtcttcagaagaacagcagcgaaagatagaagatgttcgggagctgctgggcgacctggcgacggagacgccgagcttcttgtcggacggcaccatccgtcggttcctccgggcaaggaactggagcacagagaaagcggccaagtctctgaaagaagctatcaagtggaggcgtcaattcaaaccagaaacaatttgttgggacgaccttgctggcatcgagaacgaggttcgacgagcgtatataccggactatctcgacaagaatggccgaactgtgttcgtgattgtgacgtccataaagagcttaacttcaacaaaggaacatatacaacagctagtgtataacttggaaaatatggctatgaactcagaagacgcacaagagaatgttgtttggatgtgtaatttcagtggttggacactatcttctacgccactatgggaggtccgtgaatcgctgcacataattcagaattattatccagggttgattggagccgcgattctcagcaaccctcccaagatatttgaatcattctttaagattgtaaagcagttcctcgaaccaacattgcaagacaagataaaatttgtttacaacaacaatgcagagagccagaggataatggccgatatgtttgatatggataagctggagtcggcatttgggggaagaaacacagctatccttgatattaccaagtatgctgagagaatgagaaggagagatcagataaggataacttgcaagaacacaaatagaaacacctgattttcctgatcaggaacgtaacaagatcgtttcccttgtgaacattaaagagtacttggaactacactgtcaacagctaatgtatacgaagaactctgaaaccttatattttcaaggatgtgaactgagctaaggacggtagatttcattacatagcttaagcttgataattatgagcgcctaagaggttaaacgttgaatatcttctttacatgattcaagatttgtttttatcagctcggagaaaatttaatagaatgtgaagttatgtaacactggagtacaagaaattaatgataataataagagctcttttac

SEQ ID NO: 23273 - protein, 275 aa, Panicum virgatum
  misc_feature: Ceres CLONE 1826723
  misc_feature (14)..(83): Pfam Name: CRAL_TRIO_N Pfam Description: CRAL/TRIO, N-terminus
  misc_feature (101)..(267): Pfam Name: CRAL_TRIO Pfam Description: CRAL/TRIO domain
MSYLFRTRSEKATQQKPESSEEQQRKIEDVRELLGDLATETPSFLSDGTIRRFLRARNWSTEKAAKSLKEAIKWRRQFKPETICWDDLAGIENEVRRAYIPDYLDKNGRTVFVIVTSIKSLTSTKEHIQQLVYNLENMAMNSEDAQENVVWMCNFSGWTLSSTPLWEVRESLHIIQNYYPGLIGAAILSNPPKIFESFFKIVKQFLEPTLQDKIKFVYNNNAESQRIMADMFDMDKLESAFGGRNTAILDITKYAERMRRRDQIRITCKNTNRNT

SEQ ID NO: 23274 - DNA, 1355 bp, Panicum virgatum
  misc_feature: Ceres CLONE 1826732
  misc_feature: Encodes the peptide sequence at SEQ ID NO. 23275
aaaaaaaaaaaaaccggtcagagggcgcctccatcctatccgctcagggcgccgccgccatcagctcagggccccgccgccccgccatcctcggcggcgccgcggcgggggcgccttcgacgtcctgcctcccgccgctctcctcgtcgcgcggccgccccagacctgctccgctacgacgggtccgccgaggggtagaatgtgaaactggccgaggagggctggaaccggctgcaggaaccggagagagggcgagtgatccacagccttgtgaagaggggacgaggagggcaggaaccggctgcgggagggacgaatttgatcctttgccaagagtttagggacgattttgcttattttgccctcccaaaacttccgcggccggcgccgggagagagctggagactgcaaggtcctgctcgtgtgatcggagtctaggctgtcgatccaattgggaggtagagatttgagagcagaccggcctgtctctctgtctttgccccaccgtgactcttcccctgcttcgcgatgggaggctcccctgttggggatgggactctgtctctggacggcttcaacacctccgcggcggcgctggtgaagaggtggaaggagatcgaggttgacgacttccttcctgactggacatggaagccctgcagcaaaatgggggcgccgtctgaggtagaggggtatctagcactggaaggagtgtaccgcggctgtggagggagccaggagcagattgacgagaacgacaattctgatggtgcagacgcagttgcgtgcgatacttgggtccagagctctagtgataatgttcacgtttatgatttccatgttgtctacagctactcttacaaggttccagtgctgtactttcagggtcatcgttctgatggtcagctactaacattggatgagataaaacacaaccttccctctaactcgcttaaagtattaagcgagtcaaagtggacgtttattactcgagaggagcacccccacttaagcaggccatggttcaccttgcacccctgtgcaaccagtgactggatgaagctacttcttgaagaaagtaaagtggcgattgaggaacaatcgctgcgatatctatcggcatggttatccgttgttggccaggcagtaggacttaaaatccctcttgagctttactgcaattgataggttccctcttttttttcattttcagtttatatgtatggtatatggtgattcaaagggaaagttctcacttcatactggtgatgtagaaggtcatggatacttctgagttctgacgctggttacacttgcacttttgaaattttgtggtagatttatactttcattgc

SEQ ID NO: 23275 - protein, 218 aa, Panicum virgatum
  misc_feature: Ceres CLONE 1826732
  misc_feature (93)..(218): Pfam Name: Autophagy_C Pfam Description: Autophagocytosis associated protein, C-terminal domain
MGGSPVGDGTLSLDGFNTSAAALVKRWKEIEVDDFLPDWTWKPCSKMGAPSEVEGYLALEGVYRGCGGSQEQIDENDNSDGADAVACDTWVQSSSDNVHVYDFHVVYSYSYKVPVLYFQGHRSDGQLLTLDEIKHNLPSNSLKVLSESKWTFITREEHPHLSRPWFTLHPCATSDWMKLLLEESKVAIEEQSLRYLSAWLSVVGQAVGLKIPLELYCN

SEQ ID NO: 23276 - DNA, 658 bp, Panicum virgatum
  misc_feature: Ceres CLONE 1826738
  misc_feature: Encodes the peptide sequence at SEQ ID NO. 23277
atcagatttttcttccaacggtgcacgaacccagcatggagcgggggggtcttctaggcggcggccgccggctccagggcgcagcgtcggcgccggcgagcggcggggaggggcacggctccggctcgagcccggacgcgatgcggataatggtgggcgtgctggtggcggtcatcgcctgcacgctgctctactgcgtctactgctggcggtggcggaagcgcaacggtgagctgacgatggatgcatcacctctactcgcttagcttgtgctgtgtcctaactgaatcttcctgcgcatggtttgttcaaattcagccatccggaggtccctgctggacagcctgtggccgcggtcgagctcggacctgccgctcatggacctcgcctccatcctcgccgccaccggcaacttctccaaggccaacaagctcggcgagggcggcttcggccccgtctacagaggcgtgctgagcggcgggtcggagatcgcggtgaagcggctgtcggcgcggtcgcggcagggggcggcggagttccggaacgaggtggagctgatcgccaagctgcagcaccggaacctggtgcggctgctgggctggtgcgccgagcgggacgagaagctactcgtctacgagtacctccccaaccgcagcct

SEQ ID NO: 23277 - protein, 119 aa, Panicum virgatum
  misc_feature: Ceres CLONE 1826738
  misc_feature: SWISSPROT Homolog: EC 2.7.11.1 Non-specific serine/threonine protein kinase
  misc_feature: Useful for making plants with altered carbohydrate content
  misc_feature: Useful for making plants with altered cell wall content and/or composition
  misc_feature: Useful for making plants with modulated biomass
  misc_feature: Useful for making plants with modulated nitrogen use efficiency
MVCSNSAIRRSLLDSLWPRSSSDLPLMDLASILAATGNFSKANKLGEGGFGPVYRGVLSGGSEIAVKRLSARSRQGAAEFRNEVELIAKLQHRNLVRLLGWCAERDEKLLVYEYLPNRS

SEQ ID NO: 23278 - DNA, 1288 bp, Panicum virgatum
  misc_feature: Ceres CLONE 1826751
  misc_feature: Encodes the peptide sequence at SEQ ID NO. 23279
acacaaatcagtttgaaacttcgagtggatggaattcgattgaaggctacctacctacctctctctatccttgccctcatcctactctcctccctgcttcccggctctcttcctcggcactccgcagcagcagcagcagcagcagcagcaccaagatcgtctgcctgcctcctaggcggtaagctcatcagctgagcacatcacggcaccgatggccgcctccaccaccgccaccttcctctccacgctcgccagggccaccgccagcctgagcagcagcaccatgccgtccggcggcggcgccaaggccgtccggttcttgcccacgcagaccaccagccgcgggcggcgcgcggtgctgtccgcgccgagggcggcggcctcgggcaccgagaaggcggcggcctccgacaagggcggcaagagcaaggacgagcgcgtggtgaaggtgcacagcatcgaggagttcgacggcgcgctgcaggccgccaagaaccggctggtagtggtggagttcgcggcgagcgacagcgagggcagcagccagatgtacccgaccatggtgcagctgagccgcacctgcggcgacgtggacttcctgctggtgatgggcgacgagtcggaggccaccagggagctgtgccgccgggagggcgtcgcgcaggtgccccacttcaacttctacaagggcgccgagaaggtgcacgaggaggaggccaccatcggccccgagcggctcgccggcgacgtgctctactacggcgacagccactcggcggtggtgcagctgcactcgcgggaggacgtggaggcgctcatcgacgagcaccgcggcgaggaggggaagctcgtcgtgctcgacgtcggcctcaagcactgcgggccctgcgtcaaggtgtaccccaccgtcgtcaagctgtcgcgctccatggccgagaccacggtgttcgcgcgcatgaacggcgacgagaacgacagctgcatccaattcctcagggacatggacgttgtcgaggtgcccaccttcgtcttcatcagggatggcaagatcgtcggccgctacgtcggctccggcaagggtgaactcgtcggcgagatcctcagatacaacggcgtcagggtcacctactgaagaagcgatacacacatgaatggagaatggtctgcaaattgaagatgcaaaatgtaaaattactgcgacatccatacatcatcgatgattggtcgatgcttagattgtttttttgcattggataccattaccatatatacttgtatgttaatcatc

SEQ ID NO: 23279 - protein, 306 aa, Panicum virgatum
  misc_feature: Ceres CLONE 1826751
  misc_feature (189)..(299): Pfam Name: Thioredoxin Pfam Description: Thioredoxin
  misc_feature: SWISSPROT Homolog: EC 1.8.1.9 Thioredoxin-disulfide reductase
MAASTTATFLSTLARATASLSSSTMPSGGGAKAVRFLPTQTTSRGRRAVLSAPRAAASGTEKAAASDKGGKSKDERVVKVHSIEEFDGALQAAKNRLVVVEFAASDSEGSSQMYPTMVQLSRTCGDVDFLLVMGDESEATRELCRREGVAQVPHFNFYKGAEKVHEEEATIGPERLAGDVLYYGDSHSAVVQLHSREDVEALIDEHRGEEGKLVVLDVGLKHCGPCVKVYPTVVKLSRSMAETTVFARMNGDENDSCIQFLRDMDVVEVPTFVFIRDGKIVGRYVGSGKGELVGEILRYNGVRVTY

SEQ ID NO: 23280 - DNA, 641 bp, Panicum virgatum
  misc_feature: Ceres CLONE 1826820
  misc_feature: Encodes the peptide sequence at SEQ ID NO. 23281
aaaccgaagcggcggcagcagcaatggcggcctccatgatctcgtcgtcagctctggcggcaccggccagggcccagggcctgccgtccctcggccgccgcgcgtcctccttcgccgtcgtctgcggcaccggcaagaagatcaagaccgacaagcccttcgggattggaggtggcctcaccgtcgaccacgatgcctccgggaggaaggtcaagggcaagggcgtgtaccagttcgtcgacaagtacggcgccaacgtcgacggatacagcccaatctacaaagaggaggactggtctcccaccggtgacgtctacgtcggtggtaagtacattagtaatttcacccattcacttgtccagaatatattgctatatatgattacacggtggaaattaatcaccagatctatatatgtgcttggttaaataatttcagttagcatgcgcagcataaaagagatgaaatgttattcattatatttattgtggtccataatgtttgtattaatttccttattattatacacacaccggttaaaattcacatttacaccagtcctgtgactctataacagtgtctaggtcctgtttgttttccaccatggattacataatccagctttgggatgggaaacaaac

SEQ ID NO: 23281 - protein, 134 aa, Panicum virgatum
  misc_feature: Ceres CLONE 1826820
  misc_feature (35)..(127): Pfam Name: PsbR Pfam Description: Photosystem II 10 kDa polypeptide PsbR
MAASMISSSALAAPARAQGLPSLGRRASSFAVVCGTGKKIKTDKPFGIGGGLTVDHDASGRKVKGKGVYQFVDKYGANVDGYSPIYKEEDWSPTGDVYVGGKYISNFTHSLVQNILLYMITRWKLITRSIYVLG

SEQ ID NO: 23282 - DNA, 1780 bp, Panicum virgatum
  misc_feature: Ceres CLONE 1826843
  misc_feature: Encodes the peptide sequence at SEQ ID NO. 23283
actatatcatcgatctgccagcagccgatcgagctagcctcctccatcccagtcccaggcacacccatcatccagctgactgatctatccatggggacctgcagaggcagccctgtgctcgctctggcctcgcatgatgaggagcgcaagcctcggtcttacaccccaagcatctggggcgatttcttcctcaaacaccagccatgcaccccatcgcagcttgtgtcaatgaaggagagggcacggagcaagcaggaggaggtgaggcagatcttactcgacaccattgccgcctcttccgagctggttcacaagctggagcttgtcgacacgctgcaacggatcggagtggactaccactacaagaaggagatcgatgagttgctgcgtgatgttgttcacgatccccagcatgaagaaggttgcgatgatgacgagctatatgtcgtatcgctgcggttctatttgctcagaaagcatgggtacaatgtctcttctgatgtgtttgtgaagtttaaggatgactgcagaaactttgcaagtaatgatgtgaaatgtctgttggccctgtatgatgctgcaaatctcagaactcgcggtgaagagatccttaacagtgccgtggttttcatcaggagtcgcctccagtctatgatgaaaactttagacgacccagagctggcagcagaggtggagtacacattggaaacacctagttacaggagggttgaaagagttgaagcaaggcgctacatctctttgtatgagaaaaaggttacacgaaatgacaccatactggaatttgcaaagttggactacaacattctgcaagctctgtattgtgaggagttgaaagttcttacagcatggtggaaaggcctccagtcacaagcgtgtgtgagatttgcacgggatagagtgccagagatgcatttttggatgcttgggattattcaagaacctcgccagtcatatgcacggatagcattgacaaaatgctttaaacttgtgtcgctgatggacgacttatgtgacaactatagcaccacagaagaatatgaaatattcatgacttctctggaaaggtgggataaacaagccgcggagaaaatgccagcatacatgaaggacttattcatcttcatactcaacactataaatgatatcatggaagagttaaaacttcagaaaaacaaccatgctgaatttgtcaaagaactgtttattgacactgtcaaacgttacggtgctgagagaaaatggtgcgacgagcgctatgtaccagcaaaaattgaagagcacctacaaatttcagtggctagcagtgcatgtatgcatttggcaagcatcactttcgtcttaatgggagacgtaactaccggagaggccattgagtgggctttctcctatccagaaatgataagagctgcttgtgttgtcgcgcgcgtctgtaatgacatcatgtcacatgagcgagaacaagcatcaaagcatgtcgcgtccacagtgcaaacttgcatgaaggagtacgggatgacggtacatcaagcctatgaaaagcttggagacctaatcgatgaagcatggatggatattgtccagggatgtcttgatcaagcttatcctatggagcatttggagaaggtggttaacattgcacgaggaatggatcacatgtacaagcgtgatgatgcgtatacccacccatatagtctcaaagacaccataacttcaatgtatgtgaactccgtttgaatatatatgatgaagatctagcatc

SEQ ID NO: 23283 - protein, 554 aa, Panicum virgatum
  misc_feature: Ceres CLONE 1826843
  misc_feature (234)..(503): Pfam Name: Terpene_synth_C Pfam Description: Terpene synthase family, metal binding domain
  misc_feature (29)..(229): Pfam Name: Terpene_synth Pfam Description: Terpene synthase, N-terminal domain
  misc_feature: SWISSPROT Homolog: EC 4.2.3.13 (+)-delta-cadinene synthase
MGTCRGSPVLALASHDEERKPRSYTPSIWGDFFLKHQPCTPSQLVSMKERARSKQEEVRQILLDTIAASSELVHKLELVDTLQRIGVDYHYKKEIDELLRDVVHDPQHEEGCDDDELYVVSLRFYLLRKHGYNVSSDVFVKFKDDCRNFASNDVKCLLALYDAANLRTRGEEILNSAVVFIRSRLQSMMKTLDDPELAAEVEYTLETPSYRRVERVEARRYISLYEKKVTRNDTILEFAKLDYNILQALYCEELKVLTAWWKGLQSQACVRFARDRVPEMHFWMLGIIQEPRQSYARIALTKCFKLVSLMDDLCDNYSTTEEYEIFMTSLERWDKQAAEKMPAYMKDLFIFILNTINDIMEELKLQKNNHAEFVKELFIDTVKRYGAERKWCDERYVPAKIEEHLQISVASSACMHLASITFVLMGDVTTGEAIEWAFSYPEMIRAACVVARVCNDIMSHEREQASKHVASTVQTCMKEYGMTVHQAYEKLGDLIDEAWMDIVQGCLDQAYPMEHLEKVVNIARGMDHMYKRDDAYTHPYSLKDTITSMYVNSV

SEQ ID NO: 23284 - DNA, 677 bp, Panicum virgatum
  misc_feature: Ceres CLONE 1826876
  misc_feature: Encodes the peptide sequence at SEQ ID NO. 23285
ccgagagagcttcttcattcttgtcgatctcttgcttgagcagtcagtcctcgattcggcggttccatcgatcgagctgctgtctagctactagctacctggtggtccatatcgaccgatcgaggccggccggccggcgacgatatatgatgatggagatggagatggagatgatgatgtcgcaggcggcgacgtcgcagctgccgccggggttccggttccaccccaccgacgaggagctcatcctgcactacctccgcaaccgcgccgcctccgcgccgtgccccgtccccatcatcgccgacgttgacatctacaagttcgacccatgggacctcccctccaaggctgtgcacggcgacggcgagtactacttcttcagcccgcgcgaccgcaagtaccccaacggcatccgccccaaccgcgcggcggggtccggctactggaaggccaccggcaccgacaagcccatccacgacagcgccaccggcgagggcgtcggcgtcaagaaggcgctcgtcttctacaagggccgcccgcccaggggcaccaagaccaactggatcatgcacgagtaccgcctcgccgccgccaacccgctcgccgccgccgccgcctaccgcccgccctccaagttcaggaacgtctccatgaggctggacgactgggtgctgtgc

SEQ ID NO: 23285 - protein, 176 aa, Panicum virgatum
  misc_feature: Ceres CLONE 1826876
  misc_feature (19)..(147): Pfam Name: NAM Pfam Description: No apical meristem (NAM) protein
  misc_feature: The sequence is a functional homolog of SEQ ID NO 851 in the 10/374,780 US patent application
  misc_feature: The sequence is a functional homolog of SEQ ID NO 854 in the 10/374,780 US patent application
  misc_feature: Useful for making plants with modulated oxidative stress sensitivity
  misc_feature: The sequence is a functional homolog of SEQ ID NO 1012 in the 11/435,388 US patent application
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: Useful for making plants with altered alkaloid content
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: Useful for making plants with altered cell wall content and/or composition
  misc_feature: Useful for making plants with altered lignin content
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 853 in the 10/374,780 US patent application
  misc_feature: The sequence is a functional homolog of SEQ ID NO 890 in the 10/374,780 US patent application
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: The sequence is a functional homolog of SEQ ID NO 891 in the 10/374,780 US patent application
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: Useful for making plants with modulated water use efficiency
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: Useful for making plants with modulated light quality response
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: The sequence is a functional homolog of SEQ ID NO 852 in the 10/374,780 US patent application
  misc_feature: Useful for making plants with altered terpenoid content
  misc_feature: The sequence is a functional homolog of SEQ ID NO 2592 in the 10/374,780 US patent application
  misc_feature: The sequence is a functional homolog of SEQ ID NO 288 in the 10/225,066 US patent application
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: Useful for making plants with modulated nitrogen use efficiency
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: The sequence is a functional homolog of SEQ ID NO 320 in the 10/374,780 US patent application
  misc_feature: The sequence is a functional homolog of SEQ ID NO 850 in the 10/225,066 US patent application
  misc_feature: The sequence is a functional homolog of SEQ ID NO 492 in the 11/435,388 US patent application
  misc_feature: The sequence is a functional homolog of SEQ ID NO 741 in the 11/479,226 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: Useful for making plants with modulated light quality sensitivity
  misc_feature: The sequence is a functional homolog of SEQ ID NO 2590 in the 10/374,780 US patent application
  misc_feature: The sequence is a functional homolog of SEQ ID NO 286 in the 10/225,066 US patent application
  misc_feature: Useful for making plants with modulated biomass
  misc_feature: The sequence is a functional homolog of SEQ ID NO 612 in the 11/435,388 US patent application
  misc_feature: The sequence is a functional homolog of SEQ ID NO 476 in the 10/666,642 US patent application
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: The sequence is a functional homolog of SEQ ID NO 2472 in the 10/374,780 US patent application
  misc_feature: The sequence is a functional homolog of SEQ ID NO 520 in the 11/435,388 US patent application
  misc_feature: The sequence is a functional homolog of SEQ ID NO 974 in the 10/225,066 US patent application
  misc_feature: The sequence is a functional homolog of SEQ ID NO 106 in the 10/225,068 US patent application
  misc_feature: The sequence is a functional homolog of SEQ ID NO 2348 in the 10/374,780 US patent application
  misc_feature: The sequence is a functional homolog of SEQ ID NO 340 in the 10/412,699 US patent application
  misc_feature: The sequence is a functional homolog of SEQ ID NO 778 in the 11/479,226 US patent application
  misc_feature: The sequence is a functional homolog of SEQ ID NO 2 in US patent 7230164
  misc_feature: The sequence is a functional homolog of SEQ ID NO 6 in US patent 7230160
  misc_feature: The sequence is a functional homolog of SEQ ID NO 116 in the 10/225,066 US patent application
  misc_feature: The sequence is a functional homolog of SEQ ID NO 2476 in the 10/374,780 US patent application
  misc_feature: The sequence is a functional homolog of SEQ ID NO 88 in the 11/375,241 US patent application
  misc_feature: The sequence is a functional homolog of SEQ ID NO 1365 in the 11/479,226 US patent application
  misc_feature: The sequence is a functional homolog of SEQ ID NO 2474 in the 10/374,780 US patent application
  misc_feature: The sequence is a functional homolog of SEQ ID NO 744 in the 10/225,066 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 160 in the 10/666,642 US patent application
  misc_feature: The sequence is a functional homolog of SEQ ID NO 634 in the 10/412,699 US patent application
  misc_feature: The sequence is a functional homolog of SEQ ID NO 638 in the 11/435,388 US patent application
  misc_feature: The sequence is a functional homolog of SEQ ID NO 194 in the 10/374,780 US patent application
  misc_feature: The sequence is a functional homolog of SEQ ID NO 898 in the 10/225,066 US patent application
  misc_feature: The sequence is a functional homolog of SEQ ID NO 1729 in the 11/479,226 US patent application
  misc_feature: The sequence is a functional homolog of SEQ ID NO 328 in the 10/374,780 US patent application
  misc_feature: The sequence is a functional homolog of SEQ ID NO 852 in the 10/225,066 US patent application
  misc_feature: The sequence is a functional homolog of SEQ ID NO 2416 in the 10/374,780 US patent application
  misc_feature: The sequence is a functional homolog of SEQ ID NO 914 in the 10/225,066 US patent application
  misc_feature: Useful for biocontainment applications
  misc_feature: The sequence is a functional homolog of SEQ ID NO 162 in the 10/225,068 US patent application
  misc_feature: The sequence is a functional homolog of SEQ ID NO 2414 in the 10/374,780 US patent application
  misc_feature: The sequence is a functional homolog of SEQ ID NO 428 in the 11/435,388 US patent application
  misc_feature: The sequence is a functional homolog of SEQ ID NO 508 in the 10/412,699 US patent application
  misc_feature: The sequence is a functional homolog of SEQ ID NO 728 in the 10/225,066 US patent application
  misc_feature: Useful for making plants with altered carbohydrate content
  misc_feature: The sequence is a functional homolog of SEQ ID NO 1198 in the 10/412,699 US patent application
  misc_feature: The sequence is a functional homolog of SEQ ID NO 867 in the 10/374,780 US patent application
  misc_feature: The sequence is a functional homolog of SEQ ID NO 310 in the 10/666,642 US patent application
  misc_feature: The sequence is a functional homolog of SEQ ID NO 854 in the 11/435,388 US patent application
  misc_feature: The sequence is a functional homolog of SEQ ID NO 344 in the 10/666,642 US patent application
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: The sequence is a functional homolog of SEQ ID NO 142 in the 10/286,264 US patent application
  misc_feature: The sequence is a functional homolog of SEQ ID NO 324 in the 10/412,699 US patent application
  misc_feature: The sequence is a functional homolog of SEQ ID NO 756 in the 11/479,226 US patent application
  misc_feature: The sequence is a functional homolog of SEQ ID NO 2168 in the 10/374,780 US patent application
  misc_feature: The sequence is a functional homolog of SEQ ID NO 370 in the 10/666,642 US patent application
  misc_feature: The sequence is a functional homolog of SEQ ID NO 745 in the 11/479,226 US patent application
  misc_feature: The sequence is a functional homolog of SEQ ID NO 240 in the 10/225,068 US patent application
  misc_feature: The sequence is a functional homolog of SEQ ID NO 368 in the 10/374,780 US patent application
  misc_feature: The sequence is a functional homolog of SEQ ID NO 582 in the 10/666,642 US patent application
  misc_feature: The sequence is a functional homolog of SEQ ID NO 1816 in the 11/479,226 US patent application
  misc_feature: The sequence is a functional homolog of SEQ ID NO 2112 in the 10/374,780 US patent application
MMMEMEMEMMMSQAATSQLPPGFRFHPTDEELILHYLRNRAASAPCPVPIIADVDIYKFDPWDLPSKAVHGDGEYYFFSPRDRKYPNGIRPNRAAGSGYWKATGTDKPIHDSATGEGVGVKKALVFYKGRPPRGTKTNWIMHEYRLAAANPLAAAAAYRPPSKFRNVSMRLDDWVL

SEQ ID NO: 23286 - DNA, 1238 bp, Panicum virgatum
  misc_feature: Ceres CLONE 1826887
  misc_feature: Encodes the peptide sequence at SEQ ID NO. 23287
accacccaccacctgcttgcactcgcttcgctttcgctcactgcccccccagcccgcgcgcagccagccagggaagccggaagggcgagcgaaggcggccatgggcgccccctcctccctccccgccgccgcggcgctcctgctccttatgagcctcctcgccggtgggcactgccgagaggcccagctcgacgtcggtggcgccgacgcggccggcgccgagaactacaacaccagcgacgccgccgtgtactggggcccctggcagaaggcccgcgccacctggtacggccagcccaacggcgccggcccagacgacaacggcggtgcgtgcggcttcaagcacaccaaccagtacccgttcatgtccatggggtcctgcggcaaccagccattgttcaaggacggcaagggctgcggctcctgctacaagattcggtgcaccaaggacaagtcctgctccggcaaggcggagacggtgatcatcaccgacatgaactactacccggtgtccaagtaccacttcgacctcagcggcacggccttcggccggctcgccaaacccggcctcaacgacaagctccgccactcgggcatcatcgacatcgagttcaccagggtgccgtgcgagttcccgggcctgaaggtcgggttccacgtggaggagtactcgaaccccgtctacttcgcggtgctggtcgagtacgaggacggcgacggcgacgtggtgcaggtggacctgatggagtccaagacggcgcgcggcccggccacggggcggtggacgccgatgcgcgagtcctggggcaacgtctggcgcctcgacaccaaccaccgcatgcaggcgcccttctccatccgcatccgcaacgagtccggcaagacgctcgtcgcccgcaacgtcatccccgccaactggaggcccaacacctcctaccgctccttcgtccagtacagctgatcaggccctgcgcccgcaattggagctggcgcgcccggtcgtcgtcgtcttctctactactactacgctactaccaccactagactactgcttctactagtacggcgggcgggaacggaacggctagtcgtcgagggttgtctctctggtcatcgtgtcgttgcagttgtattatcatgagtcggggtccgtccgttgcatttgggtgggcgcgcttggcttttaggtcgagcgccatgtgcgggtgttctgtgtgagtcatcagggagggggatga

SEQ ID NO: 23287 - protein, 286 aa, Panicum virgatum
  misc_feature: Ceres CLONE 1826887
  misc_feature (183)..(270): Pfam Name: Pollen_allerg_1 Pfam Description: Pollen allergen
  misc_feature (92)..(171): Pfam Name: DPBB_1 Pfam Description: Rare lipoprotein A (RlpA)-like double-psi beta-barrel
  misc_feature: Useful for making plants with altered carbohydrate content
MGAPSSLPAAAALLLLMSLLAGGHCREAQLDVGGADAAGAENYNTSDAAVYWGPWQKARATWYGQPNGAGPDDNGGACGFKHTNQYPFMSMGSCGNQPLFKDGKGCGSCYKIRCTKDKSCSGKAETVIITDMNYYPVSKYHFDLSGTAFGRLAKPGLNDKLRHSGIIDIEFTRVPCEFPGLKVGFHVEEYSNPVYFAVLVEYEDGDGDVVQVDLMESKTARGPATGRWTPMRESWGNVWRLDTNHRMQAPFSIRIRNESGKTLVARNVIPANWRPNTSYRSFVQYS

SEQ ID NO: 23288 - DNA, 1630 bp, Panicum virgatum
  misc_feature: Ceres CLONE 1826889
  misc_feature: Encodes the peptide sequence at SEQ ID NO. 23289
gcgaaaaaacgaaataactcgaggtttcttgcgccactccggctccgccgccccccgccgcgctccgcagccgcagcccccgcagtcgagatgggaatcaagggtttgacgaagctgctggcggacaatgcgcccaaggctatgaaggaacagaagttcgagagctacttcggccgcaaaatcgccgtcgacgccagcatgagcatctaccagttcctgattgtagttggaagaacaggtatggaaactctcacgaatgaagctggtgaagtcactagtcacctgcaaggtatgttcaaccggacaataaggttgctggaggcaggaatcaagccagtttacgtttttgatggcaagcctcctgacatgaagaaacaagagcttgctaaaagatactctaaaagagaggatgcaaccaaagaactgactgaggcagtagaggaaggagataaggacgcgattgaaaaacttagcaagaggactgtaaaggtcacaaggcagcacaacgatgactgtaaacgactattgagacttatgggggttcctgttgtagaggcaccttgtgaagctgaagcagaatgtgcagcactttgtataaatgataaggtgtacgcagttgcttcagaagatatggactcccttacttttggggctccacggttccttcgtcatttgatggatccaagttccaagaaaatacctgtgatggaatttgatattgccaaagttttggaggagcttgaactcaccatggaccagttcattgatttgtgcatcctctgtggatgtgactactgtgacagcatcaaaggtattggggggcaaacagctctgaagcttattcatcaacacgggtccatagaaagcattttggagaatcttaataaagacagatatcaaattcctgaagactggccttaccaagaagctcgacgcttgttcaaggaacctaatgttacattagatattcctgagttgaaatggactgcacctgatgaggagggtctcataaccttcctggtaaaagataatggcttcaacgaagatcgggtgacaaaagccatagagaagatcaaatctgccaagaataaatcatcccaaggaagactcgagtcctttttcaagccagttgctagcgcatcgacaccgctgaaacggaaggagacttcagagaaaacaactaaggcagctgcgaacaagaaaacaaaggccggtggaaagaagaaataagcttgaatgcttgatgtgcaatggaggaacagaagctgcagcggccagtagccttcttagattttttttttaactacgtgctgtaactccaactttggtccactttttcgatgttccaagctaggtagattagttgtccttgaagaggaattggtgtaccaagtgacaaagaaaaacctatcatgtatgttagttcgtctgctcatgcttgtacattttcctcttcccttatggagtttttatgttacttgctgttaaagggggttttctctgtccagacctcctgggagtatcaacagcacgtgagtgtggtgtggccgtgtggacatgtccgggaacagggtcttttgtgcttgacgctcagtgttccagtggattcaggcatgattgatggtcggcc

SEQ ID NO: 23289 - protein, 379 aa, Panicum virgatum
  misc_feature: Ceres CLONE 1826889
  misc_feature (1)..(108): Pfam Name: XPG_N Pfam Description: XPG N-terminal domain
  misc_feature (147)..(238): Pfam Name: XPG_I Pfam Description: XPG I-region
  misc_feature (219)..(308): Pfam Name: 5_3_exonuc Pfam Description: 5'-3' exonuclease, C-terminal SAM fold
  misc_feature: SWISSPROT Homolog: EC 2.7.7.7 DNA-directed DNA polymerase
MGIKGLTKLLADNAPKAMKEQKFESYFGRKIAVDASMSIYQFLIVVGRTGMETLTNEAGEVTSHLQGMFNRTIRLLEAGIKPVYVFDGKPPDMKKQELAKRYSKREDATKELTEAVEEGDKDAIEKLSKRTVKVTRQHNDDCKRLLRLMGVPVVEAPCEAEAECAALCINDKVYAVASEDMDSLTFGAPRFLRHLMDPSSKKIPVMEFDIAKVLEELELTMDQFIDLCILCGCDYCDSIKGIGGQTALKLIHQHGSIESILENLNKDRYQIPEDWPYQEARRLFKEPNVTLDIPELKWTAPDEEGLITFLVKDNGFNEDRVTKAIEKIKSAKNKSSQGRLESFFKPVASASTPLKRKETSEKTTKAAANKKTKAGGKKK

SEQ ID NO: 23290 - DNA, 1384 bp, Panicum virgatum
  misc_feature: Ceres CLONE 1826908
  misc_feature: Encodes the peptide sequence at SEQ ID NO. 23291
cacaggaccacctccaactccaagccgccgcagcagccagcggcaccaccactccacccgccgggaccacctccaactccaagccgccgcagcagccaccgcgcccgctgtgtgctctgctgcgacggcggcgccaatggccgaccgcgtctacccggccgccaagcccaacccgcccccggcggcggcggccgcggccgccaacggcagcggcgccccgccggcgtcgttcccggcgcccaagtcgcagatgtaccagcggcccatctaccggccgcaggcccccgcgaagcgccggcgcgcgcggtcctgccggtgcagcttctgctgctgcttctgctgggcgctgctggcggtgatcctcctggcgctcgttgccgccgtggccggcggcgccttctacctcctgtaccggccgcagcgcccgtccttcaccgtctcctccgtgcggctggcgtcgctgaacctcacctcctccgccaccgcgccggccctcaccgacgccatcacgctgaccgtcaccgcccgcaaccccaacaagaagatcgcctacgtctacggcgacttcaccctgtcggcggccacctccgccaacgcgctcccgctgggcagcgcgacggtgcccgggttcgcgcacgcggccggcaacaccaccgtgctgaccgccaccatcgcctccgccgcggcgacggtggaccccgccgcgagcgccgacgtgaagaagcccggcgggttcagcgtggtcctggacgcggacacgagcgcgggcgcccgcgtgggcggcctgaggaccaagaggatcggcatccaggtgcactgcgagggcatcaaggtgaccccgccgcgcccgcccccgcccccgccggcgcccaggaaggccaagggcgggaagaacggcaccgtcgcgctcgcgccggcgccgaccccgtccgacgccgacgcgacgacgacggcgacggccgcgacggtgagcacggcggcgcacccgtgcaaggtcagggtgcgcgtcaagatctggaagtggaccttctaggtgcggaagcgcgttacgattaggggctgggctggaggctggagcgcgaaagattttccagtaaagttttttcgctttgagatatactacgcactactataatttatttactactcctacatgattattatattggagcagacgagtaggaagccattacccatccatgcgtgcgtcgcgtcggtgtaaatcccccccaggcatctcatttttttccttttttttctcttctccctcctgatcgaaacaattttttttgtgtcattgagtagtagtgggtgtataattggcgagatctgatattgtacactgtataattcgaatggatttattattttattttaagcttgc

SEQ ID NO: 23291 - protein, 298 aa, Panicum virgatum
  misc_feature: Ceres CLONE 1826908
  misc_feature (89)..(228): Pfam Name: Hin1 Pfam Description: Harpin-induced protein 1 (Hin1)
MADRVYPAAKPNPPPAAAAAAANGSGAPPASFPAPKSQMYQRPIYRPQAPAKRRRARSCRCSFCCCFCWALLAVILLALVAAVAGGAFYLLYRPQRPSFTVSSVRLASLNLTSSATAPALTDAITLTVTARNPNKKIAYVYGDFTLSAATSANALPLGSATVPGFAHAAGNTTVLTATIASAAATVDPAASADVKKPGGFSVVLDADTSAGARVGGLRTKRIGIQVHCEGIKVTPPRPPPPPPAPRKAKGGKNGTVALAPAPTPSDADATTTATAATVSTAAHPCKVRVRVKIWKWTF

SEQ ID NO: 23292 - DNA, 677 bp, Panicum virgatum
  misc_feature: Ceres CLONE 1826924
  misc_feature: Encodes the peptide sequence at SEQ ID NO. 23293
accaggcagcaggggattgtgcaggtctctatcgccctctccacagctctcaggcaccagccgcgtccaccgcctaaaccctctgctctcctcgggagctgcgagggtaggacggccatggcggacgccaagcagcagcaggtggtggcgccaagcgccgtgtggatgacggtgaagcccttcgtcaatggcggcgcctccggcatgctcgccacctgcgtcatccagccaatcgacatggtcaaggtcaaaatccaactgggagagggctctgcagccaccgtcaccaagaagatgctcgctaatgagggaatcggttccttttacaagggattatcagctggtttgctaaggcaagccacgtacacgaccgctcgtcttggatccttcagggttctaacaaataaagcagttgaagcaaatgagggaaagccactacctctactgcaaaaagctgttattggtctcactgctggagcaattggagcatctgttggtagtcctgcagatttggcactcattaggatgcaggccgattcaaccctgccggctgcccaacggcgtaactacaagaatgcttttcatgcactttaccgtattgttgctgatgaaggtgttctggcactttggaagggtgcaggcccaactgtagtcagagctatgtccctaaacatggg

SEQ ID NO: 23293 - protein, 186 aa, Panicum virgatum
  misc_feature: Ceres CLONE 1826924
  misc_feature (21)..(98): Pfam Name: Mito_carr Pfam Description: Mitochondrial carrier protein
  misc_feature (108)..(185): Pfam Name: Mito_carr Pfam Description: Mitochondrial carrier protein
  misc_feature: Useful for making plants with modulated biomass
MADAKQQQVVAPSAVWMTVKPFVNGGASGMLATCVIQPIDMVKVKIQLGEGSAATVTKKMLANEGIGSFYKGLSAGLLRQATYTTARLGSFRVLTNKAVEANEGKPLPLLQKAVIGLTAGAIGASVGSPADLALIRMQADSTLPAAQRRNYKNAFHALYRIVADEGVLALWKGAGPTVVRAMSLNM

SEQ ID NO: 23294 - DNA, 523 bp, Panicum virgatum
  misc_feature: Ceres CLONE 1826926
  misc_feature: Encodes the peptide sequence at SEQ ID NO. 23295
actcacccagcacaagaagcaagctccatcgccgggccccttcctccacctcccccaccacccatctccgcacagtcccaccgaccgcttcggccatggcccggcgggtgtcgtccctactgctgctgctgctgctgggcgcgctggccgcggcggcggcggcggccgcggccagcttccaccaggatttcgacctcccctggggccaccgcccgcgccagatccacgacggcggccgcctccttacgctcacgctcgaccgccccccccgctcccgcttccactccaggcaacagtacctcttcggcaagatcgacatgcacatcaagctcgtccccggcaactccgccggcaccgccaccgcctactacccctcgtcgcacgggagcacccacgacgagatcgacttcgagttcctgggcaacgtcaccggccagccctacacgctgcacaccaacgtgctcacgcaagggcaaggccagcgcgagcagcagttccccctctggttcgacccccccaccga

SEQ ID NO: 23295 - protein, 142 aa, Panicum virgatum
  misc_feature: Ceres CLONE 1826926
  misc_feature (28)..(142): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
  misc_feature: Useful for making plants with altered carbohydrate content
  misc_feature: Useful for making plants with altered cell wall content and/or composition
MARRVSSLLLLLLLGALAAAAAAAAASFHQDFDLPWGHRPRQIHDGGRLLTLTLDRPPRSRFHSRQQYLFGKIDMHIKLVPGNSAGTATAYYPSSHGSTHDEIDFEFLGNVTGQPYTLHTNVLTQGQGQREQQFPLWFDPPT

SEQ ID NO: 23296 - DNA, 1294 bp, Panicum virgatum
  misc_feature: Ceres CLONE 1826947
  misc_feature: Encodes the peptide sequence at SEQ ID NO. 23297
aaaaaaaaaattagcgccgccactcccagacacatagcccgagccctctcctcctccccttcgggccaccaccaaacccttgcatacccatccaccatggcggcggcggcaggcggaggcgcgccgcgggcgttgtcccagaaggagcaggacatccagatgatgctcgccgccgacgtccaactgggcaccaagaactgcgacttccagatggagcgctacgtcttcaagcgccgcactgacggcatctacatcatcaaccttggcaagacatgggagaagctccagctggcggcgagggtaatcgttgccattgagaaccctcaggacatcattgtccagtccgcccgcccctacggccagcgcgccgtcctcaagttcgcgcagtacactggtgcccatgctattgccgggaggcacacccctggaaccttcaccaatcagctgcagacgtccttcagtgagcctcggctgctcatccttaccgacccaaggactgaccaccagccgatcaaggagtctgctctggggaacatccccaccattgccttctgtgatactgactcccccatgcggtatgtcgatatcggcatcccagccaacaacaagggaaggaacagcattggatgcctgttctggctcttggcaaggatggttctgcagatgaggggcactatcctccctgggcacaagtgggaagtcatggttgatttgttcttctacagagaccctgaggaagcaaaggagcaggaggaggaagctgctgctgcccctgagtttgccgctatcactgattacccagcggctgatcagtggggtggtggagaccagtggacctctgatgttgctgcaccgcctgttgctgttggtggcactggtgccgagtggggtgctgctccagctccagttcctactggagaaggctgggatccagctggggctcctgcacctgtggagggtgctgttcctccggttgttgctgcttcggctggttgggatccagcagcacaacccaccgcccagggctgggactaggcataggccctccctttgtgatgcatcttgaattcaggaatttttccaaagtatgaatacccaaaatcaggatgcatcgtctacagctatgcattgaacacttttgtttagggctttctagctgaacttgtgcccctgttctgttttcaacattgctgctagaggagactgcgaagatgtggtataagtagcatttccgttcgtgttgtttatggatccgttcaatatgatggttctatataacatgttgaggcagttg

SEQ ID NO: 23297 - protein, 312 aa, Panicum virgatum
  misc_feature: Ceres CLONE 1826947
  misc_feature (23)..(191): Pfam Name: Ribosomal_S2 Pfam Description: Ribosomal protein S2
MAAAAGGGAPRALSQKEQDIQMMLAADVQLGTKNCDFQMERYVFKRRTDGIYIINLGKTWEKLQLAARVIVAIENPQDIIVQSARPYGQRAVLKFAQYTGAHAIAGRHTPGTFTNQLQTSFSEPRLLILTDPRTDHQPIKESALGNIPTIAFCDTDSPMRYVDIGIPANNKGRNSIGCLFWLLARMVLQMRGTILPGHKWEVMVDLFFYRDPEEAKEQEEEAAAAPEFAAITDYPAADQWGGGDQWTSDVAAPPVAVGGTGAEWGAAPAPVPTGEGWDPAGAPAPVEGAVPPVVAASAGWDPAAQPTAQGWD

SEQ ID NO: 23298 - DNA, 1444 bp, Panicum virgatum
  misc_feature: Ceres CLONE 1826958
  misc_feature: Encodes the peptide sequence at SEQ ID NO. 23299
tccgggttccgccgctgtgctctgcctctgctcgacgacccaacccggcgagccaccaccgagcgcgatggcgagctcggctctgaggcgatctctccctcggggcccctcgctccgcagcgccctcttgtcccgccgcccacccgccgccagcgacttctgccgctctttccagtccggggatggtgaaactcgggagaccacggacgaattcgaggcgcggctgtttgggaacaagggcctggaagagggttcactctatcagaaactcgatagggttgagaataccagtaagagatacggcatgggctctggatccaggggtggttttggtggtctccgcgataggagcagttctgggaccatgggtggttttggtgggttcggtgaccgtaacagcactggatccatgggtgggtttggcgacaggagcagctctgggtcattgggtggttttgattctttgaatgatgggatgagtgagatgcttggtaatgtggcacgtaacaacatcgaattggacgatgacgatgaggaggactgggacgatgaggactttgagttcaggcctgacgtggacttcaggcgaggttcgacctatactgttcgggaccttgaccttaatagacctgcagccgcaaagaaccctcccagaccacagtttgaaacaactacagcagaagttttgaggaaggctgattttaggaacgttagattcctcgccaactttcttacagaagctggaattatcatcaagagaagccagactcgcataagtgcgaaagctcagcgtaagattgcaagagagatcaaaaccgctcgtgcctttgggctaatgcctttcacaacgatgggtagaagaccattcatctttggcagaagcgccgaggagcactattcagaggaagaatatggattcgactttgtgaagcagaaggatggtgaggataatggggaagctgagccaagcgtggaggctgtgtaagcattctggagcgaccttttgcaatcgccccgtttcatcagttgttctcatttgacacagctctgcgtgcctgcctgatgcccccattttgctttgttcagaggatagctcagcttagcctgaataaactgtgacattcggttgtgtacctctgcttgcctgttgtcgtgtgatagcgaaatatcttcagtgacactatcctccaggctggagatcatgtgccatatgaaatgggccatgtgatcggacgctcggaaacctttgtggtaatactgctgagttcaatttcatatccaagcatgactgttaggctgttcaacgagggcaccgacaattcatgattatgtgctggttgttggcagcttaatttttctattgcttttgaaggattttacccggttatctcagaaagaatgtatattgcggggtcaggatatgcccttgcacctttgtgacctc

SEQ ID NO: 23299 - protein, 305 aa, Panicum virgatum
  misc_feature: Ceres CLONE 1826958
  misc_feature (204)..(257): Pfam Name: Ribosomal_S18 Pfam Description: Ribosomal protein S18
MASSALRRSLPRGPSLRSALLSRRPPAASDFCRSFQSGDGETRETTDEFEARLFGNKGLEEGSLYQKLDRVENTSKRYGMGSGSRGGFGGLRDRSSSGTMGGFGGFGDRNSTGSMGGFGDRSSSGSLGGFDSLNDGMSEMLGNVARNNIELDDDDEEDWDDEDFEFRPDVDFRRGSTYTVRDLDLNRPAAAKNPPRPQFETTTAEVLRKADFRNVRFLANFLTEAGIIIKRSQTRISAKAQRKIAREIKTARAFGLMPFTTMGRRPFIFGRSAEEHYSEEEYGFDFVKQKDGEDNGEAEPSVEAV

SEQ ID NO: 23300 - DNA, 1668 bp, Panicum virgatum
  misc_feature: Ceres CLONE 1826973
  misc_feature: Encodes the peptide sequence at SEQ ID NO. 23301
atgtttaattgtttatcaaaaaaaaaagaacggactcgcacggccgcacgcgcacggcagccgaccggccgaccaaccacccaactcgccggcagcggcaaacctgcagatcccggcctgagttccctcatacggaacccgccctctgctgctgttccccgcctcggatcccttccgttccccgttccctgatgcggcccgggccgccgtcgcctctggatccgccgatctagccgctgctacttccgtcgcggcttggttgggttgaggaggacgaggcggaagtgagagatgatgttctggagggacggcggcgggactgggggcgggaacgggcgggactccctcagcggcgggctgccctgcggccaggtgcgcgtgctcgtcgtcggcgactcaggtgtgggcaaatcttcgttggtgcatctattattaaatggttctgcagttgctcgaccagcccaaacaattggatgtgcagttggtgttaaacatattacttacagtagccctgggagttcatcgaatagcatcaaggctgatgctgaaaggaacttctttgtcgagctttgggatgtttcaggacatgagcgctacaaagagtgccgttcactcttctattcacaaattaatggtgtcatatttgtttttgacctctctcagagaaagacaaaaacaaatttgaacaaatgggcagtggaggttgctgaatctgggaccttttcagctcctcttggttctggtggtccaggtggccttccggttccttacctagtgattgccaacaaagtggatattgctccaagagatggtagaagagtgagcagtgggaatcttgttgatgttgctcgtcaatgggttgaaaaacagggcctacttccaccaagtgaagaacttcctctcgcagatagcttccctggcaattctggtctgctcacggctgctaaagaggcaagatatgataaagaagctctgaacaaatttttccgcatgttgataaggagacgatatttttcgaacgagcttccagccccgagcccatggtcactcacacccagagaggataccatccttcctgtagaaaccgtgaatgatgatgacttgttccaaagaaaaagctatgggggccagagctacaaatacaacggagttgctccactgcctgcacagagaaacctaacaccaccccccacactctatccacagcagccaatgtcgtcttcatcagagaactacagataccacagattctcctcttcatcaattcctgattcaggcggtggtagaacaagccgagcggacatcaatatatgattatctgagtccttccccattaccacctgttatgtggaaaagaacatggtgcctggtccttttgaatcccagctttttgatattccgggctgttcacatgtcttaattgttggaaatgcatgttgccagggccctcctctttaacataatctttgtgggatcactagtataaattcttttattcttccatgtatatctttgatcttttatgtataaattcaatagtcattttagagtaacagaatggtgtatggtggtatcctgtaatagcaatttgaatcaacctgttttgccctgtggggcactgcagctgtacatgtgccagcatgcttttatattgaactttttactctt

SEQ ID NO: 23301 - protein, 340 aa, Panicum virgatum
  misc_feature: Ceres CLONE 1826973
  misc_feature (29)..(168): Pfam Name: Miro Pfam Description: Miro-like protein
MMFWRDGGGTGGGNGRDSLSGGLPCGQVRVLVVGDSGVGKSSLVHLLLNGSAVARPAQTIGCAVGVKHITYSSPGSSSNSIKADAERNFFVELWDVSGHERYKECRSLFYSQINGVIFVFDLSQRKTKTNLNKWAVEVAESGTFSAPLGSGGPGGLPVPYLVIANKVDIAPRDGRRVSSGNLVDVARQWVEKQGLLPPSEELPLADSFPGNSGLLTAAKEARYDKEALNKFFRMLIRRRYFSNELPAPSPWSLTPREDTILPVETVNDDDLFQRKSYGGQSYKYNGVAPLPAQRNLTPPPTLYPQQPMSSSSENYRYHRFSSSSIPDSGGGRTSRADINI

SEQ ID NO: 23302 - DNA, 630 bp, Panicum virgatum
  misc_feature: Ceres CLONE 1826977
  misc_feature: Encodes the peptide sequence at SEQ ID NO. 23303
ctcgcttcccggcacggctgcctccgatcccctgcgagtctgcgacctccacctgcagccatggagcaagccgccccgccgccgcaggtcccccgcgccaagctcggcacccaggggctggaggtgtcgaagctggggttcgggtgcatggggctcacgggctcctacaacgccccgctcggcgacgaggccgtcgccgccgtcgtcgagcatgccttccgccgcggggtcaccttcttcgacacctccgacgcgtacgggccccacaccaacgagaccctcctgggcagggcgctggggcggctgccgcgggggcaggtgcaggtggccaccaagttcgggatcgggcagggcgcggccggcggcctgaccgtgtgcggcgagcctgagtacgtgcgcgcctgctgcgaggccagcctgcgccgcctcggcgtcagctacatcgacctctactaccagcaccgcgtcgacatcaccgtccccatcgaggacacgattggtgagctcaagaagctggtggaggaggggaaggtcaagtacatcgggctgtcggaggcgagcccggacacgatccggcgcgcgcacgccgtgcaccccatcaccgcggtgcagatggagtggtcgctctgg

SEQ ID NO: 23303 - protein, 189 aa, Panicum virgatum
  misc_feature: Ceres CLONE 1826977
  misc_feature (16)..(189): Pfam Name: Aldo_ket_red Pfam Description: Aldo/keto reductase family
  misc_feature: SWISSPROT Homolog: EC 1.1.1.65 Pyridoxine 4-dehydrogenase
MEQAAPPPQVPRAKLGTQGLEVSKLGFGCMGLTGSYNAPLGDEAVAAVVEHAFRRGVTFFDTSDAYGPHTNETLLGRALGRLPRGQVQVATKFGIGQGAAGGLTVCGEPEYVRACCEASLRRLGVSYIDLYYQHRVDITVPIEDTIGELKKLVEEGKVKYIGLSEASPDTIRRAHAVHPITAVQMEWSL

SEQ ID NO: 23304 - DNA, 1297 bp, Panicum virgatum
  misc_feature: Ceres CLONE 1826981
  misc_feature: Encodes the peptide sequence at SEQ ID NO. 23305
gggggtcgcagtgaccaggcccgggcgactgtttaccaaaaacacaggtctccgcaaagtcgtaagaccatgtatgggggctgacgcctgcccagtgccggaaggtcaaggaagttggtgaactgatgacagggaagccggcgaccgaagccccggtgaacggcggccgtaacaataacggtcctaaggtagcgaaattccttgtcgggtaagttccgacccgcacgaaaggcgtaacgatctgggcactgtctcggagagaggctcggtgaaatagacatcagccatcccctcctgctgcaaatcttcctctgaattgtgggtctgcggcaatggcggcgcttgctccatccaagatcctcggcacccagctcaacttcgctggctcctcccggtacgccaccactgcgccgaccgctggggcgcagaagattgtctccctcttcagcaagaagcctgcccagaagcccaagcccgccgcggtatcatcctcgccggacatcagcgatgagctcgccaagtggtacggtcctgacaggaggatcttcctgccagatggcctcttggaccgctcagaggtgccggagtacctcaccggagaggtcccaggagactatggctatgatccttttggcctgggcaagaagccagaggacttcgccaagtaccaggcctacgagctgatccatgccaggtgggccatgctcggcgccgccggtgccgtcatcccggaggcgtgcaacaagttcggcgccaactgtggccctgaggccgtctggttcaagaccggcgccctgctgctggacggcaacaccctcagctacttcggcaacagcatccccatcaacctggtggtggccgtgatcgccgaggtggtcctcgttggcggcgccgagtactaccggatcatcaacggcctggacctggaggacaagctgcaccccggcggcccgttcgaccccttgggcctggccagcgaccccgaccaggctgccatcctcaaggtgaaggagatcaagaacggccggctggccatgttctccatgctcgccttcttcatccaggcgtacgtcaccggcgaaggccccgtctagaacctcgccaagcacctcagcgaccccttcggcaacaacctcctcaccgtcatctccggcgccgccgagagaacgcccagcctgtgagcaacgctgctgctgctgctgcgtttgattttaccgggaaacagagtgtgcgtgagggtctgaagaatgtgccatgcgtgtaaattatcaagatggggaagaaaccatttcgttct

SEQ ID NO: 23305 - protein, 253 aa, Panicum virgatum
  misc_feature: Ceres CLONE 1826981
  misc_feature (82)..(246): Pfam Name: Chloroa_b-bind Pfam Description: Chlorophyll A-B binding protein
MAALAPSKILGTQLNFAGSSRYATTAPTAGAQKIVSLFSKKPAQKPKPAAVSSSPDISDELAKWYGPDRRIFLPDGLLDRSEVPEYLTGEVPGDYGYDPFGLGKKPEDFAKYQAYELIHARWAMLGAAGAVIPEACNKFGANCGPEAVWFKTGALLLDGNTLSYFGNSIPINLVVAVIAEVVLVGGAEYYRIINGLDLEDKLHPGGPFDPLGLASDPDQAAILKVKEIKNGRLAMFSMLAFFIQAYVTGEGPV

SEQ ID NO: 23306 - DNA, 1554 bp, Panicum virgatum
  misc_feature: Ceres CLONE 1827002
  misc_feature: Encodes the peptide sequence at SEQ ID NO. 23307
aattcccttcgccgccagccaccgtctacctcccccgcccgctcccttcccctccccctcgcagcccgcgcccgctgagttccaagccctaggcgggcggagcggcctgttcggggacccgccgagcccgcggggggagaggcgggagagcgagattcggcccgatctgcggcgggccgccatggagctggacagcatcgagtgcgtgtcctactccgacggcatggaggacgacgacgacgccgcggccgtctcctccgcgcagctcctgcgccccttcctcaagtccgcctcctccgccggcagcgccgccgccgccgcggccgtcaacgtggtcgtcgtctccgaccgcgccggggccgcggggccgcccggggccggcccgctggtcatatcgccggccacgggcgtgcacgagctgctcgagtgccccgtctgcaccaactccatgtacccgcccatccaccagtgccaaaatggtcatactctatgttccacctgcaaaactcgggtgcacaaccgctgtccaacctgtcgacaggagcttggtgacatcaggtgtctggcattagaaaaagtggctgaatcacttgagctgccctgcaaatactactctcttggttgtccagaggtcttcccatactacagcaaactcaagcatgaatcacaatgcaattttaggccatacaactgcccatatgcaggttctgaatgctcagttgtaggggatattccctttcttgtcactcatctacgggatgatcataaagtggatatgcactctggatgtacatttaatcaccgctatgtcaagtccaacccaagagaggttgaaaatgcaacctggatgctaactgtttttcattgtttcgggcagtacttttgcttgcacttcgaggccttccagcttggaatggcaccagtatacatggctttcctccggtttatgggcgatgaaaatgatgctaggaactacagctatagccttgaggttggggcaaatggaaggaagatgatatgggagggcactccccgcagcattcgagacagtcacaggaaggtcagggacagccatgatggtctgataattcagcgaaacatggctctcttcttctcaggtggagacaggaaagagttgaaactgcgagtcacaggtcgtatctggaaggaacagcagaatcctgactcaggagcctgcattcccaatctattcagctgaatccagtaacaagaatggatccaggtgtatattgatacggcggatgtgcttgtgtgtctctatgatttgtgttttgttattttcgttgtcctgccaagctgccattgcggcctgccctaaattagttagggcatattgttacgatcatgaaaatactgagtgccttctgtaaggtctcatgaatcacatgtttagcatttttctcgatgcattggtgtatcccgtgtcattttgagatgaaggatacagcttctgctgctatgtttgttttgctgtattctgtctggaaataaactgttgaacattaactggtagtatctcataatctttttgtt

SEQ ID NO: 23307 - protein, 345 aa, Panicum virgatum
  misc_feature: Ceres CLONE 1827002
  misc_feature (125)..(324): Pfam Name: Sina Pfam Description: Seven in absentia protein family
MELDSIECVSYSDGMEDDDDAAAVSSAQLLRPFLKSASSAGSAAAAAAVNVVVVSDRAGAAGPPGAGPLVISPATGVHELLECPVCTNSMYPPIHQCQNGHTLCSTCKTRVHNRCPTCRQELGDIRCLALEKVAESLELPCKYYSLGCPEVFPYYSKLKHESQCNFRPYNCPYAGSECSVVGDIPFLVTHLRDDHKVDMHSGCTFNHRYVKSNPREVENATWMLTVFHCFGQYFCLHFEAFQLGMAPVYMAFLRFMGDENDARNYSYSLEVGANGRKMIWEGTPRSIRDSHRKVRDSHDGLIIQRNMALFFSGGDRKELKLRVTGRIWKEQQNPDSGACIPNLFS

SEQ ID NO: 23308 - DNA, 664 bp, Panicum virgatum
  misc_feature: Ceres CLONE 1827008
  misc_feature: Encodes the peptide sequence at SEQ ID NO. 23309
aaacatcctcgcaaacatcttatctcccgaggccagagagttgggattcccctcctccaccgcggccatggctaggaagtgctctagctgtggcaacaatggccacaactcgaggacctgcagcgggcacggcggcagggtcgcggagcacggcggcggggtgaggctgttcggggtgcagctgcacgtggggccgtcgtctcccctgaagaagtgcttcagcatggagtgcctctcgtccgcggcgccgccggcgtacttcgcggccgccctcgccgccagcagctcctcgccgtccgtgtcgccgtcgtcgtcgctcgtctcggtggaggagaacgccgacaaggtgaacaacgggtacctttcggacgggctcatgggcagggcgcaggagaggaagaaaggggttccatggaccgaggatgagcaccagcgattcctggcaggcctggagaagctcgggaggggcgactggcgaggcatctcccggcacttcgtgacgacgcggacgccgacgcaggtggccagccacgcccagaagtacttcctccggcagagcagcctcacgcagaagaagcggaggtccagcctcttcgacgtggtcgagaacgccggcagggcgacgagctcggtgccgccggacgcggagctcccggctctgtcc

SEQ ID NO: 23309 - protein, 198 aa, Panicum virgatum
  misc_feature: Ceres CLONE 1827008
  misc_feature (113)..(160): Pfam Name: Myb_DNA-binding Pfam Description: Myb-like DNA-binding domain
  misc_feature: The sequence is a functional homolog of SEQ ID NO 1072 in the 10/225,066 US patent application
  misc_feature: The sequence is a functional homolog of SEQ ID NO 130 in the 10/412,699 US patent application
  misc_feature: The sequence is a functional homolog of SEQ ID NO 2258 in the 10/374,780 US patent application
  misc_feature: The sequence is a functional homolog of SEQ ID NO 306 in the 11/479,226 US patent application
MARKCSSCGNNGHNSRTCSGHGGRVAEHGGGVRLFGVQLHVGPSSPLKKCFSMECLSSAAPPAYFAAALAASSSSPSVSPSSSLVSVEENADKVNNGYLSDGLMGRAQERKKGVPWTEDEHQRFLAGLEKLGRGDWRGISRHFVTTRTPTQVASHAQKYFLRQSSLTQKKRRSSLFDVVENAGRATSSVPPDAELPAL

SEQ ID NO: 23310 - DNA, 637 bp, Panicum virgatum
  misc_feature: Ceres CLONE 1827014
  misc_feature: Encodes the peptide sequence at SEQ ID NO. 23311
aagaacatcgacgaatccacaggacaccgccagagctcgctctcaaccagcagcagcagccggagctgaggagagcgttgcggtttcagagtgggagggagaaatcaaggagcccgcttcagtctgccgatcaattgcagcttcatcttccccggccgatcagcgatcgccatgggagtgccggtgaggagggagagggacgcggaggcggagctgaacctcccgccggggttccggttccacccgacggacgacgagctggtggagcactacctgtgccggaaggcggcggggcagcgcctcccggtgcccatcatcgcggaggtggacctgtacaagttcgacccctgggacctgccggagcgcgcgctgttcggcacccgggagtggtacttcttcacgcccagggaccgcaagtaccccaaccgctcgcgccccaaccgcgccgccgggaacggctactggaacgccaccggcaccgacaagcccgtcgctccgcgggggcgcacgctggggatcaagaaggcgctcgagttctacgccggcaaggcgccgcgcggggtccagaccgactggatcatgcacgagtacaggcctcgccgacccccgcccccgccgccccggccaagaaggggtc

SEQ ID NO: 23311 - protein, 155 aa, Panicum virgatum
  misc_feature: Ceres CLONE 1827014
  misc_feature (17)..(143): Pfam Name: NAM Pfam Description: No apical meristem (NAM) protein
  misc_feature: The sequence is a functional homolog of SEQ ID NO 853 in the 10/374,780 US patent application
  misc_feature: The sequence is a functional homolog of SEQ ID NO 891 in the 10/374,780 US patent application
  misc_feature: Useful for making plants with altered terpenoid content
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Useful for making plants with modulated water use efficiency
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: The sequence is a functional homolog of SEQ ID NO 890 in the 10/374,780 US patent application
  misc_feature: Useful for making plants with modulated light quality response
  misc_feature: The sequence is a functional homolog of SEQ ID NO 854 in the 10/374,780 US patent application
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: Useful for making plants with altered cell wall content and/or composition
  misc_feature: Useful for making plants with altered lignin content
  misc_feature: Useful for making plants with modulated oxidative stress sensitivity
  misc_feature: The sequence is a functional homolog of SEQ ID NO 851 in the 10/374,780 US patent application
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: Useful for making plants with altered alkaloid content
  misc_feature: The sequence is a functional homolog of SEQ ID NO 1012 in the 11/435,388 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 2592 in the 10/374,780 US patent application
  misc_feature: The sequence is a functional homolog of SEQ ID NO 288 in the 10/225,066 US patent application
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: The sequence is a functional homolog of SEQ ID NO 612 in the 11/435,388 US patent application
  misc_feature: The sequence is a functional homolog of SEQ ID NO 320 in the 10/374,780 US patent application
  misc_feature: The sequence is a functional homolog of SEQ ID NO 850 in the 10/225,066 US patent application
  misc_feature: The sequence is a functional homolog of SEQ ID NO 2472 in the 10/374,780 US patent application
  misc_feature: The sequence is a functional homolog of SEQ ID NO 520 in the 11/435,388 US patent application
  misc_feature: The sequence is a functional homolog of SEQ ID NO 974 in the 10/225,066 US patent application
  misc_feature: The sequence is a functional homolog of SEQ ID NO 852 in the 10/374,780 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 2 in US patent 7230164
  misc_feature: The sequence is a functional homolog of SEQ ID NO 6 in US patent 7230160
  misc_feature: The sequence is a functional homolog of SEQ ID NO 116 in the 10/225,066 US patent application
  misc_feature: The sequence is a functional homolog of SEQ ID NO 2476 in the 10/374,780 US patent application
  misc_feature: The sequence is a functional homolog of SEQ ID NO 88 in the 11/375,241 US patent application
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: Useful for making plants with modulated light quality sensitivity
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 2590 in the 10/374,780 US patent application
  misc_feature: The sequence is a functional homolog of SEQ ID NO 286 in the 10/225,066 US patent application
  misc_feature: Useful for making plants with modulated biomass
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: Useful for biocontainment applications
  misc_feature: The sequence is a functional homolog of SEQ ID NO 328 in the 10/374,780 US patent application
  misc_feature: The sequence is a functional homolog of SEQ ID NO 852 in the 10/225,066 US patent application
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: The sequence is a functional homolog of SEQ ID NO 2168 in the 10/374,780 US patent application
  misc_feature: The sequence is a functional homolog of SEQ ID NO 370 in the 10/666,642 US patent application
  misc_feature: Useful for making plants with modulated nitrogen use efficiency
  misc_feature: The sequence is a functional homolog of SEQ ID NO 1365 in the 11/479,226 US patent application
  misc_feature: The sequence is a functional homolog of SEQ ID NO 2474 in the 10/374,780 US patent application
  misc_feature: The sequence is a functional homolog of SEQ ID NO 744 in the 10/225,066 US patent application
  misc_feature: The sequence is a functional homolog of SEQ ID NO 2416 in the 10/374,780 US patent application
  misc_feature: The sequence is a functional homolog of SEQ ID NO 914 in the 10/225,066 US patent application
  misc_feature: The sequence is a functional homolog of SEQ ID NO 106 in the 10/225,068 US patent application
  misc_feature: The sequence is a functional homolog of SEQ ID NO 2348 in the 10/374,780 US patent application
  misc_feature: The sequence is a functional homolog of SEQ ID NO 340 in the 10/412,699 US patent application
  misc_feature: The sequence is a functional homolog of SEQ ID NO 778 in the 11/479,226 US patent application
  misc_feature: The sequence is a functional homolog of SEQ ID NO 476 in the 10/666,642 US patent application
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: Useful for making plants with altered carbohydrate content
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: The sequence is a functional homolog of SEQ ID NO 492 in the 11/435,388 US patent application
  misc_feature: The sequence is a functional homolog of SEQ ID NO 741 in the 11/479,226 US patent application
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: The sequence is a functional homolog of SEQ ID NO 240 in the 10/225,068 US patent application
  misc_feature: The sequence is a functional homolog of SEQ ID NO 368 in the 10/374,780 US patent application
  misc_feature: The sequence is a functional homolog of SEQ ID NO 854 in the 11/435,388 US patent application
  misc_feature: The sequence is a functional homolog of SEQ ID NO 108 in the 10/666,642 US patent application
  misc_feature: The sequence is a functional homolog of SEQ ID NO 332 in the 10/412,699 US patent application
  misc_feature: The sequence is a functional homolog of SEQ ID NO 344 in the 10/666,642 US patent application
  misc_feature: The sequence is a functional homolog of SEQ ID NO 582 in the 10/666,642 US patent application
  misc_feature: The sequence is a functional homolog of SEQ ID NO 310 in the 10/666,642 US patent application
  misc_feature: The sequence is a functional homolog of SEQ ID NO 886 in the 10/412,699 US patent application
  misc_feature: The sequence is a functional homolog of SEQ ID NO 1816 in the 11/479,226 US patent application
  misc_feature: The sequence is a functional homolog of SEQ ID NO 2112 in the 10/374,780 US patent application
  misc_feature: The sequence is a functional homolog of SEQ ID NO 142 in the 10/286,264 US patent application
  misc_feature: The sequence is a functional homolog of SEQ ID NO 324 in the 10/412,699 US patent application
  misc_feature: The sequence is a functional homolog of SEQ ID NO 756 in the 11/479,226 US patent application
MGVPVRRERDAEAELNLPPGFRFHPTDDELVEHYLCRKAAGQRLPVPIIAEVDLYKFDPWDLPERALFGTREWYFFTPRDRKYPNRSRPNRAAGNGYWNATGTDKPVAPRGRTLGIKKALEFYAGKAPRGVQTDWIMHEYRPRRPPPPPPRPRRG

SEQ ID NO: 23312 - DNA, 625 bp, Panicum virgatum
  misc_feature: Ceres CLONE 1827027
  misc_feature: Encodes the peptide sequence at SEQ ID NO. 23313
acgagattcctcgcgcgagcgcgagaggagcatgggatcggaggggcggggctggaacggcgcggccgccggaaccggcgccggcgacggcgccaggggcgggaaggagaaaccgaccaccaccgcggcggtggccgcaggggcgccggcggacgtgcccacgtcggcggcctccgtcgacatctcgctgccgctcccggagatgacgcctcacatcataggtctctgcaagggatcggtcaaagggtggtcgtcgctggacagctcgtgcttctccatcgagacggtgtctagcggcatcacgaatctattgctgaaggtatctgtaaaagaagatactggaaatgagttttctgtgactgttcgtttgtatggaccaaatacagacttggtgattgatcggaaaagggaattgcaggcgataccatatctctcagctgcagggttcggggctcgactacttggaatttttgagaatggagtagttcagtcattcatcaatgctcgaacactgtcacctgcagacatgagagaacttagaatagcagctgagattgccaaggagctccacagattccatcaagtagacattccagggtgtaaagaaccacaactgtggaatgat

SEQ ID NO: 23313 - protein, 197 aa, Panicum virgatum
  misc_feature: Ceres CLONE 1827027
  misc_feature (105)..(197): Pfam Name: Choline_kinase Pfam Description: Choline/ethanolamine kinase
  misc_feature: SWISSPROT Homolog: EC 2.7.1.32 Choline kinase
MGSEGRGWNGAAAGTGAGDGARGGKEKPTTTAAVAAGAPADVPTSAASVDISLPLPEMTPHIIGLCKGSVKGWSSLDSSCFSIETVSSGITNLLLKVSVKEDTGNEFSVTVRLYGPNTDLVIDRKRELQAIPYLSAAGFGARLLGIFENGVVQSFINARTLSPADMRELRIAAEIAKELHRFHQVDIPGCKEPQLWN

SEQ ID NO: 23314 - DNA, 1781 bp, Panicum virgatum
  misc_feature: Ceres CLONE 1827039
  misc_feature: Encodes the peptide sequence at SEQ ID NO. 23315
aacctccctctctcggctctccccatcgcgcgccttgtcagtttctcgccgcagccgccaccgccgccgccgcgggttcgcctcctgctcctccggaccccaccgccgctggagcttccgaagctccgccgcagccattggaaccgccccccggccccctccatgcgcgcgtcccggtagatcctccaccacccacgccgtcgcgcgagcacccggcgcaaaggctagccggcggcacccgatggcgtccgtggcggagctcaaggagaagcacgccgcggcgacggcgtcggtcaactccctgcgcgagcgcctccgccagcgccgggagatgctcctcgacaccgacgtagcgaggtactccaaggcgcaggggagggcgccggtgagcttcaacccgacggatctggtctgctgccgcacgctgcagggccacagcggaaaggtatattctctggactggactcctgaaaagaattggatagtcagtgcatcacaagatggaaggctaattgtatggaatgcattaacaagccagaaaacacatgccataaagctgcattgcccatgggtgatgacgtgtgcttttgcacccaatggccagtcagttgcctgtggtggtctagatagtgcatgctctattttcaatcttaactcgcaagcagacagagatgggaacatgcctgtatctagaattcttactggacacaagggctatgtatcatcatgccaatatgtcccagatcaggaaactcgccttattacaagctcaggcgatcagacatgtgttctgtgggatgttactactggccagaggatatcaatatttggaggtgaatttccatcagggcatacagctgatgttctaagtgtatccatcaactcatcaaatacaaatatgtttgtctctggctcatgtgatgcaactgtgaggctgtgggatataagaattgcaagtcgggctgttcgaacctatcatggacatgagggtgacgttaacagtgtgaagtttttccctgatggccataggtttggtactggctcagatgatggcacatgtagatcatttgacatgagaacagggcatcaacttcaggtttacagtagggagcctgctagaaatgataatgaactacctactgttacatctatagcattttcgatatcaggaaggctactttttgctgggtactccaatggtgactgttacgtgtgggacacacttcttgccgaggtggtacttaatttgggaaacctccagaactcccatgattgtcggataagttgccttggaatgtcatctgatggcagtgcattgtgtacaggaagttgggacaaaaatttgaagatttgggcctttagtggacaccggaaaatagtttgaagccacatttcttcaacatgttgtatgtttcgttatcgcaccttacgaatggtgatctttgatcgacttgacttgttccaggggatcgatttgttgtttttgtagtatagcatcttgtgtaatatgccaagtttcaatgggaaaaaaggagcaatttctcggcaagacatcatgtgctgtatcttgttgagttagtgtctgttgatactgttattaccagaatatcagcaacgtgtgacctaccctttctttgtacaacctttttctcgtttcgagttggagaagtagcatgtatattccgaaaccaatctatcagtttgatcttttgccaaatttggaacactagcttcctgtgacgatttccacgtttagtaatgttgtattcttaccaggtacc

SEQ ID NO: 23315 - protein, 380 aa, Panicum virgatum
  misc_feature: Ceres CLONE 1827039
  misc_feature (56)..(94): Pfam Name: WD40 Pfam Description: WD domain, G-beta repeat
  misc_feature (239)..(277): Pfam Name: WD40 Pfam Description: WD domain, G-beta repeat
  misc_feature (147)..(186): Pfam Name: WD40 Pfam Description: WD domain, G-beta repeat
  misc_feature (194)..(234): Pfam Name: WD40 Pfam Description: WD domain, G-beta repeat
  misc_feature: SWISSPROT Homolog: EC 2.3.1.48 Histone acetyltransferase
MASVAELKEKHAAATASVNSLRERLRQRREMLLDTDVARYSKAQGRAPVSFNPTDLVCCRTLQGHSGKVYSLDWTPEKNWIVSASQDGRLIVWNALTSQKTHAIKLHCPWVMTCAFAPNGQSVACGGLDSACSIFNLNSQADRDGNMPVSRILTGHKGYVSSCQYVPDQETRLITSSGDQTCVLWDVTTGQRISIFGGEFPSGHTADVLSVSINSSNTNMFVSGSCDATVRLWDIRIASRAVRTYHGHEGDVNSVKFFPDGHRFGTGSDDGTCRSFDMRTGHQLQVYSREPARNDNELPTVTSIAFSISGRLLFAGYSNGDCYVWDTLLAEVVLNLGNLQNSHDCRISCLGMSSDGSALCTGSWDKNLKIWAFSGHRKIV

SEQ ID NO: 23316 - DNA, 1460 bp, Panicum virgatum
  misc_feature: Ceres CLONE 1827041
  misc_feature: Encodes the peptide sequence at SEQ ID NO. 23317
attcgcatgcggcacctgctggaagaaggaatagtggctattttacgcatgagaggttggataggagagccgccggaaacagccaagcagctgtgggggacaaaaatccagtgcaaatcatcgtcgcaggctcggagcgatctgagattctttacagtcgttggtgttgccttttggctgttgctgttctgtgtactaggatgttgctcgatgctcataactttgggtgggtggtttcttgcttggagtgaatgaaaatgttcctgtgctgtgatctgcaggtgagagcctgcacacgccgtacctgagcccctacctcaaggcgctgggcgcggacttccggaacggcgtcaacttcgccgtcggcggctccacggcgtcgccgggcgggtctcccttctcgctggacgtgcagctccaccagtggctctacttcagggccagatccatggagatgatcgacctaggccagaagccccccatcgaccgcgacgggttcagacgggccatctacaccatcgacatcggccagaacgacctctctgcttacatgcacctgcccttcgaccaagtgctcgccaagatcccctccgtcgtcgcccagatcaagtacaccatcgagaccctgtacgcgcacggcggccgcaagttctggatccacggcacgggcgcgctgggctgcctgccgcagaagctggcgatcccgcgggccgacgacgccggcctggacgcccacggctgcctcacggcctacaacgccgcggcgcggcggttcaacgcgctgctggcgggcgcctgcacggagctccggcgccggatggtggacgccgcgctcgtcttcgtcgacgtgtacgccgccaagtacgacctggtggccggccacgccgcgcacggcatcgcccggcccctcatggcgtgctgcggccacggcggcccgccctacaactaccaccacttcaaggcctgcatgtcggcggagatgcagctgtgcgacgtcggcgcgcgcttcgccagctgggacggcgtccacttcaccgaggccgccaacgccatcgtcgccgccaaggtgctctccggcgacctctccacgcccaggggggtcaccatcgccagcctcgtcaacgccacgctcgtcgtggccaacaacaacgatggctaggctctcgctcgtgcggtttcttgctgcccatggggggaagtgatgatggtagaaaggaatctagccaagatatgatgattgcagcgagttcgtggagatcgatccgagctggttcgccgctcgtcaggatcgagctggttcaacaaaggagcgagcaattatgtgacaccattgattattgactagaattctgcaaatgaaagggtggcccaacctagtggttttgtggggattattggcctccagtttgagacttaatttgtactacatcaaacatgataacatacacatgcatgtgtgt

SEQ ID NO: 23317 - protein, 236 aa, Panicum virgatum
  misc_feature: Ceres CLONE 1827041
  misc_feature (1)..(207): Pfam Name: Lipase_GDSL Pfam Description: GDSL-like Lipase/Acylhydrolase
  misc_feature: SWISSPROT Homolog: EC 3.2.1.51 Alpha-L-fucosidase
MEMIDLGQKPPIDRDGFRRAIYTIDIGQNDLSAYMHLPFDQVLAKIPSVVAQIKYTIETLYAHGGRKFWIHGTGALGCLPQKLAIPRADDAGLDAHGCLTAYNAAARRFNALLAGACTELRRRMVDAALVFVDVYAAKYDLVAGHAAHGIARPLMACCGHGGPPYNYHHFKACMSAEMQLCDVGARFASWDGVHFTEAANAIVAAKVLSGDLSTPRGVTIASLVNATLVVANNNDG

SEQ ID NO: 23318 - DNA, 1318 bp, Panicum virgatum
  misc_feature: Ceres CLONE 1827061
  misc_feature: Encodes the peptide sequence at SEQ ID NO. 23319
gatcctgctctgacggatgaagctctcctcaccggcatcgcgcctcgccgagagctccgagatcctcctcctcccgccgcaccgccagcagcgccgcggcggcatcgtcgtggcgcggatgttgccctcccactgcgacgacggcagcggcgcgctgccctacgcggcggcgggacggcgggcggcggcgctgctcgaccaccggcggtaccggcccaacgtcgaggtgccgcccagctgcccgcgctgcgactcgcccaacaccaagttctgctactacaacaactacagcctcagccagccgcgctacttctgcaagggctgccgacgctactggaccaagggtggctccctccgcaacgtgcccgtcggcggcgggtgccggaagaaccgccgcggcaagccggtgcgcgccgggcccgtcgccggcgcggtcgcgcccggtagcgctggtgccgcggcggcggcgttcgcgcaccggtcgtctttccacggcacgctgcggccggatctgctcctggaaggcatggtcggcagcccggccggcggcctcttccagcctatggacgccgccgacaagccggccgcggtccaggggtccacgatcgacttggcgttgctgtacgccaagttcttgaaccatcagccggcggcggtcgagcagtgcgccgccatcctgccggaatcgctcgacaccttgagtggctcatcgagtgacacgagccccaacgtcccgccgccggatcaccatcccttccggcgagcgcaagacgagttcggcgagctttccgcgccggcgagcgcggatcccagagcagccgcgcagcagtgccccgacgcgcgcacggaggtgcttggggagctcagcttcagcgtggagcagagctgcttcgactcgctcgggttgccgacggacgacggcgatctgatcctgccgtcgacgtggcacccggaggccaagtacgagccgttcgatccgctgcccgaggacgccatgagcctccaaggcggcagctccggcggggatgatgtgtggagcagtgcgttggcctgccaaggactggaagcagctctctgcaggccgtaattttaaaactcatcatctttttatggttactaccgtgcttgagattgtttttatgcattcttgtttttttttcaggttttgatcacgttcaggagtaatttatatagataatatatatacatgtccagatcatgcatattaagggaagaagggtatacatgtgagatagaattgtaataaaaaaattcgatactttgtttggtattgctgaacagatcgttgttccattcc

SEQ ID NO: 23319 - protein, 322 aa, Panicum virgatum
  misc_feature: Ceres CLONE 1827061
  misc_feature (34)..(96): Pfam Name: zf-Dof Pfam Description: Dof domain, zinc finger
  misc_feature: The sequence is a functional homolog of SEQ ID NO 1967 in the 11/479,226 US patent application
MLPSHCDDGSGALPYAAAGRRAAALLDHRRYRPNVEVPPSCPRCDSPNTKFCYYNNYSLSQPRYFCKGCRRYWTKGGSLRNVPVGGGCRKNRRGKPVRAGPVAGAVAPGSAGAAAAAFAHRSSFHGTLRPDLLLEGMVGSPAGGLFQPMDAADKPAAVQGSTIDLALLYAKFLNHQPAAVEQCAAILPESLDTLSGSSSDTSPNVPPPDHHPFRRAQDEFGELSAPASADPRAAAQQCPDARTEVLGELSFSVEQSCFDSLGLPTDDGDLILPSTWHPEAKYEPFDPLPEDAMSLQGGSSGGDDVWSSALACQGLEAALCRP

SEQ ID NO: 23320 - DNA, 685 bp, Panicum virgatum
  misc_feature: Ceres CLONE 1827067
  misc_feature: Encodes the peptide sequence at SEQ ID NO. 23321
gcaaaaggagttcaagggcatccattgctttagtgattggaatcccaactatatcaatattcacaactctaattgttggcatttattgtattaagaagcggaaaaggagtttgatggataaagaactcagagctcttgacctgcaaattggctccttcactttgcgtcaaatcaaagcggcaactaggaacttcgatgcagctaacaagattggtgaaggtggctttggttcagtttacaagggtttattatccgatggcaccatcatcgctgtcaagcagttatcatcaaggtctaaacaagggaaccgggaatttgtgaatgagataggcatggtatctgcactccagcatcctaaccttgtcaaactttatggctgttgtacagaaggaaaccagctgtcactggtttatgagtatatggaaaacaattgccttgcacgagctcttttcgttgaacaatacagactgagactggattggccaacaagatacaagatttgccttgggatagcaagaggtctagcatatctgcatgaggaatccgcaataaggattgtgcaccgagatatcaaggccagcaatatactgcttgacaaagatttgaatgctaagatttcagattttgggctagcaaagcttaatgaagacgatcacacccacataagcacaaaagtagctggaac

SEQ ID NO: 23321 - protein, 227 aa, Panicum virgatum
  misc_feature: Ceres CLONE 1827067
  misc_feature (64)..(226): Pfam Name: Pkinase_Tyr Pfam Description: Protein tyrosine kinase
  misc_feature: SWISSPROT Homolog: EC 2.7.11.1 Non-specific serine/threonine protein kinase
  misc_feature: Useful for making plants with altered cell wall content and/or composition
KRSSRASIALVIGIPTISIFTTLIVGIYCIKKRKRSLMDKELRALDLQIGSFTLRQIKAATRNFDAANKIGEGGFGSVYKGLLSDGTIIAVKQLSSRSKQGNREFVNEIGMVSALQHPNLVKLYGCCTEGNQLSLVYEYMENNCLARALFVEQYRLRLDWPTRYKICLGIARGLAYLHEESAIRIVHRDIKASNILLDKDLNAKISDFGLAKLNEDDHTHISTKVAG

SEQ ID NO: 23322 - DNA, 1620 bp, Panicum virgatum
  misc_feature: Ceres CLONE 1827068
  misc_feature: Encodes the peptide sequence at SEQ ID NO. 23323
gaggaggattggaggaagaggaagcggaagaggaggaagagaaggagcgtggcggcgcgatggctcccgatccggaggcggcggctggcgggcaggcggagccgcccgacgaggaggaggacgaccccgacgtcgacgaggtcgaccccaccggccgctacctccggtacaaggagatcgtgggatcaggtgccttcaagacagtctacaaaggcttcgacgcggtggacggcatcgaggtggcgtgggccaaagtggagataaccagccggatcatgggatccccgaaggagctgcagcggctcaagacggagatccagctgctgcggtctctccagcacaagcacatccttaagctctatgcctcgtgggtcgacaacaagaagaggaccgtcaacatcatcactgagctcttcacctccggcaacttgaggcagtaccgtacaaagcacaaaaaagttgacatcaaggcaatgcggcgatgggcgaaacaaatattgacagggctagcttatctgcacgatcagaagccaccaatcatacacagggacttgaagtgtgacaacattttcatcaatggaaaccatggaaaagtaaagattggggatttcggtttggcaatggtcatgcaacagaggaagacacagagtatacaaggcaccttagaattcatggcaccagagctctttggtgaaaactacaatgagttggtggatatatattcttttgggatgtgtatgcttgaaatggtgactggtgagtgcccttacagtgaatgtcagggctttcttcagatatacaagaagatttctgaaggtgtaaaaccaatttctctctccaagatcaaagatgcagaagtaagaagtttcatagagggctgtctgggttcagcagctgacagattaccagcaagtgagctcttgaagagcccttttatcctgaaagatgacatcatcaatgataaaacctttaatccagcacaagaaccgatagcgtttccacaaaatttggatctagatctcgatgccacaccaattttcgtctctttgttatccaatggaactcctggtgatgggaaggagtctatcagcctggtgcttcggaggggtgtttttgtgctggaaggagatatgaggatcaacgaccccgtcaagttgttactaagaattcctgtccccaatggtaagtgtaagaacattgagctcgcatttgacctggagaaggacacgagtctttcaatggctactgagatggtcgaagagcttgaactgccttcttggagcatgcatgctgtggcgaagctgatcgatgcattcttgctcaagacggtgcgcggctggaggccctgcgttcaggtcggccagatgattcaggcagtgctcaacactgcatcagcagatggaacgtgaaattgtgaatccaaatctctcggtgtttttctgaatccaaagcactggttcaatgctcatggtcatccattctgcccctcttgtacatgctcaaatcgcaatgccatgaacggtgttgctaagcacatcttttttttatttgatgatggctaaagattgtgcatgcatgattactaatttctctagattagttcttgtagtatttcatatt

SEQ ID NO: 23323 - protein, 449 aa, Panicum virgatum
  misc_feature: Ceres CLONE 1827068
  misc_feature (35)..(293): Pfam Name: Pkinase Pfam Description: Protein kinase domain
  misc_feature: SWISSPROT Homolog: EC 2.7.11.1 Non-specific serine/threonine protein kinase
MAPDPEAAAGGQAEPPDEEEDDPDVDEVDPTGRYLRYKEIVGSGAFKTVYKGFDAVDGIEVAWAKVEITSRIMGSPKELQRLKTEIQLLRSLQHKHILKLYASWVDNKKRTVNIITELFTSGNLRQYRTKHKKVDIKAMRRWAKQILTGLAYLHDQKPPIIHRDLKCDNIFINGNHGKVKIGDFGLAMVMQQRKTQSIQGTLEFMAPELFGENYNELVDIYSFGMCMLEMVTGECPYSECQGFLQIYKKISEGVKPISLSKIKDAEVRSFIEGCLGSAADRLPASELLKSPFILKDDIINDKTFNPAQEPIAFPQNLDLDLDATPIFVSLLSNGTPGDGKESISLVLRRGVFVLEGDMRINDPVKLLLRIPVPNGKCKNIELAFDLEKDTSLSMATEMVEELELPSWSMHAVAKLIDAFLLKTVRGWRPCVQVGQMIQAVLNTASADGT

SEQ ID NO: 23324 - DNA, 1125 bp, Panicum virgatum
  misc_feature: Ceres CLONE 1827092
  misc_feature: Encodes the peptide sequence at SEQ ID NO. 23325
attcctctgcccctcccaccggcggcgagcgtagcggaggccgggtcgcgagaggagagagatgacggtggcggcggggctggggtacgcgctcatcgcgctgggccccgccctctccctcttcgccggcgtagtcgccaggaagcccttcctcgtccttaccctcctctccagcaccttgttttggcttataagtttgatagtcctctcgggaatatggaggggatttcttcctataaaatctggaacttggtgggcatatgcaattctgatcattacatctgttgccttgcaagaaggcactcgtcttgtgttttggaggctttacaagaaaatggaagagatgctagatgcctttgctgatagaatttctaagccacgtcttagtttgacagacaagatgctaatttctttagctggtggtttaggtcatggagtagctcatgcagtctttttctgcctcagccttctgactccagcattcggtcaagccacattttatgttgaaaggtgttcaaagatgccttttttccttgcgtcagcccttattgcacttggattcttggtcatccatacattctcaatgatcattgcttttaatgcatacgatgaaagaaagaaaagtgaccaaatctttgtcccagttgttcacttgactgctgctgtaatgacacttgttaacctcgccccagggggttgcctcatcggcactcctctgttgttggtcacggctgcgctgaccttgcagtactgctggcgagtggcatgccggaggctaactgagcatcagcatcggcagctgaacaacaactagctcttgccagtgttcctcgcatcatgtaatttccccatgtgtgtttgtcttaagcttctcatgcgtacaacagagaaaactcaaaggctgacaggctgtgagtggtgtcgtgtagttactcagaggctgacaagagggtttaccagagttgcgctcagttaaagatgctatcttctgtttgtactacgctctaatctcgtcctgaactccagatgtcttctgagccggtgaaaatgctgcacttttcataaattgtctgacacttgtccatcactgtttgatcatcaacatgacacactgaatactgcttt

SEQ ID NO: 23325 - protein, 250 aa, Panicum virgatum
  misc_feature: Ceres CLONE 1827092
  misc_feature (1)..(246): Pfam Name: Aph-1 Pfam Description: Aph-1 protein
MTVAAGLGYALIALGPALSLFAGVVARKPFLVLTLLSSTLFWLISLIVLSGIWRGFLPIKSGTWWAYAILIITSVALQEGTRLVFWRLYKKMEEMLDAFADRISKPRLSLTDKMLISLAGGLGHGVAHAVFFCLSLLTPAFGQATFYVERCSKMPFFLASALIALGFLVIHTFSMIIAFNAYDERKKSDQIFVPVVHLTAAVMTLVNLAPGGCLIGTPLLLVTAALTLQYCWRVACRRLTEHQHRQLNNN

SEQ ID NO: 23326 - DNA, 560 bp, Panicum virgatum
  misc_feature: Ceres CLONE 1827133
  misc_feature: Encodes the peptide sequence at SEQ ID NO. 23327
acttcagatccaagtggatagcgcccaccaagatctcatgtgcgtgcaccggagggagcagcggggatctgttgcccgcgcgcgatcggtcgatcgcatgaggagctgcggcgcgcctccagtctcgccggcgacgaaccacgaggaggacaaggagggcggccggacaaggcagggagcgagcgaagctaattctcactaactagcttgtcaccgtgaagatgctcgttccgctgccttcgcgggctcggagcctgcgggcggccggagagagagcggcgaccagtcgcgggcgaggagggagaagaggggggtgcggcggatgcggagcgcgacagagcggctgcggtcgctgtcaccggaggacctgtcgcggacgctggcctcctgggggctgctcggcttcaccctggcggagctccggtccgcgacgcgcgacttgtccagcagccacttaatcggcgagggcgggttcggccccgtgtacaacggcttcctacacgagcggctccggcccggggagctcgcgcagcatcacttcgccgtaaagtacctcgaca

SEQ ID NO: 23327 - protein, 79 aa, Panicum virgatum
  misc_feature: Ceres CLONE 1827133
  misc_feature: SWISSPROT Homolog: EC 2.7.11.1 Non-specific serine/threonine protein kinase
MRSATERLRSLSPEDLSRTLASWGLLGFTLAELRSATRDLSSSHLIGEGGFGPVYNGFLHERLRPGELAQHHFAVKYLD

SEQ ID NO: 23328 - DNA, 640 bp, Panicum virgatum
  misc_feature: Ceres CLONE 1827148
  misc_feature: Encodes the peptide sequence at SEQ ID NO. 23329
tagcagcagggacagccaggtagctgtgaaccgcataattggggccaaatggtccacctgttccggccaagcttgcatcgccatcgactacatgctggtcgaggagaaattcgcgcccactctgatcgagctgctcaagtcgaccctgaagaggttcttcaccaagccggagtacatggctcgcatcctgaacgagaagcacttcaacaggctgagcaacctcctggcggaccgcagggtggcggcctccgtggtgcacggcgggcactgcaaccccaaggcgctgagcatcgagcccacgctgctgctgaaccctccgctcgactccgacatcatgacggaggagatcttcggcccgctgctcccgatcatcacggtcaagaagatcgaagacagcatcatgttcctgaaatcgaagccgaagccgctggcgatctacgccttcacccggaacgagaagctgaagcgccggatcatcgaggagacgtcgtccgggagcgtcacgttcaacgatgccatcgtgcagtacggcctggacaccatcccgttcggcggcatcgggcacagcgggttcgggcagtaccacggcaagtactcgttcgagatgttcagccacaagaaggcggtgctcaagaggagc

SEQ ID NO: 23329 - protein, 212 aa, Panicum virgatum
  misc_feature: Ceres CLONE 1827148
  misc_feature: SWISSPROT Homolog: EC 1.2.1.3 Aldehyde dehydrogenase (NAD(+))
SSRDSQVAVNRIIGAKWSTCSGQACIAIDYMLVEEKFAPTLIELLKSTLKRFFTKPEYMARILNEKHFNRLSNLLADRRVAASVVHGGHCNPKALSIEPTLLLNPPLDSDIMTEEIFGPLLPIITVKKIEDSIMFLKSKPKPLAIYAFTRNEKLKRRIIEETSSGSVTFNDAIVQYGLDTIPFGGIGHSGFGQYHGKYSFEMFSHKKAVLKR

SEQ ID NO: 23330 - DNA, 1777 bp, Panicum virgatum
  misc_feature: Ceres CLONE 1827175
  misc_feature: Encodes the peptide sequence at SEQ ID NO. 23331
agactccagagcacaacatcaacgaccaaaccaaaggccggttagttttaaaaaaaaaaacaaaggtcaatttcatgtctgaagaatatatatgttcaccttagtctgagcaagaaggaagcagcagcggcagctccctccaatggcttcccagctgcccgcctccctcgcggcaacagcgggcctgtgcttgctctcggtgctcgccgcggccgtgctggcggtggccctctacatcctccgcgtcgtcgcgtccttcgccgccttctgcttcagggaatacgcctggcgagaccgggaccgaccgccgctcatcgggacggtgttccggcagctcagcaacttcgacaggctgttcgacgagcatgtcaggtacgcgctggagcaccgcaccagcaggctggtctaccctggccacagcgagatctgcaccgccgacccggccgtcgtcgagcatgtcctcaagaccagcttcagtaaatacagcaggggggccttcaattatggcgtcatgaaggatctgttcggggatgggattttcgcaacagatggggagaactggaagcaccagaggaagcttgcaagccacgagttctcaaccaaagtgctccgcgaattcagcagtgttgtgttcagaacaaatgctactaagctggcagatacaatatcctctgcagcaactagtggaaatattataaacatgcaggaccttttgatgaaagcaactatggattctatcttcaaagtgggattcggtttcgagctgaacacactatctggatcagatgaatcaagcattcagtttagcaatgcatttgatgaggcaaactctcttgtttatcaccgatatgttgatctattctggcagctgaaaaggtatttcaatatcggatcagaagccaaacttaagaggaatattcagataattgatgacttcgtgatgaagctgatccatcaaaagagaaagcaaatgaatggacaagataatagagcaagagaggacatactatcaagattcataatagagagcaacaaggaccctcagacaatgaatgatcgttacctgcgtgacatagtactaaacttcctgatcgctgggaaagacacgactgcgaacactctcacatggttcttctacatgctttgcaagaatcctatagtgcaggataaagttgcccttgaaatcaaggagtcagttgagtgggacaaggaagataacaacacagagcgtttcacagaaaaattgaacgaaggcgctattgacaaaatgcactacctccatgctgcgatctccgagacactacggctgtatccagctgttccagtggatagtaagatggcagatgaagatgatgtactacctaatggttatagagtgataaaaggagatggaatgaattacatgacttatgcaatgggaaggatgacatacctctggggtgaagatgctgaagatttcaggcctgaaagatggcttgtgaatggagtcttccagcaagagagtccttacaagtttgtatccttcaatgcggggccccgtatttgcttggggaaggagtttgcatataggcaaatgaagatcatggctgccaccctgatacacttcttcaggttcaaacaggcagatgagtccaaggatgctacatacaaaacaatgtttaccctccacatggataaaggcctccatttgtatgcctacccacgttcaacttgaactgccaaacaaactattgtatcacttgttactgttgcaaaaaaagtgtactacttatttgac

SEQ ID NO: 23331 - protein, 523 aa, Panicum virgatum
  misc_feature: Ceres CLONE 1827175
  misc_feature (55)..(517): Pfam Name: p450 Pfam Description: Cytochrome P450
  misc_feature: SWISSPROT Homolog: EC 1.14.14.1 Unspecific monooxygenase
MASQLPASLAATAGLCLLSVLAAAVLAVALYILRVVASFAAFCFREYAWRDRDRPPLIGTVFRQLSNFDRLFDEHVRYALEHRTSRLVYPGHSEICTADPAVVEHVLKTSFSKYSRGAFNYGVMKDLFGDGIFATDGENWKHQRKLASHEFSTKVLREFSSVVFRTNATKLADTISSAATSGNIINMQDLLMKATMDSIFKVGFGFELNTLSGSDESSIQFSNAFDEANSLVYHRYVDLFWQLKRYFNIGSEAKLKRNIQIIDDFVMKLIHQKRKQMNGQDNRAREDILSRFIIESNKDPQTMNDRYLRDIVLNFLIAGKDTTANTLTWFFYMLCKNPIVQDKVALEIKESVEWDKEDNNTERFTEKLNEGAIDKMHYLHAAISETLRLYPAVPVDSKMADEDDVLPNGYRVIKGDGMNYMTYAMGRMTYLWGEDAEDFRPERWLVNGVFQQESPYKFVSFNAGPRICLGKEFAYRQMKIMAATLIHFFRFKQADESKDATYKTMFTLHMDKGLHLYAYPRST

SEQ ID NO: 23332 - DNA, 1726 bp, Panicum virgatum
  misc_feature: Ceres CLONE 1827179
  misc_feature: Encodes the peptide sequence at SEQ ID NO. 23333
agcggccttgccgagcagatacgaaaagaagcggaggggtttgctgaaaaagccccgccgccccccgcgtcgcgaggtgggagacgacactagccgagccgagcgccccaaacccaaaccccagaacctccgacctagggttccgccgccatgggatccgccgcctccgctgctgtgccgccgccgcctccccccgcgcaggcccacgcgggcgcgccgccgtatgggcccgggctcgccgggatcctcccgccgaggccggatggggaggagaaggaggagaaggtggactacctcaacctcccctgccccgtgcccttcgaggagatccagcgcgaggccctcatgtctttgaaacctgaactttttgaaggactgaggtttgactttacaaaagggttgaatcaaaagttttctcttagccacagtgttttcatgggctccttagaagttccagcccaatcatctgaaactattaaagttccaactgcacattatgagtttggtgccaactttttagatccaaagttaatgctcattgggcgtgttatgactgatgggaggctcaatgctcgtgtcaaatgtgatttgacagaaaatcttacgctgaaagtaaatgcacagcttacccaagaggcgcattactcccaagggatgtttaactttgactacaagggaagtgactatcaaactcaattccaaattggaaacaatgcattctatggtgcaaattatatccagagtgttactcccaacctatcattgggaactgaaatattctggcttggtcaccagaggaaatctggaattggttttgcctctcgctataatacggataaaatggtgggtactctacaagttgcaagcactggaatagttgctttaagttatgtccagaaagtttctgagaaggtttccctcgcatctgacttcatgtataaccacatgtcgaaagatgtaactgccagctttggttatgattacttgcttaggcagtgccgtctgagaggcaaaatcgactcgaatggtgttgttgctgcatacttggaggagagattgaacatgggtgtcaacttccttctttctgctgagattgaccattgtaagaagaattacaagtttggtttcggaatgacagtaggcgagtaaccatgctaaaacaatgcctgtgggtgcacctgagatgcctacacagttggttttgcatggatgttccaacacttcaggcctcagttttgagtgagcaggttcttgcccttgtgccctgggaaaatacaggagcaatcacttgctactttacagagtttctctttctgtgtattggtggttatgaattttgaactgcttgatgatgtgagcatggggggccatgattctttgttcatcttggatggaactagtgcgggaataatgttgtattggctgagtgattttttacaattttacctttaagtcaccaccagcccttcactctaggcctgtcatgtaccttcaccttacgtgagccacagaagattttatggtccgaagcatctgaccattcgccatgtttagagtcctcgtgcttttcttcatcgatactgaatcagagtaattagtataagcatgttttataatcatgctaatggcaccatgatcttcttttattcgttcagtaccataggaagttctgttcctgtggcctgaaagatgtggaagtaaattgccgctcctgcttgtcagttgg

SEQ ID NO: 23333 - protein, 332 aa, Panicum virgatum
  misc_feature: Ceres CLONE 1827179
  misc_feature (53)..(325): Pfam Name: Porin_3 Pfam Description: Eukaryotic porin
MGSAASAAVPPPPPPAQAHAGAPPYGPGLAGILPPRPDGEEKEEKVDYLNLPCPVPFEEIQREALMSLKPELFEGLRFDFTKGLNQKFSLSHSVFMGSLEVPAQSSETIKVPTAHYEFGANFLDPKLMLIGRVMTDGRLNARVKCDLTENLTLKVNAQLTQEAHYSQGMFNFDYKGSDYQTQFQIGNNAFYGANYIQSVTPNLSLGTEIFWLGHQRKSGIGFASRYNTDKMVGTLQVASTGIVALSYVQKVSEKVSLASDFMYNHMSKDVTASFGYDYLLRQCRLRGKIDSNGVVAAYLEERLNMGVNFLLSAEIDHCKKNYKFGFGMTVGE

SEQ ID NO: 23334 - DNA, 690 bp, Panicum virgatum
  misc_feature: Ceres CLONE 1827189
  misc_feature: Encodes the peptide sequence at SEQ ID NO. 23335
agccggttgcttgcaccaattagggatggaaaaccatgtcgacgagatcgacatcgacgatgagctccgtggacgccaccggcggcgagaagaagacgtcgtggccggaggtggtgggcctgccggcggaggaggccaagaagatcatcctcaaggacatgcccgacgccgacgtcgtcgtcctgcccgccggctcgccggtgaccatggactggaggtccaaccgcgtccgcgtcttcgtcgacaccgtcgctcagaccccgacggtgggctgaatgataaacgtaccgcctgcatgctggatcaaagctgctagctagcgcctacacccttgatgttccttcctgattgcccttactggtttagcttttagctagtacactagaaaagggaagatctagagatcaaataattgaagctcatcaaatagtatggggaatggagctagctgctgtctagaataaaactgatggaatgcatgaataaacaatgtattactgcagtacttcacattatgtgtccgtattcagggggctaacaatgtatatattcttatgtttgcagagaagcgccttgggcttcaaccagcatgcactgctgcctgaagggcaaacaatctagttgtacagctaacagttgctaggtttgcgctcacgttttttctctactaaaaaccttataaaagggccc

SEQ ID NO: 23335 - protein, 71 aa, Panicum virgatum; identical to SEQ ID NO: 19463
  misc_feature: Ceres CLONE 1827189
  misc_feature (12)..(71): Pfam Name: potato_inhibit Pfam Description: Potato inhibitor I family

SEQ ID NO: 23336 - DNA, 617 bp, Panicum virgatum
  misc_feature: Ceres CLONE 1827201
  misc_feature: Encodes the peptide sequence at SEQ ID NO. 23337
ctacctacctacctgcctgacctcaccggcggcgacccatccgccgtccgtccctcactagctagctgctgcctctgccgctgcatcgatcaggccagcacgcggatcgatcggcgggagaagctcgaaggagaagaaagggatcgaccaagatggggcgcggtaaggtgcagctgaagcggatagagaacaagataaaccggcaggtgaccttctccaagcgccgcaacggcctcctcaagaaggcgcacgagatctccgtcctctgcgacgccgaggtcgccgtcatcgtcttctccccaaaggggaagctctacgagtacgccaccgacgaccgcatggacaaaattcttgaacgttacgagcgctattcctatgcagaaaaggctctaatttcagctgaatctgagagtgagggaaattggtgccatgaatacaggaaactgaaggccaaaattgagactatacaaaaatgccacaagcacctaatgggagaggatctagagtctctgaatctcaaagagctccaacaactagagcagcagctggagagctcactgaagcacatcagatcaagaaagagccaccttatggtcgagtccatttctgagctacag

SEQ ID NO: 23337 - protein, 154 aa, Panicum virgatum
  misc_feature: Ceres CLONE 1827201
  misc_feature (9)..(59): Pfam Name: SRF-TF Pfam Description: SRF-type transcription factor (DNA-binding and dimerisation domain)
  misc_feature (75)..(154): Pfam Name: K-box Pfam Description: K-box region
  misc_feature: The sequence is a functional homolog of SEQ ID NO 6 in US patent 7279615
  misc_feature: Useful for making plants with modulated biomass
  misc_feature: Useful for making plants with modulated flowering time
  misc_feature: Useful for making plants with modulated phosphate use efficiency
  misc_feature: The sequence is a functional homolog of SEQ ID NO 2 in US patent 7273968
  misc_feature: Useful for making plants with altered alkaloid content
  misc_feature: The sequence is a functional homolog of SEQ ID NO 1360 in the 10/666,642 US patent application
  misc_feature: The sequence is a functional homolog of SEQ ID NO 22 in the 10/666,642 US patent application
  misc_feature: The sequence is a functional homolog of SEQ ID NO 46 in the 10/666,642 US patent application
  misc_feature: The sequence is a functional homolog of SEQ ID NO 730 in the 10/666,642 US patent application
  misc_feature: The sequence is a functional homolog of SEQ ID NO 428 in the 10/666,642 US patent application
  misc_feature: The sequence is a functional homolog of SEQ ID NO 892 in the 11/435,388 US patent application
  misc_feature: Useful for making plants with altered terpenoid content
  misc_feature: The sequence is a functional homolog of SEQ ID NO 4 in US patent 7057087
  misc_feature: The sequence is a functional homolog of SEQ ID NO 707 in the 10/666,642 US patent application
  misc_feature: The sequence is a functional homolog of SEQ ID NO 30 in the 10/666,642 US patent application
  misc_feature: The sequence is a functional homolog of SEQ ID NO 1362 in the 10/666,642 US patent application
  misc_feature: The sequence is a functional homolog of SEQ ID NO 199 in the 11/479,226 US patent application
  misc_feature: The sequence is a functional homolog of SEQ ID NO 34 in the 10/666,642 US patent application
  misc_feature: The sequence is a functional homolog of SEQ ID NO 58 in the 10/412,699 US patent application
  misc_feature: The sequence is a functional homolog of SEQ ID NO 36 in the 10/666,642 US patent application
  misc_feature: The sequence is a functional homolog of SEQ ID NO 60 in the 10/412,699 US patent application
  misc_feature: The sequence is a functional homolog of SEQ ID NO 1732 in the 10/412,699 US patent application
  misc_feature: The sequence is a functional homolog of SEQ ID NO 44 in the 10/666,642 US patent application
  misc_feature: The sequence is a functional homolog of SEQ ID NO 66 in the 10/412,699 US patent application
  misc_feature: The sequence is a functional homolog of SEQ ID NO 203 in the 11/479,226 US patent application
  misc_feature: The sequence is a functional homolog of SEQ ID NO 40 in the 10/666,642 US patent application
  misc_feature: The sequence is a functional homolog of SEQ ID NO 1368 in the 10/666,642 US patent application
  misc_feature: The sequence is a functional homolog of SEQ ID NO 422 in the 11/435,388 US patent application
  misc_feature: The sequence is a functional homolog of SEQ ID NO 42 in the 10/666,642 US patent application
  misc_feature: The sequence is a functional homolog of SEQ ID NO 1949 in the 10/412,699 US patent application
  misc_feature: The sequence is a functional homolog of SEQ ID NO 1955 in the 10/412,699 US patent application
  misc_feature: The sequence is a functional homolog of SEQ ID NO 1701 in the 10/412,699 US patent application
  misc_feature: Useful for making plants with altered lignin content
  misc_feature: The sequence is a functional homolog of SEQ ID NO 1963 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: The sequence is a functional homolog of SEQ ID NO 1965 in the 10/412,699 US patent application
  misc_feature: The sequence is a functional homolog of SEQ ID NO 1967 in the 10/412,699 US patent application
MGRGKVQLKRIENKINRQVTFSKRRNGLLKKAHEISVLCDAEVAVIVFSPKGKLYEYATDDRMDKILERYERYSYAEKALISAESESEGNWCHEYRKLKAKIETIQKCHKHLMGEDLESLNLKELQQLEQQLESSLKHIRSRKSHLMVESISEL

SEQ ID NO: 23338 - DNA, 1132 bp, Panicum virgatum
  misc_feature: Ceres CLONE 1827202
  misc_feature: Encodes the peptide sequence at SEQ ID NO. 23339
atccccccaaaccccacaccaccaccgcatttcgccgggctcctctcccctcctctccgccgcaaccgtctggtcctcgggacgaacccctcctccctgtcgccatgggtcccggcctctactccgagatcggcaagaaggccagggatctcctgaacaaggacttccatacagaccagaagtttaccctgaccacctacacctcgagtggagccgcaataacagctgcgagcacaaagaaaaacgaggctatcttcagtgaggtccaaaccaagctgaagcagaagaatgttacagtggatgtgaaagcaacttcagactgtctgctcttaactacagtcacagttgaagaatttggtgtaccaggcttgaaaaagatagtaaccattcctttcccaagccaatcagctggaaaggctgaagtccagtacctgcatgattatgctggtatcaacgccagttttggcttgaactcaaaacctttggttagcctttctggtgtgctcggcaacaaagctattgctgttggtgctgatgttgcatatgatactgctactggggatttcgccaagtacaatgctgggttgagtttcaccaatgctgatctcattgctgctgtgaccttgaacaacaaaggtgacagcctcactgcatcctactaccacttggtgaacgcggagaagaacacagctgttggagcagaggtgacccgcagcttctcaagcaagcagaacactgtcaccatcggcacgcagcatgccctggaccccagcaccactgtgaaggcgcgctacaacagcaacggcatggccagcgctctcatccagcacgagtggaggcccaagtcattcttcaccctcaccacagaggtcgacactaaggctttcgagaagagctccaaggtcgggctgtcgctggtccttacgccctgatgatgatgccgatccctttttggtcctaggatggttaggttgccgtatcaccacctgaggttgactgtaataattctgaattctgaacatcttcctggctcaactttggtgtcatgtggcatcttcgattctgcaagcttacccttctgtaagtgtcattcgtcactctttggtgtagacgtggtggaactgaatcggtg

SEQ ID NO: 23339 - protein, 275 aa, Panicum virgatum
  misc_feature: Ceres CLONE 1827202
  misc_feature (2)..(268): Pfam Name: Porin_3 Pfam Description: Eukaryotic porin
  misc_feature: Useful for making plants with modulated drought sensitivity
MGPGLYSEIGKKARDLLNKDFHTDQKFTLTTYTSSGAAITAASTKKNEAIFSEVQTKLKQKNVTVDVKATSDCLLLTTVTVEEFGVPGLKKIVTIPFPSQSAGKAEVQYLHDYAGINASFGLNSKPLVSLSGVLGNKAIAVGADVAYDTATGDFAKYNAGLSFTNADLIAAVTLNNKGDSLTASYYHLVNAEKNTAVGAEVTRSFSSKQNTVTIGTQHALDPSTTVKARYNSNGMASALIQHEWRPKSFFTLTTEVDTKAFEKSSKVGLSLVLTP

SEQ ID NO: 23340 - DNA, 578 bp, Panicum virgatum
  misc_feature: Ceres CLONE 1827209
  misc_feature: Encodes the peptide sequence at SEQ ID NO. 23341
ccctccccctcctccccctccgcccggtcttctactccaatggaatctcgcaccctcgattagcccgccccgctccagtccgccgactcgagctcgacccaaagatcgcgcctttatttgtgcgtgtgcgcgcgcggcggcggtaggtgtcgccgtcagggatcagctgggggtgggaagaaattagttgtttgggttgaccattcagggtgggttattaggatggaggcggcgaaggaggctgctgtggcgaagccgcggctgccgccggggttccggttccggccgacggacgaggagctggtggtgcactacctccggcggcgcgcgctggcggccccgctccccgccgccgtggacatccccgacgtgcgcatcctggcgcacgacccctcggacctgctgcccccagggtggagcgagccagaacgctacttcttcacgtgcaaggaggtcaagtacgtcaaggggcggcgcgcgaaccgcgccacgggggccgggtactggaaggccacgggcaaggagaagcccgtggcggcggcggtgccggtgcccgcgaggggccaggcggagcaggc

SEQ ID NO: 23341 - protein, 118 aa, Panicum virgatum
  misc_feature: Ceres CLONE 1827209
  misc_feature (14)..(117): Pfam Name: NAM Pfam Description: No apical meristem (NAM) protein
  misc_feature: Useful for making plants with modulated nitrogen use efficiency
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: Useful for making plants with altered cell wall content and/or composition
  misc_feature: Useful for making plants with altered lignin content
  misc_feature: The sequence is a functional homolog of SEQ ID NO 854 in the 10/374,780 US patent application
  misc_feature: The sequence is a functional homolog of SEQ ID NO 853 in the 10/374,780 US patent application
  misc_feature: The sequence is a functional homolog of SEQ ID NO 851 in the 10/374,780 US patent application
  misc_feature: Useful for making plants with modulated oxidative stress sensitivity
  misc_feature: The sequence is a functional homolog of SEQ ID NO 1012 in the 11/435,388 US patent application
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: Useful for making plants with altered alkaloid content
  misc_feature: The sequence is a functional homolog of SEQ ID NO 891 in the 10/374,780 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
MEAAKEAAVAKPRLPPGFRFRPTDEELVVHYLRRRALAAPLPAAVDIPDVRILAHDPSDLLPPGWSEPERYFFTCKEVKYVKGRRANRATGAGYWKATGKEKPVAAAVPVPARGQAEQ

SEQ ID NO: 23342 - DNA, 1214 bp, Panicum virgatum
  misc_feature: Ceres CLONE 1827221
  misc_feature: Encodes the peptide sequence at SEQ ID NO. 23343
acgctgcacaccactccccaccccgagctgtcccccattgcttgcttccgcagtagctgctcgctcgctcgctctagagtgttcgcccgcggtccggtcgagagagctcgagctcttgcagccatggcggttcccctgcttctcctgctgctgctggccatgttcgcaggctcagatgcggcgttctgcgtgtgcaagccgggcaccccggacgcgatgatgcagaaggcgatcgactacgcctgcagcaagggcgccgactgcgcccagaccgcgcagggcgggccgtgctacggcaacggcaacaaggtggccgtctgctcctacatctgcaacagctacttccagagcaggagctccatgggcgccacctgcgacttcggcggcgtcgccaccctcaccaccaccgaccccagctccggcacctgcaagttcgcctctggacccagcagcgttggcaccggcggcggcggcatgggcaccggcgggacaggcgccggcgccggcggcggcggcatgggcaccggcgggacaggcgccggcactggcggcatgggcgccggcgcgggcacaggagcaggcaccggcgctggcactggagcgggcactggtggcatgggagcgggcaccggcgcgggcgcgggtgtcacgacccccgggagcgggagcaccctgagcccaccgttcggcggcacgggcgcgtacggcccgacgggccccgactacaacggcgccgccgccccggtcgtggccgggcgccacgtcgccgccgcgcttctcctggccgccgcggcgcccctcctccgccgctgagcgccggcgcgcgctgccagctcttgaaggagggggtgcagtagcgggttccgcgggcacgcctgccggcgcccgctttggccgccgccgcgcgcgcctttccgagcctgctgggtttttgatcgatcacaagccatcgcggtgtagcggctggtagcggtggtagccactggcacgggctactactaccatcccaactgacctcgtgctggtggccgccatgtggtgctctgtactggtagagatctaggggattcttttgtagttccggacatacgtgtcgccgtgttcacccgtccttttttttctttttcggcttttgttgctatgctctgttatgttatgctaggctgtgttactgtactatgctagttgttcgtggcggcggccactttccgtgc

SEQ ID NO: 23343 - protein, 229 aa, Panicum virgatum
  misc_feature: Ceres CLONE 1827221
  misc_feature (20)..(104): Pfam Name: X8 Pfam Description: X8 domain
  misc_feature: SWISSPROT Homolog: EC 3.2.1.39 Glucan endo-1,3-beta-D-glucosidase
  misc_feature: Useful for making plants with altered carbohydrate content
  misc_feature: Useful for making plants with altered alkaloid content
MAVPLLLLLLLAMFAGSDAAFCVCKPGTPDAMMQKAIDYACSKGADCAQTAQGGPCYGNGNKVAVCSYICNSYFQSRSSMGATCDFGGVATLTTTDPSSGTCKFASGPSSVGTGGGGMGTGGTGAGAGGGGMGTGGTGAGTGGMGAGAGTGAGTGAGTGAGTGGMGAGTGAGAGVTTPGSGSTLSPPFGGTGAYGPTGPDYNGAAAPVVAGRHVAAALLLAAAAPLLRR

SEQ ID NO: 23344 - DNA, 545 bp, Panicum virgatum
  misc_feature: Ceres CLONE 1827223
  misc_feature: Encodes the peptide sequence at SEQ ID NO. 23345
cgtgacccagtgggggaggcttcgccgtcgatcgaccgacgatgaggccgagtggatgggcaacacccccctagagtgcctccgcaaggtgacggaagggtgcgtaggccgcgtcaccgccgagatcgagtgcatggagccctgctgctccgtcgaggataggataggatacgaggtgtggggcggacatcagacgagaacggcccgatcacacccgggccgagtgtgctcgacgaaccgactagcagctaccacgtaggttcgactggcctgtgatggctgcaggatagggatgcgaagttatatctcacaaagcctggttgcaggaccatggagaggagaatcgaacaaaacagctggggttactgagcgggtgcttactgaccctcacatgagaatgaaaaggacgctgtaggataagatgaagagatccaggaagaagaccgatgtcgcagtctcgcaactgttggaaatcctgcggagggattgatccattttgagaatactgggactgcaatctagaacgtcacatcacgtgagagagg

SEQ ID NO: 23345 - protein, 85 aa, Panicum virgatum
  misc_feature: Ceres CLONE 1827223
  misc_feature: SWISSPROT Homolog: EC 2.5.1.47 Cysteine synthase
VTQWGRLRRRSTDDEAEWMGNTPLECLRKVTEGCVGRVTAEIECMEPCCSVEDRIGYEVWGGHQTRTARSHPGRVCSTNRLAATT

SEQ ID NO: 23346 - DNA, 346 bp, Panicum virgatum
  misc_feature: Ceres CLONE 1827224
  misc_feature: Encodes the peptide sequence at SEQ ID NO. 23347
caacccatagcttctaggacccgggggtcgatctggtgttcctcatccgatcttcaggcatgttcgggaaaggcacctgagggttccctgctggatgctaatcacggcgattctaaaatggatgacttgcggagggcgggtgatactgacgaattcttaacttcctatgatgaagtgtttgagagtgttgatgacatggggctccaagacaatcttttgagaggattttacgcttatggcctcgagaatgcttctgctatggaacagagaggaactgtgcctttctgcaagggccttgatatggttccgcaaggacagtctggtacaggaaagacaacaactttct

SEQ ID NO: 23347 - protein, 115 aa, Panicum virgatum
  misc_feature: Ceres CLONE 1827224
  misc_feature: Useful for making plants with altered alkaloid content
  misc_feature: Useful for making plants with altered lignin content
QPIASRTRGSIWCSSSDLQACSGKAPEGSLLDANHGDSKMDDLRRAGDTDEFLTSYDEVFESVDDMGLQDNLLRGFYAYGLENASAMEQRGTVPFCKGLDMVPQGQSGTGKTTTF

SEQ ID NO: 23348 - DNA, 647 bp, Panicum virgatum
  misc_feature: Ceres CLONE 1827229
  misc_feature: Encodes the peptide sequence at SEQ ID NO. 23349
aagctgacagggattgaatattcgtagcaagcagcctccggcccccgcccctttttagttcctttgctgctcctcgatttgattgcttgcgttcatcctcgacctcgattgattcctccctgaggcgaaggcaggcaggcaggctggtcaccatgggatctaaggcacctttcttcctcttgctcctcttgctgctcgtcgcccgggcacctgcacaagccagggatcctgcaaatcacagccctgtcgacaaggaacatattcctgtccatctcaagagcagcagcccgatatgctctgcttgtgaaaacttagcgagtggtgctgtcacttatctaagtgagaaacaaacacaagataagatcatggaattacttcatcatgcttgttcgcagtcattctccttggaacagaagtgtgttgaattgatggactcctatgcaactctgctgtttgccaagatttcggagatcaagccagaagagttctgcaaacagtatggcctgtgcagggataccacctttttctctggtgtgggtagtgacagaacttgtgtgttttgccaccaccttcttgacgaaattatgtccaaactgaaagatccagatgcggagtttgagataattcaaattctcatcaaggagtgc

SEQ ID NO: 23349 - protein, 164 aa, Panicum virgatum
  misc_feature: Ceres CLONE 1827229
  misc_feature (45)..(84): Pfam Name: SapB_1 Pfam Description: Saposin-like type B, region 1
  misc_feature (86)..(119): Pfam Name: SapB_2 Pfam Description: Saposin-like type B, region 2
MGSKAPFFLLLLLLLVARAPAQARDPANHSPVDKEHIPVHLKSSSPICSACENLASGAVTYLSEKQTQDKIMELLHHACSQSFSLEQKCVELMDSYATLLFAKISEIKPEEFCKQYGLCRDTTFFSGVGSDRTCVFCHHLLDEIMSKLKDPDAEFEIIQILIKE

SEQ ID NO: 23350 - DNA, 568 bp, Panicum virgatum
  misc_feature: Ceres CLONE 1827238
  misc_feature: Encodes the peptide sequence at SEQ ID NO. 23351
aaccatcccgaaaccccatcgcaaactaatccccaaccccaaacccccaatccacccacccccctcatccattccggggggccatggcctgttccttcgccgccgccgccgccaccgtctcctccgcgccaacccacgccgccagggctctcgccgcggcgccgcaggctgtctccgtcgcccgctccgcggtagccgccaggcccctccgccccgccggctccaaatccgcgcgggccaccaggctcgtcgcccgcgccggcggcgtcaataacttgcctttggtcggaaacaaggcgtcaaacttcaaggccaaggccgtgttcaaccagaagttcatcaacgttaagctatccaattacattggaaaaaagtacgtgattctgttcttctaccccttgaacttcaccttcgtctgccccaccaaaattaccgccttcagcgacaaatataaaaaattcaaaaagttgaacactgagatccttggtgtctccattgacagtgtgttctcccaccttgcatgggtgcaaacaaacaggaagtctggggggcttgggaatcttaaata

SEQ ID NO: 23351 - protein, 161 aa, Panicum virgatum
  misc_feature: Ceres CLONE 1827238
  misc_feature (68)..(161): Pfam Name: AhpC-TSA Pfam Description: AhpC/TSA family
  misc_feature: SWISSPROT Homolog: EC 1.11.1.15 Peroxiredoxin
MACSFAAAAATVSSAPTHAARALAAAPQAVSVARSAVAARPLRPAGSKSARATRLVARAGGVNNLPLVGNKASNFKAKAVFNQKFINVKLSNYIGKKYVILFFYPLNFTFVCPTKITAFSDKYKKFKKLNTEILGVSIDSVFSHLAWVQTNRKSGGLGNLK

SEQ ID NO: 23352 - DNA, 1397 bp, Panicum virgatum
  misc_feature: Ceres CLONE 1827249
  misc_feature: Encodes the peptide sequence at SEQ ID NO. 23353
acttgtcccgcgtcaacacaccggtcaaacctccccaccctcccaaaccttcctttcccctcgccggagcggagccggccacggccacgatgccgtcgctcgccgcccgcctggccgtaccggcagccgcgctgctgctcctcttcctcctggcggcgccctcctcggccacaaatttcacctgcgcctcgccgggcaccacctgccggtccgccatcggctacccggcgcccaacgccaccacctacgcggagctcgccgcccgcttcaacgccaccacgacgctcgccgagctcctcggcgccaacggcctccccgccggcacgtccccctccgcgcccgtcgcggccaaggccaccgtccgcgtccccttccgctgccgctgcgggagcaacggggtggccagctccgacggcgggcccgtctacgtggtgcagccgcaggacgggctggaccacatcgcccgcgacgtcttcggcgccttcgtcacctaccaggagatcgccaccgccaacggcatcaaggacgtcaacctcatctaccccggccagaagctgcggatcccgctgccctgcacctgcgacccggtggacggcgccgccgtgatgcacttcgcgtacagcgtcgccaagggcgacgagacgtctggcatcgccgccaggttcggggtgaacgagcgcacgctgctgactctgaacaagatcgccgaccccaaggacctgctgcaggggcagatcctggatgtccccctccctgtttgtcactcatcaatcagcaacacctcggctgattacaacctgctcgtcccgaacggaagctacgcgctcaccgccggagactgcatgcggtgcagctgcagtgcaaacaattacgagcagtaagctcccctgctctcattcctcctgccctggcgtttatcaatcagtggccaccatgatttgcatcacgtttccctgtgatttccaggctagactgctctccagttcagcgcagaggatgcccggccgtcccgtcgtgcaatggaggcctgaagcttgggcagacgacgaacagcactggctgcgagtccaagatttgtgcgtacagcggctactccaacaccacgtcgctcagcataaacaccgctcttgttactgcaaaccagacagcgtgcgaccagaagggaggagcagcgaggtcggagtttgctgggtccatgtggagaatgtccgtgatctctttccacatggtgctcatcctgatctgcttcctatgatggctgtagaggttagaagttgagattggtatacgatttgtgtgtcggtgagattgttgtttaacttgtctgtatgttaggtctggtttatccagattttgtcggtatagatgtttgaataaagcaaagctgagtttgcatc

SEQ ID NO: 23353 - protein, 263 aa, Panicum virgatum
  misc_feature: Ceres CLONE 1827249
  misc_feature (113)..(159): Pfam Name: LysM Pfam Description: LysM domain
  misc_feature (177)..(220): Pfam Name: LysM Pfam Description: LysM domain
  misc_feature: SWISSPROT Homolog: EC 3.5.1.28 N-acetylmuramoyl-L-alanine amidase
MPSLAARLAVPAAALLLLFLLAAPSSATNFTCASPGTTCRSAIGYPAPNATTYAELAARFNATTTLAELLGANGLPAGTSPSAPVAAKATVRVPFRCRCGSNGVASSDGGPVYVVQPQDGLDHIARDVFGAFVTYQEIATANGIKDVNLIYPGQKLRIPLPCTCDPVDGAAVMHFAYSVAKGDETSGIAARFGVNERTLLTLNKIADPKDLLQGQILDVPLPVCHSSISNTSADYNLLVPNGSYALTAGDCMRCSCSANNYEQ

SEQ ID NO: 23354 - DNA, 1249 bp, Panicum virgatum
  misc_feature: Ceres CLONE 1827274
  misc_feature: Encodes the peptide sequence at SEQ ID NO. 23355
accttcagtctgtaccctctgaccgactcctcgcacgcaagtacccagccgcgacccccctgctcctctccccaccgcgccgccgccccgcctctcccgcttccggcggccaccgcgcccattgtgaccgcgcggggcacggagcaaccgggctggtctagggcccttccccttcggagcgccaccaagaagcagagggggcggcgggggcgccagctttcttggatcgactgctcccgagctgacgaagcagaggattactcgtcccgtgcggcagccatgtctgtggagctcatcatgtggcttttctccttcgcctccgtcatggttctcatcggcctcaccgcgtaccagcttatctgtttgtctgatttggagtatgactatatcaacccatatgattcatcatctcgcatcaatgcggtggtccttatagaatacttacttcaagcagccctgtgtgcttctttcctcttgacgctacattggttcccctttctagtcatggcacctgtaacttactaccatgtgaaactgttcatggctcggaaacatctggtagatgtcactgaaatttttagacaattaaatggcgagaagaagtacaggatgatcaagcttgccttctacttctgcctatttattattactatttacaggcttgtaatgacagctgtgatgctgtttatcgacgaggatgtaaatctggtagaaactaggactatctagactttgcctccaacttgtctcagctcacagggggagcagtgttgcagacttgcagtcttcaaaggaagcccaaaagaacacaattgggaggaaccagtgagaacataactgaattccttgcccaagctatgagatgaagatcaactcgtgcccaatagctggagctaatctggtgtcttagattctcagtgttcatttttatccatcaaacagaactgaaaaatctgttgtagtatgaattatcactagtttggtctgtcaggaccgcgtttgtaaattgggctggcaatgatgcatcaccatacaatgatcacacgtttgggacttcagaggctattgcctattgtgcttgtgcatttcttttgtacttgaatccacgtgtgctgttgtatttcatttcagctccgcgttgtctgtgcatgactgatgataaagtgtagtgttcatttacatgatgcaataatttgtatgccctgcgacctcgatatcaagatgaattgaatcttatccttccgtgtac

SEQ ID NO: 23355 - protein, 149 aa, Panicum virgatum
  misc_feature: Ceres CLONE 1827274
  misc_feature (4)..(127): Pfam Name: Cornichon Pfam Description: Cornichon protein
MSVELIMWLFSFASVMVLIGLTAYQLICLSDLEYDYINPYDSSSRINAVVLIEYLLQAALCASFLLTLHWFPFLVMAPVTYYHVKLFMARKHLVDVTEIFRQLNGEKKYRMIKLAFYFCLFIITIYRLVMTAVMLFIDEDVNLVETRTI

SEQ ID NO: 23356 - DNA, 668 bp, Panicum virgatum
  misc_feature: Ceres CLONE 1827313
  misc_feature: Encodes the peptide sequence at SEQ ID NO. 23357
tttttaaaagccattacgctttcctacactgcactgcacagcacctcactcgctcgctcgctcactcagcaggttcagctcagagccccagacacccacccgccactgcacagccagcagccagcagccagcagccagcagccatgagcaagggggagaagcaccaccggcacgagcaccacctgcgccgctgctgcggctgcatggcctcggtcctgctggcgctggtcctcgtggtggccttcgtcgcgctggtcgtctacctcgcgctgcgcccctccaagccgtccttctacctgcaggacctgcaactccgccggcccatccacgtcggcgacccctccctctcggcgtccgcgcaggtcacgctcgcctcccgcaaccccaacgaccgcgtcggcgtcctctacaagcgcctcgacgtcttcctcacctaccgcgaccagcccgtcacggcgcccgtctccctcccgccgcagtaccagggccaccgggacgtcatcgtctggtcccccgtgctggccgccgagtccgtgcccgtggccggctacgtcgcggacgccatgaagcaggacatcgccgccgggttcgtcgcgctgcaggtcaaggtcgacggccgcgtcaagtggaaggtcgggagctgggtctccgggagctaccacctcttc

SEQ ID NO: 23357 - protein, 174 aa, Panicum virgatum
  misc_feature: Ceres CLONE 1827313
  misc_feature (40)..(174): Pfam Name: Hin1 Pfam Description: Harpin-induced protein 1 (Hin1)
MSKGEKHHRHEHHLRRCCGCMASVLLALVLVVAFVALVVYLALRPSKPSFYLQDLQLRRPIHVGDPSLSASAQVTLASRNPNDRVGVLYKRLDVFLTYRDQPVTAPVSLPPQYQGHRDVIVWSPVLAAESVPVAGYVADAMKQDIAAGFVALQVKVDGRVKWKVGSWVSGSYHL

SEQ ID NO: 23358 - DNA, 1613 bp, Panicum virgatum
  misc_feature: Ceres CLONE 1827336
  misc_feature: Encodes the peptide sequence at SEQ ID NO. 23359
agggggaatttcaagcagagagtttgcgggtggcggcgagctgtgcggctttggctctgtggcggccgggagtgtcggggatgggggccggcatgagcagaagccggcggcgcggcttcggcctcgaggcgtcgagggggatgctgcccctgctggcgctccaggtgctgctggagtacggccgcgcgggcgcctcccggccgcccgtgaccgcggcgctgctcgccgccaatacgctgatctacctccggcccggcgcgctccacgagatcctgccctctcttgctcgagtctccttcaatccgcaactcatcatcgagtatggtgattggatgcgcttcttcctgtcacctttctaccatttgagtgaaagtcacctcttctacaacatgacgtcactcttgtggaagggcatacagcttgaaacatcaatgggtagtgctgagtttgcttccatggttgctgcattgcttgccctgtctcagggtatgacgctgctcatgtcaaagggcttaatcttccttggtgattatactgcatattatgatcaatatgctgttggattctctggtgtgctgtttgccatgaaggtcgtgctgaacgcctggtcggacgattttgtgtatctccacggaatggttattccagcgaaatatgctgcctgggctgagttaatcctcatccaggttttcattcctgggacatcctttcttggccatcttggtgggatacttgctggactggtttatctttggctgaagcgctcattcaacgggccggatccgtttacccttctggtgtcaagcattaccaaggttgtgacctggccactgaaatttgctcagaaacttctgcgatctgccagttcacaaggtcgcataacaggtaggggcagggttgggcgccgtgcatcagcaagagagacccctcgagggttatggagatgctcaacctgcacctatgacaactcaattgcgacagacatctgtgagatgtgcagcactgcacgagaggaccgttctttttcaaggagacagaatcatcaagatgggggtagtggtgagctttcggttgacgagatacgccataggaggctgcaaagatttgacagatgatgcaagtcattgctaccagtactaagattgcgtactggcaattctgaagctagaatgtgtcgtcacatttgtttcttctcatgatgaggagcagtttacataattgactctttcctcaccatttgaaggagggtggctccattctataggttcttcaaagccttgatagtatgtagttattgcccacttttgtataaattgtatcaggcgatgttgaaattaaagtacttgagcatatatcgtcaccttctgttcgttaatgatagtcattttttttatatagctgaaagactttaagaacattggaatgctcgaagtcatctatccattgtcatatcagatgcgttctcttttcattttcagttaccagttgaataagtctcagcagcatgtgttttggatagttgcatggacagaggaaattggttctgattaaagggttcatgctgtgtagtgtccagcagatgtttcgcctgaattcgcctaaagctggatcac

SEQ ID NO: 23359 - protein, 344 aa, Panicum virgatum
  misc_feature: Ceres CLONE 1827336
  misc_feature (78)..(232): Pfam Name: Rhomboid Pfam Description: Rhomboid family
  misc_feature (283)..(312): Pfam Name: zf-RanBP Pfam Description: Zn-finger in Ran binding protein and others
MGAGMSRSRRRGFGLEASRGMLPLLALQVLLEYGRAGASRPPVTAALLAANTLIYLRPGALHEILPSLARVSFNPQLIIEYGDWMRFFLSPFYHLSESHLFYNMTSLLWKGIQLETSMGSAEFASMVAALLALSQGMTLLMSKGLIFLGDYTAYYDQYAVGFSGVLFAMKVVLNAWSDDFVYLHGMVIPAKYAAWAELILIQVFIPGTSFLGHLGGILAGLVYLWLKRSFNGPDPFTLLVSSITKVVTWPLKFAQKLLRSASSQGRITGRGRVGRRASARETPRGLWRCSTCTYDNSIATDICEMCSTAREDRSFSRRQNHQDGGSGELSVDEIRHRRLQRFDR

SEQ ID NO: 23360 - DNA, 1362 bp, Panicum virgatum
  misc_feature: Ceres CLONE 1827361
  misc_feature: Encodes the peptide sequence at SEQ ID NO. 23361
ctgcagccgccacgaagccttgcgggttgcaactcgtcactgtagagctcgctgccgacgatgtgatgcttcctggcccccttccgccactcgagaccttccctcgctgacatctggtcgccgccgaaccgcccgatggcccaagacgccacgtccgagcttgaggaggagtggtcggacaccgacctcggcgacacctcggactccgaggtgggcgatgccctggactggctcgacgccgtggagggccccgacggctcggcgcggccctccgcggcgttctcggccgccggtggcgcgggcgtggcgcgcaggcccaacgcgcatggcggcgtgctctcccgccccctccagccgctctccaatcgcacccagaagctcgcctcgcacatccgcgcggcgcccttggaggagtgggaaggtaggatgaacgtggggatgtccaattcagtaactaccgctatcagggatagcataagggaaacaacaattgggaagataaggaacacggagaaggctgaccgtgctacagtggaacaggctattgacccaagaacacgcatggttttgttcaagatgttaaatcgtggtgtttttaataacataaatggttgcatctctacagggaaagaggcaaatgtctatcatgcaacaaaggcggagggtcaggagttagcaattaaagtctacaaaacctctgtgcttgtttttaaggatcgcgaccggtatgttcaaggagattatcgttttaggcatggttactgcaagcataatccacggaaaatggttaagacctgggctgaaaaggaaatgagaaaccttctacgagtgagagcagctggaatcagatgccctaaaccgttgctattgaggcttcatgtattggtgatggaattcatagggaaaggaggttgggctgctcctcgtcttaaggatgctgctttgtcagatgacaagttgcgtgaaagttactttgagataattacaacaatgcggacactttaccaaaagtgcaagttggtccatggagatttgagtgagtacaatattctttatttcgagggccacttgtacattattgatgtttcacaatctgttgaccttgatcacccttcagcattggacttcctgatagagacatggagaacaatcggaccctgagcacatcctgattcgctacttctccacactgcattatgaacctgttgacatgttctatcgtggaaacctccccttgtcccgagaacttggtgaaattagacactatatttatgcgggaatggaagttgatcataagcaggtgggtatggggtcctgtacatgatagatagttgcttcggcctaagaccaaactgttccctt

SEQ ID NO: 23361 - protein, 341 aa, Panicum virgatum
  misc_feature: Ceres CLONE 1827361
  misc_feature (168)..(339): Pfam Name: RIO1 Pfam Description: RIO1 family
  misc_feature: SWISSPROT Homolog: EC 2.7.11.1 Non-specific serine/threonine protein kinase
  misc_feature: Useful for making plants with modulated biomass
  misc_feature: Useful for making plants with modulated flowering time
MAQDATSELEEEWSDTDLGDTSDSEVGDALDWLDAVEGPDGSARPSAAFSAAGGAGVARRPNAHGGVLSRPLQPLSNRTQKLASHIRAAPLEEWEGRMNVGMSNSVTTAIRDSIRETTIGKIRNTEKADRATVEQAIDPRTRMVLFKMLNRGVFNNINGCISTGKEANVYHATKAEGQELAIKVYKTSVLVFKDRDRYVQGDYRFRHGYCKHNPRKMVKTWAEKEMRNLLRVRAAGIRCPKPLLLRLHVLVMEFIGKGGWAAPRLKDAALSDDKLRESYFEIITTMRTLYQKCKLVHGDLSEYNILYFEGHLYIIDVSQSVDLDHPSALDFLIETWRTIGP

SEQ ID NO: 23362 - DNA, 1730 bp, Panicum virgatum
  misc_feature: Ceres CLONE 1827372
  misc_feature: Encodes the peptide sequence at SEQ ID NO. 23363
ttctcttctcgcttggaactctttgcacgccgctatgcgggcaaccattggagccactgatttcttaaaaaaaaaatctgtcggagccacttgatttattatggtttcagagagatgagagtgccgttgaacactgtcagctcgtcaatctagctagctagatagcgtcctttggaattttggcgttcgtcgtaaacatgcatcgaggggaggccgtcgaggacgttgtcatcgtgggcgccgggctcgccggcctcgcgacagccctcgggctccacaggaaaggggtgaggagcctggtcctggagtcgtcgccggcgctgcggacggcggggttcgcgttcacggcgtggaggaacgccttccgggcgctggacgccctcggggtgggcgacaagatcagggagcagcatctgcaggcgcaggcgtatgttcctcccccgccctatctccaatctctcctcccgatcgattcagtcgtgctcccacctcccattgctgcaggctacgcgtcatgtcttcgtctaccggggaggtcgcgcaggaactggacctgacggcggtgcagaagaaccggacccaatgagatccgctgcgtcaggcgggacgcgctgctgcagaccttggaggaggagctgccacgaggcaccatccgctactcctccaggattgtgtccatcgaggacggtggcggcgtcaggatcctgcatctagctgatggctcgactctgagggcaaaggtgctgattgggtgcgacgggatcaactccgtggtggcgaaatggctgggcctcgcggagccgtcctactcggggcgcatggcggcgagaggcctcgcgcatttccctgatggccacggcttggagcccaagttcctgcagttcatcggccgcggcttccgctccggcatgcgaccctgcaaccagactgacgtctactggttcttcacctggactccttccgagaacgataagggcgtcatcgagagtggctcaaagctgaagcagttcgtgctggccaacctcacggccctgaaggtgcctccaatggcgctggcggtgatcgagaggagcgaggcgaaggaggtctttgcggtgccgctgcggttccggccgccgctctcgcttctaaccgcgagcatcagcaagggcagcgtctgcgtggccggcgacgcgctgcacccgatgacgccggacctgggccagggcggctgcgccgcgctggaggacagcgtcgtcttggccagatgcctcggcgaggccgttctcggcgagggcgcgaggggcggcacggagagccggaggatcgaggaggggttgcgtgagtacgctgggatccggcgatggaggagcgtcgagctcgttgctacggcctatgtggtcggcttcatccagcagagtagcaatgccatcgtaggcttcctgcgggacaagtttttgtcagggttcctcgcgagacggcttctgaagatggcagcatatgactgtggcacgctctggagctgttaattaaccgaccctaatgtatttggcaaagcagcgcatagaggtggggtccacagcaggtagtccatagttatggtaaataccatggtaaaagttatattgggtgccaccgaaggtaaaaaaaatccacacggttctgcacttttcgttggctagttttgtttagctactctatgatactgtacatgcgttcgtgacggatcccagcgctactcctttcaatac

SEQ ID NO: 23363 - protein, 229 aa, Panicum virgatum
  misc_feature: Ceres CLONE 1827372
  misc_feature: SWISSPROT Homolog: EC 1.14.13.90 Zeaxanthin epoxidase
MAARGLAHFPDGHGLEPKFLQFIGRGFRSGMRPCNQTDVYWFFTWTPSENDKGVIESGSKLKQFVLANLTALKVPPMALAVIERSEAKEVFAVPLRFRPPLSLLTASISKGSVCVAGDALHPMTPDLGQGGCAALEDSVVLARCLGEAVLGEGARGGTESRRIEEGLREYAGIRRWRSVELVATAYVVGFIQQSSNAIVGFLRDKFLSGFLARRLLKMAAYDCGTLWSC

SEQ ID NO: 23364 - DNA, 1555 bp, Panicum virgatum
  misc_feature: Ceres CLONE 1827388
  misc_feature: Encodes the peptide sequence at SEQ ID NO. 23365
ccctccaccgaccgccccgcagcaaagcaaagcaaccttctccaccggcgaccattttccccggattccctgccaaactcgttcgagatctgcccatcgaatccacccctctcctcacccgcgatttgcccatgggcatctctcaccctctctctgacgagtacgacgccctccgcgccgccgtcctctcgccggagaggacgcctccctcgtccccgccgccgccgccccatcaccactgcctggagcacgaggtttccaggatggatacgctcgccggcatcgccatcaagtacggcgtcgagatatcggacattaagagggcaaatggtctggtcactgatagccagatgtttgcacacaaaacattgctcatacctctaccaggaaggcccatgccagctgttgtaagattgagtggttctggtcaaagaattaaaagagcatgggctccaaaccatcagcaaaacagagacaccgttgattcactagattcatcaaattgtggtcagaagggggcgtcgcctgcaatgagtaccttgcagagatactatggcctatcatctcagaaaggaagtgccatggattgcagcactgaaatgtctgtgtaccgtaagggtggtttccagagtaatctcagtgaaacattgctgagttcttctgcagctccaggcacaaatggtatggatggaagctgggagtatgaagagtcagttaacaggttttcatcagcgaacggtgccaatgggaacaagagcaacggggtacccaaacccaggcaagatgcttctatgcgtcgtcggcagaaagcggaagcagaatctaacacaactgatacccaggatgattttctagcagacccaattaaggcaattaagtgtttgttgccccggccaatatctagtatccgtctaaacatggatacaggcagcccagattccagccagaagatcagcatttcgtttcttaattttaatgggttcaaatctgtgaggaagtcgccaagcgcacccagctttgcagatgcagaaaatggggtgtctagctcgacatggaccttcaagcatgagtccttcacccggccgttactcgatggcctgccaaaaccggtgtctggtcggaggatgaaaactgccttggactgaacgacttaaggtcagcaatgctgcggatttttctggcatggttactagactacagtggatcaacaattggaagaggaggtgacttggtagagcatgtgtcttccgtgccagtggtctgtgctcgttttgggaggatggtcacagtgcagattatgggatctgagttgcagttgccttgtgttccttgctgctgtttaccactctttgcctctccgttggataaaattgtccagcgcattactggatcatcatctatcagtgccatggaagcgatgtgatggctctagtatgtatgaggatgatccatccatcatcttcttgtagtatgtaccttggtctgtagcttggaacctgcgtgtatgatgctgtgttggtggaatcaatagatagattgatgattctgttttcag

SEQ ID NO: 23365 - protein, 337 aa, Panicum virgatum
  misc_feature: Ceres CLONE 1827388
  misc_feature (40)..(83): Pfam Name: LysM Pfam Description: LysM domain
MGISHPLSDEYDALRAAVLSPERTPPSSPPPPPHHHCLEHEVSRMDTLAGIAIKYGVEISDIKRANGLVTDSQMFAHKTLLIPLPGRPMPAVVRLSGSGQRIKRAWAPNHQQNRDTVDSLDSSNCGQKGASPAMSTLQRYYGLSSQKGSAMDCSTEMSVYRKGGFQSNLSETLLSSSAAPGTNGMDGSWEYEESVNRFSSANGANGNKSNGVPKPRQDASMRRRQKAEAESNTTDTQDDFLADPIKAIKCLLPRPISSIRLNMDTGSPDSSQKISISFLNFNGFKSVRKSPSAPSFADAENGVSSSTWTFKHESFTRPLLDGLPKPVSGRRMKTALD

SEQ ID NO: 23366 - DNA, 663 bp, Panicum virgatum
  misc_feature: Ceres CLONE 1827392
  misc_feature: Encodes the peptide sequence at SEQ ID NO. 23367
agacacgcgcgggccggccggcacagctctatccgcaacgcaggcacgcagctgcgcgccaccgtgccgtgtctcgcgtcgcgcgcgtatccgagttcggccgttcgccatggggtgcggccggctgccggcgtgcttcgtcgcgctcctcctcgtcgcgggggcgctcccggcgcccgccgcagcgcgggagtacgcggccatcttcaacttcggggactccctggtggacgccggcaacctcgtggtggacggcatcccggactacctcgccacggcgcggctgccctacggcatgacctacttcggctaccccaccgggcgctgctccgacggccgcctcgtcgtcgacttcatcgcccaggagcttgggctgccgctgctgccgccgtccaaggcgaagaacgcgacgttccaccgcggcgccaacttcgccatcacgggcgcgacgtcgctggacacgcccttcttcgtggcgcgcgggctcgggaagacggtctggaactcggggtccctgcacacccagatcaagtggttccaggacctcaagcccaagatctgcggctcctcgtccccggaggagtgccggtcgctgttccggcggtcgctcttcatcgtgggcgagttcggcggcaacgactacaactcgccgctcttcgcgtt

SEQ ID NO: 23367 - protein, 184 aa, Panicum virgatum
  misc_feature: Ceres CLONE 1827392
  misc_feature: SWISSPROT Homolog: EC 3.2.1.51 Alpha-L-fucosidase
MGCGRLPACFVALLLVAGALPAPAAAREYAAIFNFGDSLVDAGNLVVDGIPDYLATARLPYGMTYFGYPTGRCSDGRLVVDFIAQELGLPLLPPSKAKNATFHRGANFAITGATSLDTPFFVARGLGKTVWNSGSLHTQIKWFQDLKPKICGSSSPEECRSLFRRSLFIVGEFGGNDYNSPLFA

SEQ ID NO: 23368 - DNA, 1431 bp, Panicum virgatum
  misc_feature: Ceres CLONE 1827396
  misc_feature: Encodes the peptide sequence at SEQ ID NO. 23369
atctcctcgccctctcttcacctccttacctgttgttttcctcctccctcccttgacccgtcgtcccatgctaaagcccagggttaggagctagaggtaatctctccctgtcaccctgtgtgtgtgtgtgtgtgtctctgcccccggccaagccgagagggggcgacgcatggaagccatggacgtcaagtacaagcccttcatgttccccaacggcgccgccgtcaagaaggtgaagccggcggccgtggcgccggcagcgggggagccgctgtaccgggagtgcctgaagaaccacgccgcgagcctgggcggccacgccgtggacggctgcggggagttcatgccctcgccgggggccaaccccactgacccgacgtcgctcaagtgcgcggcgtgcgggtgccaccgcaacttccaccgccgggcggtggagggctccccgccgccgcctgcgccgctggcgcttccggtgctgccgagcgtgctgcacggccagccgcaccgcggcggcgaggagacccccgatgaccggctcccgggggccgtcgacgactccgactccgattcggacggctccgagtacgacgaggagcggtcggtgtccccgccgcctccgccgcaccacgtgccggcgccggtggcgcagcagccgcccccgccgccgtacttcccgtcggggccgcacatgctgctctcgctcggctccggcgcgccgggggccgcggtggcggccgcggcgcagaggctgccccccgcccagctgacgccgtcgagcgcgccgccccccggggccgcgatgccgaggaagcggttccgcaccaagttcactgccgagcagaagcagcggatgcaggagctgtcggagcggctcgggtggcggctgcagaagcgcgacgaggccatcgtcgacgagtggtgccgcgacatcggcgtcggcaagggcgtcttcaaggtctggatgcacaacaacaagcacaacttcctgggcggccacagcgctcggcgcagcgcatcctccgcccccgccggccccggcgccggcgcggcgccgctccacgccccaatcgccaacgccggcgccgccgcaccgtcattcaacacgtccgccatcacccctccccctcccgtcctcacctcgtcaccgccctccgcaagcggcttcaacatcaacggcgccgcctcctccgcccccaccgccaccgccggccacccagacaacgtcaccggagcctcgtcgccgcagtccgcataaactagagagagagagaggagagagggaagggagaatggagagagaaacatgtagcttaatttcagtgatcatttctttttcttttttccttagacttttcatctagtaagaaattaaccccaagaaagcatgcgccgccgcgcgccatgcctagaaatccaagcttccttccatgc

SEQ ID NO: 23369 - protein, 358 aa, Panicum virgatum
  misc_feature: Ceres CLONE 1827396
  misc_feature (28)..(89): Pfam Name: ZF-HD_dimer Pfam Description: ZF-HD protein dimerisation region
  misc_feature: The sequence is a functional homolog of SEQ ID NO 114 in the 10/714,887 US patent application
  misc_feature: The sequence is a functional homolog of SEQ ID NO 114 in the 11/435,388 US patent application
  misc_feature: Useful for making plants with modulated low light sensitivity
  misc_feature: Useful for biocontainment applications
  misc_feature: Useful for making plants with modulated biomass
  misc_feature: Useful for making plants with modulated flowering time
MDVKYKPFMFPNGAAVKKVKPAAVAPAAGEPLYRECLKNHAASLGGHAVDGCGEFMPSPGANPTDPTSLKCAACGCHRNFHRRAVEGSPPPPAPLALPVLPSVLHGQPHRGGEETPDDRLPGAVDDSDSDSDGSEYDEERSVSPPPPPHHVPAPVAQQPPPPPYFPSGPHMLLSLGSGAPGAAVAAAAQRLPPAQLTPSSAPPPGAAMPRKRFRTKFTAEQKQRMQELSERLGWRLQKRDEAIVDEWCRDIGVGKGVFKVWMHNNKHNFLGGHSARRSASSAPAGPGAGAAPLHAPIANAGAAAPSFNTSAITPPPPVLTSSPPSASGFNINGAASSAPTATAGHPDNVTGASSPQSA

SEQ ID NO: 23370 - DNA, 945 bp, Panicum virgatum
  misc_feature: Ceres CLONE 1827410
  misc_feature: Encodes the peptide sequence at SEQ ID NO. 23371
aaaagccagccagaacaaaaccaccaccacctcctctttctcctctcgcccctgctccgctactcgggcaagccaagccaggggaaccggaacccaaccccccacacaccgcaggcgagcccacgcagacgcggccgcggctcaagccaccccgtgggctccgatgggctgctgccgctcctcgctgcggacggggacgctcccggtgaagaagccgccggggagggcggcgggggcgctccccccgcaccgcccctccctctcgctgaaccagcaccaggcgcggccgccctccgcggcgcgcgcgggcgccgccggccgcgaggtgccggcggtcaaggagttctcgctggaggagctgcgcgccgccacgggaggcttcgcgccggagaacatcgtctccgagagcggcgacaaggcgccgaatttcgtgtacaagggccgcctcgaggccagccgccgcgcgatcgccgtcaagaagttcaccaagatggcctggcccgatgccaagcagttcgcggaggaggccaagggggtcggcaagcttcgacactgccggatggccaacctgatcggctactgctgcgacggggacgagcgcctgctcgtcgccgagttcatgcccaacgacacgctcgccaagcacctcttccactgggaaaaccagacacttgaatgggctatgcgtctaagagttgcatactacatcgctgaagcactggagtattgcagctctgagggaaggcctttgtatcacgatctaaattcatacagggttctctttgatgagaatggtgatcctcgtctttcatgctttggcctcatgaaaaacagcagggacgggaaaagttatagcacaaatcttgcatacacacctccagaatatttaagaaatggaagagttacatcggaaagtatcatatacagttatggcactatacttct

SEQ ID NO: 23371 - protein, 260 aa, Panicum virgatum
  misc_feature: Ceres CLONE 1827410
  misc_feature: SWISSPROT Homolog: EC 2.7.11.1 Non-specific serine/threonine protein kinase
MGCCRSSLRTGTLPVKKPPGRAAGALPPHRPSLSLNQHQARPPSAARAGAAGREVPAVKEFSLEELRAATGGFAPENIVSESGDKAPNFVYKGRLEASRRAIAVKKFTKMAWPDAKQFAEEAKGVGKLRHCRMANLIGYCCDGDERLLVAEFMPNDTLAKHLFHWENQTLEWAMRLRVAYYIAEALEYCSSEGRPLYHDLNSYRVLFDENGDPRLSCFGLMKNSRDGKSYSTNLAYTPPEYLRNGRVTSESIIYSYGTIL

SEQ ID NO: 23372 - DNA, 569 bp, Panicum virgatum
  misc_feature: Ceres CLONE 1827410-R
attacagggatgatgaagggactaatgagctgtcgttccaggaatggacacagcagatgagggacatgttggaggctaggaaacgtggagactttgcttttcgtgataaagatttcaaggcagccatagactgttatacacaatttgttgatgtggggacgatggtatcaccaacagtgttcgcgaggcggagcctgtgccacctcatgtccgaccagcctgatgccgccctccgtgatgcaatgcaggcgcaatgcgtgtaccctgattggcccaccgcgttctacatgcaggccgtcgccctctcgaagctgaacatgcagagcgacgccatggacatgctgaatgaggcttcgcagctcgaagagaagcggcagaagaacaccaaaccttgaaagtccagtcagctcggcgtccctcctccggctccataggtggtttatgttgagacatgctactcggtgcttcctaaaagttgtggttagctcctgttccctgggtttggggatgtaattggatggatggtgtgctgtagagttagtcctgtgattgttaatacccggtttggc

SEQ ID NO: 23373 - DNA, 655 bp, Panicum virgatum
  misc_feature: Ceres CLONE 1827456
  misc_feature: Encodes the peptide sequence at SEQ ID NO. 23374
ctcgtatgcttcgcgcgtgcacgcgggtcggcggcggcggcgtgggcgccggcggccggcgaggaggagccctcatggcctccctcatccacttcctcccttcctccgcctactactcctcccatctcccgcccaagccccagccccagccccagccgcggccagctcccactcccgctcacgccgccgccgccgcggcgcgcccgtcccggctccgcctcctgttcgcgcgcgccgccgcgcggcgcgacccggagcctctgccgttcccgacggaggcgcctccggatcccgcggtcggggagaggaggtcgctggcggtgaggacgggggagctcttcctcgggctggcggcgctgctgctgcgcgggaccggggccgtgcgcgggggcgggggcggcggggcggcggcggtggaggaggtggaggcgagggacggggtggtgtgggagcagcggcccgaggacgtggaggccgagcggcggcggcgggagctcaccagccccgggttcagcttctccgcggctgggttgctcttcccctaccacctaggcgtcgcgcagtgcctcatggacaaaggctacatcactgagagaactccgttagctggctcatcagctggtgccataatctgtgcagtgattgcatctggaaa

SEQ ID NO: 23374 - protein, 193 aa, Panicum virgatum
  misc_feature: Ceres CLONE 1827456
  misc_feature: SWISSPROT Homolog: EC 3.1.1.3 Triacylglycerol lipase
MASLIHFLPSSAYYSSHLPPKPQPQPQPRPAPTPAHAAAAAARPSRLRLLFARAAARRDPEPLPFPTEAPPDPAVGERRSLAVRTGELFLGLAALLLRGTGAVRGGGGGGAAAVEEVEARDGVVWEQRPEDVEAERRRRELTSPGFSFSAAGLLFPYHLGVAQCLMDKGYITERTPLAGSSAGAIICAVIASG

SEQ ID NO: 23375 - DNA, 690 bp, Panicum virgatum
  misc_feature: Ceres CLONE 1827469
  misc_feature: Encodes the peptide sequence at SEQ ID NO. 23376
gccatcatccccagtctccacgcgcttctcgccaagtcctcctccccgcctcccacgccgcctcaccgcgcgctaggtagcttgcttcgaatcccacatccccatccgcttctcgccatgggcgccgccgcggacaaccacgaggaggagtcgagcccgctcctcccagctgcggtcggccccgccatccccgcggacgagaagcccccgcaggcgccggcgccgtctccggaggccgccaagctctacgccgatggggtccccgtcgtgatgggcgagccggtcgcggcgcacgccatcccgcaggagagctggagctccgggatcctctcctgcctcggccgcaacgacgagttctgcagcagcgacgtcgaagtgtgtcttcttggaagcgtagcaccatgcgtgctgtatggcagtaatgttgagaggcttgcggctggacaaagcacttttgcaaacagctgtttgccttacactggtctctatatgcttggaaactccctctttgggtggaactgcctagccccatggttctctcatcccactcgtacagctattcgtcggcgctacaatcttgagggtagctttgaggctttcaccaggcaatgtgggtgctgcggtggtctggtggaggatgaggagaggcgcgagcacctagaggctgcctgtgaccttgcaacccactac

SEQ ID NO: 23376 - protein, 190 aa, Panicum virgatum
  misc_feature: Ceres CLONE 1827469
  misc_feature (66)..(177): Pfam Name: PLAC8 Pfam Description: PLAC8 family
MGAAADNHEEESSPLLPAAVGPAIPADEKPPQAPAPSPEAAKLYADGVPVVMGEPVAAHAIPQESWSSGILSCLGRNDEFCSSDVEVCLLGSVAPCVLYGSNVERLAAGQSTFANSCLPYTGLYMLGNSLFGWNCLAPWFSHPTRTAIRRRYNLEGSFEAFTRQCGCCGGLVEDEERREHLEAACDLATH

SEQ ID NO: 23377 - DNA, 1421 bp, Panicum virgatum
  misc_feature: Ceres CLONE 1827477
  misc_feature: Encodes the peptide sequence at SEQ ID NO. 23378
actccccagtcacctcaccctctcggtcgccggggcggggcgatgagcctcggcagcggcgccgcgccggactcccgcgtggagaccatctcccggctggcgcagtggcgcatcgacaccctgggcccctgctgcttccgccgctccgaccccttcaagctcggcatctggaactggtacctgtcggtcgagaagacccgctccctgtgcatccgcctcttcccggagcccggccgggtggccaaggagcagccccctctcgcgcgcttcctgctccgcgtctcctggcccggcccgccgcgccgctcctgcgcatcccctgtgcaagagcagcttctccgaaccagtgatgactttgtatggcaagttgatgccatgtcccatgggcgtttcacaatcgatgttgagtttctagacctgaggatagccactaacaatgctaccgaatcatcttcgtcaatctggccgaatgaaggaatggtgcagagaattgctggtaacagcactctgggatgcctttcccgcatgctgacagagtcaatccacacggacgtgaccatcaacacgactgatggcgtcctcaaggcccacaaggctgtgctggcagcttgctctcccgtgtttgagagcatgttcgtgcacgacctcaaggagaaggagtcgtccacggtgagcatcaacgacatgtgcctggagtcgtgctcggcacttctgggcttcatctacgggacgatcaagcaggaacagttctggaagcaccggctgtcgctgctggcagcggcgaacaagtacggcatcggcgacatcaaggactgctgcgaggagagcctgctggaggacatcaactcgagcaacgtcctggagcggctccacgtggcgtggctgtaccagctggggaggctgaagaaagggtgcctcagctacctgtttgtgtttgggaagatttacgacgtgagggatgagatccatagcttcttccaccacgcggaccgcgagctgatggtggagatgttccaggaggtgctcagtgtctggaagcccatatgaaatgactgaggcgtcggaccggacctggcggaccctctggctacaagcatcgtgcttccatttaaagtaatgtgtagaggaagctggctctgtcaatatctatgtatttatttgttgagtgtgtactatattggaaaggttgcttggaatttgaagggccgtcaaggtatccggcgtgaattgaggtaggtcactaggtcagggatgtgtgtgcataacaatccacgcggttatcctacatgtttgattggaagaagtaagcaatgcatgttgtggcgtgctgtgatgtatgcctgcctgtctgtctgtatatgactgctatctagaagcgtgtactcgagaatgaatgaatatgaattggtcttgttgtagac

SEQ ID NO: 23378 - protein, 334 aa, Panicum virgatum
  misc_feature: Ceres CLONE 1827477
  misc_feature (159)..(267): Pfam Name: BTB Pfam Description: BTB/POZ domain
MSLGSGAAPDSRVETISRLAQWRIDTLGPCCFRRSDPFKLGIWNWYLSVEKTRSLCIRLFPEPGRVAKEQPPLARFLLRVSWPGPPRRSCASPVQEQLLRTSDDFVWQVDAMSHGRFTIDVEFLDLRIATNNATESSSSIWPNEGMVQRIAGNSTLGCLSRMLTESIHTDVTINTTDGVLKAHKAVLAACSPVFESMFVHDLKEKESSTVSINDMCLESCSALLGFIYGTIKQEQFWKHRLSLLAAANKYGIGDIKDCCEESLLEDINSSNVLERLHVAWLYQLGRLKKGCLSYLFVFGKIYDVRDEIHSFFHHADRELMVEMFQEVLSVWKPI

SEQ ID NO: 23379 - DNA, 672 bp, Panicum virgatum
  misc_feature: Ceres CLONE 1827492
  misc_feature: Encodes the peptide sequence at SEQ ID NO. 23380
atggtcatagcctgcccccgcctgctctgctcctgctgctgcccccgagacgaatccgagcccgtcagccaagagacgccgtcggcgatggcgccccctgccgccaccaccggcagcgacgaccggaacactgacagcaccaccaccgtcacgcaccgcaccgtggaggtgggccccggcgtgcgcctgcacgtggcggaggccggcccggccggcgcgcccacggtgctgctgctccacggcttcccggagctgtggtacacctggcgccaccagatgcgcgcgctggccgcggcgggctaccgcgccgtggcacccgacctgcgcggctacggcggctccgacgcgcccgcgctcgacgacgccgggcagtacacggcgctgcacgtggtgggcgacctggtggcgctcatcgacgccctcggcgagaagcgggtgttcgtggccgcgcacgactggggggcgctcatggcgtggagcctctgcctgttccgccccgacagggtgcgcgcgctcgtcgcgctcagcgtcgcctacacgccccggagcgccgcgcggaggcctatcgacgggctcagggcgctcttcggcgacgactactacatctgccggatccaggagcctggagcagttgaagctgaattcgaacgccttggcacggagctggtactc

SEQ ID NO: 23380 - protein, 194 aa, Panicum virgatum
  misc_feature: Ceres CLONE 1827492
  misc_feature: SWISSPROT Homolog: EC 3.3.2.10 Soluble epoxide hydrolase
MAPPAATTGSDDRNTDSTTTVTHRTVEVGPGVRLHVAEAGPAGAPTVLLLHGFPELWYTWRHQMRALAAAGYRAVAPDLRGYGGSDAPALDDAGQYTALHVVGDLVALIDALGEKRVFVAAHDWGALMAWSLCLFRPDRVRALVALSVAYTPRSAARRPIDGLRALFGDDYYICRIQEPGAVEAEFERLGTELV

SEQ ID NO: 23381 - DNA, 1743 bp, Panicum virgatum
  misc_feature: Ceres CLONE 1827498
  misc_feature: Encodes the peptide sequence at SEQ ID NO. 23382
aaaagcaaagcaccaaaactcaacacaacacgcacacaccacacacggtacaaaagaaaaaaatcaagtcgaagatgagcaacagcataatgctgtcatcactccccatctgtgctgccttccggtccaaaagcaactccaagtacctgaggtcctgtgccaaccatggcgagggggccgacggccgtgtccttcagctgaccggtgacgatgctgagaacccgctcacgaggttcttcgtcgagaaatcgtgcaagcacaatgggctctttcatatcaggtgcggctacaacaagtactgggtcgctgagaagcggcaaggtgatgaatggtggatcgctggcagtgccgacaagcccgaggaggacctgtccgagttgtcatgcacactgttccagctcaaacctgtcaaggaagatcctaagaccatcaggttttaccatgctcggcttgggaaatattttggcattctctccaattctaatggggaaaacgagaccgacaaagcccttctgcaggcagttgatgaagagcaatcagaacaatttgtgactgagttgttccaatacttgttgcctaaatacgtatgtttcaagggagataatggcaagtacctcagtgcacaatcgctacacaacccagttctggtctttgaatccgagaatatcaaagatccaactgtgatgcacactatcacgccaaatagagatggcaccatgaggataaaatctgatcatttcgacggtttctggaggaactctgatagcaccaacttagggccctggatacttgcagactctagtgataccaacaacgatgacccaaacacattattccaagcgtggtatactggcggagcatttaggcttctcaacctgggaagcaatcagtattgcaagaggctcacaatgtcaaacttggagcacggcctttctgctacaggaacccggcttgagccctggtctaggttgcagattgaagagccagtgctctcccggaagattactgccttcctaaggtcagagaatgccgtaatctttggcgagaaactcctaaatcttgctactgcatcagtcaccaacaatacctcatcggtcatgccccgcgtgaagctcaccttggattacactttgatggagatgaaggcatggcaatccaagctgcacttcaagtctccagttccaaccctgatcatctctgaaaacgtgtacatgcagtatggtttcattgcagtgtcaccgatgttctttaatgggcccattagctggggagcaagcaatgtgaagagcttcaaggtgactgaagagcgcttcattgatgttccaccaatgaccaagatgacaataacctgcatgggagtaacgagcaactatgaattgcccttctcataccggcagaccgacgaactagtagatggagagacggtcacccttcagtatgatgacggcctctacaccggtcggaatgtccacagcttcatctacgataccaaagaagaaaaaattgatcagtaatgcgaatttgcaattcgagctatctataaatctacgtatgtatctaatcaataagagcctgcaccatgggtagacgtaagatgaataaggcttagttgccaaagtgtcagaattctatatgtatagcgcatattttgtttctttctttttttatctccatttttaaacctattcgatcagtggacagagttgtccgaatcgttttatgaattcttactggtaaaaattg

SEQ ID NO: 23382 - protein, 479 aa, Panicum virgatum
  misc_feature: Ceres CLONE 1827498
  misc_feature (165)..(303): Pfam Name: Agglutinin Pfam Description: Agglutinin
  misc_feature (8)..(151): Pfam Name: Agglutinin Pfam Description: Agglutinin
MSNSIMLSSLPICAAFRSKSNSKYLRSCANHGEGADGRVLQLTGDDAENPLTRFFVEKSCKHNGLFHIRCGYNKYWVAEKRQGDEWWIAGSADKPEEDLSELSCTLFQLKPVKEDPKTIRFYHARLGKYFGILSNSNGENETDKALLQAVDEEQSEQFVTELFQYLLPKYVCFKGDNGKYLSAQSLHNPVLVFESENIKDPTVMHTITPNRDGTMRIKSDHFDGFWRNSDSTNLGPWILADSSDTNNDDPNTLFQAWYTGGAFRLLNLGSNQYCKRLTMSNLEHGLSATGTRLEPWSRLQIEEPVLSRKITAFLRSENAVIFGEKLLNLATASVTNNTSSVMPRVKLTLDYTLMEMKAWQSKLHFKSPVPTLIISENVYMQYGFIAVSPMFFNGPISWGASNVKSFKVTEERFIDVPPMTKMTITCMGVTSNYELPFSYRQTDELVDGETVTLQYDDGLYTGRNVHSFIYDTKEEKIDQ

SEQ ID NO: 23383 - DNA, 1426 bp, Panicum virgatum
  misc_feature: Ceres CLONE 1827518
  misc_feature: Encodes the peptide sequence at SEQ ID NO. 23384
aagatgatcaactctccactgctcctttccttttcttcttgttcggttgttcacttgttcttagagacgaaattagatgatttctttctaaaggtgttttttgtatgaggtgattcaaaggaaggatggctctcaagaagctgctgcagctgttttgtgtcagtaagaaggattcaaagaagaaaggaaaatccattgatccactttggcaagcatctgctccgcactcgtctttgagtgtcactgcaaataagagtcatttggatccttgttcaagtagacatgaatgctcaagtatgatttcatcattggcaaggactgaacatggaactgggagtaacgattacatgtcatttaaccaattcgatgttgttcaagatttctctgatcaccactatgcaaaaacatcaccaggaaaggccaccaaagattgggtgaaggcaatccaaagtgaatggagtcttctacagaaaaatctacctgagtctatatatgttagagtttatgaggacaggatcgatctgctcagggctgctatagttgggccagctggaactccatatcatgatggattgttcttctttgatgtccgttttccttctgaatacccaaaatgcccaccgaaagttcattaccattcaggtggacttcggttgaatccgaacctgtatgagagcggaaaagtttgcttgagccttctgaatacctggtggggtaatggatgcgagaagtggggcaagtcaaattcaaccatgctgcaggtgctggtctccattcagggccttgtgctgaatgataagccatacttcaatgagcctggaaacaaaaattctgctaaaacaacagctggtgaaaagaattccttggtttacaatcagacggcctttgtgctgtcctgcaagacaatgttatattcactccgaaagcctccaaagcattttgagacccttgttgcaggacactttcacgagcgtgagcatgccttcctcgacgcgtgcagcgcttacatgtctgggacagttgtcggatcatcagctggaagcggcgccagatatgactgtgccaagtgctttgcagatttcaaaaagtcgctgacgctgtacactgaacatctcaggaccgagtttgctgctaacagaagtcgcttgctggaactggaaagaaaggcatcacctgtgggtgagatagtgcctaccagctagaattctttcttcagaacaacacctgaccattgcatttcaccttccgaagtcctaattgaaaggtgaaatggtgtaataggtcacaattcaaacgcttaaatatagtgcacagtgtagaaaaggctttggtatctggtacaagagttgttcttgtcagatattacctatttcaggtgatgggtcatctatttaattctatagaaaaattagactcattatgtgcc

SEQ ID NO: 23384 - protein, 358 aa, Panicum virgatum
  misc_feature: Ceres CLONE 1827518
  misc_feature (106)..(255): Pfam Name: UQ_con Pfam Description: Ubiquitin-conjugating enzyme
  misc_feature: SWISSPROT Homolog: EC 6.3.2.19 Ubiquitin--protein ligase
MALKKLLQLFCVSKKDSKKKGKSIDPLWQASAPHSSLSVTANKSHLDPCSSRHECSSMISSLARTEHGTGSNDYMSFNQFDVVQDFSDHHYAKTSPGKATKDWVKAIQSEWSLLQKNLPESIYVRVYEDRIDLLRAAIVGPAGTPYHDGLFFFDVRFPSEYPKCPPKVHYHSGGLRLNPNLYESGKVCLSLLNTWWGNGCEKWGKSNSTMLQVLVSIQGLVLNDKPYFNEPGNKNSAKTTAGEKNSLVYNQTAFVLSCKTMLYSLRKPPKHFETLVAGHFHEREHAFLDACSAYMSGTVVGSSAGSGARYDCAKCFADFKKSLTLYTEHLRTEFAANRSRLLELERKASPVGEIVPTS

SEQ ID NO: 23385 - DNA, 1140 bp, Panicum virgatum
  misc_feature: Ceres CLONE 1827526
  misc_feature: Encodes the peptide sequence at SEQ ID NO. 23386
acttcactgcccagagcccagcgccgagcatcatccactgcaggaactcgctagagaccgagcccagatcgagggcgcaagggcgcaggcgcagccgaggagggaagacgacccgctccaggcgcagggcgacacggcccagctgctgggccagggccaggacccgcagcaggcggccatcaggtacggccacgtgttcgccgtgacgggcgacctcgcggggcagcccatcgcgccgcgcgacgcggccgccatgcggtctgccgaggacagcgtgccgggcgtccaggttccggagggcgccggcggcggcttccgcgccgcgaccgccatggagacggccgcggcatacgaggccgtcggggccgtgcaccccggccaggccagcggcgccgccgccgcgcagggaatcatcgtcccccagaccgccgtgccggggggccgcgtcgtcacggagttcgtcgcgggccaggtcgtggggcagtactccgtggcggacccgccgccggccgcggaggaggacgccaccaagatcaccatcggcgaggcgctggaggcgacggcgagggcgggggccgggcgccccgtcgaccgcgccgacgcggaggccatccgcgccgcggagatgagcgcgcacggggcggacgtcgccatgcccggcggcctcggcgaccaggcacgggccgcggcgcgcgccaacgcccaggccacgcgcgacggcggcaaggtcaagatcggcgacctcctctcggacgcgacggcgaagctggccggagacaaggccgcggcgacggaggacgcgacgagggtggtccaggcggagacgttcaacgacgccgaagcgcacgccagggccggcggggtgggcgcggcggtggccacggcggcgaggctcaacgaagacaacaacctcggcgacgcttgaattttgtcccaagaaccatagtagactgttagatggagcgagcttcaagggtgagagtctgcacgcatgtgtatagctagtttggtactgtaggtgtgtgggggcagaaataaaagtcagttcctgtgatcgatcgtcagttctggcctgacactctgttatgctcagagaatgttgcctcagaaagaatgaaaaaaaatcggttttaccctttc

SEQ ID NO: 23386 - protein, 307 aa, Panicum virgatum
  misc_feature: Ceres CLONE 1827526
  misc_feature (177)..(238): Pfam Name: SMP Pfam Description: Seed maturation protein
  misc_feature (242)..(304): Pfam Name: SMP Pfam Description: Seed maturation protein
  misc_feature (59)..(123): Pfam Name: SMP Pfam Description: Seed maturation protein
LHCPEPSAEHHPLQELARDRAQIEGARAQAQPRREDDPLQAQGDTAQLLGQGQDPQQAAIRYGHVFAVTGDLAGQPIAPRDAAAMRSAEDSVPGVQVPEGAGGGFRAATAMETAAAYEAVGAVHPGQASGAAAAQGIIVPQTAVPGGRVVTEFVAGQVVGQYSVADPPPAAEEDATKITIGEALEATARAGAGRPVDRADAEAIRAAEMSAHGADVAMPGGLGDQARAAARANAQATRDGGKVKIGDLLSDATAKLAGDKAAATEDATRVVQAETFNDAEAHARAGGVGAAVATAARLNEDNNLGDA

SEQ ID NO: 23387 - DNA, 1958 bp, Panicum virgatum
  misc_feature: Ceres CLONE 1827533
  misc_feature: Encodes the peptide sequence at SEQ ID NO. 23388
actctacggcatctgcactttacgttccatcaatctgtttttttttttttttggcgaaaatcctgtctcatatgtctgctacgcttgttgccttccaccaatttgtcaacgcatccacctgagatctgctggtcagcacggacgctcagcttcatcaccttcccaagctcaatcttccccggtccactccatctccaacccccaacaaactccatagactaataccaaatgccaagctcgtgttcaattcctaaatccatttccgaccccatttccatctgagcacgccccgcgctcaagaacttgccaagaaaccatcagtaattcgccaagagaccatgctgaacctggacgaggacgccgccatggatgcggaccgcctcgtcggcgaggagccgggatcgccgtcgcagcagcccggcggcgagcgggcctgggcggcggccgtgctggagccggtgcggtgggtgcggatgctgtgccgggagctgggcgcgacgttcgtggccggggtggtgctggtgtacggcctcagccagggcttcgccggctccttcttcagggtggcgtcggactactattggaaggacgtgcagcgggtgcagccggccaccgtgcagttcctctccgtcttcttctacgtgccgtgggtgctcaagccgctctggggggtcatgaccgatgtcttccccgtccacgggtaccgccgccgcccgtacttcctcttctcaggaatacttggaatagtctcagctactattgttgcaatggctaccggactcccagtgagttctgctgtactttgcttggtgggaatctcaacagcagtcgccattgctgatgtaacgatagatgcttgcatcgcaaagaacagtattgataagccggcgttggctccagacatgcagagtctttgtgcattatcatcatctctaggtgcacttattgggtatgccacaagtggcatgtttgtccaccatcttggggcccagggtgcattaggtgtgatggctatacctccagccacagtggttttccttggattttttatatatgagctgaaaacgtatcaacatagtgttaaagagaaggttttaaataaagttagtggggcagtgaagggaatggttcggactataaagtatccagtagtgtggaaaccatctctttacatgttcctatctctggctctgagtatcagcacccatgaggggcagttctactggtacactaacaagacaccaccaaatcctggattttcacaggagttcgtcgggctggtccacgccatcggcgcggtggcgtccatggtgggcgtgctcatctaccacaagtggctcaaggactacccgttccggagcatcctcttttacgcgcagctcctctacggcgcctccgggctcctggacctcaccttcgtgctccgctggaacctggcgctcggcgtgcccgacgccgccttcgtgaccctggaggagtgcgtctcccgcgtggtgggccgcgtccggctgatgccgatgatggtgctgagcaccaagctgtgcccgcccggcgtggagggcaccttcttcgcgctgctcatgtgcatcgacagcctcggcatgctggcggccaaggccggcggtgccgccgtgctgcgcgcgctgcgcgtgacgagggccgacttcgggcacctctggctcgccgtgctgctcaggaacgtgctcaggctcgccacgctgggggccatctccctcgtgcccacggctgaccagacggacgtgctggtgccgggcgagctcctggcgagctcgccggcggccgtggccgatggcgaggaggagaggctccagctcgcgatgctcacttcccacaccgacgatgtatgacatatgatccacgttgttgtgtacaaaaggaaatgaaaaaacgggcgaattgagcaatggaccatggtcatgcatggctagtgtcacatc

SEQ ID NO: 23388 - protein, 509 aa, Panicum virgatum
  misc_feature: Ceres CLONE 1827533
  misc_feature (67)..(481): Pfam Name: BT1 Pfam Description: BT1 family
MLNLDEDAAMDADRLVGEEPGSPSQQPGGERAWAAAVLEPVRWVRMLCRELGATFVAGVVLVYGLSQGFAGSFFRVASDYYWKDVQRVQPATVQFLSVFFYVPWVLKPLWGVMTDVFPVHGYRRRPYFLFSGILGIVSATIVAMATGLPVSSAVLCLVGISTAVAIADVTIDACIAKNSIDKPALAPDMQSLCALSSSLGALIGYATSGMFVHHLGAQGALGVMAIPPATVVFLGFFIYELKTYQHSVKEKVLNKVSGAVKGMVRTIKYPVVWKPSLYMFLSLALSISTHEGQFYWYTNKTPPNPGFSQEFVGLVHAIGAVASMVGVLIYHKWLKDYPFRSILFYAQLLYGASGLLDLTFVLRWNLALGVPDAAFVTLEECVSRVVGRVRLMPMMVLSTKLCPPGVEGTFFALLMCIDSLGMLAAKAGGAAVLRALRVTRADFGHLWLAVLLRNVLRLATLGAISLVPTADQTDVLVPGELLASSPAAVADGEEERLQLAMLTSHTDDV

SEQ ID NO: 23389 - DNA, 1204 bp, Panicum virgatum
  misc_feature: Ceres CLONE 1827540
  misc_feature: Encodes the peptide sequence at SEQ ID NO. 23390
ccacccaaaaccctcgccgaaatctgagatccatctcggggcccccggcgcggcacgaagccctagcccagggagctcgctccatggcgataatctccgacttccaggacgacgaggcccagccgcggcagcagcaggcggcggcgggcgtcgaggaggccctcgcggcgctgctggagcggagcggcggcgccttgccgttcctccaggcggccgtcggcgtcgcgcaccgccggtccggcctgttccgcgacccgtcggcggtgagcaaggtcaccgcgatggcggcggccgctagggcggaggtggaggccgaggagagggcggccagggaggcgaagaggaaggcggaggaggccgagcggaaggcggcggccgaggcggagaaggcggccaaggccgcggcggctgcggcggagaaaccggagagctcggcggagaaagacggcatggaggtggataaggaggagggcaacgtgagacaaccaaatgctggcaatggccttgacttggagaagtactcgtggactcaacagttgccagaggttaacatctccgttcctgttcctgaaggaacaaaatcaagatttgtggtctgcgatataaagaagaaccatctgaaggttggcctgaagggccagccccctatcattgatggtgagctctataagccagttaaggttgatgactgcttctggagtattgaggatggaaaatcgctgaatatattgcttacaaagcacaaccaaatggagtggtggaagtctctgataaagggcgaccctgaagttgatacccaaaaggtggaaccagagagcagcaaactttctgatttggatccagagactagacaaactgtgtagaagatgatgtttgaccaacgtcagaagcagatgggccttccaacaagtgatgagatgcagaagcaagaaatgctcaagaagttcatggctgagcatcctgatatcgacttctcaggggcgaaaatagcttgaggacaattgaagccaggttggggaaattgtttctacaagtagacggtcgaagccaaaccacctgaggttgcggaaattgtttctacacaagtctatgctggatgatggttcttttgccgccgtttagaagtatacattagaaccgtgacttgtatcccgaacctatctactgggtgttgcataaagtaatgagctgcactattgcctcc

SEQ ID NO: 23390 - protein, 259 aa, Panicum virgatum
  misc_feature: Ceres CLONE 1827540
  misc_feature (144)..(219): Pfam Name: CS Pfam Description: CS domain
MAIISDFQDDEAQPRQQQAAAGVEEALAALLERSGGALPFLQAAVGVAHRRSGLFRDPSAVSKVTAMAAAARAEVEAEERAAREAKRKAEEAERKAAAEAEKAAKAAAAAAEKPESSAEKDGMEVDKEEGNVRQPNAGNGLDLEKYSWTQQLPEVNISVPVPEGTKSRFVVCDIKKNHLKVGLKGQPPIIDGELYKPVKVDDCFWSIEDGKSLNILLTKHNQMEWWKSLIKGDPEVDTQKVEPESSKLSDLDPETRQTV

SEQ ID NO: 23391 - DNA, 1111 bp, Panicum virgatum
  misc_feature: Ceres CLONE 1827547
  misc_feature: Encodes the peptide sequence at SEQ ID NO. 23392
atccggcatccgctgaccgccgccgctctaagctagcaggcccagaccgcatcgccacagcttcgtcgcctcctcacgtggggggcaacgcctgccggcgcacctcctctcgagccgcctgcgcagggagccagaaaagggctggcggcatctgctcgacccgccggccgcgcctcctcccggccgccggccttcgcccccccacagcggccggcgacggctccagcgcccttgcgagttgcggcgcttgttgaaggagaggccaggaacaaagaagtctacgcctgacggtggagagccgagatccgttgatttccccaccattgtactccacggccggcgcagggatgcagaaccccgcgacgcccgccccggcggcggccccgtccaagggcaagtcggcggcgcagaaccctagcgggcaccacgccgcgacgaccgccccgtcggggacgccgtccaagggcaagtcggcggcggcgcaggccgcggccgcgggccagggccagggctcctcctcgcatcaccactccgccgccggcggcgccggcgccggcgccgacgcgtccgcccccaccctcaagcgcaagcgcggcgtcttccagaaagacctgcagcacaggatgtatggatttggggacgatccaaatccacttccagaaacagttgcacttgtggaggacattgttgtcgaatatgtcaccgatctggtccacaaggcgcagaatgttgcctcaaagagggggaagctgctgacagaggattttctttaccttatacgcaaggatttacggaaactgcaccgtgctactgaactactctccatgaatgaagagctcaagcaagcaaggaaagcttttgacgtggatgaagagacgctagctacaaatgccatttgatatcttcccggaagcctcagaaaccttcatacaatatgcattagttttcctttcagctgtttctgctgaaaagaatttataatgatggtttttgagggcttttgccttgtactgaccaaactatcaaatcgttcttgttgccgatacttaacagttgatacgtactgacaacaattcacctgtgcattcctggtttcaaacttcagaaagcg

SEQ ID NO: 23392 - protein, 183 aa, Panicum virgatum
  misc_feature: Ceres CLONE 1827547
  misc_feature (83)..(173): Pfam Name: TFIID-18kDa Pfam Description: Transcription initiation factor IID, 18kD subunit
MQNPATPAPAAAPSKGKSAAQNPSGHHAATTAPSGTPSKGKSAAAQAAAAGQGQGSSSHHHSAAGGAGAGADASAPTLKRKRGVFQKDLQHRMYGFGDDPNPLPETVALVEDIVVEYVTDLVHKAQNVASKRGKLLTEDFLYLIRKDLRKLHRATELLSMNEELKQARKAFDVDEETLATNAI

SEQ ID NO: 23393 - DNA, 674 bp, Panicum virgatum
  misc_feature: Ceres CLONE 1827550
  misc_feature: Encodes the peptide sequence at SEQ ID NO. 23394
accacccccgcctgcgcagcagcggcgtcacactcggctcccctccctcaatcgctctcgctcctcggcctcggcccccgcctgcttcgccggggagaggaggaggcaatggcggcgggcgggaacggcgcggccggcggcggcgccgacacgaaggcggcgttcgcgcagatctacaagacgctcaaggaggagctgctcgccgaccccgccttcgagttcaccgccgaggcgcaccagtggatcgaccgcatgattgactacaatgtacttggaggaaagtgcaaccgtgggctctctgtggttgacagctacaagctgttgaagggtgctgatgttctgggcgaggaggagttgtttcttgcttccactcttggctggtgcattgaatggcttcaagcttactttctggtgcttgatgacatcatggatgactcccacactcgccgaggccagccatgttggttcagggtgcctcatgttggcttcattgctgtgaatgatgggattatccttcgcaaccatatttcaaggatcctgcggcaccaatttaagggcaaaccttactacgctgatctccttgatttattcaatgaggttgagttcaagacagcttcaggacagctgcttgaccttatcacaactcatgagggagaacaagatttaacaaagta

SEQ ID NO: 23394 - protein, 188 aa, Panicum virgatum
  misc_feature: Ceres CLONE 1827550
  misc_feature (45)..(188): Pfam Name: polyprenyl_synt Pfam Description: Polyprenyl synthetase
  misc_feature: SWISSPROT Homolog: EC 2.5.1.67 Chrysanthemyl diphosphate synthase
  misc_feature: Useful for making plants with modulated salt sensitivity
MAAGGNGAAGGGADTKAAFAQIYKTLKEELLADPAFEFTAEAHQWIDRMIDYNVLGGKCNRGLSVVDSYKLLKGADVLGEEELFLASTLGWCIEWLQAYFLVLDDIMDDSHTRRGQPCWFRVPHVGFIAVNDGIILRNHISRILRHQFKGKPYYADLLDLFNEVEFKTASGQLLDLITTHEGEQDLTK

SEQ ID NO: 23395 - DNA, 698 bp, Panicum virgatum
  misc_feature: Ceres CLONE 1827574
  misc_feature: Encodes the peptide sequence at SEQ ID NO. 23396
aaactggcttcagcgtctccaatccctgtctttcgatctcccgatcccgccaccggaggcgatggcggcggcgccagtggtaaggtttccggtcttcggcctcgtgcggctgctgggcttggccgccgcggctggcatccttttctgggccgtccactaccgcggcggcatggccctgtccaccgacgaggagagcaagttcccgattttcaacgttcaccctgtgctgatgctgattggtttggtagccttgaatggtgaagctcttttggcctataaaaccgtgccaggaaccaaaaaattgaaaaagctagtgcaccttgccctgcagttccttgccatgtttttgtgtctaattggtctctgggctgtctggaagttccacgatgaaagaaaaatcgatcacttatatacacttcactcatggatgggactcacttgcatcatcttcttcagcttgcagtgggctactggattttggaccttttggtatcctggtggatcaagaagtggccgtgcatctctccttccctggcatgtcttcttcggtatattcatctatgctcttgctatcgccacaagtgtgagcggactcctagagaagtcgatctttatgcagagcgccaaaatgattgggcgcttctccaaagaagccatgtttatgaactcgctggggatgctactgctggtactgggcg

SEQ ID NO: 23396 - protein, 212 aa, Panicum virgatum
  misc_feature: Ceres CLONE 1827574
  misc_feature (11)..(212): Pfam Name: Cytochrom_B561 Pfam Description: Cytochrome b561
MAAAPVVRFPVFGLVRLLGLAAAAGILFWAVHYRGGMALSTDEESKFPIFNVHPVLMLIGLVALNGEALLAYKTVPGTKKLKKLVHLALQFLAMFLCLIGLWAVWKFHDERKIDHLYTLHSWMGLTCIIFFSLQWATGFWTFWYPGGSRSGRASLLPWHVFFGIFIYALAIATSVSGLLEKSIFMQSAKMIGRFSKEAMFMNSLGMLLLVLG

SEQ ID NO: 23397 - DNA, 669 bp, Panicum virgatum
  misc_feature: Ceres CLONE 1827577
  misc_feature: Encodes the peptide sequence at SEQ ID NO. 23398
tacccattttctgctctctctgatccagccaagctgtataatgatcttagatggaatattagtagaccacagggttttgaggctgtcatgcgcgtcaggtgtagtcaggggcttcaagttcaagactactttggcaatttctgcaagcgtgttcctactgatatcgatcttcctgcgattgactcagacaaagctataatggttacatttaagcacgatgacaaattgcaggagaattcagaatgtgctttccagtgcgcacttctttacacgacagtttttgggcaaagaaggatacgggtcataaacctttccctttcatgcacaaatatgctcagtaaccttttccgatatgctgatctggaaacacaattcacatatgtagtaaagcaagctgcaaaaggcattccatcattacctctttctcaagttagggaccaagtaacaagtacatgtatcaatatcctccagtcgtaccgaaagtattgtgcatctgtaagttcttctgggcaattgattcttccggaggctctgaaacttctaccattgtatactctagctttaactaaaagtgtgggattgcgcaatgatgggagattggatgatcggtcctattggacctctattgtatcttcaatttctgtgttattagctattccgttggtgttt

SEQ ID NO: 23398 - protein, 222 aa, Panicum virgatum
  misc_feature: Ceres CLONE 1827577
  misc_feature (25)..(109): Pfam Name: Sec23_BS Pfam Description: Sec23/Sec24 beta-sandwich domain
  misc_feature (121)..(222): Pfam Name: Sec23_helical Pfam Description: Sec23/Sec24 helical domain
YPFSALSDPAKLYNDLRWNISRPQGFEAVMRVRCSQGLQVQDYFGNFCKRVPTDIDLPAIDSDKAIMVTFKHDDKLQENSECAFQCALLYTTVFGQRRIRVINLSLSCTNMLSNLFRYADLETQFTYVVKQAAKGIPSLPLSQVRDQVTSTCINILQSYRKYCASVSSSGQLILPEALKLLPLYTLALTKSVGLRNDGRLDDRSYWTSIVSSISVLLAIPLV

SEQ ID NO: 23399 - DNA, 1474 bp, Panicum virgatum
  misc_feature: Ceres CLONE 1827583
  misc_feature: Encodes the peptide sequence at SEQ ID NO. 23400
gccgcacctcacaaactcacattttcctctccttctctctcgcgccccgacctgctccaggcctatcccactagctaattctagctagcaacaggagccatggacgccatgggcttgccatgggcagcgcagtgcgcgggcatggccttctcagccttgtccctctgcttggttgcgctggccgccgtgctcctgctcgtgcgccggtggccgtggtgcagctgccatgtctgccgggcgtacctgacggggtcctgggcgagggacttccccaacctcggcgactggtacgcgcacctgctccgggagtcccccaccggcaccgtccacgtccacgtcctcggctgcaccatcaccgccaacccggccaacgtcgagtacatgctcaagaccaacttcgacaccatctgcaaaatctccttcggcctcgacccgggctgcctcgagcgggaaatgcccatgtccaagctcgccgacgccttcgacacggcgacgcggctctgcgccatgcgcggcgccgcagcgtcgccgctgctctggaggatgaagcgcctgctcaacgtcgggtccgagcgggagctcaggaaggccatcaggctcgtcgacgagctcgcggccgccatgatccgggagcgccggaagctgggcgtcgccagcagccatgacctcctgtcccggttcatggcctcggccggcggcgacgcccacgccgtgttcgacaagtacctccgcgacatcgtggtcagcttcctcctcgccgggcgcgacacggtgtcctccgcgctcaccacgctcttcatgctcctgtccaagcacccggaggtggcggccgccatgcgcgccgaggccggggacggcgactcgacgccggtcacctacgagcacctcaagggcctgcactacacccacgcggtgctgtacgagaacatgcgcctgttcccgcccgtgcagttcgactccaagttctgcgccgggcccgacgtgctccccgacggcacctacgtctccggtggggcgcgcgtgatgtaccacccctacgccatgggccgcatgcccagcatctggggcgccgaccatggcgacttccgcccggaccggtggctcaccggacccggccgctccttcgtgccggagagcctgtacaggtaccccgtgttccaggcgggcctccgcgtgtgcctcggcaaggagctcgcggtcaccgagatgaaggcggtgggcgtggcggtggtgagggcgttcgacgtcgaggtggtcggggagagtggcagcggcgcctgcgccccaaagttcgtgtcggggctcaccgcgtccatcagcggcgggctcccagtcaggattagaagagttagaaattagagattcaaggtttcagagaaaagaggttagatagagtgttgtttcgcgaaaacggctatgaaatgtacatagactaattaaacgaacaagggaatgaaaatagctagttgaatcg

SEQ ID NO: 23400 - protein, 419 aa, Panicum virgatum
  misc_feature: Ceres CLONE 1827583
  misc_feature (4)..(412): Pfam Name: p450 Pfam Description: Cytochrome P450
  misc_feature: SWISSPROT Homolog: EC 1.14.13.98 Cholesterol 24-hydroxylase
MDAMGLPWAAQCAGMAFSALSLCLVALAAVLLLVRRWPWCSCHVCRAYLTGSWARDFPNLGDWYAHLLRESPTGTVHVHVLGCTITANPANVEYMLKTNFDTICKISFGLDPGCLEREMPMSKLADAFDTATRLCAMRGAAASPLLWRMKRLLNVGSERELRKAIRLVDELAAAMIRERRKLGVASSHDLLSRFMASAGGDAHAVFDKYLRDIVVSFLLAGRDTVSSALTTLFMLLSKHPEVAAAMRAEAGDGDSTPVTYEHLKGLHYTHAVLYENMRLFPPVQFDSKFCAGPDVLPDGTYVSGGARVMYHPYAMGRMPSIWGADHGDFRPDRWLTGPGRSFVPESLYRYPVFQAGLRVCLGKELAVTEMKAVGVAVVRAFDVEVVGESGSGACAPKFVSGLTASISGGLPVRIRRVRN

SEQ ID NO: 23401 - DNA, 697 bp, Panicum virgatum
  misc_feature: Ceres CLONE 1827591
  misc_feature: Encodes the peptide sequence at SEQ ID NO. 23402
agcgtcagatcggcggccgtcgcgcgccaagcccgagcctagagccgctgctcgtcccgccacccagccccgacctctgaggaacagcgaggtccttgcggatcgggatcgcgccgcggcggcgggacgaccccatgggcgaggaggccaagtacctggagacggcgcgggccgaccgctccgtgtggctcatgaagtgccccccggtcgtctcccgcgcctgggaggcagcctccgcctccgcctccgcctcgttctcctccgacgccgccaaccccaaccccgtcgtcgccaaggtcgtcctctccctcgacctgctcagcaacgaggagccttccctccagttcaagatggagttggctcaaactaacactggcaatacacctaaaagctactctttaaatatgttccaagatttcgtgcccatgtgtgttttctccgaatctaaccaagggaaactttcatgtgaaggaaaagttgagcataaatttgacatggaacctcacagtgataatttggtgaactatggaaagttatgccgtgaaagaacacagaaatacatggttaaatctagacaagtgcaggtacttgacaatgaccacggcatgagcatgagaccaatgcctggcatggttggtttaataccttctgggtcaaaggagaagaagaagcaaacaccagccaaatcatctgatgt

SEQ ID NO: 23402 - protein, 187 aa, Panicum virgatum
  misc_feature: Ceres CLONE 1827591
  misc_feature: Useful for making plants with altered lignin content
MGEEAKYLETARADRSVWLMKCPPVVSRAWEAASASASASFSSDAANPNPVVAKVVLSLDLLSNEEPSLQFKMELAQTNTGNTPKSYSLNMFQDFVPMCVFSESNQGKLSCEGKVEHKFDMEPHSDNLVNYGKLCRERTQKYMVKSRQVQVLDNDHGMSMRPMPGMVGLIPSGSKEKKKQTPAKSSD

SEQ ID NO: 23403 - DNA, 606 bp, Panicum virgatum
  misc_feature: Ceres CLONE 1827593
  misc_feature: Encodes the peptide sequence at SEQ ID NO. 23404
aaacccaacgctcgcccccacgtacagatcgcacccgagccaaccaagccaacacgatcatcgaccgcctgatccacacgggatatacacatcaccaggagccagcacccggcctgcatcccgaccaaagccaagtacgctaccaccactgctgcaccgcaccgaccgagggtgcaacggcagcagcagccgaagagccgagcgtgtagcagctagcagatggtgtccctgcagtcggcgctcctaccggaggccagcaagcggccgccgtgcctctccctcgtgggcagcgccgccgtcgcctccaccgccaccagcaagaagcggaagcgggacggcggcggcgacgacgaccgcgacaacagccgcggcgaggtcgtggacgggatcgagctcaatttcgacgccgcgccgctgccccccgagtggcaacgctgcctcgacatcaagtcggggcagatccactactacaacacgaggacgcagaagcggacgtggaaggaccccagaggcgagccggactaccgcgccgctccggccgccgccgccgacgaggaggaggactccgcgaattgcgcgccgccggggctggacctggagctgaaa

SEQ ID NO: 23404 - protein, 128 aa, Panicum virgatum
  misc_feature: Ceres CLONE 1827593
  misc_feature (66)..(96): Pfam Name: WW Pfam Description: WW domain
  misc_feature: SWISSPROT Homolog: EC 5.2.1.8 Peptidylprolyl isomerase
MVSLQSALLPEASKRPPCLSLVGSAAVASTATSKKRKRDGGGDDDRDNSRGEVVDGIELNFDAAPLPPEWQRCLDIKSGQIHYYNTRTQKRTWKDPRGEPDYRAAPAAAADEEEDSANCAPPGLDLEL

SEQ ID NO: 23405 - DNA, 1384 bp, Panicum virgatum
  misc_feature: Ceres CLONE 1827596
  misc_feature: Encodes the peptide sequence at SEQ ID NO. 23406
atagcacagacttcctccccactcttgtaataatcttgctagaaatatatatcgtgcttgcagcaatccctgccatggctgcacctgctgacaccggcgccgctacagcagcagcatcaaccctagttcctcctcggcttgccacgcctcacggcgacctggccgagatcctcccttccctccccctcgagacgcggtgcctgccatcgttccatctccgctgctacaagggtttttggctgtccgagaaagccctcaccgggtacttcccagccatccacgcccacttcgagcccaggcccgacgacatctttctagccagcttccccaagtccggcaccacgttgctcaaggccctcgccttcgcgacgttgaaccgggccgcgcacccgccatccgacgccgatcacccactccgccggcgcaacccccacagctgcgtgaggttcctcggggcgagcggtgccgacgacacagaagatgagccggcggcggcgctccgctctccgcgcgtgctcgccacccacttgccctactccttgctgccggagcgcatcaggggaggccgaggggaggggtcgaggatcgtgtacatctgtcggaaccccaaagatgtgctggtctccggatggctcttcaccaagaaaacatcagcgatgttcgggctggacgtgcagtcgtacaccctccaggaggcgttcgatctcttctgcgagggtcgctgcatcaatggcccgcactggcagcacgccctcgagtactgggaggaaagcttcaggaggccgggcaaggtgctgttcctcaggtacgaggagatgctgcgcgagcccgcgagcagcttgaggaagctggcggagttcatggggtgcgcgttctccgaggaggaggaggatggagggctggtcgatgcgatcgtggagctctgcagcctgggtgagttgaagagcatggatgtgaacaagaacgggagcaatcatctgggtgtgaagaacgagacctacttccgcaagggggtgattggggattggagcaatcacctaacaccggagatggcggaaaaacttgataagatcgtgggcgacgcgttgcaggggtctggactggacttatcgtcaccaactgtttctaactaggtgatcgatcaggtatggacgtgtggtactcgaaaattggaaagcacaagtatttactagtttaatcatacttcctagatcccaaaataaatgcacttattgagtttaaaatttgttctaaaataaatccgcatctatggatgaaacaatctagctctatttatcttttttttacttcgctaaatcataaatttcagttgttttcaccgtcgtggatgaataaagtttggagatgattttccaacgagatt

SEQ ID NO: 23406 - protein, 352 aa, Panicum virgatum
  misc_feature: Ceres CLONE 1827596
  misc_feature (76)..(342): Pfam Name: Sulfotransfer_1 Pfam Description: Sulfotransferase domain
  misc_feature: SWISSPROT Homolog: EC 2.8.2.3 Amine sulfotransferase
MAAPADTGAATAAASTLVPPRLATPHGDLAEILPSLPLETRCLPSFHLRCYKGFWLSEKALTGYFPAIHAHFEPRPDDIFLASFPKSGTTLLKALAFATLNRAAHPPSDADHPLRRRNPHSCVRFLGASGADDTEDEPAAALRSPRVLATHLPYSLLPERIRGGRGEGSRIVYICRNPKDVLVSGWLFTKKTSAMFGLDVQSYTLQEAFDLFCEGRCINGPHWQHALEYWEESFRRPGKVLFLRYEEMLREPASSLRKLAEFMGCAFSEEEEDGGLVDAIVELCSLGELKSMDVNKNGSNHLGVKNETYFRKGVIGDWSNHLTPEMAEKLDKIVGDALQGSGLDLSSPTVSN

SEQ ID NO: 23407 - DNA, 499 bp, Panicum virgatum
  misc_feature: Ceres CLONE 1827607
  misc_feature: Encodes the peptide sequence at SEQ ID NO. 23408
aagagaggggggagggggaaggtgtcatcgtactctgctctctccgctactcgaagctttccccccaacccccattcccagccgccggcgccaccccacccttccgtctagaccatgagggagtgcatctcgatccacatgggtcaggccggtatccaagtcggaaactcgtgctgggagctctactgcctcgggcatggcattcaggctgatgagcggatgcgtggtgacaagaccagtggaggaggtgatgatgctttcgacaccttcttcagggagactggggctgggaagcgcgtcccccgtgctgtatttgttgacgttgagcccactgtgattgatgaagtgaggactggcgcttaccgccggctcttccaccctgagcagctcatcagtggaaaggatgatgctgccaaccgcttcgcccgtggtgactacaccattggcaatgatattgcggagctggggcttgaccgcatcgggcagcttggcgacaact
